United States Patent 7,960,612 (PLANT QUALITY WITH VARIOUS PROMOTERS) - sequence listing, part 2

SEQ ID NO: 3228 - protein, 44 aa, Arabidopsis thaliana
  G3102,Z-C2H2 domain
TNNNNNSVDHPSDSNTNNNNIVDHPNDIKNKNNVDNKDNNSRDK

SEQ ID NO: 3229 - protein, 42 aa, Arabidopsis thaliana
  G3111,RING/C3H2C3 domain
CAICLAEFSAGDELRVLPQCGHGFHVACIDTWLGSHSSCPSC

SEQ ID NO: 3230 - protein, 68 aa, Arabidopsis thaliana
  G32,AP2 domain
GTRFLGVRRRPWGRYAAEIRDPTTKERHWLGTFDTAEEAALAYDRAARSMRGTRARTNFVYSDMPPSS

SEQ ID NO: 3231 - protein, 49 aa, Arabidopsis thaliana
  G323,RING/C3HC4 domain
CNICLDSVQEPVVTLCGHLFCWPCIHKWLDVQSFSTSDEYQRHRQCPVC

SEQ ID NO: 3232 - protein, 84 aa, Arabidopsis thaliana
  G326,1st Z-CO-like domain
ACEFCGERTAVLFCRADTAKLCLPCDQHVHSANLLSRKHVRSQICDNCSKEPVSVRCFTDNLVLCQECDWDVHGSCSSSATHER

SEQ ID NO: 3233 - protein, 47 aa, Arabidopsis thaliana
  G326,2nd Z-CO-like domain
QNRDNAMQRYKEKKKTRRYDKTIRYETRKARAETRLRVKGRFVKATD

SEQ ID NO: 3234 - protein, 67 aa, Arabidopsis thaliana
  G328,Z-CO-like domain
CDTCRSAACTVYCRADSAYLCSSCDAQVHAANRLASRHERVRVCQSCERAPAAFFCKADAASLCTTC

SEQ ID NO: 3235 - protein, 14 aa, Arabidopsis thaliana
  G335,Z-Tall-1 domain
CSSCFRFTHNRAYC

SEQ ID NO: 3236 - protein, 121 aa, Arabidopsis thaliana
  G341,Z-C3H domain
NSIYATDEFRMYSFKVRPCSRAYSHDWTECPFVHPGENARRRDPRKFHYSCVPCPDFRKGACRRGDMCEYAHGVFECWLHPAQYRTRLCKDGTGCARRVCFFAHTPEELRPLYASTGSAVP

SEQ ID NO: 3237 - protein, 27 aa, Arabidopsis thaliana
  G344,GATA/Zn domain
CSHCGVQKTPQWRMGPLGAKTLCNACG

SEQ ID NO: 3238 - protein, 23 aa, Arabidopsis thaliana
  G350,1st Z-C2H2 domain
CSVCDKAFSSYQALGGHKASHRK

SEQ ID NO: 3239 - protein, 21 aa, Arabidopsis thaliana
  G350,2nd Z-C2H2 domain
CSICHKSFATGQALGGHKRCH

SEQ ID NO: 3240 - protein, 21 aa, Arabidopsis thaliana
  G351,1st Z-C2H2 domain
CGVCYKTFSSYQALGGHKASH

SEQ ID NO: 3241 - protein, 23 aa, Arabidopsis thaliana
  G351,2nd Z-C2H2 domain
HVCSVCGKSFATGQALGGHKRCH

SEQ ID NO: 3242 - protein, 21 aa, Arabidopsis thaliana
  G352,1st Z-C2H2 domain
CTVCGKSFSSYQALGGHKTSH

SEQ ID NO: 3243 - protein, 21 aa, Arabidopsis thaliana
  G352,2nd Z-C2H2 domain
CSICFKSFASGQALGGHKRCH

SEQ ID NO: 3244 - protein, 21 aa, Arabidopsis thaliana
  G354,1st Z-C2H2 domain
CKTCLKEFSSFQALGGHRASH

SEQ ID NO: 3245 - protein, 22 aa, Arabidopsis thaliana
  G354,2nd Z-C2H2 domain
CPICGVKFPMGQALGGHMRRHR

SEQ ID NO: 3246 - protein, 23 aa, Arabidopsis thaliana
  G357,Z-C2H2 domain
CKLCSKSFCNGRALGGHMKSHLV

SEQ ID NO: 3247 - protein, 21 aa, Arabidopsis thaliana
  G362,Z-C2H2 domain
CQYCGKEFANSQALGGHQNAH

SEQ ID NO: 3248 - protein, 22 aa, Arabidopsis thaliana
  G363,Z-C2H2 domain
CNYCQRKFYSSQALGGHQNAHK

SEQ ID NO: 3249 - protein, 21 aa, Arabidopsis thaliana
  G365,Z-C2H2 domain
CNYCQRKFYSSQALGGHQNAH

SEQ ID NO: 3250 - protein, 41 aa, Arabidopsis thaliana
  G379,RING/C3HC4 domain
CPLCDKLLRDATTISECLHTFCRKCIYEKITEDEIESCPVC

SEQ ID NO: 3251 - protein, 26 aa, Arabidopsis thaliana
  G383,GATA/Zn domain
CANCDTTSTPLWRNGPRGPKSLCNAC

SEQ ID NO: 3252 - protein, 64 aa, Arabidopsis thaliana
  G385,HB domain
LHPNKKKRYHRHTQLQIQEMEAFFKECPHPDDKQRKQLSRELNLEPLQVKFWFQNKRTQMKNHH

SEQ ID NO: 3253 - protein, 61 aa, Arabidopsis thaliana
  G392,HB domain
KYVRYTPEQVEALERLYNDCPKPSSMRRQQLIRECPILSNIEPKQIKVWFQNRRCREKQRK

SEQ ID NO: 3254 - protein, 61 aa, Arabidopsis thaliana
  G399,HB domain
ETSRKKLRLSKDQSAFLEETFKEHNTLNPKQKLALAKKLNLTARQVEVWFQNRRARTKLKQ

SEQ ID NO: 3255 - protein, 63 aa, Arabidopsis thaliana
  G4,AP2 domain
KNQYRGIRQRPWGKWAAEIRDPRKGSREWLGTFDTAEEAARAYDAAARRIRGTKAKVNFPEEK

SEQ ID NO: 3256 - protein, 61 aa, Arabidopsis thaliana
  G406,HB domain
GLSEKKRRLSINQVKALEKNFELENKLEPERKVKLAQELGLQPRQVAVWFQNRRARWKTKQ

SEQ ID NO: 3257 - protein, 61 aa, Arabidopsis thaliana
  G409,HB domain
QLPEKKRRLTTEQVHLLEKSFETENKLEPERKTQLAKKLGLQPRQVAVWFQNRRARWKTKQ

SEQ ID NO: 3258 - protein, 61 aa, Arabidopsis thaliana
  G413,HB domain
HNKNNQRRFSDEQIKSLEMMFESETRLEPRKKVQLARELGLQPRQVAIWFQNKRARWKSKQ

SEQ ID NO: 3259 - protein, 61 aa, Arabidopsis thaliana
  G415,HB domain
KSSSSACKQTDPKTQRLYISFQENQYPDKATKESLAKELQMTVKQVNNWFKHRRWSINSKP

SEQ ID NO: 3260 - protein, 64 aa, Arabidopsis thaliana
  G421,HB domain
QIWRPQRGLPEKSVSVLRNWMFQNFLHPYPKDSEKHLLAIRSGLTRSQVSNWFINARVRLWKPM

SEQ ID NO: 3261 - protein, 61 aa, Arabidopsis thaliana
  G426,HB domain
RRAGKLPGDTTSVLKAWWQSHSKWPYPTEEDKARLVQETGLQLKQINNWFINQRKRNWHSN

SEQ ID NO: 3262 - protein, 64 aa, Arabidopsis thaliana
  G428,HB domain
SKKKKKGKLPREARQALLDWWNVHNKWPYPTEGDKIALAEETGLDQKQINNWFINQRKRHWKPS

SEQ ID NO: 3263 - protein, 69 aa, Arabidopsis thaliana
  G43,AP2 domain
TRHYRGVRRRPWGKFAAEIRDPAKKGSRIWLGTFESDIDAARAYDYAAFKLRGRKAVLNFPLDAGKYDA

SEQ ID NO: 3264 - protein, 64 aa, Arabidopsis thaliana
  G435,HB domain
SQSQGKNKKKRLTQDQVRQLEKCFTMNKKLEPDLKLQLSNQLGLPQRQVAVWFQNKRARFKTQS

SEQ ID NO: 3265 - protein, 63 aa, Arabidopsis thaliana
  G440,AP2 domain
IKKFRGVRQRPWGKWAAEIRDPEQRRRIWLGTFETAEEAAVVYDNAAIRLRGPDALTNFSIPP

SEQ ID NO: 3266 - protein, 9 aa, Arabidopsis thaliana
  G450,1st IAA domain
TELCLGLPG

SEQ ID NO: 3267 - protein, 12 aa, Arabidopsis thaliana
  G450,2nd IAA domain
VGWPPVRNYRKN

SEQ ID NO: 3268 - protein, 17 aa, Arabidopsis thaliana
  G450,3rd IAA domain
FVKVSMDGAPYLRKVDL

SEQ ID NO: 3269 - protein, 38 aa, Arabidopsis thaliana
  G450,4th IAA domain
YEDKDGDWMLVGDVPWPMFVESCKRLRIMKGSEAIGLA

SEQ ID NO: 3270 - protein, 9 aa, Arabidopsis thaliana
  G451,1st IAA domain
TELRLGLPG

SEQ ID NO: 3271 - protein, 12 aa, Arabidopsis thaliana
  G451,2nd IAA domain
VGWPPVRSNRKN

SEQ ID NO: 3272 - protein, 17 aa, Arabidopsis thaliana
  G451,3rd IAA domain
YVKVSMDGAPYLRKIDL

SEQ ID NO: 3273 - protein, 34 aa, Arabidopsis thaliana
  G451,4th IAA domain
YEDKDGDWMLVGDVPWDMFSSSCQKLRIMKGSEA

SEQ ID NO: 3274 - protein, 10 aa, Arabidopsis thaliana
  G463,1st IAA domain
LELGLGLSLG

SEQ ID NO: 3275 - protein, 12 aa, Arabidopsis thaliana
  G463,2nd IAA domain
VGWPPIGSHRMN

SEQ ID NO: 3276 - protein, 17 aa, Arabidopsis thaliana
  G463,3rd IAA domain
FIKVNMDGVAIGRKVDL

SEQ ID NO: 3277 - protein, 34 aa, Arabidopsis thaliana
  G463,4th IAA domain
YEDKEGDWMLVGDVPWRMFINSVKRLRVMKTSEA

SEQ ID NO: 3278 - protein, 17 aa, Arabidopsis thaliana
  G468,1st IAA domain
YVKVNMEGVPIGRKIDL

SEQ ID NO: 3279 - protein, 31 aa, Arabidopsis thaliana
  G468,2nd IAA domain
YADKEGDWMMVGDVPWEMFLSTVRRLKISRA

SEQ ID NO: 3280 - protein, 66 aa, Arabidopsis thaliana
  G47,AP2 domain
SQSKYKGIRRRKWGKWVSEIRVPGTRDRLWLGSFSTAEGAAVAHDVAFFCLHQPDSLESLNFPHLL

SEQ ID NO: 3281 - protein, 90 aa, Arabidopsis thaliana
  G481,CAAT domain
REQDRYLPIANISRIMKKALPPNGKIGKDAKDTVQECVSEFISFITSEASDKCQKEKRKTVNGDDLLWAMATLGFEDYLEPLKIYLARYR

SEQ ID NO: 3282 - protein, 90 aa, Arabidopsis thaliana
  G482,CAAT domain
REQDRFLPIANVSRIMKKALPANAKISKDAKETMQECVSEFISFVTGEASDKCQKEKRKTINGDDLLWAMTTLGFEDYVEPLKVYLQRFR

SEQ ID NO: 3283 - protein, 90 aa, Arabidopsis thaliana
  G485,CAAT domain
REQDRFLPIANVSRIMKKALPANAKISKDAKETVQECVSEFISFITGEASDKCQREKRKTINGDDLLWAMTTLGFEDYVEPLKVYLQKYR

SEQ ID NO: 3284 - protein, 97 aa, Arabidopsis thaliana
  G489,CAAT domain
KEIEKTTDFKKHSLPLARIKKIMKADEDVRMISAEAPVVFARACEMFILELTLRSWNHTEENKRRTLQKNDIAAAVTRTDIFDFLVDIVPREDLRDE

SEQ ID NO: 3285 - protein, 122 aa, Arabidopsis thaliana
  G501,NAC domain
GFRFHPTDEELVKFYLCRKCASEQISAPVIAEIDLYKFNPWELPEMSLYGEKEWYFFSPRDRKYPNGSRPNRAAGTGYWKATGADKPIGKPKTLGIKKALVFYAGKAPKGIKTNWIMHEYRL

SEQ ID NO: 3286 - protein, 146 aa, Arabidopsis thaliana
  G513,NAC domain
GFRFSPTDEELVRYYLRLKINGHDNDVRVIREIDICKWEPWDLPDFSVVKTTDSEWLFFCPLDRKYPSGSRMNRATVAGYWKATGKDRKIKSGKTKIIGVKRTLVFYTGRAPKGTRTCWIMHEYRATEKDLDGTKSGQNPFVVCKL

SEQ ID NO: 3287 - protein, 122 aa, Arabidopsis thaliana
  G519,NAC domain
GFRFHPTDEELVKFYLCRRCASEPINVPVIAEIDLYKFNPWELPEMALYGEKEWYFFSHRDRKYPNGSRPNRAAGTGYWKATGADKPIGKPKTLGIKKALVFYAGKAPKGIKTNWIMHEYRL

SEQ ID NO: 3288 - protein, 156 aa, Arabidopsis thaliana
  G522,NAC domain
VPPGFRFHPTDEELVGYYLRKKVASQKIDLDVIRDIDLYRIEPWDLQESCRIGYEERNEWYFFSHKDKKYPTGTRTNRATMAGFWKATGRDKAVYDKSKLIGMRKTLVFYKGRAPNGQKTDWIMHEYRLESDENAPPQEEGWVVCRAFKKKPMTGQ

SEQ ID NO: 3289 - protein, 145 aa, Arabidopsis thaliana
  G525,NAC domain
GFRFHPTDEELITHYLKPKVFNTFFSATAIGEVDLNKIEPWDLPWKAKMGEKEWYFFCVRDRKYPTGLRTNRATEAGYWKATGKDKEIFKGKSLVGMKKTLVFYKGRAPKGVKTNWVMHEYRLEGKYCIENLPQTAKNEWVICRV

SEQ ID NO: 3290 - protein, 8 aa, Arabidopsis thaliana
  G529,GF14 domain
LRDNLTLW

SEQ ID NO: 3291 - protein, 9 aa, Arabidopsis thaliana
  G530,GF14 domain
LRDNLTLWT

SEQ ID NO: 3292 - protein, 8 aa, Arabidopsis thaliana
  G531,GF14 domain
LRDNLTLW

SEQ ID NO: 3293 - protein, 21 aa, Arabidopsis thaliana
  G547,1st Z-C2H2 domain
CTECGRKFWSWKALFGHMRCH

SEQ ID NO: 3294 - protein, 21 aa, Arabidopsis thaliana
  G547,2nd Z-C2H2 domain
CGGCKKVFGSHQALGGHRASH

SEQ ID NO: 3295 - protein, 23 aa, Arabidopsis thaliana
  G547,3rd Z-C2H2 domain
HKCNICFRVFSSGQALGGHMRCH

SEQ ID NO: 3296 - protein, 67 aa, Arabidopsis thaliana
  G553,bZIP domain
RINDKMKRRLAQNREAARKSRLRKKAHVQQLEESRLKLSQLEQELVRARQQGLCVRNSSDTSYLGPA

SEQ ID NO: 3297 - protein, 61 aa, Arabidopsis thaliana
  G556,bZIP domain
RRLAQNREAARKSRLRKKAYVQQLETSRLKLIHLEQELDRARQQGFYVGNGVDTNALSFSD

SEQ ID NO: 3298 - protein, 61 aa, Arabidopsis thaliana
  G558,bZIP domain
QKTLRRLAQNREAARKSRLRKKAYVQQLENSRLKLTQLEQELQRARQQGVFISGTGDQAHS

SEQ ID NO: 3299 - protein, 62 aa, Arabidopsis thaliana
  G559,bZIP domain
KRAKRIWANRQSAARSKERKTRYIFELERKVQTLQTEATTLSAQLTLLQRDTNGLTVENNEL

SEQ ID NO: 3300 - protein, 63 aa, Arabidopsis thaliana
  G562,bZIP domain
WLQNERELKRERRKQSNRESARRSRLRKQAETEELARKVEALTAENMALRSELNQLNEKSDKL

SEQ ID NO: 3301 - protein, 63 aa, Arabidopsis thaliana
  G563,bZIP domain
AAAQRQKRMIKNRESAARSRERKQAYQVELETLAAKLEEENEQLLKEIEESTKERYKKLMEVL

SEQ ID NO: 3302 - protein, 61 aa, Arabidopsis thaliana
  G567,bZIP domain
SLKPEDVKKSRRMLSNRESARRSRRRKQEQTSDLETQVNDLKGEHSSLLKQLSNMNHKYDE

SEQ ID NO: 3303 - protein, 51 aa, Arabidopsis thaliana
  G568,bZIP domain
NRRHKRMIKNRESAARSRARKQAYTNELELEVAHLQAENARLKRQQDQKMA

SEQ ID NO: 3304 - protein, 53 aa, Arabidopsis thaliana
  G577,1st BZIPT2 domain
MGCTASKLDSEDAVRRCKERRRLMKDAVYARHHLAAAHSDYCRSLRLTGSALS

SEQ ID NO: 3305 - protein, 111 aa, Arabidopsis thaliana
  G577,2nd BZIPT2 domain
LCSTLDRLLAWEKKLYEDVKAREGVKIEHEKKLSALQSQEYKGGDESKLDKTKTSITRLQSLIIVSSEAVLTTSNAILRLRDTDLVPQLVELCHGLMYMWKSMHEYHEIQN

SEQ ID NO: 3306 - protein, 61 aa, Arabidopsis thaliana
  G579,bZIP domain
NACGSMGIPNAKRNPGQRSRVRKLQYIAELERTVGMLQTVEADLSVRVASLLQTRATLSLE

SEQ ID NO: 3307 - protein, 57 aa, Arabidopsis thaliana
  G580,bZIP domain
RGDRRYKRMIKNRESAARSRARKQAYTNELELEIAHLQTENARLKIQQEQLKIAEAT

SEQ ID NO: 3308 - protein, 58 aa, Arabidopsis thaliana
  G588,HLH/MYC domain
NGREEALNHVEAERQRREKLNQRFYALRAVVPNISKMDKASLLADAITYITDMQKKIR

SEQ ID NO: 3309 - protein, 58 aa, Arabidopsis thaliana
  G591,HLH/MYC domain
RRGQATDPHSIAERLRRERIAERIRALQELVPTVNKTDRAAMIDEIVDYVKFLRLQVK

SEQ ID NO: 3310 - protein, 9 aa, Arabidopsis thaliana
  G596,1st AT-hook domain
RRPRGRPAG

SEQ ID NO: 3311 - protein, 147 aa, Arabidopsis thaliana
  G596,2nd AT-hook domain
SKNKPKPPIIITRDSANALKSHVMEVANGCDVMESVTVFARRRQRGICVLSGNGAVTNVTIRQPASVPGGGSSVVNLHGRFEILSLSGSFLPPPAPPAASGLTIYLAGGQGQVVGGSVVGPLMASGPVVIMAASFGNAAYERLPLEE

SEQ ID NO: 3312 - protein, 59 aa, Arabidopsis thaliana
  G598,DBP domain
KKIEYNVGSFNNRLNEEARGEKSKSDGENAKQCGESAEESGGEKSDGRGKERDRGCKSS

SEQ ID NO: 3313 - protein, 33 aa, Arabidopsis thaliana
  G599,1st DBP domain
EKKKEETRAHNAQIHAAVSVAGVAAAVAAIAAA

SEQ ID NO: 3314 - protein, 37 aa, Arabidopsis thaliana
  G599,2nd DBP domain
LASVVSSAVNVRSAGDIMTLTAGAATALRGVQTLKAR

SEQ ID NO: 3315 - protein, 60 aa, Arabidopsis thaliana
  G615,TEO domain
KDRHSKIQTAQGIRDRRVRLFIGIARQFFDLQDMLGFDKASKTLDWLLKKSRKAIKEVVQ

SEQ ID NO: 3316 - protein, 343 aa, Arabidopsis thaliana
  G619,ARF domain
SELWHACAGPLTCLPKKGNVVVYFPQGHLEQDAMVSYSSPLEIPKFDLNPQIVCRVVNVQLLANKDTDEVYTQVTLLPLQEFSMLNGEGKEVKELGGEEERNGSSSVKRTPHMFCKTLTASDTSTHGGFSVPRRAAEDCFAPLDYKQQRPSQELIAKDLHGVEWKFRHIYRGQPRRHLLTTGWSIFVSQKNLVSGDAVLFLRDEGGELRLGIRRAARPRNGLPDSIIEKNSCSNILSLVANAVSTKSMFHVFYSPRATHAEFVIPYEKYITSIRSPVCIGTRFRMRFEMDDSPERRCAGVVTGVCDLDPYRWPNSKWRCLLVRWDESFVSDHQERVSPWEIDP

SEQ ID NO: 3317 - protein, 68 aa, Arabidopsis thaliana
  G625,AP2 domain
KFRYRGVRQRSWGKWVAEIREPRKRTRKWLGTFATAEDAARAYDRAAVYLYGSRAQLNLTPSSPSSVS

SEQ ID NO: 3318 - protein, 71 aa, Arabidopsis thaliana
  G631,bZIP domain
KRAKRIWANRQSAARSKERKMRYIAELERKVQTLQTEATSLSAQLTLLQRDTNGLGVENNELKLRVQTMEQ

SEQ ID NO: 3319 - protein, 86 aa, Arabidopsis thaliana
  G634,1st TH domain
RWPREETLALLRIRSDMDSTFRDATLKAPLWEHVSRKLLELGYKRSSKKCKEKFENVQKYYKRTKETRGGRHDGKAYKFFSQLEAL

SEQ ID NO: 3320 - protein, 57 aa, Arabidopsis thaliana
  G634,2nd TH domain
RWPKAEILALINLRSGMEPRYQDNVPKGLLWEEISTSMKRMGYNRNAKRCKEKWENI

SEQ ID NO: 3321 - protein, 85 aa, Arabidopsis thaliana
  G635,TH domain
KWKPEEIKKVIRMRGELHSRFQVVKGRMALWEEISSNLSAEGINRSPGQCKSLWASLIQKYEESKADERSKTSWPHFEDMNNILS

SEQ ID NO: 3322 - protein, 86 aa, Arabidopsis thaliana
  G639,TH domain
WPQEEVQALISSRSDVEEKTGINKGAIWDEISARMKERGYERSAKKCKEKWENMNKYYRRVTEGGQKQPEHSKTRSYFEKLGNFYK

SEQ ID NO: 3323 - protein, 80 aa, Arabidopsis thaliana
  G641,TH domain
QSQTPEIASPVAVGDRFPQWSVEETKELIGIRGELDQTFMETKRNKLLWEVISNKMRDKSFPRSPEQCKCKWKNLVTRFK

SEQ ID NO: 3324 - protein, 66 aa, Arabidopsis thaliana
  G645,1st SCR domain
YKSFSEISPVLQFANFTSNQALLESFHGFHRLHIIDFDIGYGGQWASLMQELVLRDNAAPLSLKIT

SEQ ID NO: 3325 - protein, 88 aa, Arabidopsis thaliana
  G645,2nd SCR domain
EKEAVAVNISAASFSHLPLVLRFVKHLSPTIIVCSDRGCERTDLPFSQQLAHSLHSHTALFESLDAVNANLDAMQKIERFLIQPEIEK

SEQ ID NO: 3326 - protein, 74 aa, Arabidopsis thaliana
  G645,3rd SCR domain
LVLDRSRPIERPMMTWQAMFLQMGFSPVTHSNFTESQAECLVQRTPVRGFHVEKKHNSLLLCWQRTELVGVSAW

SEQ ID NO: 3327 - protein, 52 aa, Arabidopsis thaliana
  G653,1st Z-LIM domain
CRACEKTVYPVELLSADGISYHKACFKCSHCKSRLQLSNYSSMEGVVYCRPH

SEQ ID NO: 3328 - protein, 52 aa, Arabidopsis thaliana
  G653,2nd Z-LIM domain
CATCTKTVYPIEKVTVESQCYHKSCFKCSHGGCPISPSNYAALEGILYCKHH

SEQ ID NO: 3329 - protein, 163 aa, Arabidopsis thaliana
  G655,MYB-(R1)R2R3 domain
KGGWTAEEDQILTNVVKKYQGRNWKRIAECLPGSEENRRNDVQCQHRWLKVLDPSLQKGAWKKEEDELLSELVKDYMENDRPPWSKISKELPGRIGKQCRERWHNHLNPTIIKSPWTREEELILVQAQRGNGNKWAEIAKLLPGRTENNIKNHWNCSVKKRLE

SEQ ID NO: 3330 - protein, 104 aa, Arabidopsis thaliana
  G658,MYB-(R1)R2R3 domain
GRSPCCEKAHMNKGAWTKEEDQLLVDYIRKHGEGCWRSLPRAAGLQRCGKSCRLRWMNYLRPDLKRGNFTEEEDELIIKLHSLLGNKWSLIAGRLPGRTDNEIK

SEQ ID NO: 3331 - protein, 101 aa, Arabidopsis thaliana
  G659,MYB-(R1)R2R3 domain
RGPWSPEEDIKLISFIQKFGHENWRSLPKQSGMSLLLSSQSKQKPLQLFFLFFMILNVYICKNEGLLRCGKSCRLRWINYLRPDLKRGNFTSEEEETIIKL

SEQ ID NO: 3332 - protein, 103 aa, Arabidopsis thaliana
  G663,MYB-(R1)R2R3 domain
RKGAWTAEEDSLLRLCIDKYGEGKWHQVPLRAGLNRCRKSCRLRWLNYLKPSIKRGRLSNDEVDLLLRLHKLLGNRWSLIAGRLPGRTANDVKNYWNTHLSKK

SEQ ID NO: 3333 - protein, 103 aa, Arabidopsis thaliana
  G664,MYB-(R1)R2R3 domain
KGAWTKEEDERLVAYIKAHGEGCWRSLPKAAGLLRCGKSCRLRWINYLRPDLKRGNFTEEEDELIIKLHSLLGNKWSLIAGRLPGRTDNEIKNYWNTHIRRKL

SEQ ID NO: 3334 - protein, 49 aa, Arabidopsis thaliana
  G665,MYB-related domain
VPWTAEEHRTFLIGLEKLGKGDWRGISRNFVVTKSPTQVASHAQKYFLR

SEQ ID NO: 3335 - protein, 103 aa, Arabidopsis thaliana
  G666,MYB-(R1)R2R3 domain
KGPWTPEEDIILVTYIQEHGPGNWRAVPTNTGLLRCSKSCRLRWTNYLRPGIKRGNFTEHEEKMIVHLQALLGNRWAAIASYLPQRTDNDIKNYWNTHLKKKL

SEQ ID NO: 3336 - protein, 101 aa, Arabidopsis thaliana
  G674,MYB-(R1)R2R3 domain
KGLWSPEEDEKLRSHVLKYGHGCWSTIPLQAGLQRNGKSCRLRWVNYLRPGLKKSLFTKQEETILLSLHSMLGNKWSQISKFLPGRTDNEIKNYWHSNLKK

SEQ ID NO: 3337 - protein, 104 aa, Arabidopsis thaliana
  G675,MYB-(R1)R2R3 domain
KKGPWTPEEDQKLIDYIHKHGHGSWRALPKLADLNRCGKSCRLRWTNYLRPDIKRGKFSAEEEQTILHLHSILGNKWSAIATHLQGRTDNEIKNFWNTHLKKKL

SEQ ID NO: 3338 - protein, 49 aa, Arabidopsis thaliana
  G679,MYB-related domain
VPWTENEHKRFLIGLQKVGKGDWKGISRNFVKSRTPTQVASHAQKYFLR

SEQ ID NO: 3339 - protein, 45 aa, Arabidopsis thaliana
  G682,MYB-related domain
VNMSQEEEDLVSRMHKLVGDRWELIAGRIPGRTAGEIERFWVMKN

SEQ ID NO: 3340 - protein, 64 aa, Arabidopsis thaliana
  G699,HB domain
HHMGLSEKKRRLKVDQVKALEKNFELENKLEPERKTKLAQELGLQPRQVAVWFQNRRARWKTKQ

SEQ ID NO: 3341 - protein, 68 aa, Arabidopsis thaliana
  G7,AP2 domain
PKKYRGVRQRPWGKWAAEIRDPHKATRVWLGTFETAEAAARAYDAAALRFRGSKAKLNFPENVGTQTI

SEQ ID NO: 3342 - protein, 61 aa, Arabidopsis thaliana
  G707,HB domain
KKKKRYHRHTPKQIQDLESVFKECAHPDEKQRLDLSRRLNLDPRQVKFWFQNRRTQMKTQI

SEQ ID NO: 3343 - protein, 93 aa, Arabidopsis thaliana
  G714,CAAT domain
KEIEKTTDFKNHSLPLARIKKIMKADEDVRMISAEAPVVFARACEMFILELTLRSWNHTEENKRRTLQKNDIAAAVTRTDIFDFLVDIVPRED

SEQ ID NO: 3344 - protein, 97 aa, Arabidopsis thaliana
  G715,CAAT domain
QEIEQVNDFKNHQLPLARIKKIMKADEDVRMISAEAPILFAKACELFILELTIRSWLHAEENKRRTLQKNDIAAAITRTDIFDFLVDIVPRDEIKDE

SEQ ID NO: 3345 - protein, 49 aa, Arabidopsis thaliana
  G720,GARP domain
WTPELHKKFVQAVEQLGVDQAIPSRILELMKVGTLTRHNVASHLQKFRQ

SEQ ID NO: 3346 - protein, 49 aa, Arabidopsis thaliana
  G722,GARP domain
WTHELHNKFLAAVDHLGVERAVPKKILDLMNVDKLTRENVASHLQKFRV

SEQ ID NO: 3347 - protein, 49 aa, Arabidopsis thaliana
  G724,GARP domain
WTPQLHKRFVDAVAHLGIKNAVPKTIMQLMSVDGLTRENVASHLQKYRL

SEQ ID NO: 3348 - protein, 44 aa, Arabidopsis thaliana
  G727,GARP domain
WSVELHQQFVAAVNQLGVDSELKTCLLMHLCVSIGNIVEFQKYR

SEQ ID NO: 3349 - protein, 49 aa, Arabidopsis thaliana
  G730,GARP domain
WTTTLHAHFVHAVQLLGGHERATPKSVLELMDVQDLTLAHVKSHLQMYR

SEQ ID NO: 3350 - protein, 61 aa, Arabidopsis thaliana
  G732,bZIP domain
RKRKRMLSNRESARRSRMRKQKHVDDLTAQINQLSNDNRQILNSLTVTSQLYMKIQAENSV

SEQ ID NO: 3351 - protein, 29 aa, Arabidopsis thaliana
  G748,Z-Dof domain
CPRCKSMETKFCYYNNYNINQPRHFCKAC

SEQ ID NO: 3352 - protein, 53 aa, Arabidopsis thaliana
  G749,Z-C3H domain
CPDFRKGGCKKGDSCEFAHGVFECWLHPARYRTQPCKDGGNCLRKICFFAHSP

SEQ ID NO: 3353 - protein, 46 aa, Arabidopsis thaliana
  G751,Z-Dof domain
CPRCNSLNTKFCYYNNYSLTQPRYFCKDCRRYWTAGGSLRNIPVGG

SEQ ID NO: 3354 - protein, 121 aa, Arabidopsis thaliana
  G756,Z-C3H domain
YPADASLPDINEGVYGSDEFRMYSFKVKPCSRAYSHDWTECAFVHPGENARRRDPRKYPYTCVPCPEFRKGSCPKGDSCEYAHGVFESWLHPAQYKTRLCKDETGCARKVCFFAHKREEMR

SEQ ID NO: 3355 - protein, 141 aa, Arabidopsis thaliana
  G763,NAC domain
GFRFHPTDEELVVQYLKRKVCSSPLPASIIPEFDVCRADPWDLPRNLEKERYFFSTREAKYPNGNRSNRATGSGYWKATGIDKRVVTSRGNQIVGLKKTLVFYKGKPPHGSRTDWIMHEYRLSSSPPSSMGPTQNWVLCRI

SEQ ID NO: 3356 - protein, 145 aa, Arabidopsis thaliana
  G764,NAC domain
GFRFHPTDEELITHYLRPKVVNSFFSAIAIGEVDLNKVEPWDLPWKAKLGEKEWYFFCVRDRKYPTGLRTNRATKAGYWKATGKDKEIFKGKSLVGMKKTLVFYKGRAPKGVKTNWVMHEYRLEGKFAIDNLSKTAKNECVISRV

SEQ ID NO: 3357 - protein, 59 aa, Arabidopsis thaliana
  G783,HLH/MYC domain
GKVPKRINKAVRERLKREHLNELFIELADTLELNQQNSGKASILCEATRFLKDVFGQIE

SEQ ID NO: 3358 - protein, 57 aa, Arabidopsis thaliana
  G787,HLH/MYC domain
ASSPASKNIVSERNRRQKLNQRLFALRSVVPNITKMDKASIIKDAISYIEGLQYEEK

SEQ ID NO: 3359 - protein, 58 aa, Arabidopsis thaliana
  G789,HLH/MYC domain
RRSRAAEVHNLSERRRRDRINERMKALQELIPHCSRTDKASILDEAIDYLKSLQMQLQ

SEQ ID NO: 3360 - protein, 60 aa, Arabidopsis thaliana
  G792,HLH/MYC domain
ESCTGSNSKACREKQRRDRLNDKFTELSSVLEPGRTPKTDKVAIINDAIRMVNQARDEAQ

SEQ ID NO: 3361 - protein, 58 aa, Arabidopsis thaliana
  G793,HLH/MYC domain
RRGQATDPHSIAERLRRERIAERIRSLQELVPTVNKTDRAAMIDEIVDYVKFLRLQVK

SEQ ID NO: 3362 - protein, 67 aa, Arabidopsis thaliana
  G8,1st AP2 domain
SSQYRGVTFYRRTGRWESHIWDCGKQVYLGGFDTAHAAARAYDRAAIKFRGVDADINFTLGDYEEDM

SEQ ID NO: 3363 - protein, 51 aa, Arabidopsis thaliana
  G8,2nd AP2 domain
SSKYRGVTLHKCGRWEARMGQFLGKKAYDKAAINTNGREAVTNFEMSSYQN

SEQ ID NO: 3364 - protein, 92 aa, Arabidopsis thaliana
  G810,HS domain
PFLSKTYDMVDDPLTDDVVSWSSGNNSFVVWNVPEFAKQFLPKYFKHNNFSSFVRQLNTYGFRKVDPDRWEFANEGFLRGQKQILKSIVRRK

SEQ ID NO: 3365 - protein, 92 aa, Arabidopsis thaliana
  G811,HS domain
PFIVKTYQMVNDPSTDWLITWGPAHNSFIVVDPLDFSQRILPAYFKHNNFSSFVRQLNTYGFRKVDPDRWEFANEHFLRGQKHLLNNIARRK

SEQ ID NO: 3366 - protein, 92 aa, Arabidopsis thaliana
  G812,HS domain
PFLTKTFEMVDDPNTDHIVSWNRGGTSFVVWDLHSFSTILLPRHFKHSNFSSFIRQLNTYGFRKIEAERWEFANEEFLLGQRQLLKNIKRRN

SEQ ID NO: 3367 - protein, 511 aa, Arabidopsis thaliana
  G819,AKR domain
ELIPCLDRNLIYQMRLKLDLSLMEHYERHCPPPERRFNCLIPPRPGYKIPIKWPKSRDEVWKVNIPHTHLAHEKSDQNWRVVKGEKINFPGGGTHFHYGADKYIASMANMLNFPNNVLNNGGRLRTFLDVGCGVASFGGYLLASEIMTMSLAPNDVHQNQIQFALERGIPAYLGVLGTKRLPYPSRSFELAHCSRCRIDWLQRDGILLLELDRVLRPGGYFAYSSPEAYAQDEEDLRIWREMSALVGRMCWTIAAKRNQTVIWQKPLTNDCYLGREPGTQPPLCNSDSDPDAVYGVNMEACITQYSDHDHKTKGSGLAPWPARLTSPPPRLADFGYSTDIFEKDTETWRQRVDTYWDLLSPKIQSDTVRNIMDMKASMGSFAAALKEKDVWVMNVVPEDGPNTLKLIYDRGLMGAVHSWCEAFSTYPRTYDLLHAWDIISDIKKRGCSAEDLLLEMDRILRPSGFILIRDKQSVVDLVKKYLKALHWEAVETKTASESDQDSDNVILIVQK

SEQ ID NO: 3368 - protein, 513 aa, Arabidopsis thaliana
  G830,AKR domain
ELIPCLDRNLHYQLKLKLNLSLMEHYEHHCPPSERRFNCLVPPPVGYKIPLRWPVSRDEVWKANIPHTHLAQEKSDQNWMVVNGDKINFPGGGTHFHNGADKYIVSLAQMLKFPGDKLNNGGSIRNVLDVGCGVASFGAYLLSHDIIAMSLAPNDVHQNQIQFALERGIPSTLGVLGTKRLPYPSRSFELAHCSRCRIDWLQRDGILLLELDRLLRPGGYFVYSSPEAYAHDPENRKIGNAMHDLFKRMCWKVVAKRDQSVIWGKPISNSCYLKRDPGVLPPLCPSGDDPDATWNVSMKACISPYSVRMHKERWSGLVPWPRRLTAPPPRLEEIGVTPEQFREDTETWRLRVIEYWKLLKPMVQKNSIRNVMDMSSNLGGFAAALNDKDVWVMNVMPVQSSPRMKIIYDRGLIGATHDWCEAFDTYPRTFDLIHAWNTFTETQARGCSFVDLLIKMDRILRPEGFVIIRDTTDNISYIKKYLTLLKWDKWSTETTPKGDPLSTKDEIVLIARK

SEQ ID NO: 3369 - protein, 60 aa, Arabidopsis thaliana
  G843,1st MISC domain
LSGLVRFKCAVCMDFDLCVECFSVGVELNRHKNSHPYRVMDNLSFSLVTSDWNADEEILL

SEQ ID NO: 3370 - protein, 81 aa, Arabidopsis thaliana
  G843,2nd MISC domain
TELYGYNLKREEFEIEHDNDAEQLLADMEFKDSDTDAEREQKLQVLRIYSKRLDERKRRKEFVLERNLLYPDQYEMSLSAE

SEQ ID NO: 3371 - protein, 68 aa, Arabidopsis thaliana
  G865,AP2 domain
RRHYRGVRQRPWGKWAAEIRDPKKAARVWLGTFETAEEAALAYDRAALKFKGTKAKLNFPERVQGPTT

SEQ ID NO: 3372 - protein, 56 aa, Arabidopsis thaliana
  G869,AP2 domain
RKKPVGVRQRKWGKWAAEIRDPIKKTRTWLGTFDTLEEAAKAYDAKKLEFDAIVAG

SEQ ID NO: 3373 - protein, 58 aa, Arabidopsis thaliana
  G881,WRKY domain
KDGFQWRKYGQKVTRDNPSPRAYFRCSFAPSCPVKKKVQRSAEDPSLLVATYEGTHNH

SEQ ID NO: 3374 - protein, 53 aa, Arabidopsis thaliana
  G886,1st BZIPT2 domain
MGCGGSKVDNQPIVILCRERKELLKAASYHRSALAVAHLTYFQSLSDVGEAIQ

SEQ ID NO: 3375 - protein, 111 aa, Arabidopsis thaliana
  G886,2nd BZIPT2 domain
LSSTLEKLYAWEKKLYKEVKDEEKLRAIYEEKCRRLKKMDSHGAESIKIDATRAAIRKLLTKIDVCIRSVDSISSRIHKLRDEELQPQLIQLIHGLIRMWRSMLRCHQKQF

SEQ ID NO: 3376 - protein, 22 aa, Arabidopsis thaliana
  G896,Z-LSDlike domain
CSGCRTPLQLPSGARSIRCALC

SEQ ID NO: 3377 - protein, 32 aa, Arabidopsis thaliana
  G897,1st Z-CO-like domain
CDSCKSTAATLFCRADAAFLCGDCDGKIHTAN

SEQ ID NO: 3378 - protein, 32 aa, Arabidopsis thaliana
  G897,2nd Z-CO-like domain
CEVCEQAPAHVTCKADAAALCVTCDRDIHSAN

SEQ ID NO: 3379 - protein, 42 aa, Arabidopsis thaliana
  G904,RING/C3H2C3 domain
CAVCLSKFEPEDQLRLLPLCCHAFHADCIDIWLVSNQTCPLC

SEQ ID NO: 3380 - protein, 42 aa, Arabidopsis thaliana
  G905,RING/C3H2C3 domain
CPVCLNEFEDDETLRLIPQCCHVFHPGCIDAWLRSQTTCPLC

SEQ ID NO: 3381 - protein, 24 aa, Arabidopsis thaliana
  G910,1st Z-CO-like domain
CEFCKAYRAVVYCIADTANLCLTC

SEQ ID NO: 3382 - protein, 27 aa, Arabidopsis thaliana
  G910,2nd Z-CO-like domain
CHGCNDKFHGGGSSEHRRRDLRCYTGC

SEQ ID NO: 3383 - protein, 60 aa, Arabidopsis thaliana
  G920,WRKY domain
EDRYAWRKYGQKEILNTTFPRSYFRCTHKPTQGCKATKQVQKQDQDSEMFQITYIGYHTC

SEQ ID NO: 3384 - protein, 58 aa, Arabidopsis thaliana
  G921,WRKY domain
KDGYQWRKYGQKVTRDNPSPRAYFKCACAPSCSVKKKVQRSVEDQSVLVATYEGEHNH

SEQ ID NO: 3385 - protein, 64 aa, Arabidopsis thaliana
  G927,CAAT domain
STIYVNSKQYHGIIRRRQSRAKAAAVLDQKKLSSRCRKPYMHHSRHLHALRRPRGSGGRFLNTK

SEQ ID NO: 3386 - protein, 60 aa, Arabidopsis thaliana
  G929,CAAT domain
EPVFVNAKQYHGILRRRQSRAKLEARNRAIKAKKPYMHESRHLHAIRRPRGCGGRFLNAK

SEQ ID NO: 3387 - protein, 49 aa, Arabidopsis thaliana
  G936,GARP domain
WTPDLHLRFVRAVERLGGQERATPKLVRQMMNIKGLSIAHVKSHLQMYR

SEQ ID NO: 3388 - protein, 50 aa, Arabidopsis thaliana
  G937,GARP domain
WNPELHRRFVDALQQLGGPGVATPKQIREHMQEEGLTNDEVKSHLQKYRL

SEQ ID NO: 3389 - protein, 9 aa, Arabidopsis thaliana
  G938,EIL domain
AQDGILKYM

SEQ ID NO: 3390 - protein, 10 aa, Arabidopsis thaliana
  G939,EIL domain
AQDGILKYMS

SEQ ID NO: 3391 - protein, 9 aa, Arabidopsis thaliana
  G941,EIL domain
AQDGILKYM

SEQ ID NO: 3392 - protein, 169 aa, Arabidopsis thaliana
  G961,NAC domain
QSQVPPGFRFHPTEEELLQYYLRKKVNSIEIDLDVIRDVDLNKLEPWDIQEMCKIGTTPQNDWYFFSHKDKKYPTGTRTNRATAAGFWKATGRDKIIYSNGRRIGMRKTLVFYKGRAPHGQKSDWIMHEYRLDDNIISPEDVTVHEVVSIIGEASQDEGWVVCRIFKKK

SEQ ID NO: 3393 - protein, 123 aa, Arabidopsis thaliana
  G962,NAC domain
PGFRFHPTEEELIEFYLRRKVEGKRFNVELITFLDLYRYDPWELPAMAAIGEKEWYFYVPRDRKYRNGDRPNRVTTSGYWKATGADRMIRSETSRPIGLKKTLVFYSGKAPKGTRTSWIMNEY

SEQ ID NO: 3394 - protein, 68 aa, Arabidopsis thaliana
  G975,AP2 domain
TKKFRGVRQRHWGSWVAEIRHPLLKRRIWLGTFETAEEAARAYDEAAVLMSGRNAKTNFPLNNNNTGE

SEQ ID NO: 3395 - protein, 67 aa, Arabidopsis thaliana
  G976,AP2 domain
NPVYRGIRCRSGKWVSEIREPKKTTRVWLGTYPTPEMAAAAYDVAALALKGGDTLLNFPDSLGSYPI

SEQ ID NO: 3396 - protein, 77 aa, Arabidopsis thaliana
  G979,1st AP2 domain
SSIYRGVTRHRWTGRFEAHLWDKSSWNSIQNKKGKQVYLGAYDSEEAAAHTYDLAALKYWGPDTILNFPAETYTKEL

SEQ ID NO: 3397 - protein, 69 aa, Arabidopsis thaliana
  G979,2nd AP2 domain
VSKYRGVARHHHNGRWEARIGRVFGNKYLYLGTYNTQEEAAAAYDMAAIEYRGANAVTNFDISNYIDRL

SEQ ID NO: 3398 - protein, 68 aa, Arabidopsis thaliana
  G988,1st SCR domain
NQLTPFIRFGHLTANQAILDATETNDNGALHILDLDISQGLQWPPLMQALAERSSNPSSPPPSLRITG

SEQ ID NO: 3399 - protein, 90 aa, Arabidopsis thaliana
  G988,2nd SCR domain
VNCVHFLHKIFNDDGDMIGHFLSAIKSLNSRIVTMAEREANHGDHSFLNRFSEAVDHYMAIFDSLEATLPPNSRERLTLEQRWFGKEILD

SEQ ID NO: 3400 - protein, 74 aa, Arabidopsis thaliana
  G988,3rd SCR domain
EETERKQRHRRFEIWEEMMKRFGFVNVPIGSFALSQAKLLLRLHYPSEGYNLQFLNNSLFLGWQNRPLFSVSSW

SEQ ID NO: 3401 - protein, 8 aa, Arabidopsis thaliana
  G991,1st IAA domain
LELRLAPP

SEQ ID NO: 3402 - protein, 12 aa, Arabidopsis thaliana
  G991,2nd IAA domain
PVVGWPPVRSSR

SEQ ID NO: 3403 - protein, 34 aa, Arabidopsis thaliana
  G991,3rd IAA domain
YVKINMEGVPIGRKVNLSAYNNYQQLSHAVDQLF

SEQ ID NO: 3404 - protein, 37 aa, Arabidopsis thaliana
  G991,4th IAA domain
TLVYEDTEGDKVLVGDVPWEMFVSTVKRLHVLKTSHA

SEQ ID NO: 3405 - protein, 66 aa, Arabidopsis thaliana
  G993,1st AP2 domain
SSKYKGVVPQPNGRWGAQIYEKHQRVWLGTFNEEEEAASSYDIAVRRFRGRDAVTNFKSQVDGNDA

SEQ ID NO: 3406 - protein, 100 aa, Arabidopsis thaliana
  G993,2nd AP2 domain
REVLFEKTVTPSDVGKLNRLVIPKQHAEKHFPLPAMTTAMGMNPSPTKGVLINLEDRTGKVWRFRYSYWNSSQSYVLTKGWSRFVKEKNLRAGDVVCFER

SEQ ID NO: 3407 - protein, 51 aa, Arabidopsis thaliana
  G997,MYB-related domain
SSWTAREDKQFEMALAKFDKDTPDRWQKIARAVGGKSTEEVKRHYELLLRD

SEQ ID NO: 3408 - protein, 280 aa, Arabidopsis thaliana
  G999,MYB-(R1)R2R3 domain
ASKNGCAAPKKIGLRRCGKSCRVRKTDHSGTKHESFTSEDEDLIIKMHAAMGSRWQLIAQHLPGKTEEEVKMFWNTKLKKKLSEMGIDHVTHRPFSHVLAEYGNINGGGNLNPNPSNQAGSLGRNHSLNDDGHQQQPNDSGDLMFHLQAIKLMTDSSNQVKPESTFVYASSSSSNSSPPLFSSTCSTIAQENSEVNFTWSDFLLDQETFHENQQNHPQELDSLFGNDFSEVTAATMANTSTVPSQIEEESLSNGFVESIIAKEKEFFLGFPSYLEQPFHF

SEQ ID NO: 3409 - protein, 68 aa, Arabidopsis thaliana
  G10,AP2 domain
EKRYKGIRMRKWGKWVAEIREPNKRSRIWLGSYKTAVAAARAYDTAVFYLRGPSARLNFPEEVFKDGN

SEQ ID NO: 3410 - protein, 90 aa, Arabidopsis thaliana
  G1010,ABI3/VP-1 domain
HMFDKVVTPSDVGKLNRLVIPKQHAERFFPLDSSSNEKGLLLNFEDLTGKSWRFRYSYWNSSQSYVMTKGWSRFVKDKKLDAGDIVSFQR

SEQ ID NO: 3411 - protein, 56 aa, Arabidopsis thaliana
  G1011,MADS domain
VRGKIEMKKIENATSRQVTFSKRRNGLLKKAYELSVLCDAQLSLIIFSQRGRLYEF

SEQ ID NO: 3412 - protein, 73 aa, Arabidopsis thaliana
  G1029,HMG domain
DPNKPKRPASAFFVFMEDFRETFKKENPKNKSVATVGKAAGDKWKSLSDSEKAPYVAKAEKRKVEYEKNIKAY

SEQ ID NO: 3413 - protein, 53 aa, Arabidopsis thaliana
  G1035,bZIP domain
DERKRKRKQSNRESARRSRMRKQKHLDDLTAQVTHLRKENAQIVAGIAVTTQH

SEQ ID NO: 3414 - protein, 124 aa, Arabidopsis thaliana
  G1037,1st GARP domain
DQFPVGMRVLAVDDDQTCLKILESLLRHCQYHVTTTNQAQKALELLRENKNKFDLVISDVDMPDMDGFKLLELVGLEMDLPVIMLSAHSDPKYVMKGVTHGACDYLLKPVRIEELKNIWQHVVR

SEQ ID NO: 3415 - protein, 49 aa, Arabidopsis thaliana
  G1037,2nd GARP domain
WTVELHKKFVAAVNQLGYEKAMPKKILDLMNVEKLTRENVASHLQKFRL

SEQ ID NO: 3416 - protein, 50 aa, Arabidopsis thaliana
  G1040,GARP domain
RWTSTLHAHFVHAVQLLGGHERATPKSVLELMNVKDLTLAHVKSHLQMYR

SEQ ID NO: 3417 - protein, 52 aa, Arabidopsis thaliana
  G1047,bZIP domain
RKRKRMESNRESAKRSRMRKQRHIDNLKDEANRLGLENRELANRLRIVLYNI

SEQ ID NO: 3418 - protein, 54 aa, Arabidopsis thaliana
  G1050,bZIP domain
KRVKRILANRVSAARSKERKTRYMAELEHKVQTLQTEATTLSAQLTHLQRDSMG

SEQ ID NO: 3419 - protein, 79 aa, Arabidopsis thaliana
  G1058,bZIP domain
RRQRRMIKNRESAARSRARKQAYTLELEAEIEKLKKTNQELQKKQAEMVEMQKNELKETSKRPWGSKRQCLRRTLTGPW

SEQ ID NO: 3420 - protein, 58 aa, Arabidopsis thaliana
  G1061,HLH/MYC domain
RRGQATDPHSIAERLRRERIAERMKALQELVPNGNKTDKASMLDEIIDYVKFLQLQVK

SEQ ID NO: 3421 - protein, 9 aa, Arabidopsis thaliana
  G1073,1st AT-hook domain
RRPRGRPAG

SEQ ID NO: 3422 - protein, 145 aa, Arabidopsis thaliana
  G1073,2nd AT-hook domain
SKNKPKPPTIITRDSPNVLRSHVLEVTSGSDISEAVSTYATRRGCGVCIISGTGAVTNVTIRQPAAPAGGGVITLHGRFDILSLTGTALPPPAPPGAGGLTVYLAGGQGQVVGGNVAGSLIASGPVVLMAASFANAVYDRLPIEE

SEQ ID NO: 3423 - protein, 9 aa, Arabidopsis thaliana
  G1075,1st AT-hook domain
RRPRGRPAG

SEQ ID NO: 3424 - protein, 143 aa, Arabidopsis thaliana
  G1075,2nd AT-hook domain
SKNKPKPPVIVTRESANTLRAHILEVGSGCDVFECISTYARRRQRGICVLSGTGTVTNVSIRQPTAAGAVVTLRGTFEILSLSGSFLPPPAPPGATSLTIFLAGAQGQVVGGNVVGELMAAGPVMVMAASFTNVAYERLPLDE

SEQ ID NO: 3425 - protein, 41 aa, Arabidopsis thaliana
  G1108,RING/C3H2C3 domain
CCICLAKYANNEELRELPCSHFFHKECVDKWLKINASCPLC

SEQ ID NO: 3426 - protein, 11 aa, Arabidopsis thaliana
  G1149,PAZ domain
GTSRPAHYHVL

SEQ ID NO: 3427 - protein, 11 aa, Arabidopsis thaliana
  G1152,PAZ domain
GTSRPAHYHVL

SEQ ID NO: 3428 - protein, 92 aa, Arabidopsis thaliana
  G1181,HS domain
PFLTKTFNLVEDSSIDDVISWNEDGSSFIVWNPTDFAKDLLPKHFKHNNFSSFVRQLNTYGFKKVVPDRWEFSNDFFKRGEKRLLREIQRRK

SEQ ID NO: 3429 - protein, 513 aa, Arabidopsis thaliana
  G1186,AKR domain
EYTPCEDRERGRRFDRNMMKYRERHCPSKDELLYCLIPPPPNYKIPFKWPQSRDYAWYDNIPHKELSIEKAIQNWIQVEGERFRFPGGGTMFPRGADAYIDDIARLIPLTDGAIRTAIDTGCGVASFGAYLLKRDIVAMSFAPRDTHEAQVQFALERGVPAIIGIMGSRRLPYPARAFDLAHCSRCLIPWFQNDGLYLTEVDRVLRPGGYWILSGPPINWKKYWKGWERSQEDLKQEQDSIEDAARSLCWKKVTEKGDLSIWQKPINHVECNKLKRVHKTPPLCSKSDLPDFAWYKDLESCVTPLPEANSSDEFAGGALEDWPNRAFAVPPRIIGGTIPDINAEKFREDNEVWKERISYYKQIMPELSRGRFRNIMDMNAYLGGFAAAMMKYPSWVMNVVPVDAEKQTLGVIFERGFIGTYQDWCEGFSTYPRTYDLIHAGGLFSIYENRCDVTLILLEMDRILRPEGTVVFRDTVEMLTKIQSITNGMRWKSRILDHERGPFNPEKILLAVK

SEQ ID NO: 3430 - protein, 68 aa, Arabidopsis thaliana
  G12,AP2 domain
DKPYKGIRMRKWGKWVAEIREPNKRSRIWLGSYSTPEAAARAYDTAVFYLRGPSARLNFPELLAGVTV

SEQ ID NO: 3431 - protein, 60 aa, Arabidopsis thaliana
  G1227,HLH/MYC domain
EIESQRMTHIAVERNRRRQMNVHLNSLRSIIPSSYIQRGDQASIVGGAIDFVKILEQQLQ

SEQ ID NO: 3432 - protein, 49 aa, Arabidopsis thaliana
  G1232,Z-C4HC3 domain
VCGACGDNYGGDEFWICCDACEKWFHGKCVKITPAKAEHIKHYKCPSCT

SEQ ID NO: 3433 - protein, 85 aa, Arabidopsis thaliana
  G1242,1st SWI/SNF domain
DILEDYLMYRGYQYCRIDGNTGGDERDASIEAYNKPGSEKFVFLLSTRAGGLGINLATADVVILYDSDWNPQVDLQAQDRAHRIG

SEQ ID NO: 3434 - protein, 50 aa, Arabidopsis thaliana
  G1242,2nd SWI/SNF domain
GFSTWSRRDFNAFIRACEKYGRNDIKSIASEMEGKTEEEVERYAQVFQVR

SEQ ID NO: 3435 - protein, 62 aa, Arabidopsis thaliana
  G1242,3rd SWI/SNF domain
KGKLYNEECDRFMICMVHKLGYGNWDELKAAFRTSPLFRFDWFVKSRTTQELARRCDTLIRL

SEQ ID NO: 3436 - protein, 101 aa, Arabidopsis thaliana
  G1245,MYB-(R1)R2R3 domain
KGPWTQAEDNLLIAYVDKHGDGNWNAVQNNSGLSRCGKSCRLRWVNHLRPDLKKGAFTEKEEKRVIELHALLGNKWARMAEELPGRTDNEIKNFWNTRLKR

SEQ ID NO: 3437 - protein, 68 aa, Arabidopsis thaliana
  G1277,AP2 domain
ERPFKGIRMRKWGKWVAEIREPNKRSRLWLGSYSTPEAAARAYDTAVFYLRGPTATLNFPELLPCTSA

SEQ ID NO: 3438 - protein, 56 aa, Arabidopsis thaliana
  G129,MADS domain
GRGKIEIKRIENTTNRQVTFCKRRNGLLKKAYELSVLCDAEVALIVFSSRGRLYEY

SEQ ID NO: 3439 - protein, 101 aa, Arabidopsis thaliana
  G1307,MYB-(R1)R2R3 domain
RGPWTPEEDQILINYIHLYGHSNWRALPKHAGLLRCGKSCRLGWINYLRPDIKRGNFTPQEEQTIINLHESLGNRWSAIAAKLPGRTDNEIKNVWHTHLKK

SEQ ID NO: 3440 - protein, 103 aa, Arabidopsis thaliana
  G1321,MYB-(R1)R2R3 domain
CSRGHWRPAEDEKLKDLVEQYGPHNWNAIALKLPGRSGKSCRLRWFNQLDPRINRNPFTEEEEERLLAAHRIHGNRWSIIARLFPGRTDNAVKNHWHVIMARR

SEQ ID NO: 3441 - protein, 102 aa, Arabidopsis thaliana
  G1323,MYB-(R1)R2R3 domain
KRGPWSHDEDLKLISFIHKNGHENWRSLPKQAGLLRCGKSCRLRWINYLRPDVKRGNFSAEEEDTIIKLHQSFGNKWSKIASKLPGRTDNEIKNVWHTHLKK

SEQ ID NO: 3442 - protein, 105 aa, Arabidopsis thaliana
  G1325,MYB-(R1)R2R3 domain
KGPWTSTEDGILIDYVKKHGEGNWNAVQKHTSLARCGKSCRLRWANHLRPNLKKGAFSQEEEQLIVEMHAKMGNKWAQMAEHLPGRTDNEIKNYWNTRIKRRQRA

SEQ ID NO: 3443 - protein, 105 aa, Arabidopsis thaliana
  G1329,MYB-(R1)R2R3 domain
GLRKGAWTTEEDSLLRQCINKYGEGKWHQVPVRAGLNRCRKSCRLRWLNYLKPSIKRGKLSSDEVDLLLRLHRLLGNRWSLIAGRLPGRTANDVKNYWNTHLSKK

SEQ ID NO: 3444 - protein, 58 aa, Arabidopsis thaliana
  G1334,CAAT domain
DGTIYVNSKQYHGIIRRRQSRAKAEKLSRCRKPYMHHSRHLHAMRRPRGSGGRFLNTK

SEQ ID NO: 3445 - protein, 67 aa, Arabidopsis thaliana
  G1337,Z-CO-like domain
CDFCGERTAVLFCRADTAKLCLPCDQQVHTANLLSRKHVRSQICDNCGNEPVSVRCFTDNLILCQEC

SEQ ID NO: 3446 - protein, 57 aa, Arabidopsis thaliana
  G136,MADS domain
RGKIEIKRIENTTNRQVTFCKRRNGLLKKAYELSVLCDAEVALVIFSTRGRLYEYAN

SEQ ID NO: 3447 - protein, 68 aa, Arabidopsis thaliana
  G1381,AP2 domain
PTSYRGVRMRSWGKWVSEIREPRKKSRIWLGTYPTAEMAARAHDVAALAIKGNSGFLNFPELSGLLPR

SEQ ID NO: 3448 - protein, 68 aa, Arabidopsis thaliana
  G1387,AP2 domain
SKKFRGVRQRQWGSWVSEIRHPLLKRRVWLGTFDTAETAARAYDQAAVLMNGQSAKTNFPVIKSNGSN

SEQ ID NO: 3449 - protein, 76 aa, Arabidopsis thaliana; identical to SEQ ID NO: 1410
  G1396,S1FA domain

SEQ ID NO: 3450 - protein, 63 aa, Arabidopsis thaliana
  G14,AP2 domain
KNQYRGIRQRPWGKWAAEIRDPREGARIWLGTFKTAEEAARAYDAAARRIRGSKAKVNFPEEN

SEQ ID NO: 3451 - protein, 67 aa, Arabidopsis thaliana
  G1416,1st AP2 domain
SSQYRGVTFYRRTGRWESHIWDCGKQVYLGGFDTAHAAARAYDRAAIKFRGVDADINFDIEDYLDDL

SEQ ID NO: 3452 - protein, 68 aa, Arabidopsis thaliana
  G1416,2nd AP2 domain
SSKYRGVTLHKCGRWESRLGQFLNKKYVYLGLFDTEIEAARAYDKAAIKCNGKDAVTNFDPKVYEEEE

SEQ ID NO: 3453 - protein, 56 aa, Arabidopsis thaliana
  G142,MADS domain
GRGRVEMKRIENKINRQVTFSKRRNGLLKKAYELSVLCDAEVALIIFSSRGKLYEF

SEQ ID NO: 3454 - protein, 129 aa, Arabidopsis thaliana
  G1426,NAC domain
QNLHVLSMDSLPVGLRFRPTDEELIRYYLRRKINGHDDDVKAIREIDICKWEPWDLPDFSVIKTKDSEWLYFCPLDRKYPSGSRQNRATVAGYWKATGKDRKIKSGKTNIIGVKRTLVFHAGRAPRGTR

SEQ ID NO: 3455 - protein, 148 aa, Arabidopsis thaliana
  G1453,NAC domain
PPGFRFHPTDEELVGYYLKKKIASQRIDLDVIREIDLYKIEPWDLQERCRIGYEEQTEWYFFSHRDKKYPTGTRTNRATVAGFWKATGRDKAVYLNSKLIGMRKTLVFYRGRAPNGQKSDWIIHEYYSLESHQNSPPQEEGWVVCRAF

SEQ ID NO: 3456 - protein, 155 aa, Arabidopsis thaliana
  G1455,NAC domain
LPLGFRFRPTDEELINHYLRLKINGRDLEVRVIPEIDVCKWEPWDLPGLSVIKTDDQEWFFFCPRDRKYPSGHRSNRATDIGYWKATGKDRTIKSKKMIIGMKKTLVFYRGRAPRGERTNWIMHEYRATDKELDGTGPGQNPYVLCRLFHKPSDS

SEQ ID NO: 3457 - protein, 143 aa, Arabidopsis thaliana
  G1458,NAC domain
YPTGEELINHYLKNKILGKTWLVDEAISEINICSYDPIYLPSLSKIKSDDPVWYFFCPKEYTSAKKKVTKRTTSSGYWKATGVDRKIKDKRGNRGEIGIKKTLVYYEGRVPKGVWTPWVMHEYHITCLPQDQRNYVICQVMYK

SEQ ID NO: 3458 - protein, 143 aa, Arabidopsis thaliana
  G1459,NAC domain
FSPTGEEVINHYLKNKLLGKYWLVDEAISEINILSHKPSKDLPKLARIQSEDLEWYFFSPIEYTNPNKMKMKRTTGSGFWKPTGVDREIRDKRGNGVVIGIKKTLVYHEGKSPHGVRTPWVMHEYHITCLPHHKRKYVVCQVK

SEQ ID NO: 3459 - protein, 127 aa, Arabidopsis thaliana
  G1461,NAC domain
DDVIISRYLKRMIVNGDSWPDHFIEDVDVFNKNPNEEFHSQSPRFVIVKPRTENCGRTDGCQSGCWRIIGRDKLIKSKETGKILGFKKILKFCLKKKPREYKRSWVMEEYRLNNNLNCKQDHVICKI

SEQ ID NO: 3460 - protein, 148 aa, Arabidopsis thaliana
  G1463,NAC domain
PLFLGRFSFVMADTLLNAEDEVIISRYLKPMIVNRVSWPDLFIEDADVFNKDPYVKFHAEIPSFVIVKPRTKACGKTDGCDSGCWRIIGRDKLIKSEETGKILGFKKILKFCLKWKPREYKRSLVMEEYRLTNNFNWKQDHVICKIRL

SEQ ID NO: 3461 - protein, 149 aa, Arabidopsis thaliana
  G1464,NAC domain
KSELLNSEDEVIISRYLKPMVVNGDSWPDHFIEDANVFTKNPNEVFNSERPRFVIVKPRTEACGKTDGCESGCWRTMGRDKLIKSEETGKILGFKKILKFCIKWKPIEYKRSWVMEEYRLTNNLNWKQDHVICKIRLLFEAEISFLLAK

SEQ ID NO: 3462 - protein, 65 aa, Arabidopsis thaliana
  G1465,NAC domain
KTDRCINGGYWKILHRDRLIKSKSGIVIGFKKVFKFHETEKERYFCGGEDVKVTWTLEEYRLSVK

SEQ ID NO: 3463 - protein, 267 aa, Arabidopsis thaliana
  G1466,PMR domain
GFGRDKVNGRYKVVRMSFAFWRVRQEEPVVECGVLDVDTGEWRKLSPPPYVVNVGSKSVCVNGSIYWLHIQTVYRILALDLHKQEFHKVPVPPTQITVDTQMVNLEDRLVLAITRVSPEWILEVWGMDTYKEKWSKTYSISLDHRVVSWRRQKRWFTPVAVSKQANLVFYDNKKRLFKYYPVKDEIRCLSLDICVLSPYVENLVPLPLKPSHPHPTPKNSDFEMRISRCRLFSTPGSWISKILKWNVMTLEILFTSLAIVGYICLPL

SEQ ID NO: 3464 - protein, 32 aa, Arabidopsis thaliana
  G1482,1st Z-CO-like domain
KIRCDVCDKEEASVFCTADEASLCGGCDHQVH

SEQ ID NO: 3465 - protein, 43 aa, Arabidopsis thaliana
  G1482,2nd Z-CO-like domain
CDICQDKKALLFCQQDRAILCKDCDSSIHAANEHTKKHDRFLL

SEQ ID NO: 3466 - protein, 27 aa, Arabidopsis thaliana
  G1489,GATA/Zn domain
CLHCATEKTPQWRTGPMGPKTLCNACG

SEQ ID NO: 3467 - protein, 56 aa, Arabidopsis thaliana
  G149,MADS domain
VRGKTEMKRIENATSRQVTFSKRRNGLLKKAFELSVLCDAEVALIIFSPRGKLYEF

SEQ ID NO: 3468 - protein, 50 aa, Arabidopsis thaliana
  G1492,GARP domain
WTPDLHRCFVHAVEILGGQHRATPKLVLKMMDVKGLTISHVKSHLQMYRG

SEQ ID NO: 3469 - protein, 48 aa, Arabidopsis thaliana
  G1493,GARP domain
WSVELHQQFVAAVNQLGVEKAVPKKILELMNVPGLTRENVASHLQKYR

SEQ ID NO: 3470 - protein, 29 aa, Arabidopsis thaliana
  G1507,GATA/Zn domain
CRHCGTSEKSTPMMRRGPDGPRTLCNACG

SEQ ID NO: 3471 - protein, 26 aa, Arabidopsis thaliana
  G1508,GATA/Zn domain
CADCGTSKTPLWRGGPVGPKSLCNAC

SEQ ID NO: 3472 - protein, 56 aa, Arabidopsis thaliana
  G152,MADS domain
GRGKIVIQKIDDSTSRQVTFSKRRKGLIKKAKELAILCDAEVCLIIFSNTDKLYDF

SEQ ID NO: 3473 - protein, 57 aa, Arabidopsis thaliana
  G153,MADS domain
MGRGKIVIRRIDNSTSRQVTFSKRRSGLLKKAKELSILCDAEVGVIIFSSTGKLYDY

SEQ ID NO: 3474 - protein, 64 aa, Arabidopsis thaliana
  G1545,HB domain
NEGNGWFRKRKLSDEQVRMLEISFEDDHKLESERKDRLASELGLDPRQVAVWFQNRRARWKNKR

SEQ ID NO: 3475 - protein, 61 aa, Arabidopsis thaliana
  G1548,HB domain
KYVRYTPEQVEALERLYHDCPKPSSIRRQQLIRECPILSNIEPKQIKVWFQNRRCREKQRK

SEQ ID NO: 3476 - protein, 59 aa, Arabidopsis thaliana
  G1588,HB domain
YHRHTQRQIQELESFFKECPHPDDKQRKELSRDLNLEPLQVKFWFQNKRTQMKAQSERH

SEQ ID NO: 3477 - protein, 20 aa, Arabidopsis thaliana
  G1594,HB domain
SENMPFAMMDDSSGSFFTEE

SEQ ID NO: 3478 - protein, 68 aa, Arabidopsis thaliana
  G16,AP2 domain
HPVYRGVRKRNWGKWVSEIREPRKKSRIWLGTFPSPEMAARAHDVAALSIKGASAILNFPDLAGSFPR

SEQ ID NO: 3479 - protein, 51 aa, Arabidopsis thaliana
  G1641,1st MYB-related domain
ATWTAAENKAFENALAVYDDNTPDRWQKVAAVIPGKTVSDVIRQYNDLEAD

SEQ ID NO: 3480 - protein, 49 aa, Arabidopsis thaliana
  G1641,2nd MYB-related domain
VPWTEEEHKLFLMGLKKYGKGDWRNISRNFVITRTPTQVASHAQKYFIR

SEQ ID NO: 3481 - protein, 58 aa, Arabidopsis thaliana; identical to SEQ ID NO: 2646
  G1664,HLH/MYC domain

SEQ ID NO: 3482 - protein, 154 aa, Arabidopsis thaliana
  G1672,NAC domain
VGLPAGVKFDPTDQELIEHLEAKVKGKEENKKWSSSHPLIDEFIPTIDGEDGICYTHPQKLPGVTRDGLSKHFFHKPSRAYTTGTRKRRKIIQTDHDSELTGSSETRWHKTGKTRPVMINGQQRGCKKILVLYTNFGKNRRPEKTNWVMHQYHL

SEQ ID NO: 3483 - protein, 56 aa, Arabidopsis thaliana
  G170,MADS domain
GMKKVKLSLIANERSRKTSFIKRKDGIFKKLHELSTLCGVQACALIYSPFIPVPES

SEQ ID NO: 3484 - protein, 68 aa, Arabidopsis thaliana
  G1748,AP2 domain
KNLYRGVRQRHWGKWVAEIRLPKNRTRLWLGTFETAEKAALAYDQAAFQLRGDIAKLNFPNLIHEDMN

SEQ ID NO: 3485 - protein, 69 aa, Arabidopsis thaliana
  G1749,AP2 domain
EKKHKGVRKKPSGKWAAEIWDPSLKVRRWLGTFPTAEMAAKAYNDAAAEFVGRRSARRGTKNGEEASTK

SEQ ID NO: 3486 - protein, 69 aa, Arabidopsis thaliana
  G1753,AP2 domain
HPLYRGVRQRKNSNKWVSEIREPRKPNRIWLGTFSTPEMAAIAYDVAALALKGSQAELNFPNSVSSLPA

SEQ ID NO: 3487 - protein, 68 aa, Arabidopsis thaliana
  G1754,AP2 domain
ICDYRGVRQRRWGKWVAEIREPDGGARLWLGTFSSSYEAALAYDEAAKAIYGQSARLNLPEITNRSSS

SEQ ID NO: 3488 - protein, 144 aa, Arabidopsis thaliana
  G1766,NAC domain
GFRFHPTDEELVDYYLRKKVASKRIEIDIIKDVDLYKIEPCDLQELCKIGNEEQSEWYFFSHKDKKYPTGTRTNRATKAGFWKATGRDKAIYIRHSLIGMRKTLVFYKGRAPNGQKSDWIMHEYRLETSENGTPQEEGWVVCRV

SEQ ID NO: 3489 - protein, 66 aa, Arabidopsis thaliana
  G1768,1st SCR domain
VYVLHEVCPYFKFGYMSANGAIAEAMKDEERIHIIDFQIGQGSQWIALIQAFAARPGGAPNIRITG

SEQ ID NO: 3490 - protein, 89 aa, Arabidopsis thaliana
  G1768,2nd SCR domain
YMLHHLPDESVSMENHRDRLLRMVKSLSPKVVTLVEQECNTNTSPFLPRFLETLSYYTAMFESIDVMLPRNHKERINIEQHCMARDVVN

SEQ ID NO: 3491 - protein, 73 aa, Arabidopsis thaliana
  G1768,3rd SCR domain
CEGAERIERHELLGKWKSRFSMAGFEPYPLSSIISATIRALLRDYSNGYAIEERDGALYLGWMDRILVSSCAW

SEQ ID NO: 3492 - protein, 50 aa, Arabidopsis thaliana
  G1779,GATA/Zn domain
NGYNNDCVIRICSDCNTTKTPLWRSGPRGPKSLCNACGIRQRKARRAAMA

SEQ ID NO: 3493 - protein, 65 aa, Arabidopsis thaliana
  G1791,AP2 domain
NEMKYRGVRKRPWGKYAAEIRDSARHGARVWLGTFNTAEDAARAYDRAAFGMRGQRAILNFPHEY

SEQ ID NO: 3494 - protein, 65 aa, Arabidopsis thaliana
  G1792,AP2 domain
KQARFRGVRRRPWGKFAAEIRDPSRNGARLWLGTFETAEEAARAYDRAAFNLRGHLAILNFPNEY

SEQ ID NO: 3495 - protein, 65 aa, Arabidopsis thaliana
  G1795,AP2 domain
EHGKYRGVRRRPWGKYAAEIRDSRKHGERVWLGTFDTAEEAARAYDQAAYSMRGQAAILNFPHEY

SEQ ID NO: 3496 - protein, 57 aa, Arabidopsis thaliana
  G1798,MADS domain
MVRGKIEIKKIENVTSRQVTFSKRRSGLFKKAHELSVLCDAQVAAIVFSQSGRLHEY

SEQ ID NO: 3497 - protein, 45 aa, Arabidopsis thaliana
  G1816,MYB-related domain
INMTEQEEDLIFRMYRLVGDRWDLIAGRVPGRQPEEIERYWIMRN

SEQ ID NO: 3498 - protein, 285 aa, Arabidopsis thaliana
  G1817,PMR domain
VLEEIFLRFPVKALIRLKSLSKQWRSTIESRSFEERHLTIAKKAFVDHPKVMLVGEEDPIRGTGIRPDTDIGFRLFCLESASLLSFTRLNFPQGFFNWIYISESCDGLFCIHSPKSHSVYVVNPATRWLRLLPPAGFQILIHKFNPTEREWNVVMKSIFHLAFVKATDYKLVWLYNCDKYIVDASSPNVGVTKCEIFDFRKNAWRYLACTPSHQIFYYQKPASANGSVYWFTEPYNERIEVVAFDIQTETFRLLPKINPAIAGSDPHHIDMCTLDNSLCMSKREK

SEQ ID NO: 3499 - protein, 93 aa, Arabidopsis thaliana
  G1818,CAAT domain
KGMEGDLNVKNHEFPISRIKRIMKFDPDVSMIAAEAPNLLSKACEMFVMDLTMRSWLHAQESNRLTIRKSDVDAVVSQTVIFDFLRDDVPKDE

SEQ ID NO: 3500 - protein, 21 aa, Arabidopsis thaliana
  G1832,1st Z-C2H2 domain
CTECGKQFGSLKALFGHMRCH

SEQ ID NO: 3501 - protein, 17 aa, Arabidopsis thaliana
  G1832,2nd Z-C2H2 domain
CDGCKKVFGSHQALGGH

SEQ ID NO: 3502 - protein, 21 aa, Arabidopsis thaliana
  G1832,3rd Z-C2H2 domain
CNICSRVFSSGQALGGHMRCH

SEQ ID NO: 3503 - protein, 68 aa, Arabidopsis thaliana
  G1840,AP2 domain
EKKHKGVRKKPSGKWSAEIWDPSTRTRRWLGTFPTAEMAADAYDEAAAALVEKRSARRGSKKGEGSIH

SEQ ID NO: 3504 - protein, 68 aa, Arabidopsis thaliana
  G1846,AP2 domain
QPVYRGVRMRSWGKWVSEIREPRKKSRIWLGTFPTAEMAMRAHDVAAMSIKGTSAILNFPELSKLLPR

SEQ ID NO: 3505 - protein, 107 aa, Arabidopsis thaliana
  G1868,GRF-like domain
PFTLTQWAELEQQALIYKYITANVPVPSSLLISIKKSFYPYGSLPPSSFGWGTFHLGFAGGNMDPEPGRCRRTDGKKWRCSRDAVPDQKYCERHINRGRHRSRKPVE

SEQ ID NO: 3506 - protein, 60 aa, Arabidopsis thaliana
  G1879,HLH/MYC domain
EIENQRMTHIAVERNRRKQMNEYLAVLRSLMPSSYAQRGDQASIVGGAINYVKELEHILQ

SEQ ID NO: 3507 - protein, 31 aa, Arabidopsis thaliana
  G1887,Z-LSDlike domain
LVDCSSCRTPLHLPPGATRIRCAICHAFTLI

SEQ ID NO: 3508 - protein, 21 aa, Arabidopsis thaliana
  G1889,Z-C2H2 domain
CPICGAEFAVGQALGGHMRKH

SEQ ID NO: 3509 - protein, 43 aa, Arabidopsis thaliana
  G1891,Z-Dof domain
CARCDSDNTKFCYYNNYCEFQPRYFCKNCRRYWTHGGALRNIP

SEQ ID NO: 3510 - protein, 43 aa, Arabidopsis thaliana
  G1895,Z-Dof domain
CPRCNSADTKFCYYNNYNVNQPRHFCRKCQRYWTAGGSMRIVP

SEQ ID NO: 3511 - protein, 53 aa, Arabidopsis thaliana
  G1900,Z-Dof domain
LPCPRCNSMETKFCYYNNYNVNQPRHFCKACQRYWTSGGTMRSVPIGAGRRKN

SEQ ID NO: 3512 - protein, 29 aa, Arabidopsis thaliana
  G1902,Z-Dof domain
CPRCDSPNTKFCYYNNYNLSQPRHFCKSC

SEQ ID NO: 3513 - protein, 51 aa, Arabidopsis thaliana
  G1911,MYB-related domain
GSWTAKQNKAFEQALATYDQDTPNRWQNVAKVVGGKTTEEVKRHYELLVQD

SEQ ID NO: 3514 - protein, 172 aa, Arabidopsis thaliana
  G1927,NAC domain
APGFRFHPTDEELVVYYLKRKICCKKLRVNAIGVVDVYKVDPSELPGLSMLKTGDRQWFFFTPRNRKYPNAARSSRGTATGYWKATGKDRVIEYNSRSVGLKKTLVFYRGRAPNGERTDWVMHEYTMDEEELGRCKNAKEYYALYKLYKKSGAGPKNGEQYGAPFQEEEWVD

SEQ ID NO: 3515 - protein, 23 aa, Arabidopsis thaliana
  G1929,Z-CO-like domain
CELCDGDASVFCEADSAFLCRKC

SEQ ID NO: 3516 - protein, 66 aa, Arabidopsis thaliana
  G1930,1st AP2 domain
SSRFKGVVPQPNGRWGAQIYEKHQRVWLGTFNEEDEAARAYDVAAHRFRGRDAVTNFKDTTFEEEV

SEQ ID NO: 3517 - protein, 95 aa, Arabidopsis thaliana
  G1930,2nd AP2 domain
AELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKR

SEQ ID NO: 3518 - protein, 59 aa, Arabidopsis thaliana
  G1942,HLH/MYC domain
RRGQATDNHSLAERARREKINARMKLLQELVPGCDKIQGTALVLDEIINHVQTLQRQVE

SEQ ID NO: 3519 - protein, 103 aa, Arabidopsis thaliana
  G197,MYB-(R1)R2R3 domain
KGAWTKEEDDKLISYIKAHGEGCWRSLPRSAGLQRCGKSCRLRWINYLRPDLKRGNFTLEEDDLIIKLHSLLGNKWSLIATRLPGRTDNEIKNYWNTHVKRKL

SEQ ID NO: 3520 - protein, 29 aa, Arabidopsis thaliana
  G1974,1st Z-C2H2 domain
KKRVFRCKTCERDFDSFQALGGHRASHSK

SEQ ID NO: 3521 - protein, 45 aa, Arabidopsis thaliana
  G1974,2nd Z-C2H2 domain
SPKKKPKTTTTTTAHTCPICGLEFPMGQALGGHMRKHRNEKEREK

SEQ ID NO: 3522 - protein, 21 aa, Arabidopsis thaliana
  G1986,1st Z-C2H2 domain
CSICSKTFNRYNNMQMHMWGH

SEQ ID NO: 3523 - protein, 21 aa, Arabidopsis thaliana
  G1986,2nd Z-C2H2 domain
CGKCGKALAVKGDWRTHEKNC

SEQ ID NO: 3524 - protein, 21 aa, Arabidopsis thaliana
  G1995,Z-C2H2 domain
CHYCFRNFPTSQALGGHQNAH

SEQ ID NO: 3525 - protein, 101 aa, Arabidopsis thaliana
  G201,MYB-(R1)R2R3 domain
KGAWTAEEDKKLISYIHEHGGGGWRDIPQKAGLKRCGKSCRLRWANYLKPDIKRGEFSYEEEQIIIMLHASRGNKWSVIARHLPKRTDNEIKNYWNTHLKK

SEQ ID NO: 3526 - protein, 329 aa, Arabidopsis thaliana
  G2016,AKR domain
LHIAAKWGHLELVKEIIFECPCLLFEQNSSRQTPLHVATHGGHTKVVEALVASVTSALASLSTEESEGLNPHVLKDEDGNTALYYAIEGRYLEMATCLVNADKDAPFLGNNKGISSLYEAVDAGNKFEDLVKAILKTTDDNVDREVRKFNLDSKLQGNKHLAHVALKAKSIGVLDVILDEYPSLMDEQDEDGRTCLSYGASIGYYKGLCNILNRSTKGVYVCDQDGSFPIHSAAKNEHYEIIKEFIKRCPASKYLLNRLGQNILHVAAKNEASLTAYMLMHDKDTKHLGVGQDVDGNTPLHLAVMNWDFDSITCLASRNHEILKLRNKS

SEQ ID NO: 3527 - protein, 326 aa, Arabidopsis thaliana
  G2017,AKR domain
RGDSVLHLAARWGHLELVKNIISECPCLVLELNFKDQLPLHVAAHAGHSAIVEALVASVTFFSDRLAEEDRERLNPYVLRDKYGNTALHLAIEGRYMEMAASLVNENQNASFLENNEGISSLYMAVEAGDVTLVKEILKTAGNNDLEGRNSNLDSKLEGRKHLVHVALNARSIGVLDVILNEYPSLEDERDEEGRTCLSFAASIGFYKGVCNLLDRSTKNVYVCDEDGSFPIHTAAENGHIRIVKEILKRCPHSKHMLNKLGQNVLHIAAKIGEHNLVKSLMRSDDTKHLGVGQDVDGNTPLHLAVLNWRYRSIRTLASDVKILQL

SEQ ID NO: 3528 - protein, 104 aa, Arabidopsis thaliana
  G202,MYB-(R1)R2R3 domain
KKGAWTTEEDKKLISYIHDHGEGGWRDIPQKAGLKRCGKSCRLRWTNYLKPEIKRGEFSSEEEQIIIMLHASRGNKWSVIARHLPRRTDNEIKNYWNTHLKKRL

SEQ ID NO: 3529 - protein, 283 aa, Arabidopsis thaliana
  G2022,AKR domain
VEALVSFIKDISCNKPGVAKKIYFAKDRHQDNALHVSLKRKHLKVASCLVCAEQSLSFVANNDGVSPLYLAVEAGQADLAKTMWQHSNNGSSSTSTLASKIGGRSIVHGAMKARRKDILVAILSEDASLINFRDEGRTCLSFGASLGYYEGFCYLLDKALDSVYVSDDDGSFPIHMAVKYGYVKILKAILKRCPDALELLDRENQNVLHVAAKNGKIEVLKFILRCCKDKNKEKLINEEDANGNTPLHLATKNWHPKVVSMLTWDNRVDLKTLNHDGVTALDI

SEQ ID NO: 3530 - protein, 325 aa, Arabidopsis thaliana
  G2023,AKR domain
TGDFTLHLAAAWGRLELVKRIVSECPCLLLETNSKDQIPLHAAAAAGRLAVVEAFVARVNEISDGLSEEERERVNLYAMKDIDGNTALHLALKGGHLKTAACLVKANHLASFLANNHGVSPLFTAIIAGSLTLVEAMMYVPGQTCNLASKLEGRKSLVHAALKAKNSDILDVILSEDPSLVNERDEEGRTCLSVAAYVGYYKGVVNLLHRSTSNVFECDDDGSYPIHMAVEKGRVKIFLKLLKCCPDSQYLLNKQGQNILHIAAKSGKTGTYLLQVIKAYDLIKNDLIMEQDVDGNTPLHLATLTWRPRTVNILNKFTLGNHLHI

SEQ ID NO: 3531 - protein, 361 aa, Arabidopsis thaliana
  G2025,AKR domain
KGDSILHLAAAFGHLELVKSIVSKFPSLLLELNFKDQLPLHVAARDGHLTVVKALVASVTFCSDRLAEEDRERLNPYILKDKNGDTALHSALKDLHEKTKELHEKTKDMHWLRRSKSKSLSNESTHLMETAACLVNANQDVSFLANKDEISPLYLAVEAGNVSLVNAMLNSHVNNVQDKTFNLATQLKGRKSLVHAALKAKNTDVLDVILGKYPSLVKERDEKGRTCLSVGASVGFYQGICKLLDTSTLSIFDCDDDGSFPIHKAVEKGHENVVKELLKRFPDSVEQLNKEGQNIFHISAKSGKSTLFLMEHINKVDTKNHLMEEQDMDGNTPLHLATINWRPKTVRMLTKFLSIRKKLLD

SEQ ID NO: 3532 - protein, 57 aa, Arabidopsis thaliana
  G2065,MADS domain
MGMKKVKLSLIANERSRKTSFMKRKNGIFKKLHELSTLCGVQACALIYSPFIPVPES

SEQ ID NO: 3533 - protein, 101 aa, Arabidopsis thaliana
  G207,MYB-(R1)R2R3 domain
KGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRK

SEQ ID NO: 3534 - protein, 103 aa, Arabidopsis thaliana
  G208,MYB-(R1)R2R3 domain
KGAWTKEEDQRLVDYIRNHGEGCWRSLPKSAGLLRCGKSCRLRWINYLRPDLKRGNFTDDEDQIIIKLHSLLGNKWSLIAGRLPGRTDNEIKNYWNTHIKRKL

SEQ ID NO: 3535 - protein, 84 aa, Arabidopsis thaliana
  G2106,1st AP2 domain
SSVHRGVTRHRWTGRYEAHLWDKNSWNETQTKKGRQVYLGAYDEEDAAARAYDLAALKYWGRDTILNFPVNFLGILLCNYEEDI

SEQ ID NO: 3536 - protein, 69 aa, Arabidopsis thaliana
  G2106,2nd AP2 domain
VSKYRGVAKHHHNGRWEARIGRVFGNKYLYLGTYATQEEAAIAYDIAAIEYRGLNAVTNFDISRYLKLP

SEQ ID NO: 3537 - protein, 60 aa, Arabidopsis thaliana
  G2110,WRKY domain
NDGCQWRKYGQKIAKGNPCPRAYYRCTIAASCPVRKQVQRCSEDMSILISTYEGTHNHPL

SEQ ID NO: 3538 - protein, 52 aa, Arabidopsis thaliana
  G2128,GARP domain
KWTPDLHERFIEAVNQLGGADKATPKTIMKVMGIPGLTLYHLKSHLQKYRLS

SEQ ID NO: 3539 - protein, 72 aa, Arabidopsis thaliana
  G2131,1st AP2 domain
SSPYRGVTRHRWTGRYEAHLWDKNSWNDTQTKKGRQVYLGAYDEEEAAARAYDLAALKYWGRDTLLNFPLPS

SEQ ID NO: 3540 - protein, 72 aa, Arabidopsis thaliana
  G2131,2nd AP2 domain
SGFSRGVSKYRGVARHHHNGRWEARIGRVFGNKYLYLGTYATQEEAAIAYDIAAIEYRGLNAVTNFDVSRYL

SEQ ID NO: 3541 - protein, 68 aa, Arabidopsis thaliana
  G2133,AP2 domain
DQSKYKGIRRRKWGKWVSEIRVPGTRQRLWLGSFSTAEGAAVAHDVAFYCLHRPSSLDDESFNFPHLL

SEQ ID NO: 3542 - protein, 73 aa, Arabidopsis thaliana
  G2138,AP2 domain
EKKYRGVRQRPWGKWVAEIRCGRGACKGRRDRLWLGTFNTAEEAALAYDNASIKLIGPHAPTNFGLPAENQED

SEQ ID NO: 3543 - protein, 59 aa, Arabidopsis thaliana
  G2149,HLH/MYC domain
KRGCATHPRSIAERERRTRISGKLKKLQDLVPNMDKQTSYSDMLDLAVQHIKGLQHQLQ

SEQ ID NO: 3544 - protein, 181 aa, Arabidopsis thaliana
  G2158,ACBF-like domain
TLWVGDLLHWMDETYLHTCFSHTNEVSSVKVIRNKQTCQSEGYGFVEFLSRSAAEEALQSFSGVTMPNAEQPFRLNWASFSTGEKRASENGPDLSIFVGDLAPDVSDAVLLETFAGRYPSVKGAKVVIDSNTGRSKGYGFVRFGDENERSRAMTEMNGAFCSSRQMRVGIATPKRAAAYGQ

SEQ ID NO: 3545 - protein, 125 aa, Arabidopsis thaliana
  G2159,DBP domain
KTVGRWLKDRREKKKEEMRAHNAQIHAAVSVAGVAAAVAAIAAATAASSSAGKDENMAKTDMAVASAATLVAAQCVEAAEVMGAERDHLASVVSSAVNVRSAGDIMTLTAGAATALRGVATLKAR

SEQ ID NO: 3546 - protein, 131 aa, Arabidopsis thaliana
  G2184,NAC domain
APGFRFHPTDEELVMYYLKRKICRKRLRVNVIGVVDVYKMDPEELPGQSMLKTGDRQWFYFTPRSRKYPNAARSNRGTENGYWKATGKDRVIEYNSRSVGLKKTLVFYRGRAPSGERTDWVMHEYTMDEDE

SEQ ID NO: 3547 - protein, 50 aa, Arabidopsis thaliana
  G2216,bZIP-NIN domain
YFYMPITQAARELNIGLTLLKKRCRELGIKRWPHRKLMSLQKLISNVKEL

SEQ ID NO: 3548 - protein, 207 aa, Arabidopsis thaliana
  G223,PMR domain
ELLEDIFLRLPLKSILKFKTVSRQWRSILESKLFVERRGNLQKHHRKILAAYNCNYFMRPSIFPESRFEGDEEIVYLHCDAAQPSMTCDGLLCITEPGWFNVLNPSAGQLRRFPPGPGPVKGPQENWLLGFGRDNVTGRYKIVRMCFHDCYEFGILDIETGVWSKLRSPPHNMLPGSKSVCVNGSIYWLQISAGYIILAMDLHEESY

SEQ ID NO: 3549 - protein, 108 aa, Arabidopsis thaliana
  G224,PMR domain
DLLEEIFLGLPLKSILRFKTVSKQWRSILESKSFAERRLNVEKKEKILAVGDRTELGFEGEEEIQMVYLHCDIDATRPSLTCEGLVCIPAPGWINVLNPSTRQLRRFP

SEQ ID NO: 3550 - protein, 45 aa, Arabidopsis thaliana
  G226,MYB-related domain
ISMTEQEEDLISRMYRLVGNRWDLIAGRVVGRKANEIERYWIMRN

SEQ ID NO: 3551 - protein, 56 aa, Arabidopsis thaliana
  G2297,MADS domain
GKQRINIKKIEKDEDRLVTLSKRRNGIYTKLSELSILCGAEVAFLGYSCSGKPYTF

SEQ ID NO: 3552 - protein, 101 aa, Arabidopsis thaliana
  G230,MYB-(R1)R2R3 domain
KGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRK

SEQ ID NO: 3553 - protein, 105 aa, Arabidopsis thaliana
  G231,MYB-(R1)R2R3 domain
KGPWTVEEDKKLINFILTNGHCCWRALPKLAGLRRCGKSCRLRWTNYLRPGLKRGLLSHDEEQLVIDLHANLGNKWSKIASRLPGRTDNEIKNHWNTHIKKKLLK

SEQ ID NO: 3554 - protein, 103 aa, Arabidopsis thaliana
  G233,MYB-(R1)R2R3 domain
KRGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKKR

SEQ ID NO: 3555 - protein, 102 aa, Arabidopsis thaliana
  G234,MYB-(R1)R2R3 domain
KGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKK

SEQ ID NO: 3556 - protein, 90 aa, Arabidopsis thaliana
  G2345,CAAT domain
REQDRFLPIANISRIMKRGLPLNGKIAKDAKETMQECVSEFISFVTSEASDKCQREKRKTINGDDLLWAMATLGFEDYIDPLKVYLMRYR

SEQ ID NO: 3557 - protein, 92 aa, Arabidopsis thaliana
  G2379,1st TH domain
GREDWWSEEATATLVEAWGNRYVKLNHGNLRQNDWKDVADAVNSRHGDNSRKKTDLQCKNRVDTLKKKYKTEKAKLSPSTWRFYNRLDVLIG

SEQ ID NO: 3558 - protein, 60 aa, Arabidopsis thaliana
  G2379,2nd TH domain
GSTCRELATAILKFGEVYERIEGKKQQMMIELEKQRMEVTKEVELKRMNMLMEMQLEIEK

SEQ ID NO: 3559 - protein, 68 aa, Arabidopsis thaliana
  G24,AP2 domain
LKPYKGIRMRKWGKWVAEIREPNKRSRIWLGSYATPEAAARAYDTAVFYLRGPSARLNFPELLAGLTV

SEQ ID NO: 3560 - protein, 96 aa, Arabidopsis thaliana
  G2436,Z-CO-like domain
CDTCRSAACTVYCEADSAYLCTTCDARVHAANRVASRHERVRVCQSCESAPAAFLCKADAASLCTACDAEIHSANPLARRHQRVPILPLSANSCSS

SEQ ID NO: 3561 - protein, 67 aa, Arabidopsis thaliana
  G2443,Z-CO-like domain
CDTCRSNACTVYCHADSAYLCMSCDAQVHSANRVASRHKRVRVCESCERAPAAFLCEADDASLCTAC

SEQ ID NO: 3562 - protein, 39 aa, Arabidopsis thaliana
  G2456,1st YABBY domain
LCYVHCSFCDTVLAVSVPPSSLFKTVTVRCGHCSNLLSV

SEQ ID NO: 3563 - protein, 48 aa, Arabidopsis thaliana; identical to SEQ ID NO: 3014
  G2456,2nd YABBY domain

SEQ ID NO: 3564 - protein, 39 aa, Arabidopsis thaliana
  G2459,1st YABBY domain
LCYIPCNFCNIILAVNVPCSSLFDIVTVRCGHCTNLWSV

SEQ ID NO: 3565 - protein, 48 aa, Arabidopsis thaliana
  G2459,2nd YABBY domain
RPPEKRQRVPSAYNQFIKEEIQRIKANNPDISHREAFSTAAKNWAHFP

SEQ ID NO: 3566 - protein, 92 aa, Arabidopsis thaliana
  G2467,HS domain
PFLTKTFEMVGDPNTNHIVSWNRGGISFVVWDPHSFSATILPLYFKHNNFSSFVRQLNTYGFRKIEAERWEFMNEGFLMGQRDLLKSIKRRT

SEQ ID NO: 3567 - protein, 138 aa, Arabidopsis thaliana
  G2469,1st AKR domain
SDVTFSVEGRLVHAHRCILAARSLFFRKFFCESDPSQPGAEPANQTGSGARAAAVGGVIPVNSVGYEVFLLLLQFLYSGQVSIVPHKHEPRSNCGDRGCWHTHCTAAVDLSLDILAAARYFGVEQLALLTQKHLTSMV

SEQ ID NO: 3568 - protein, 65 aa, Arabidopsis thaliana
  G2469,2nd AKR domain
DESLALIYAVENCSREVVKALLELGAADVNYPAGPTGKTALHIAAEMVSPDMVAVLLDHHADPNV

SEQ ID NO: 3569 - protein, 81 aa, Arabidopsis thaliana
  G2494,1st BPF-1 domain
VKLRIKSFRVPELFVEIPETATVGSLKRMVMEAVTTILGDGLRVGLMVQGKKVRDDGKTLLQTGISEENNHLDSLGFSLEP

SEQ ID NO: 3570 - protein, 87 aa, Arabidopsis thaliana
  G2494,2nd BPF-1 domain
QRRIRRPFSVTEVEALVQAVEKLGTGRWRDVKVRAFEDADHRTYVDLKDKWKTLVHTARISPQQRRGEPVPQELLDRVLKAHAYWSQ

SEQ ID NO: 3571 - protein, 69 aa, Arabidopsis thaliana
  G2512,AP2 domain
EKSYRGVRKRPWGKFAAEIRDSTRKGIRVWLGTFDTAEAAALAYDQAAFALKGSLAVLNFPADVVEESL

SEQ ID NO: 3572 - protein, 68 aa, Arabidopsis thaliana
  G2513,AP2 domain
HPVYRGIRRRNGDKWVCEVREPTHQRRIWLGTYPTADMAARAHDVAVLALRGRSACLNFADSAWRLPV

SEQ ID NO: 3573 - protein, 67 aa, Arabidopsis thaliana
  G2514,AP2 domain
DPVYRGIRCRSGKWVSEIREPRKTTRIWLGTYPMAEMAAAAYDVAAMALKGREAVLNFPGSVGSYPV

SEQ ID NO: 3574 - protein, 148 aa, Arabidopsis thaliana
  G2534,NAC domain
PPGFRFHPTEEELVGYYLDRKINSMKSALDVIVEIDLYKMEPWDIQARCKLGYEEQNEWYFFSHKDRKYPTGTRTNRATAAGFWKATGRDKAVLSKNSVIGMRKTLVYYKGRAPNGRKSDWIMHEYRLQNSELAPVQEEGWVVCRAFR

SEQ ID NO: 3575 - protein, 64 aa, Arabidopsis thaliana
  G2545,HB domain
MRKRRAGKLPGDTTTVLKNWWQQHCKWPYPTEDDKAKLVEETGLQLKQINNWFINQRKRNWHNN

SEQ ID NO: 3576 - protein, 61 aa, Arabidopsis thaliana
  G2548,HB domain
MLGEKKKRLQLEQVKALEKSFELGNKLEPERKIQLAKALGMQPRQIAIWFQNRRARWKTRQ

SEQ ID NO: 3577 - protein, 103 aa, Arabidopsis thaliana
  G256,MYB-(R1)R2R3 domain
KGPWTPEEDIILVSYIQQHGPGNWRSVPANTGLLRCSKSCRLRWTNYLRPGIKRGNFTQPEEKMIIHLQALLGNRWAAIASYLPQRTDNDIKNYWNTHLKKKL

SEQ ID NO: 3578 - protein, 77 aa, Arabidopsis thaliana
  G2572,1st AP2 domain
TSIYRGVTRHRWTGRYEAHLWDNSCRREGQARKGRQVYLGGYDKEDKAARAYDLAALKYWNATATTNFPITNYSKEV

SEQ ID NO: 3579 - protein, 69 aa, Arabidopsis thaliana
  G2572,2nd AP2 domain
ASIYRGVTRHHQQGRWQARIGRVAGNKDLYLGTFATEEEAAEAYDIAAIKFRGINAVTNFEMNRYDVEA

SEQ ID NO: 3580 - protein, 68 aa, Arabidopsis thaliana
  G2583,AP2 domain
SRKFRGVRQRQWGSWVSEIRHPLLKRRVWLGTFETAEAAARAYDQAALLMNGQNAKTNFPVVKSEEGS

SEQ ID NO: 3581 - protein, 58 aa, Arabidopsis thaliana
  G2587,WRKY domain
NDGFTWRKYGQKTIKASAHKRCYYRCTYAKDQNCNATKRVQKIKDNPPVYRTTYLGKH

SEQ ID NO: 3582 - protein, 70 aa, Arabidopsis thaliana
  G2629,bZIP domain
ERKQRRMISNRESARRSRMRKQRHLDELWSQVIRLRTDNHCLMDKLNRVSESHELALKENAKLKEETSDL

SEQ ID NO: 3583 - protein, 66 aa, Arabidopsis thaliana
  G2633,1st SCR domain
MHILYEVCPYFKFGYMSANGAIAEAMKEENRVHIIDFQIGQGSQWVTLIQAFAARPGGPPRIRITG

SEQ ID NO: 3584 - protein, 89 aa, Arabidopsis thaliana
  G2633,2nd SCR domain
FVLHHMPDESVSTENHRDRLLRMVKSLSPKVVTLVEQESNTNTAAFFPRFMETMNYYAAMFESIDVTLPRDHKQRINVEQHCLARDVVN

SEQ ID NO: 3585 - protein, 73 aa, Arabidopsis thaliana
  G2633,3rd SCR domain
CEGADRVERHELLGKWRSRFGMAGFTPYPLSPLVNSTIKSLLRNYSDKYRLEERDGALYLGWMHRDLVASCAW

SEQ ID NO: 3586 - protein, 154 aa, Arabidopsis thaliana
  G2635,NAC domain
VPPGFRFHPTDEELLHYYLKKKISYEKFEMEVIKEVDLNKIEPWDLQDRCKIGSTPQNEWYFFSHKDRKYPTGSRTNRATHSGFWKATGRDKCIRNSYKKIGMRKTLVFYKGRAPHGQKTDWIMHEYRIEDTEDDPCEDGWVVCRVFKKKNLFK

SEQ ID NO: 3587 - protein, 44 aa, Arabidopsis thaliana
  G2642,SRS domain
DFGNQAKKDCSHMRCRTCCKSRGFECSTHVRSTWVPATKRRERQ

SEQ ID NO: 3588 - protein, 43 aa, Arabidopsis thaliana
  G2689,MADS domain
MKTDWSHYLSVEMESTISNELSILCGAEVAFLGYSCSGKPYTF

SEQ ID NO: 3589 - protein, 68 aa, Arabidopsis thaliana
  G2698,1st SCR domain
YRSFSETSPFLQFVNFTANQSILESCNESGFDRIHIIDFDVGYGGQWSSLMQELASGVGGRRRNRASS

SEQ ID NO: 3590 - protein, 64 aa, Arabidopsis thaliana
  G2698,2nd SCR domain
ERSPPWRILFTQCGFSPASLSQMAEAQAECLLQRNPVRGFHVEKRQSSLVMCWQRKELVTVSAW

SEQ ID NO: 3591 - protein, 51 aa, Arabidopsis thaliana
  G2701,1st MYB-related domain
GSWTKEENKMFERALAIYAEDSPDRWFKVASMIPGKTVFDVMKQYSKLEED

SEQ ID NO: 3592 - protein, 49 aa, Arabidopsis thaliana
  G2701,2nd MYB-related domain
VPWTEEEHRRFLLGLLKYGKGDWRNISRNFVVSKTPTQVASHAQKYYQR

SEQ ID NO: 3593 - protein, 49 aa, Arabidopsis thaliana
  G2709,MYB-related domain
LKWTPEEETALKAGVLKHGTGKWRTILSDPVYSTILKSRSNVDLKDKWR

SEQ ID NO: 3594 - protein, 49 aa, Arabidopsis thaliana
  G2717,MYB-related domain
QKWTQEEESALKSGVIKHGPGKWRTILKDPEFSGVLYLRSNVDLKDKWR

SEQ ID NO: 3595 - protein, 45 aa, Arabidopsis thaliana
  G2718,MYB-related domain
IAMAQEEEDLICRMYKLVGERWDLIAGRIPGRTAEEIERFWVMKN

SEQ ID NO: 3596 - protein, 66 aa, Arabidopsis thaliana
  G2738,1st SCR domain
EMHFYESCPYLKFAHFTANQAILEAVTTARRVHVIDLGLNQGMQWPALMQALALRPGGPPSFRLTG

SEQ ID NO: 3597 - protein, 88 aa, Arabidopsis thaliana
  G2738,2nd SCR domain
VNSVFELHRLLARSGSIEKLLNTVKAIKPSIVTVVEQEANHNGIVFLDRFNEALHYYSSLFDSLEDSYSLPSQDRVMSEVYLGRQILN

SEQ ID NO: 3598 - protein, 75 aa, Arabidopsis thaliana
  G2738,3rd SCR domain
AEGSDRVERHETAAQWRIRMKSAGFDPIHLGSSAFKQASMLLSLYATGDGYRVEENDGCLMIGWQTRPLITTSAW

SEQ ID NO: 3599 - protein, 49 aa, Arabidopsis thaliana; identical to SEQ ID NO: 2748
  G2741,GARP domain

SEQ ID NO: 3600 - protein, 58 aa, Arabidopsis thaliana
  G2767,HLH/MYC domain
TKKRELSAQSIAARKRRRRITEKTQELGKLIPGSQKHNTAEMFNAAAKYVKFLQAQIE

SEQ ID NO: 3601 - protein, 63 aa, Arabidopsis thaliana
  G2781,DBP domain
AVASAATLVAAKCVEAAEIMGADREHLASVVSSAVNVRSAGDIMTLTAAAATALRGAAQLKAR

SEQ ID NO: 3602 - protein, 296 aa, Arabidopsis thaliana
  G2817,1st SWI/SNF domain
LIMPLLRYQKEFLAWATKQEQSVAGGILADEMGMGKTIQAISLVLARREVDRAQFGEAAGCTLVLCPLVAVSQWLNEIARFTSPGSTKVLVYHGAKRAKNIKEFMNYDFVLTTYSTVESEYRRNIMPSKVQCAYCSKSFYPKKLVIHLRYFCGPSAVKTAKQSKQKRKKTSDSSSQQGKEADAGEDKKLKKSKKKTKQTVEKDQLGSDDKEKSLLHSVKWNRIILDEAHYIKERRSNTARAVFALEATYRWALSGTPLQNRVGELYSLIRFLQIRPYSYYFCKDCDCRILDYFCLI

SEQ ID NO: 3603 - protein, 40 aa, Arabidopsis thaliana
  G2817,2nd SWI/SNF domain
TNQPMHFFDDIDILAVDHPYLVVYSNSSGANANLVDENKS

SEQ ID NO: 3604 - protein, 84 aa, Arabidopsis thaliana
  G2817,3rd SWI/SNF domain
TKADTEHKASKTTLKGFRASSILNRIKLDDFQTSTKIEALREEIRFMVERDGSAKAIVFSQFTSFLDLINYTLGKCGVSCVQLV

SEQ ID NO: 3605 - protein, 21 aa, Arabidopsis thaliana
  G2827,1st Z-C2H2 domain
CSVCGKSFPSYQALGGHKTSH

SEQ ID NO: 3606 - protein, 21 aa, Arabidopsis thaliana
  G2827,2nd Z-C2H2 domain
CSICFKSFPSGQALGGHKRCH

SEQ ID NO: 3607 - protein, 21 aa, Arabidopsis thaliana
  G2834,1st Z-C2H2 domain
CTICGKGFKRDANLRMHMRGH

SEQ ID NO: 3608 - protein, 22 aa, Arabidopsis thaliana
  G2834,2nd Z-C2H2 domain
CSRCHTKKFSVIADLKTHEKHC

SEQ ID NO: 3609 - protein, 27 aa, Arabidopsis thaliana
  G2839,1st Z-C2H2 domain
KRVFRCKTCLKEFSSFQALGGHRASHK

SEQ ID NO: 3610 - protein, 29 aa, Arabidopsis thaliana
  G2839,2nd Z-C2H2 domain
HPCPICGVEFPMGQALGGHMRRHRSEKAS

SEQ ID NO: 3611 - protein, 181 aa, Arabidopsis thaliana
  G2853,ACBF-like domain
LQNWMDEAYLNSAFTSAEEREIVSLKVIRNKHNGSSEGYGFVEFESHDVADKVLQEFNGAPMPNTDQPFRLNWASFSTGEKRLENNGPDLSIFVGDLAPDVSDALLHETFSEKYPSVKAAKVVLDANTGRSKGYGFVRFGDENERTKAMTEMNGVKCSSRAMRIGPATPRKTNGYQQQGGY

SEQ ID NO: 3612 - protein, 59 aa, Arabidopsis thaliana
  G2859,HLH/MYC domain
RRGQATDSHSIAERVRRGKINERLKCLQDIVPGCYKTMGMATMLDEIINYVQSLQNQVE

SEQ ID NO: 3613 - protein, 17 aa, Arabidopsis thaliana
  G2866,1st IAA domain
YVKVNMEGVPIGRKIDL

SEQ ID NO: 3614 - protein, 30 aa, Arabidopsis thaliana
  G2866,2nd IAA domain
YADKEGDWMMVGDVPWEMFLSSVRRLKISR

SEQ ID NO: 3615 - protein, 384 aa, Arabidopsis thaliana
  G2869,ARF domain
EQLWKLCAGPLCDIPKLGEKVYYFPQGHIELVSSLSLYSFSLLSLSLSLSLSLSLSLSLSLSPFSLFSLFSLSPLSLSLSLSLLLSHVEASTREELNELQPICDFPSKLQCRVIAIQLKVENNSDETYAEITLMPDTTQVVIPTQNQNQFRPLVNSFTKVLTASDTSVHGGFSVPKKHAIECLPPLDMSQPLPTQEILAIDLHGNQWRFRHIYRGTAQRHLLTIGWNAFTTSKKLVEGDVIVFVRGETGELRVGIRRAGHQQGNIPSSIVSIESMRHGIIASAKHAFDNQCMFIVVYKPRSSQFIVSYDKFLDVVNNKFNVGSRFTMRFEGDDFSERRSFGTIIGVSDFSPHWKCSEWRSLEVQWDEFASFPRPNQVSPWDIEH

SEQ ID NO: 3616 - protein, 328 aa, Arabidopsis thaliana
  G2870,ARF domain
EQLWKLCAGPLCDIPKLGEKVYYFPQGNIELVEASTREELNELQPICDLPSKLQCRVIAIHLKVENNSDETYAKITLMPDTTQVVIPTQNENQFRPLVNSFTKVLTASDISANGVFSVPKKHAIECLPPLDMSQPLPAQELLAIDLHGNQWSFRHSYRGTPQRHLLTTGWNEFTTSKKLVKGDVIVFVRGETGELRVGIRRARHQQGNIPSSIVSIDCMRHGVIASAKHAFDNQCMFIVVYKPRSSQFIVSYDKFLDAVNNKFNVGSRFTMRFEGDDLSERRYFGTIIGVSNFSPHWKCSDWRSLEVQWDEFASFLRPNKVSPWEIEH

SEQ ID NO: 3617 - protein, 21 aa, Arabidopsis thaliana
  G2888,1st Z-C2H2 domain
CEICNQGFQRDQNLQMHRRRH

SEQ ID NO: 3618 - protein, 21 aa, Arabidopsis thaliana
  G2888,2nd Z-C2H2 domain
CERCSKGYAVQSDYKAHLKTC

SEQ ID NO: 3619 - protein, 306 aa, Arabidopsis thaliana
  G289,1st SWI/SNF domain
LTVPLLRHQRIALSWMAQKETSGFPCSGGILADDQGLGKTVSTIALILKERSKPAQACEESTKKEIFDLESETGECAPLKPSGRSKHFEHSQLLSNENKVGGDSVGKVTGRPAAGTLVVCPTSVMRQWADELHKKVTSEANLSVLVYHGSSRTKDPHELAKYDVVVTTFSIVSMEVPKQPLVDDEDEEKDGVHDGGTAATGFCSNKKRKYPPDSKKKGSKKKKVEFLSGPLAKVSWFRVVLDEAQSIKNYKTQVARACWGLRAKRRWCLSGTPIQNSIDDLYSYFRFLKYDPYSSYVLFCSTIKNP

SEQ ID NO: 3620 - protein, 39 aa, Arabidopsis thaliana
  G289,2nd SWI/SNF domain
CGICNDAPEDAVASVCGHVFCKQCIYERLTGDSNHCPFA

SEQ ID NO: 3621 - protein, 84 aa, Arabidopsis thaliana
  G289,3rd SWI/SNF domain
NLLEASLVSSHIQYRRLDGTMSVAARDKAVQDFNTLPEVTVMIMSLKAASLGLNMVAACHVLMLDLWWNPTTEDQAIDRAHRIG

SEQ ID NO: 3622 - protein, 73 aa, Arabidopsis thaliana
  G2895,HMG domain
DPNQPKRPPSAFFVFLEDFRKEFNLANPNNKSVATVGKAAGARWKAMTDEDKAPYVAKAESRKTEYIKNVQQY

SEQ ID NO: 3623 - protein, 71 aa, Arabidopsis thaliana
  G2903,1st HMG domain
ETKRPSSSYVLWCKDQWTEVKKENPEADFKETSNILGAKWKSLSAEDKKPYEERYQVEKEAYLQVIAKEKR

SEQ ID NO: 3624 - protein, 70 aa, Arabidopsis thaliana
  G2903,2nd HMG domain
DPLKPKHPVSAFLVYANERRAALREENKSVVEVAKITGEEWKNLSDKKKAPYEKVAKKNKETYLQAMEEY

SEQ ID NO: 3625 - protein, 71 aa, Arabidopsis thaliana
  G2903,3rd HMG domain
KPKKPASSYFLFSKDERKKLTEERPGTNNATVTALISLKWKELSEEEKQVYNGKAAKLMEAYKKEVEAYNK

SEQ ID NO: 3626 - protein, 29 aa, Arabidopsis thaliana
  G291,MISC domain
GRLENVVGWYHSHPGYGCWLSGIDVSTQM

SEQ ID NO: 3627 - protein, 19 aa, Arabidopsis thaliana
  G2981,E2F domain
RRRVYDALNVLMAMDIISK

SEQ ID NO: 3628 - protein, 57 aa, Arabidopsis thaliana
  G2988,MADS domain
GTKRKIAIETIQKRDSLRVTCTKRRKGLYSKASQLCLLSDAQIAILATPPSSESDVS

SEQ ID NO: 3629 - protein, 54 aa, Arabidopsis thaliana
  G2994,1st ZF-HB domain
IKYKECLKNHAAAMGGNATDGCGEFMPSGEDGSIEALTCSACNCHRNFHRKEVE

SEQ ID NO: 3630 - protein, 64 aa, Arabidopsis thaliana
  G2994,2nd ZF-HB domain
KKRFRTKFTPEQKEKMLSFAEKVGWKIQRQEDCVVQRFCEEIGVKRRVLKVWMHNNKIHFSKKN

SEQ ID NO: 3631 - protein, 6 aa, Arabidopsis thaliana
  G3027,1st bZIP domain
PHPYMW

SEQ ID NO: 3632 - protein, 8 aa, Arabidopsis thaliana
  G3027,2nd bZIP domain
MMPPYGTP

SEQ ID NO: 3633 - protein, 4 aa, Arabidopsis thaliana
  G3027,3rd bZIP domain
YAHP

SEQ ID NO: 3634 - protein, 43 aa, Arabidopsis thaliana
  G3027,4th bZIP domain
QPWLQVSDEREIKRQRRKQSNRESARRSRLRKQAECDELAQRA

SEQ ID NO: 3635 - protein, 22 aa, Arabidopsis thaliana
  G3065,Z-C2H2 domain
CPHCKITAPGLKTMQIHHESKH

SEQ ID NO: 3636 - protein, 66 aa, Arabidopsis thaliana
  G307,1st SCR domain
QMHFYETCPYLKFAHFTANQAILEAFEGKKRVHVIDFSMNQGLQWPALMQALALREGGPPTFRLTG

SEQ ID NO: 3637 - protein, 86 aa, Arabidopsis thaliana
  G307,2nd SCR domain
VNSVFELHKLLGRPGGIEKVLGVVKQIKPVIFTVVEQESNHNGPVFLDRFTESLHYYSTLFDSLEGVPNSQDKVMSEVYLGKQICN

SEQ ID NO: 3638 - protein, 76 aa, Arabidopsis thaliana
  G307,3rd SCR domain
ACEGPDRVERHETLSQWGNRFGSSGLAPAHLGSNAFKQASMLLSVFNSGQGYRVEESNGCLMLGWHTRPLITTSAW

SEQ ID NO: 3639 - protein, 31 aa, Arabidopsis thaliana
  G3079,1st bZIP-ZW2 domain
YFAPSWNTPIENSMLWMGGCRPSSFIRLIYA

SEQ ID NO: 3640 - protein, 28 aa, Arabidopsis thaliana
  G3079,2nd bZIP-ZW2 domain
ADKLRFETLRKIVDVVTPLQAVEFLLAG

SEQ ID NO: 3641 - protein, 66 aa, Arabidopsis thaliana
  G308,1st SCR domain
QMHFYETCPYLKFAHFTANQAILEAFQGKKRVHVIDFSMSQGLQWPALMQALALRPGGPPVFRLTG

SEQ ID NO: 3642 - protein, 86 aa, Arabidopsis thaliana
  G308,2nd SCR domain
VNSVFELHKLLGRPGAIDKVLGVVNQIKPEIFTVVEQESNHNSPIFLDRFTESLHYYSTLFDSLEGVPSGQDKVMSEVYLGKQICN

SEQ ID NO: 3643 - protein, 76 aa, Arabidopsis thaliana
  G308,3rd SCR domain
ACDGPDRVERHETLSQWRNRFGSAGFAAAHIGSNAFKQASMLLALFNGGEGYRVEESDGCLMLGWHTRPLIATSAW

SEQ ID NO: 3644 - protein, 67 aa, Arabidopsis thaliana
  G312,1st SCR domain
YKTLNDACPYSKFAHLTANQAILEATEKSNKIHIVDFGIVQGIQWPALLQALATRTSGKPTQIRVSG

SEQ ID NO: 3645 - protein, 90 aa, Arabidopsis thaliana
  G312,2nd SCR domain
VNFMLQLYKLLDETPTIVDTALRLAKSLNPRVVTLGEYEVSLNRVGFANRVKNALQFYSAVFESLEPNLGRDSEERVRVERELFGRRISG

SEQ ID NO: 3646 - protein, 81 aa, Arabidopsis thaliana
  G312,3rd SCR domain
GLIGPEKTGIHRERMEEKEQWRVLMENAGFESVKLSNYAVSQAKILLWNYNYSNLYSIVESKPGFISLAWNDLPLLTLSSW

SEQ ID NO: 3647 - protein, 66 aa, Arabidopsis thaliana
  G313,1st SCR domain
MSVLYEICPYWKFAYTTANVEILEAIAGETRVHIIDFQIAQGSQYMFLIQELAKHPGGPPLLRVTG

SEQ ID NO: 3648 - protein, 89 aa, Arabidopsis thaliana
  G313,2nd SCR domain
YVLHHMPDESVSVENHRDRLLHLIKSLSPKLVTLVEQESNTNTSPFLSRFVETLDYYTAMFESIDAARPRDDKQRISAEQHCVARDIVN

SEQ ID NO: 3649 - protein, 68 aa, Arabidopsis thaliana
  G314,SCR domain
LAEFVDLTPWHRFGFIAANAAILDAVEGYSSVHIVDLSLTHCMQIPTLIDSMANKLHKKPPPLLKLTV

SEQ ID NO: 3650 - protein, 68 aa, Medicago truncatula
  G3362,AP2 domain
HPVYRGVRKRDSGKWVCEVREPNKKTRIWLGTFPTPEMAARAHDVAAIALRGRSACLNFADSAWKLPV

SEQ ID NO: 3651 - protein, 64 aa, Medicago truncatula
  G3364,AP2 domain
HPVYRGVRKRNLDKWVCEMREPNTKTRIWLGTFPTAEMAARAHDVAAMALRGRYACLNFADSVW

SEQ ID NO: 3652 - protein, 68 aa, Medicago truncatula
  G3365,AP2 domain
HPVYRGVRRRNNNNNKWVCEVRVPNDKSTRIWLGTYPTPEMAARAHDVAALALRGKSACLNFADSAWR

SEQ ID NO: 3653 - protein, 65 aa, Medicago truncatula
  G3366,AP2 domain
RHPVYRGVRKRNLDKWVCEMREPNKKTKIWLGTFPTAEMAARAHDVAAMALRGRYACLNFADSAW

SEQ ID NO: 3654 - protein, 64 aa, Medicago truncatula
  G3367,AP2 domain
HPVYRGVRKRNLNKWVCEMREPNTKNRIWLGTFPTAEMAARAHDVAAIALRGRYACLNFADSVW

SEQ ID NO: 3655 - protein, 70 aa, Medicago truncatula
  G3368,AP2 domain
HPVYRGVRRRKNNKWVCEMRVPNNIVNKNNKSRIWLGTYPTPEMAARAHDVAALTLKGKSACLNFADSAW

SEQ ID NO: 3656 - protein, 64 aa, Medicago truncatula
  G3369,AP2 domain
HPVYRGVRKRNLDKWVCEMREPNKKTKIWLGTFPTAEMAARAHDVAAMALRGRYACLNFADSAW

SEQ ID NO: 3657 - protein, 71 aa, Oryza sativa (indica cultivar-group)
  G3370,AP2 domain
RHPVYRGVRRRGGRPGAAGRWVCEVRVPGARGSRLWLGTFATAEAAARAHDAAALALRGRAACLNFADSAW

SEQ ID NO: 3658 - protein, 67 aa, Oryza sativa (indica cultivar-group)
  G3371,AP2 domain
RHLVFRGVRWRGCAGRWVCKVRVPGSRGDRFWIGTSDTAEETARTHDAAMLALCGASASLNFADSAW

SEQ ID NO: 3659 - protein, 66 aa, Oryza sativa (japonica cultivar-group)
  G3372,AP2 domain
RHPVYRGVRRRGPAGRWVCEVREPNKKSRIWLGTFATAEAAARAHDVAALALRGRGACLNFADSAR

SEQ ID NO: 3660 - protein, 67 aa, Oryza sativa (japonica cultivar-group)
  G3373,AP2 domain
RHPVYRGVRARAGGSRWVCEVREPQAQARIWLGTYPTPEMAARAHDVAAIALRGERGAELNFPDSPS

SEQ ID NO: 3661 - protein, 68 aa, Oryza sativa (indica cultivar-group)
  G3374,AP2 domain
RHPVFRGVRRRGRAGRWVCEVRVPGRRGCRLWLGTFDAADAAARAHDAAMLALRGRAAACLNFADSAW

SEQ ID NO: 3662 - protein, 65 aa, Oryza sativa (japonica cultivar-group)
  G3375,AP2 domain
RHPVYKGVRSRNPGRWVCEVREPHGKQRIWLGTFETAEMAARAHDVAAMALRGRAACLNFADSPR

SEQ ID NO: 3663 - protein, 65 aa, Oryza sativa (indica cultivar-group)
  G3376,AP2 domain
RHPVFKGVRRRNPGRWVCEVREPHGKQRIWLGTFETAEMAARAHDVAALALRGRAACLNFADSPR

SEQ ID NO: 3664 - protein, 67 aa, Oryza sativa (japonica cultivar-group)
  G3377,AP2 domain
RHPVFRGVRRRGRAGRWVCEVRVPGSRGDRLWVGTFDTAEEAARAHDAAMLALCGASASLNFADSAW

SEQ ID NO: 3665 - protein, 72 aa, Oryza sativa (indica cultivar-group)
  G3378,AP2 domain
RHPVYRGVRRRGGAGRWVCEVRVPGKRGARLWLGTYVTAEAAARAHDAAMIALRGGAGGGGAACLNFQDSAW

SEQ ID NO: 3666 - protein, 73 aa, Oryza sativa (japonica cultivar-group)
  G3379,AP2 domain
RHPVFRGVRRRGNAGRWVCEVRVPGRRGCRLWLGTFDTAEGAARAHDAAMLAINAGGGGGGGACCLNFADSAW

SEQ ID NO: 3667 - protein, 65 aa, Oryza sativa (japonica cultivar-group)
  G3380,AP2 domain
ETTKYRGVRRRPSGKFAAEIRDSSRQSVRVWLGTFDTAEEAARAYDRAAYAMRGHLAVLNFPAEA

SEQ ID NO: 3668 - protein, 65 aa, Oryza sativa (japonica cultivar-group)
  G3381,AP2 domain
LVAKYRGVRRRPWGKFAAEIRDSSRHGVRVWLGTFDTAEEAARAYDRSAYSMRGANAVLNFPADA

SEQ ID NO: 3669 - protein, 65 aa, Oryza sativa (japonica cultivar-group)
  G3383,AP2 domain
TATKYRGVRRRPWGKFAAEIRDPERGGARVWLGTFDTAEEAARAYDRAAYAQRGAAAVLNFPAAA

SEQ ID NO: 3670 - protein, 105 aa, Oryza sativa (japonica cultivar-group)
  G3384,MYB-(R1)R2R3 domain
KGPWTPEEDLMLVSYIQEHGAGNWRAVPTNTGLMRCSKSCRLRWTNYLRPGIKRGNFTEQEEKLIVHLQALLGNRWAAIASYLPERTDNDIKNYWNTHLKKKLKK

SEQ ID NO: 3671 - protein, 105 aa, Oryza sativa (japonica cultivar-group)
  G3385,MYB-(R1)R2R3 domain
KGPWTPEEDMVLASYVQEHGPGNWRAVPPRTGLLRCSKSCRLRWTNYLRPGIRRGGFSHHEERLILHLQALLGNRWAAIASYLPHRTDNDVKNFWNTHLKKKLAL

SEQ ID NO: 3672 - protein, 105 aa, Oryza sativa (japonica cultivar-group)
  G3386,MYB-(R1)R2R3 domain
KGPWTPEEDLVLVSYVQEHGPGNWRAVPTRTGLMRCSKSCRLRWTNYLRPGIKRGNFTDQEEKLIVHLQALLGNRWAAIASYLPERTDNDIKNYWNTHLKRKLQG

SEQ ID NO: 3673 - protein, 64 aa, Oryza sativa (japonica cultivar-group)
  G3388,1st AP2 domain
SSRYKGVVPQPNGRWGAQIYERHARVWLGTFPDEEAAARAYDVAALRYRGRDAATNFPGAAASA

SEQ ID NO: 3674 - protein, 94 aa, Oryza sativa (japonica cultivar-group)
  G3388,2nd AP2 domain
LFEKAVTPSDVGKLNRLVVPKQHAEKHFPLRRAASSDSASAAATGKGVLLNFEDGEGKVWRFRYSYWNSSQSYVLTKGWSRFVREKGLRAGDTI

SEQ ID NO: 3675 - protein, 66 aa, Oryza sativa (japonica cultivar-group)
  G3389,1st AP2 domain
SSRYKGVVPQPNGRWGAQIYERHARVWLGTFPDEEAAARAYDVAALRFRGRDAVTNRAPAAEGASA

SEQ ID NO: 3676 - protein, 90 aa, Oryza sativa (japonica cultivar-group)
  G3389,2nd AP2 domain
LFEKAVTPSDVGKLNRLVVPKQQAERHFPFPLRRHSSDAAGKGVLLNFEDGDGKVWRFRYSYWNSSQSYVLTKGWSRFVREKGLRPGDTV

SEQ ID NO: 3677 - protein, 66 aa, Oryza sativa (japonica cultivar-group)
  G3390,1st AP2 domain
SSKYKGVVPQPNGRWGAQIYERHQRVWLGTFTGEAEAARAYDVAAQRFRGRDAVTNFRPLAESDPE

SEQ ID NO: 3678 - protein, 103 aa, Oryza sativa (japonica cultivar-group)
  G3390,2nd AP2 domain
LFDKTVTPSDVGKLNRLVIPKQHAEKHFPLQLPPPTTTSSVAAAADAAAGGGDCKGVLLNFEDAAGKVWKFRYSYWNSSQSYVLTKGWSRFVKEKGLHAGDAV

SEQ ID NO: 3679 - protein, 70 aa, Oryza sativa (japonica cultivar-group)
  G3391,1st AP2 domain
SSKFKGVVPQPNGRWGAQIYERHQRVWLGTFAGEDDAARAYDVAAQRFRGRDAVTNFRPLAEADPDAAAE

SEQ ID NO: 3680 - protein, 86 aa, Oryza sativa (japonica cultivar-group)
  G3391,2nd AP2 domain
LFDKTVTPSDVGKLNRLVIPKQHAEKHFPLQLPSAGGESKGVLLNFEDAAGKVWRFRYSYWNSSQSYVLTKGWSRFVKEKGLHADG

SEQ ID NO: 3681 - protein, 45 aa, Oryza sativa (japonica cultivar-group)
  G3392,MYB-related domain
VHFTEEEEDIVFRMHRLVGNRWELIAGRIPGRTAEEVEKFWAIKH

SEQ ID NO: 3682 - protein, 45 aa, Oryza sativa (japonica cultivar-group)
  G3393,MYB-related domain
VHFTEEEEDLVFRMHRLVGNRWELIAGRIPGRTAKEVEMFWAVKH

SEQ ID NO: 3683 - protein, 89 aa, Oryza sativa (indica cultivar-group)
  G3394,CAAT domain
RQDRFLPIANISRIMKKAIPANGKIAKDAKETVQECVSEFISFITSEASDKCQREKRKTINGDDLLWAMATLGFEDYIEPLKVYLQKYR

SEQ ID NO: 3684 - protein, 90 aa, Oryza sativa (japonica cultivar-group)
  G3395,CAAT domain
REQDRFLPIANISRIMKKAVPANGKIAKDAKETLQECVSEFISFVTSEASDKCQKEKRKTINGEDLLFAMGTLGFEEYVDPLKIYLHKYR

SEQ ID NO: 3685 - protein, 90 aa, Oryza sativa (japonica cultivar-group)
  G3396,CAAT domain
KEQDRFLPIANIGRIMRRAVPENGKIAKDSKESVQECVSEFISFITSEASDKCLKEKRKTINGDDLIWSMGTLGFEDYVEPLKLYLRLYR

SEQ ID NO: 3686 - protein, 90 aa, Oryza sativa (japonica cultivar-group)
  G3397,CAAT domain
REQDRFLPIANVSRIMKKALPANAKISKDAKETVQECVSEFISFITGEASDKCQREKRKTINGDDLLWAMTTLGFEDYVDPLKHYLHKFR

SEQ ID NO: 3687 - protein, 90 aa, Oryza sativa (japonica cultivar-group)
  G3398,CAAT domain
REQDRFLPIANVSRIMKRALPANAKISKDAKETVQECVSEFISFITGEASDKCQREKRKTINGDDLLWAMTTLGFEDYIDPLKLYLHKFR

SEQ ID NO: 3688 - protein, 9 aa, Oryza sativa (japonica cultivar-group)
  G3399,1st AT-hook domain
RRPRGRPPG

SEQ ID NO: 3689 - protein, 146 aa, Oryza sativa (japonica cultivar-group)
  G3399,2nd AT-hook domain
SKNKPKPPIIVTRDSPNALHSHVLEVAGGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEG

SEQ ID NO: 3690 - protein, 9 aa, Oryza sativa (japonica cultivar-group)
  G3400,1st AT-hook domain
RRPRGRPLG

SEQ ID NO: 3691 - protein, 146 aa, Oryza sativa (japonica cultivar-group)
  G3400,2nd AT-hook domain
SKNKPKPPIIVTRDSPNAFHSHVLEVAAGTDIVECVCEFARRRGRGVSVLSGGGAVANVALRQPGASPPGSLVATMRGQFEILSLTGTVLPPPAPPSASGLTVFLSGGQGQVVGGSVAGQLIAAGPVFLMAASFANAVYERLPLDG

SEQ ID NO: 3692 - protein, 9 aa, Oryza sativa (japonica cultivar-group)
  G3406,1st AT-hook domain
RRPRGRPPG

SEQ ID NO: 3693 - protein, 142 aa, Oryza sativa (japonica cultivar-group)
  G3406,2nd AT-hook domain
SKNKPKPPVIITRESANTLRAHILEVGSGCDVFECVSTYARRRQRGVCVLSGSGVVTNVTLRQPSAPAGAVVSLHGRFEILSLSGSFLPPPAPPGATSLTIFLAGGQGQVVGGNVVGALYAAGPVIVIAASFANVAYERLPL

SEQ ID NO: 3694 - protein, 9 aa, Oryza sativa (japonica cultivar-group)
  G3407,1st AT-hook domain
RRPRGRPPG

SEQ ID NO: 3695 - protein, 149 aa, Oryza sativa (japonica cultivar-group)
  G3407,2nd AT-hook domain
SKNKPKPPVIITRESANALRAHILEVAAGCDVFEALTAYARRRQRGVCVLSAAGTVANVTLRQPQSAQPGPASPAVATLHGRFEILSLAGSFLPPPAPPGATSLAAFLAGGQGQVVGGSVAGALIAAGPVVVVAASFSNVAYERLPLED

SEQ ID NO: 3696 - protein, 85 aa, Oryza sativa (japonica cultivar-group)
  G3429,CAAT domain
ELPMANLVRLIKKVLPGKAKIGGAAKGLTHDCAVEFVGFVGDEASEKAKAEHRRTVAPEDYLGSFGDLGFDRYVDPMDAYIHGYR

SEQ ID NO: 3697 - protein, 65 aa, Oryza sativa (japonica cultivar-group)
  G3430,AP2 domain
RGKHYRGVRQRPWGKFAAEIRDPAKNGARVWLGTFDSAEEAAVAYDRAAYRMRGSRALLNFPLRI

SEQ ID NO: 3698 - protein, 45 aa, Zea mays
  G3431,MYB-related domain
VDFTEAEEDLVSRMHRLVGNRWEIIAGRIPGRTAEEVEMFWSKKY

SEQ ID NO: 3699 - protein, 66 aa, Zea mays
  G3432,1st AP2 domain
SSRYKGVVPQPNGRWGAQIYERHQRVWLGTFAGEADAARAYDVAAQRFRGRDAVTNFRPLADADPD

SEQ ID NO: 3700 - protein, 88 aa, Zea mays
  G3432,2nd AP2 domain
LFDKTVTPSDVGKLNRLVIPKQHAEKHFPLQLPSAGGESKGVLLNLEDAAGKVWRFRYSYWNSSQSYVLTKGWSRFVKEKGLQAGDVV

SEQ ID NO: 3701 - protein, 72 aa, Zea mays
  G3433,1st AP2 domain
SSRYKGVVPQPNGRWGAQIYERHLRVWLGTFTGEAEAARAYDVAAQRFRGRDAVTNFRPLAESDLDPDAAAE

SEQ ID NO: 3702 - protein, 82 aa, Zea mays
  G3433,2nd AP2 domain
MFDKVLTPSDVGKLNRLVVPKQHAERFFPAAGAGSTQLCFQDRGGALWQFRYSYWGSSQSYVMTKGWSRFVRAARLAAGDTV

SEQ ID NO: 3703 - protein, 90 aa, Zea mays
  G3434,CAAT domain
REQDRFLPIANISRIMKKAVPANGKIAKDAKETLQECVSEFISFVTSEASDKCQKEKRKTINGDDLLWAMATLGFEEYVEPLKIYLQKYK

SEQ ID NO: 3704 - protein, 90 aa, Zea mays
  G3435,CAAT domain
REQDRFLPIANVSRIMKKALPANAKISKDAKETVQECVSEFISFITGEASDKCQREKRKTINGDDLLWAMTTLGFEDYVEPLKHYLHKFR

SEQ ID NO: 3705 - protein, 90 aa, Zea mays
  G3436,CAAT domain
REQDRFLPIANVSRIMKKALPANAKISKDAKETVQECVSEFISFITGEASDKCQREKRKTINGDDLLWAMTTLGFEDYVEPLKLYLHKFR

SEQ ID NO: 3706 - protein, 90 aa, Zea mays
  G3437,CAAT domain
KEQDRFLPIANVSRIMKRSLPANAKISKEAKETVQECVSEFISFVTGEASDKCQREKRKTINGDDLLWAMTTLGFEAYVAPLKSYLNRYR

SEQ ID NO: 3707 - protein, 67 aa, Zea mays
  G3438,AP2 domain
RHPVFRGVRRRGAAGRWVCEVRVPGRRGARLWLGTYLGAEAAARAHDAAMLALGRGAACLNFPDSAW

SEQ ID NO: 3708 - protein, 70 aa, Zea mays
  G3439,AP2 domain
HPVFRGVRRRGAAGRWVCEVRVPGRRGARLWLGTYLGAEAAARAHDAAMLALGRGAACLNFPDSAWLLAV

SEQ ID NO: 3709 - protein, 68 aa, Zea mays
  G3440,AP2 domain
RHPVFRGVRRRGSAGRWVCEVRVPGRRGCRLWLGTFDTAEAAARAHDAAMLALAGAGACCLNFADSAW

SEQ ID NO: 3710 - protein, 66 aa, Zea mays
  G3441,AP2 domain
RHPVYRGVRRRGPAGRWVCEVREPNKKSRIWLGTFATPEAAARAHDVAALALRGRAACLNFADSAR

SEQ ID NO: 3711 - protein, 67 aa, Zea mays
  G3442,AP2 domain
HPVFRGVRRRGAAGRWVCEVRVPGRRGARLWLGTYLAAEAAARAHDAAILALQGRGAGRLNFPDSAR

SEQ ID NO: 3712 - protein, 64 aa, Zea mays
  G3443,AP2 domain
TKFRETRHPVFRGVRRRGSAGRWVCEVRVPGRRGCRLWLGTFDAAEAAARAHDAAMLAIAGASA

SEQ ID NO: 3713 - protein, 45 aa, Zea mays; identical to SEQ ID NO: 3698
  G3444,MYB-related domain

SEQ ID NO: 3714 - protein, 45 aa, Glycine max
  G3445,MYB-related domain
VEFSEAEEILIAMVYNLVGERWSLIAGRIPGRTAEEIEKYWTSRF

SEQ ID NO: 3715 - protein, 45 aa, Glycine max; identical to SEQ ID NO: 3714
  G3446,MYB-related domain

SEQ ID NO: 3716 - protein, 45 aa, Glycine max; identical to SEQ ID NO: 3714
  G3447,MYB-related domain

SEQ ID NO: 3717 - protein, 45 aa, Glycine max
  G3448,MYB-related domain
VEFSEDEETLIIRMYKLVGERWSIIAGRIPGRTAEEIEKYWTSRF

SEQ ID NO: 3718 - protein, 45 aa, Glycine max
  G3449,MYB-related domain
VEFSEDEETLIIRMYKLVGERWSLIAGRIPGRTAEEIEKYWTSRF

SEQ ID NO: 3719 - protein, 45 aa, Glycine max
  G3450,MYB-related domain
IHMSEQEEDLIRRMYKLVGDKWNLIAGRIPGRKAEEIERFWIMRH

SEQ ID NO: 3720 - protein, 62 aa, Glycine max
  G3451,1st AP2 domain
SSKYKGVVPQPNGRWGAQIYEKHQRVWLGTFNEEDEAARAYDIAAQRFRGKDAVTNFKPLAG

SEQ ID NO: 3721 - protein, 100 aa, Glycine max
  G3451,2nd AP2 domain
LFEKAVTPSDVGKLNRLVIPKQHAEKHFPLQSSNGVSATTIAAVTATPTAAKGVLLNFEDVGGKVWRFRYSYWNSSQSYVLTKGWSRFVKEKNLKAGDTV

SEQ ID NO: 3722 - protein, 66 aa, Glycine max
  G3452,1st AP2 domain
SSKYKGVVPQPNGRWGAQIYEKHQRVWLGTFNEEDEAARAYDIAALRFRGPDAVTNFKPPAASDDA

SEQ ID NO: 3723 - protein, 96 aa, Glycine max
  G3452,2nd AP2 domain
LFEKTVTPSDVGKLNRLVIPKQHAEKHFPLSGSGDESSPCVAGASAAKGMLLNFEDVGGKVWRFRYSYWNSSQSYVLTKGWSRFVKEKNLRAGDAV

SEQ ID NO: 3724 - protein, 66 aa, Glycine max
  G3453,1st AP2 domain
SSKYKGVVPQPNGRWGAQIYEKHQRVWLGTFNEEDEAVRAYDIVAHRFRGRDAVTNFKPLAGADDA

SEQ ID NO: 3725 - protein, 96 aa, Glycine max
  G3453,2nd AP2 domain
LVEKTVTPSDVGKLNRLVIPKQHAEKHFPLSGSGGGALPCMAAAAGAKGMLLNFEDVGGKVWRFRYSYWNSSQSYVLTKGWSRFVKEKNLRAGDAV

SEQ ID NO: 3726 - protein, 68 aa, Glycine max
  G3454,1st AP2 domain
SSKYKGVVPQPNGRWGSQIYEKHQRVWLGTFNEEDEAARAYDVAVQRFRGKDSVTNFKPLAGADDDDG

SEQ ID NO: 3727 - protein, 100 aa, Glycine max
  G3454,2nd AP2 domain
LFEKAVTPSDVWKLNRLVIPKQHAEKHFPLQSSNGVSATTIAAVTATPTAAKGVLLNFEDVGGKVWRFRYSYWNSSQSYVLTKGWSRFVKEKNLKAGDTV

SEQ ID NO: 3728 - protein, 70 aa, Glycine max
  G3455,1st AP2 domain
SSKYKGVVPQPNGRWGSQIYEKHQRVWLGTFNEEDEAARAYDVAVQRFRGKDAVTNFKPLSGTDDDDGES

SEQ ID NO: 3729 - protein, 100 aa, Glycine max
  G3455,2nd AP2 domain
REQLFQKAVTPSDVGKLNRLVIPKQHAEKHFPLQSAANGVSATATAAKGVLLNFEDVGGKVWRFRYSYWNSSQSYVLTKGWSRFVKEKNLKAGDTVCFQR

SEQ ID NO: 3730 - protein, 9 aa, Glycine max
  G3457,1st AT-hook domain
RRPRGRPAG

SEQ ID NO: 3731 - protein, 143 aa, Glycine max
  G3457,2nd AT-hook domain
SKNKPKPPIIITRDSANALRSHVMEIANGCDIMESITAFARRRQRGVCVLSGSGTVTNVTLRQPASPGAVVTLHGRFEILSLSGSFLPPPAPPAASGLAIYLAGGQGQVVGGSVVGPLVASGPVVIMAASFGNAAYERLPLEE

SEQ ID NO: 3732 - protein, 9 aa, Glycine max
  G3458,1st AT-hook domain
RRPRGRPPG

SEQ ID NO: 3733 - protein, 143 aa, Glycine max
  G3458,2nd AT-hook domain
SKNKPKPPVIITRESANTLRAHILEVSSGCDVFESVATYARKRQRGICVLSGSGTVTNVTLRQPAAAGAVVTLHGRFEILSLSGSFLPPPAPPGATSLTVFLGGGQGQVVGGNVVGPLVASGPVIVIASSFTNVAYERLPLDE

SEQ ID NO: 3734 - protein, 9 aa, Glycine max
  G3459,1st AT-hook domain
RRPRGRPPG

SEQ ID NO: 3735 - protein, 143 aa, Glycine max
  G3459,2nd AT-hook domain
SKNKPKPPVIITRESANTLRAHILEVGSGSDVFDCVTAYARRRQRGICVLSGSGTVTNVSLRQPAAAGAVVTLHGRFEILSLSGSFLPPPAPPGATSLTIYLAGGQGQVVGGNVIGELTAAGPVIVIAASFTNVAYERLPLEE

SEQ ID NO: 3736 - protein, 9 aa, Glycine max
  G3460,1st AT-hook domain
RRPRGRPSG

SEQ ID NO: 3737 - protein, 143 aa, Glycine max
  G3460,2nd AT-hook domain
SKNKPKPPVIITRESANTLRAHILEVGSGSDVFDCVTAYARRRQRGICVLSGSGTVTNVSLRQPAAAGAVVRLHGRFEILSLSGSFLPPPAPPGATSLTIYLAGGQGQVVGGNVVGELTAAGPVIVIAASFTNVAYERLPLEE

SEQ ID NO: 3738 - protein, 66 aa, Glycine max
  G3463,AP2 domain
RHPVYRGVRRRNNNKWVCEVRVPNDKSTRIWLGTYPVPEMAARAHDVAALALRGKSACLNFADSAW

SEQ ID NO: 3739 - protein, 65 aa, Glycine max
  G3464,AP2 domain
RHPVYRGVRRRDSGKWVCEVREPNKKSRIWLGTFPTAEMAARAHDVAAIALRGRSACLNFADSAS

SEQ ID NO: 3740 - protein, 65 aa, Glycine max
  G3465,AP2 domain
RHPVYRGVRRRNSDKWVCEVREPNKKTRIWLGTFPTPEMAARAHDVAAMALRGRYACLNFADSAW

SEQ ID NO: 3741 - protein, 65 aa, Glycine max
  G3466,AP2 domain
RHPVYRGVRRRNTDKWVSEVREPNKKTRIWLGTFPTPEMAARAHDVAAMALRGRYACLNFADSTW

SEQ ID NO: 3742 - protein, 64 aa, Glycine max
  G3467,AP2 domain
HPVYRGVRRRNKNKWVCEMRVPNNNSRIWLGTYPTPEMAARAHDVAALALRGKSACLNFADSRW

SEQ ID NO: 3743 - protein, 66 aa, Glycine max
  G3468,AP2 domain
RHPVYRGVRRRNNNKWVCEVRVPNDKSTRIWLGTYPTPEMAARAHDVAALSLRGKSACLNFADSAW

SEQ ID NO: 3744 - protein, 64 aa, Glycine max
  G3469,AP2 domain
HPVYKGVRQRNGKWVSELRQPNNKNARVWLGTFAHPDMAAIAYDVAALAFKGDSASLNFPNAAT

SEQ ID NO: 3745 - protein, 90 aa, Glycine max
  G3470,CAAT domain
REQDRYLPIANISRIMKKALPPNGKIAKDAKDTMQECVSEFISFITSEASEKCQKEKRKTINGDDLLWAMATLGFEDYIEPLKVYLARYR

SEQ ID NO: 3746 - protein, 90 aa, Glycine max; identical to SEQ ID NO: 3745
  G3471,CAAT domain

SEQ ID NO: 3747 - protein, 90 aa, Glycine max
  G3472,CAAT domain
REQDRFLPIANVSRIMKKALPANAKISKEAKETVQECVSEFISFITGEASDKCQKEKRKTINGDDLLWAMTTLGFEEYVEPLKVYLHKYR

SEQ ID NO: 3748 - protein, 91 aa, Glycine max
  G3473,CAAT domain
REQDRFLPIANVSRIMKKALPANAKISKDAKETVQECVSEFISFHSPGGLAGECQKEKRKTINGDDLLWAMTTLGFEEYVEPLKVYLHKYR

SEQ ID NO: 3749 - protein, 90 aa, Glycine max
  G3474,CAAT domain
REQDRFLPIANVSRIMKKALPANAKISKEAKETVQECVSEFISFITGEASDKCQKEKRKTINGDDLLWAMTTLGFEDYVDPLKIYLHKYR

SEQ ID NO: 3750 - protein, 90 aa, Glycine max
  G3475,CAAT domain
REQDRFLPIANVSRIMKKALPANAKISKDAKETVQECVSEFISFITGEASDKCQREKRKTINGDDLLWAMTTLGFEDYVEPLKGYLQRFR

SEQ ID NO: 3751 - protein, 90 aa, Glycine max
  G3476,CAAT domain
REQDRFLPIANVSRIMKKALPANAKISKDAKETVQECVSEFISFITGEASDKCQREKRKTINGDDLLWAMTTLGFEEYVEPLKIYLQRFR

SEQ ID NO: 3752 - protein, 90 aa, Glycine max; identical to SEQ ID NO: 3750
  G3478,CAAT domain

SEQ ID NO: 3753 - protein, 56 aa, Oryza sativa (japonica cultivar-group)
  G3479,MADS domain
GRGKIVIRRIDNSTSRQVTFSKRRNGIFKKAKELAILCDAEVGLVIFSSTGRLYEY

SEQ ID NO: 3754 - protein, 56 aa, Oryza sativa (japonica cultivar-group)
  G3480,MADS domain
GRGKIVIRRIDNSTSRQVTFSKRRNGIFKKAKELAILCDAEVGLMIFSSTGRLYEY

SEQ ID NO: 3755 - protein, 56 aa, Oryza sativa (japonica cultivar-group)
  G3481,MADS domain
GRGKIVIRRIDNSTSRQVTFSKRRNGLLKKAKELSILCDAEVGLVVFSSTGRLYEF

SEQ ID NO: 3756 - protein, 56 aa, Oryza sativa (japonica cultivar-group)
  G3482,MADS domain
RGKGCWSKGEEGQEEKIKIKERMEERKRCSVSRESSFCTSDTHAIGIFLAHFRTTQ

SEQ ID NO: 3757 - protein, 56 aa, Oryza sativa (japonica cultivar-group)
  G3483,MADS domain
GRGKIEIKRIDNATSRQVTFSKRRSGLFKKARELSILCDAEVGLLVFSSTSRLYDF

SEQ ID NO: 3758 - protein, 56 aa, Glycine max
  G3484,MADS domain
GRGKIAIRRIDNSTSRQVTFSKRRNGLLKKARELSILCDAEVGLMVFSSTGKLYDY

SEQ ID NO: 3759 - protein, 56 aa, Glycine max
  G3485,MADS domain
GRGKIVIRRIDNSTSRQVTFSKRRNGLLKKAKELAILCDAEVGVMIFSSTGKLYDF

SEQ ID NO: 3760 - protein, 56 aa, Zea mays
  G3487,MADS domain
GRGKIEIKRIDNATSRQVTFSKRRGGLFKKAKELAILCDAEVGLVVFSSTGRLYHF

SEQ ID NO: 3761 - protein, 56 aa, Zea mays
  G3488,MADS domain
GRGKIVIRRIDNSTSRQVTFSKRRNGIFKKARELAILCDAEVGLVIFSSTGRLYEY

SEQ ID NO: 3762 - protein, 56 aa, Zea mays; identical to SEQ ID NO: 3753
  G3489,MADS domain

SEQ ID NO: 3763 - protein, 61 aa, Zea mays
  G3490,HB domain
PHRAKKLRLSKEQSRLLEESFRLNHTLTPKQKEALAVKLKLRPRQVEVWFQNRRARTKLKQ

SEQ ID NO: 3764 - protein, 93 aa, Oryza sativa (japonica cultivar-group)
  G3491,HS domain
FLMKTYEMVDDPATDAVVSWGPGNNSFVVWNTPEFARDLLPKYFKHSNFSSFVRQLNTYGFRKVDPDRWEFANEGFLRGQKHLLKTINRRKPT

SEQ ID NO: 3765 - protein, 92 aa, Glycine max
  G3494,HS domain
PFLSKTYDMVDDPSTDLVVSWGENNNSFVVWNVPQFATDILPNHFKHNNFSSFVRQLNTYGFRKVDPDRWEFANEGFLRGEKQLLKSISRRK

SEQ ID NO: 3766 - protein, 92 aa, Glycine max; identical to SEQ ID NO: 3765
  G3495,HS domain

SEQ ID NO: 3767 - protein, 64 aa, Medicago sativa
  G3497,AP2 domain
HPVYRGVRKRNLDKWVCEMREPNTKTRIWLGTFPTAEMAAQAHDVAAMALRGRYACVNFADSVW

SEQ ID NO: 3768 - protein, 65 aa, Medicago sativa
  G3498,AP2 domain
RHPVYRGVRKRNLDKWVCEMREPNMKTRIWLGTFPTADMAARAHDVAAKALRGRYACLNFAYSVW

SEQ ID NO: 3769 - protein, 66 aa, Medicago sativa
  G3499,AP2 domain
RHPVYRGVRRRNNNKWVCEVRVPNDKSTRIWLGTYPTPEMAARAHDVAALALRGKSACLNFANSAW

SEQ ID NO: 3770 - protein, 105 aa, Solanum lycopersicum
  G3500,MYB-(R1)R2R3 domain
KGPWTPEEDIMLVSYVQQHGPGNWRALPTKTGLRRCSKSCRLRWTNYLRPGIKRGNFTDQEEKMIIQLQALLGNKWAAIASYLPERTDNDIKNYWNTHLKKKMKR

SEQ ID NO: 3771 - protein, 105 aa, Solanum lycopersicum
  G3501,MYB-(R1)R2R3 domain
KGPWTPEEDIILVSYIQEHGPGNWRNIPTNTGLLRCSKSCRLRWTNYLRPGIKRGNFTEHEEKMIIHLQALLGNRWAAIASYLPQRTDNDIKNYWNTHLKKKLNN

SEQ ID NO: 3772 - protein, 106 aa, Oryza sativa (japonica cultivar-group)
  G3502,MYB-(R1)R2R3 domain
KGPWTPEEDLMLVAYVQEHGPGNWRAVPTNTGLMRCSKSCRLRWTNYLRPGIKRGNFTDQEEKLIVHLQALLGNRRWAAIASYLPERTDNDIKNYWNTHLKKKLKK

SEQ ID NO: 3773 - protein, 103 aa, Oryza sativa (japonica cultivar-group)
  G3503,MYB-(R1)R2R3 domain
KGAWTKEEDDRLIAYIKAHGEGCWRSLPKAAGLLRCGKSCRLRWINYLRPDLKRGNFTEEEDELIIKLHSLLGNKWSLIAGRLPGRTDNEIKNYWNTHIRRKL

SEQ ID NO: 3774 - protein, 103 aa, Oryza sativa (japonica cultivar-group)
  G3504,MYB-(R1)R2R3 domain
KGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKL

SEQ ID NO: 3775 - protein, 103 aa, Oryza sativa (japonica cultivar-group)
  G3505,MYB-(R1)R2R3 domain
KGAWTKEEDQRLIAYIRAHGEGCWRSLPKAAGLLRCGKSCRLRWMNYLRPDLKRGNFTDDEDELIIRLHSLLGNKWSLIAGQLPGRTDNEIKNYWNTHIKRKL

SEQ ID NO: 3776 - protein, 103 aa, Oryza sativa (japonica cultivar-group)
  G3506,MYB-(R1)R2R3 domain
KGAWTKEEDQRLIAYIKAHGEGCWRSLPKAAGLLRCGKSCRLRWMNYLRPDLKRGNFTDDDDELIIKLHALLGNKWSLIAGQLPGRTDNEIKNYWNTHIKRKL

SEQ ID NO: 3777 - protein, 103 aa, Oryza sativa (japonica cultivar-group)
  G3507,MYB-(R1)R2R3 domain
KGAWTKEEDQRLIAHINQHGEGCWRSLPKAAGLLRCGKSCRLRWINYLRPDLKRGNFTDEEDELIIKLHELLGNKWSLIAGRLPGRTDNEIKNYWNTHIKRKL

SEQ ID NO: 3778 - protein, 103 aa, Oryza sativa (japonica cultivar-group)
  G3508,MYB-(R1)R2R3 domain
KGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKL

SEQ ID NO: 3779 - protein, 103 aa, Solanum lycopersicum
  G3509,MYB-(R1)R2R3 domain
KGAWTKEEDERLISYIRAHGEGCWRSLPKAAGLLRCGKSCRLRWINYLRPDLKRGNFTEEEDELIIKLHSLLGNKWSLIAGRLPGRTDNEIKNYWNTHIRRKL

SEQ ID NO: 3780 - protein, 61 aa, Oryza sativa (japonica cultivar-group)
  G3510,HB domain
PHRPKKLRLSKEQSRLLEESFRLNHTLTPKQKEALAIKLKLRPRQVEVWFQNRRARTKLKQ

SEQ ID NO: 3781 - protein, 92 aa, Glycine max
  G3512,HS domain
PFLSKTYDMVDDPSTDSVVSWGKNNNTFVVWNVPQFTTDILPKHFKHNNFSSFVRQLNTYGFRKVDPDRWEFANEGFLRGEKQLLKSISRRK

SEQ ID NO: 3782 - protein, 65 aa, Oryza sativa (japonica cultivar-group)
  G3515,AP2 domain
SSSSYRGVRKRPWGKFAAEIRDPERGGARVWLGTFDTAEEAARAYDRAAFAMKGATAMLNFPGDH

SEQ ID NO: 3783 - protein, 65 aa, Zea mays
  G3516,AP2 domain
KEGKYRGVRKRPWGKFAAEIRDPERGGSRVWLGTFDTAEEAARAYDRAAFAMKGATAVLNFPASG

SEQ ID NO: 3784 - protein, 65 aa, Zea mays
  G3517,AP2 domain
EPTKYRGVRRRPWGKYAAEIRDSSRHGVRIWLGTFDTAEEAARAYDRSANSMRGANAVLNFPEDA

SEQ ID NO: 3785 - protein, 65 aa, Glycine max
  G3518,AP2 domain
VEVRYRGIRRRPWGKFAAEIRDPTRKGTRIWLGTFDTAEQAARAYDAAAFHFRGHRAILNFPNEY

SEQ ID NO: 3786 - protein, 65 aa, Glycine max
  G3519,AP2 domain
CEVRYRGIRRRPWGKFAAEIRDPTRKGTRIWLGTFDTAEQAARAYDAAAFHFRGHRAILNFPNEY

SEQ ID NO: 3787 - protein, 65 aa, Glycine max
  G3520,AP2 domain
EEPRYRGVRRRPWGKFAAEIRDPARHGARVWLGTFLTAEEAARAYDRAAYEMRGALAVLNFPNEY

SEQ ID NO: 3788 - protein, 61 aa, Glycine max
  G3524,HB domain
GEPPRKKLRLTKEQSRLLEESFRQNHTLNPKQKESLAMQLKLRPRQVEVWFQNRRARSKLK

SEQ ID NO: 3789 - protein, 105 aa, Glycine max
  G3527,MYB-(R1)R2R3 domain
NKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLL

SEQ ID NO: 3790 - protein, 105 aa, Glycine max; identical to SEQ ID NO: 3789
  G3528,MYB-(R1)R2R3 domain

SEQ ID NO: 3791 - protein, 103 aa, Glycine max
  G3529,MYB-(R1)R2R3 domain
KGAWTKEEDHRLISYIRAHGEGCWRSLPKAAGLLRCGKSCRLRWINYLRPDLKRGNFSLEEDQLIIKLHSLLGNKWSLIAGRLPGRTDNEIKNYWNTHIRRKL

SEQ ID NO: 3792 - protein, 21 aa, Arabidopsis thaliana
  G353,1st Z-C2H2 domain
CKTCLKQFHSFQALGGHRASH

SEQ ID NO: 3793 - protein, 21 aa, Arabidopsis thaliana
  G353,2nd Z-C2H2 domain
CPICGVEFPMGQALGGHMRRH

SEQ ID NO: 3794 - protein, 103 aa, Zea mays
  G3531,MYB-(R1)R2R3 domain
KGAWTKEEDDRLVAYIKAHGEGCWRSLPKAAGLVRCGKSCRLRWINYLRPDLKRGNFTEEEDELIIKLHSLLGNKWSLIAGRLPGRTDNEIKNYWNTHIRRKL

SEQ ID NO: 3795 - protein, 103 aa, Zea mays
  G3532,MYB-(R1)R2R3 domain
KGAWTKEEDERLVAHIRAHGEGCWRSLPKAAGLLRCGKSCRLRWINYLRPDLKRGNFTEEEDELIVKLHSVLGNKWSLIAGRLPGRTDNEIKNYWNTHIRRKL

SEQ ID NO: 3796 - protein, 103 aa, Zea mays; identical to SEQ ID NO: 3795
  G3533,MYB-(R1)R2R3 domain

SEQ ID NO: 3797 - protein, 103 aa, Zea mays
  G3534,MYB-(R1)R2R3 domain
RGAWTKEEDERLVAYVRAHGEGCWRSLPRAAGLLRCGKSCRLRWINYLRPDLKRGNFTADEDDLIVKLHSLLGNKWSLIAARLPGRTDNEIKNYWNTHVRRKL

SEQ ID NO: 3798 - protein, 105 aa, Glycine max
  G3537,MYB-(R1)R2R3 domain
KGPWTPEEDIILVSYIQEHGPGNWRAVPAKTGLSRCSKSCRLRWTNYLRPGIKRGNFTEQEEKMIIHLQDLLGNRWAAIASYLPQRTDNDIKNYWNTHLRKKLKK

SEQ ID NO: 3799 - protein, 105 aa, Glycine max
  G3538,MYB-(R1)R2R3 domain
KGPWTPEEDIILVSYIQEHGPGNWKAVPANTGLSRCSKSCRLRWTNYLRPGIKRGNFTDQEEKMIIHLQALLGNRWAAIAAYLPQRTDNDIKNYWNTYLKKKLNK

SEQ ID NO: 3800 - protein, 105 aa, Glycine max; identical to SEQ ID NO: 3798
  G3539,MYB-(R1)R2R3 domain

SEQ ID NO: 3801 - protein, 105 aa, Zea mays
  G3540,MYB-(R1)R2R3 domain
KGPWTPEEDLMLVSYVQEHGPGNWRAVPTNTGLMRCSKSCRLRWTNYLRPGIKRGNFTEQEEKLIVHLQALLGNRWAAIASYLPKRTDNDIKNYWNTHLKKKLKN

SEQ ID NO: 3802 - protein, 105 aa, Zea mays
  G3541,MYB-(R1)R2R3 domain
KGPWTPEEDIVLVSYVQEHGPGNWRAVPVSTGLMRCSKSCRLRWTNYLRPGIRRGNFTPHEEGIIVHLQALLGNRWAAIASYLPQRTDNDIKNYWNTHLKKKLRK

SEQ ID NO: 3803 - protein, 97 aa, Oryza sativa (japonica cultivar-group)
  G3542,CAAT domain
EEIEQTTDFKNHSLPLARIKKIMKADEDVRMISAEAPVVFAKACEVFILELTLRSWMHTEENKRRTLQKNDIAAAITRTDIYDFLVDIVPRDEMKEE

SEQ ID NO: 3804 - protein, 99 aa, Oryza sativa (japonica cultivar-group)
  G3543,CAAT domain
QEAERASASDFKNHQLPLARIKKIMKADEDVRMISAEAPVLFAKACELFILELTIRSWLHAEENKRRTLQRNDVAAAIARTDVFDFLVDIVPREEAKEE

SEQ ID NO: 3805 - protein, 97 aa, Oryza sativa (japonica cultivar-group)
  G3544,CAAT domain
VDIEQTTDFKNHSLPLARIKKIMKADEDVRMISAEAPVIFAKACEIFILELTLRSWMHTEENKRRTLQKNDIAAAITRTDMYDFLVDIVPRDDLKEE

SEQ ID NO: 3806 - protein, 101 aa, Oryza sativa (japonica cultivar-group)
  G3545,CAAT domain
EVEQMTEFKLPNLPLARIKKIMKADEDVKMIAGEAPALFAKACEMFILDMTLRSWQHTEEGRRRTLQRSDVEAVIKKTDIFDFLVDIITDDKMKDDGMGSQ

SEQ ID NO: 3807 - protein, 97 aa, Glycine max
  G3547,CAAT domain
QEIEKVTDFKNHSLPLARIKKIMKADEDVRMISAEAPVIFARACEMFILELTLRSWNHTEENKRRTLQKNDIAAAITRTDIFDFLVDIVPREDLKDE

SEQ ID NO: 3808 - protein, 97 aa, Glycine max
  G3549,CAAT domain
QEIEQTIDFKNHSLPLARIKKIMKADEDVRMISAEAPVIFAKACEMFILELTLRSWIHTEENKRRTLQKNDIAAAISRNDVFDFLVDIIPRDELKEE

SEQ ID NO: 3809 - protein, 97 aa, Glycine max; identical to SEQ ID NO: 3808
  G3550,CAAT domain

SEQ ID NO: 3810 - protein, 101 aa, Zea mays
  G3551,CAAT domain
TEIEATTDFKNHNLPLARIKKIMKADEDVRMISAEAPVVFAKACEIFILELTLRSWMHTEVNKRRTLQKNDIAAAITRTDIYDFLVDIVPRDEMKEDGIGL

SEQ ID NO: 3811 - protein, 97 aa, Zea mays
  G3552,CAAT domain
TEIEATTDFKNHNLPLARIKKIMKADEDVRMISAEAPVVFAKACEIFILELTLRSWMHTEENKRRTLQKNDIAAAITRTDIYDFLVDIVPRDEMKED

SEQ ID NO: 3812 - protein, 97 aa, Solanum lycopersicum
  G3553,CAAT domain
QEIEHVTDFKNHSLPLARIKKIMKADEDVRMISAEAPVVFARACEMFILELTLRAWNHTEENKRRTLQKNDIAAAITRTDIFDFLVDIVPREDLKDE

SEQ ID NO: 3813 - protein, 97 aa, Solanum lycopersicum; identical to SEQ ID NO: 3812
  G3554,CAAT domain

SEQ ID NO: 3814 - protein, 97 aa, Solanum lycopersicum
  G3555,CAAT domain
QEIEQVNDFKNHQLPLARIKKIMKADEDVRMISAEAPVLFAKACELFILELTIRSWLHAEENKRRTLQKNDIAAAITRTDIFDFLVDIVPRDEIKDE

SEQ ID NO: 3815 - protein, 21 aa, Arabidopsis thaliana
  G361,Z-C2H2 domain
CQYCCREFANSQALGGHQNAH

SEQ ID NO: 3816 - protein, 66 aa, Glycine max
  G3643,AP2 domain
TNNKLKGVRRRKWGKWVSEIRVPGTQERLWLGTYATPEAAAVAHDVAVYCLSRPSSLDKLNFPETL

SEQ ID NO: 3817 - protein, 71 aa, Oryza sativa (japonica cultivar-group)
  G3644,AP2 domain
ERCRYRGVRRRRWGKWVSEIRVPGTRERLWLGSYATPEAAAVAHDTAVYFLRGGAGDGGGGGATLNFPERA

SEQ ID NO: 3818 - protein, 66 aa, Brassica rapa subsp. Pekinensis
  G3645,AP2 domain
TQSKYKGIRRRKWGKWVSEIRVPGTRDRLWLGSFSTAEGAAVAHDVAFYCLHQPNSLESLNFPHLL

SEQ ID NO: 3819 - protein, 68 aa, Brassica oleracea
  G3646,AP2 domain
HQAKYKGIRRRKWGKWVSEIRVPATRERLWLGSFSTAEGAAVAHDVAFYCLHRPSSLDNEAFNFPHLL

SEQ ID NO: 3820 - protein, 66 aa, Zinnia elegans
  G3647,AP2 domain
SQKTYKGVRCRRWGKWVSEIRVPGSRERLWLGTYSTPEGAAVAHDVASYCLKGNTSFHKLNIPSML

SEQ ID NO: 3821 - protein, 73 aa, Oryza sativa (japonica cultivar-group)
  G3649,AP2 domain
EMMRYRGVRRRRWGKWVSEIRVPGTRERLWLGSYATAEAAAVAHDAAVCLLRLGGGRRAAAGGGGGLNFPARA

SEQ ID NO: 3822 - protein, 65 aa, Zea mays
  G3650,AP2 domain
RRCRYRGVRRRAWGKWVSEIRVPGTRERLWLGSYAAPEAAAVAHDAAACLLRGCAGRRLNFPGRA

SEQ ID NO: 3823 - protein, 71 aa, Oryza sativa (japonica cultivar-group)
  G3651,AP2 domain
ERCRYRGVRRRRWGKWVSEIRVPGTRERLWLGSYATPEAAAVAHDTAVYFLRGGAGDGGGGGATAQLPGAR

SEQ ID NO: 3824 - protein, 64 aa, Zea mays
  G3656,AP2 domain
RRQYRGVRMRKWGKWVAEIREPHKRTRPRLRSYATAVAAARAYDTAVFYLPGPSARLNFPEEIP

SEQ ID NO: 3825 - protein, 65 aa, Brassica oleracea
  G3659,AP2 domain
KGKHYRGVRQRPWGKFAAEIRDPAKNGARVWLGTFETAEDAALAYDRAAFRMRGSRALLNFPLRV

SEQ ID NO: 3826 - protein, 65 aa, Brassica oleracea
  G3660,AP2 domain
KGKHYRGVRQRPWGKFAAEIRDPAKKGAREWLGTFETAEDAALAYDRAAFRMRGSRALLNFPLRV

SEQ ID NO: 3827 - protein, 65 aa, Zea mays
  G3661,AP2 domain
RGKHYRGVRQRPWGKFAAEIRDPARNGARVWLGTYDTAEDAALAYDRAAYRMRGSRALLNFPLRI

SEQ ID NO: 3828 - protein, 54 aa, Lotus corniculatus var. japonicus
  G3663,1st ZF-HB domain
IRYRECLRNHAARLGSHVTDGCGEFMPNGEQGTPESLICAACECHRNFHRKEAQ

SEQ ID NO: 3829 - protein, 64 aa, Lotus corniculatus var. japonicus
  G3663,2nd ZF-HB domain
KKRFRTKFTQQQKDRMMEFAEKLGWKIQKQDEEEVKQFCSHVGVKRQAFKVWMHNSKQAMKKKQ

SEQ ID NO: 3830 - protein, 56 aa, Zea mays
  G3680,1st ZF-HB domain
PLYRECLKNHAASLGGHAVDGCGEFMPSPGANPADPTSLKCAACGCHRNFHRRTLE

SEQ ID NO: 3831 - protein, 64 aa, Zea mays
  G3680,2nd ZF-HB domain
RKRFRTKFTAEQKQRMQELSERLGWRLQKRDEAIVDEWCRDIGVGKGVFKVWMHNNKHNFLGGH

SEQ ID NO: 3832 - protein, 56 aa, Zea mays
  G3681,1st ZF-HB domain
PLYRECLKNHAASLGGHAVDGCGEFMPSPGANPADPTSLKCAACGCHRNFHRRTVE

SEQ ID NO: 3833 - protein, 64 aa, Zea mays
  G3681,2nd ZF-HB domain
RKRFRTKFTAEQKQRMQELSERLGWRLQKRDEAVVDEWCRDMGVGKGVFKVWMHNNKHNFLGGH

SEQ ID NO: 3834 - protein, 56 aa, Oryza sativa (japonica cultivar-group)
  G3691,1st ZF-HB domain
TVYRECLKNHAASLGGHALDGCGEFMPSPAANPADPTSLRCAACGCHRNFHRRLPE

SEQ ID NO: 3835 - protein, 64 aa, Oryza sativa (japonica cultivar-group)
  G3691,2nd ZF-HB domain
RKRFRTKFTAEQKQRMQELSERLGWRLQKRDEAIVDEWCRDIGVGKGVFKVWMHNNKHNYLGGH

SEQ ID NO: 3836 - protein, 21 aa, Arabidopsis thaliana
  G370,Z-C2H2 domain
CHYCFRNFPTSQALGGHQNAH

SEQ ID NO: 3837 - protein, 65 aa, Glycine max
  G3717,AP2 domain
KGKHYRGVRQRPWGKFAAEIRDPAKNGARVWLGTFETAEDAALAYDRAAYRMRGSRALLNFPLRV

SEQ ID NO: 3838 - protein, 65 aa, Glycine max
  G3718,AP2 domain
KGKHYRGVRQRPWGKFAAEIRDPAKNGARVWLGTFETAEDAALAYDRAAYRMRGSRALLNFPLRI

SEQ ID NO: 3839 - protein, 57 aa, Zea mays
  G3719,WRKY domain
DDGFKWRKYGKKTVKSSPNPRNYYRCSAEGCGVKKRVERDSDDPRYVVTTYDGVHNH

SEQ ID NO: 3840 - protein, 57 aa, Zea mays
  G3720,WRKY domain
DDGYKWRKYGKKSVKNSPNPRNYYRCSTEGCNVKKRVERDKDDPSYVVTTYEGMHNH

SEQ ID NO: 3841 - protein, 57 aa, Oryza sativa (japonica cultivar-group)
  G3721,WRKY domain
DDGFKWRKYGKKAVKNSPNPRNYYRCSTEGCNVKKRVERDREDHRYVITTYDGVHNH

SEQ ID NO: 3842 - protein, 57 aa, Zea mays
  G3722,WRKY domain
DDGYKWRKYGKKSVKNSPNPRNYYRCSTEGCNVKKRVERDRDDPRYVVTMYEGVHNH

SEQ ID NO: 3843 - protein, 57 aa, Glycine max
  G3723,WRKY domain
DDGYKWRKYGKKTVKSSPNPRNYYKCSGEGCDVKKRVERDRDDSNYVLTTYDGVHNH

SEQ ID NO: 3844 - protein, 57 aa, Glycine max
  G3724,WRKY domain
DDGYKWRKYGKKSVKSSPNLRNYYKCSSGGCSVKKRVERDRDDYSYVITTYEGVHNH

SEQ ID NO: 3845 - protein, 57 aa, Oryza sativa (japonica cultivar-group)
  G3725,WRKY domain
DDGYKWRKYGKKSVKNSPNPRNYYRCSTEGCNVKKRVERDKNDPRYVVTMYEGIHNH

SEQ ID NO: 3846 - protein, 57 aa, Oryza sativa (japonica cultivar-group)
  G3726,WRKY domain
DDGYKWRKYGKKSVKNSPNPRNYYRCSTEGCNVKKRVERDKDDPSYVVTTYEGTHNH

SEQ ID NO: 3847 - protein, 57 aa, Zea mays
  G3727,WRKY domain
DDGFKWRKYGKKAVKSSPNPRNYYRCSSEGCGVKKRVERDRDDPRYVITTYDGVHNH

SEQ ID NO: 3848 - protein, 57 aa, Zea mays
  G3728,WRKY domain
DDGFKWRKYGKKAVKNSPNPRNYYRCSSEGCGVKKRVERDRDDPRYVITTYDGVHNH

SEQ ID NO: 3849 - protein, 57 aa, Oryza sativa (japonica cultivar-group)
  G3729,WRKY domain
DDGYRWRKYGKKMVKNSPNPRNYYRCSSEGCRVKKRVERARDDARFVVTTYDGVHNH

SEQ ID NO: 3850 - protein, 57 aa, Oryza sativa (japonica cultivar-group)
  G3730,WRKY domain
DDGFKWRKYGKKAVKSSPNPRNYYRCSAAGCGVKKRVERDGDDPRYVVTTYDGVHNH

SEQ ID NO: 3851 - protein, 57 aa, Solanum lycopersicum
  G3731,WRKY domain
DDGFKCRKYGKKMVKNNPNPRNYYKCSSGGCNVKKRVERDNKDSSYVITTYEGIHNH

SEQ ID NO: 3852 - protein, 57 aa, Solanum tuberosum
  G3732,WRKY domain
DDGFKWRKYGKKMVKNSSNPRNYYKCSSGGCNVKKRVERDNEDSSYVITTYEGIHNH

SEQ ID NO: 3853 - protein, 57 aa, Hordeum vulgare
  G3733,WRKY domain
DDGYKWRKYGKKSVKNSPNPRNYYRCSTEGCSVKKRVERDRDDPAYVVTTYEGTHSH

SEQ ID NO: 3854 - protein, 65 aa, Medicago truncatula
  G3735,AP2 domain
DQIKYRGIRRRPWGKFAAEIRDPTRKGTRIWLGTFDTAEQAARAYDAAAFHFRGHRAILNFPNEY

SEQ ID NO: 3855 - protein, 65 aa, Triticum aestivum
  G3736,AP2 domain
EPTKYRGVRRRPWGKFAAEIRDSSRHGVRMWLGTFDTAEEAAAAYDRSAYSMRGRNAVLNFPDRA

SEQ ID NO: 3856 - protein, 65 aa, Oryza sativa (japonica cultivar-group)
  G3737,AP2 domain
AASKYRGVRRRPWGKFAAEIRDPERGGSRVWLGTFDTAEEAARAYDRAAFAMKGAMAVLNFPGRT

SEQ ID NO: 3857 - protein, 65 aa, Zea mays
  G3739,AP2 domain
EPTKYRGVRRRPWGKYAAEIRDSSRHGVRIWLGTFDTAEEAARAYDRSAYSMRGANAVLNFPEDA

SEQ ID NO: 3858 - protein, 59 aa, Oryza sativa (japonica cultivar-group)
  G3740,HLH/MYC domain
KRGCATHPRSIAERERRTRISEKLRKLQELVPNMDKQTSTADMLDLAVEHIKGLQSQLQ

SEQ ID NO: 3859 - protein, 59 aa, Oryza sativa (japonica cultivar-group)
  G3741,HLH/MYC domain
KRGCATHPRSIAERERRTRISEKLRKLQALVPNMDKQTSTSDMLDLAVDHIKGLQSQLQ

SEQ ID NO: 3860 - protein, 58 aa, Oryza sativa (japonica cultivar-group)
  G3748,HLH/MYC domain
HGGSGGAGQPPFGQLRRERIAERMKSLQELVPNANKTDKASMLDEIIDYVKFLQLQVK

SEQ ID NO: 3861 - protein, 57 aa, Oryza sativa (japonica cultivar-group)
  G3749,HLH/MYC domain
FSPPFFIASMPCCLRRERIAERMKALQELVPNANKTDKASMLDEIIDYVKFLQLQVK

SEQ ID NO: 3862 - protein, 58 aa, Oryza sativa (japonica cultivar-group)
  G3750,HLH/MYC domain
RRGQATDPHSIAERLRRERIAERMRALQELVPNTNKTDRAAMLDEILDYVKFLRLQVK

SEQ ID NO: 3863 - protein, 58 aa, Oryza sativa (japonica cultivar-group)
  G3751,HLH/MYC domain
RRGQATDPHSIAERLRREKISDRMKDLQELVPNSNKTNKASMLDEIIDYVKFLQLQVK

SEQ ID NO: 3864 - protein, 58 aa, Oryza sativa (japonica cultivar-group)
  G3752,HLH/MYC domain
RRGQATDPHSIAERLRREKISERMKNLQVLVPNSNKADKASMLDEIIDYVKFLQLQVK

SEQ ID NO: 3865 - protein, 58 aa, Zea mays
  G3753,HLH/MYC domain
RRGQATDPHSIAERLRREKISDRMKNLQDLVPNSNKADKASMLDEIIDYVKFLQLQVK

SEQ ID NO: 3866 - protein, 58 aa, Zea mays
  G3760,HLH/MYC domain
RRGQATDPHSIAERLRRERIAERMKALQELVPNANKTDKASMLDEIVDYVKFLQLQVK

SEQ ID NO: 3867 - protein, 59 aa, Glycine max
  G3763,HLH/MYC domain
KRGFATHPRSIAERERRTRISARIKKLQDLFPKSDKQTSTADMLDLAVEYIKDLQKQVK

SEQ ID NO: 3868 - protein, 59 aa, Glycine max
  G3764,HLH/MYC domain
KRGFATHPRSIAERVRRTRISERIKKLQDLFPKSEKQTSTADMLDLAVEYIKDLQQKVK

SEQ ID NO: 3869 - protein, 59 aa, Glycine max
  G3772,HLH/MYC domain
KRGCATHPRSIAERERRTRISGKLKKLQDLVPNMDKQTSYADMLDLAVQHIKGLQTQVQ

SEQ ID NO: 3870 - protein, 58 aa, Glycine max
  G3774,HLH/MYC domain
RRGQATDPHSIAERLRRERIAERMKALQELVPNANKTDKASMLDEIIDYVKFLQLQVK

SEQ ID NO: 3871 - protein, 65 aa, Zea mays
  G3794,AP2 domain
EPTKYRGVRRRPSGKFAAEIRDSSRQSVRMWLGTFDTAEEAARAYDRAAYAMRGQIAVLNFPAEA

SEQ ID NO: 3872 - protein, 57 aa, Capsicum annuum
  G3795,WRKY domain
DDGYKWRKYGKKMVKNSPNPRNYYRCSVEGCPVKKRVERDKEDSRYVITTYEGVHNH

SEQ ID NO: 3873 - protein, 57 aa, Lactuca sativa
  G3797,WRKY domain
DDGFKWRKYGKKMVKNSPNPRNYYRCSAAGCSVKKRVERDVEDARYVITTYEGIHNH

SEQ ID NO: 3874 - protein, 68 aa, Arabidopsis thaliana
  G38,AP2 domain
RCSFRGVRQRIWGKWVAEIREPNRGSRLWLGTFPTAQEAASAYDEAAKAMYGPLARLNFPRSDASEVT

SEQ ID NO: 3875 - protein, 57 aa, Sorghum bicolor; identical to SEQ ID NO: 3848
  G3802,WRKY domain

SEQ ID NO: 3876 - protein, 57 aa, Glycine max
  G3803,WRKY domain
DDGYKWRKYGKKTVKNNPNPRNYYKCSGEGCNVKKRVERDRDDSNYVLTTYDGVHNH

SEQ ID NO: 3877 - protein, 57 aa, Zea mays; identical to SEQ ID NO: 3848
  G3804,WRKY domain

SEQ ID NO: 3878 - protein, 65 aa, Oryza sativa (japonica cultivar-group)
  G3815,1st SCR domain
LLYEICPFFKFGYMSANGAIAEAIKGENFVHIIDFQIAQGSQWMTLIQALAARPGGPPFLRITGI

SEQ ID NO: 3879 - protein, 74 aa, Oryza sativa (japonica cultivar-group)
  G3815,2nd SCR domain
HRDRILRMVKSLSPRLVTLVEQESNTNTRPFFPRYLETLDYYTAMFESIDVALPRDDKRRMSAEQHCVARDIVN

SEQ ID NO: 3880 - protein, 73 aa, Oryza sativa (japonica cultivar-group)
  G3815,3rd SCR domain
CEGAERVERHEVFGKWKARLTMAGFRPYPLSSVVNSTIKTLLHTYNSFYRLEERDGVLYLGWKNRVLVVSSAW

SEQ ID NO: 3881 - protein, 67 aa, Triticum aestivum
  G3816,1st SCR domain
HAHFYESCPYLKFAHFTANQAILEAFAGCRRVHVVDFGIKQGMQWPALLQALALRPGGPPSFRLTGV

SEQ ID NO: 3882 - protein, 95 aa, Triticum aestivum
  G3816,2nd SCR domain
LLAQPGALEKVLGTVRAVRPRIVTVVEQEANHNSGTFLDRFTESLHYYSTMFDSLEGGSSGGGPSEVSSGAAAAPAAAGTDQVMSEVYLGRQICN

SEQ ID NO: 3883 - protein, 75 aa, Triticum aestivum
  G3816,3rd SCR domain
CEGAERTERHETLGQWRNRLGNAGFETVHLGSNAYKQASTLLALFAGGDGYKVEEKEGCLTLGWHTRPLIATSAW

SEQ ID NO: 3884 - protein, 67 aa, Oryza sativa (japonica cultivar-group)
  G3817,1st SCR domain
HAHFYESCPYLKFAHFTANQAILEAFAGCHRVHVVDFGIKQGMQWPALLQALALRPGGPPSFRLTGV

SEQ ID NO: 3885 - protein, 56 aa, Oryza sativa (japonica cultivar-group)
  G3817,2nd SCR domain
SFLDRFTESLHYYSTMFDSLEGGSSGQAELSPPAAGGGGGTDQVMSEVYLGRQICN

SEQ ID NO: 3886 - protein, 75 aa, Oryza sativa (japonica cultivar-group)
  G3817,3rd SCR domain
CEGAERTERHETLGQWRNRLGRAGFEPVHLGSNAYKQASTLLALFAGGDGYRVEEKEGCLTLGWHTRPLIATSAW

SEQ ID NO: 3887 - protein, 67 aa, Glycine max
  G3818,1st SCR domain
YHHYYEACPYLKFAHFTANQAILEAFNGHDCVHVIDFNLMQGLQWPALIQALALRPGGPPLLRLTGI

SEQ ID NO: 3888 - protein, 66 aa, Glycine max
  G3818,2nd SCR domain
LGWIRSLNPKIISVVEQEANHNQDRFLERFTEALHYYSTVFDSLEACPVEPDKALAEMYLQREICN

SEQ ID NO: 3889 - protein, 74 aa, Glycine max
  G3818,3rd SCR domain
SEGPARVERHEPLAKWRERLEKAGFKPLHLGSNAYKQASMLLTLFSAEGYSVEENQGCLTLGWHSRPLIAASAW

SEQ ID NO: 3890 - protein, 72 aa, Oryza sativa (japonica cultivar-group)
  G3819,1st SCR domain
LALAYELCPYLRFAHFVANACMLEAFEGESNVHVVDLGMTLGLDRGHQWRGLLDGLAARASGKPARVRVTGV

SEQ ID NO: 3891 - protein, 82 aa, Oryza sativa (japonica cultivar-group)
  G3819,2nd SCR domain
SVVKESRGALNSVLQTIRKLSPRAFVLVEQDAGHNGPFFLGRFMEALHYYAALFDALDAALPRYDARRARVEQFHFGAEIRN

SEQ ID NO: 3892 - protein, 73 aa, Oryza sativa (japonica cultivar-group)
  G3819,3rd SCR domain
CEGAARVERHERADQWRRRMSRAGFQSVPIKMAAKAREWLDENAGGGGYTVAEEKGCLVLGWKGKPVIAASCW

SEQ ID NO: 3893 - protein, 67 aa, Pisum sativum
  G3821,1st SCR domain
FQVFNGISPFVKFSHFTANQAIQEAFEREERVHIIDLDIMQGLQWPGLFHILASRPGGPPYVRLTGL

SEQ ID NO: 3894 - protein, 75 aa, Pisum sativum
  G3821,2nd SCR domain
TGSDTNTLWLLQRLAPKVVTVVEQDLSNAGSFLGRFVEAIHYYSALFDSLGSSYGEESEERHVVEQQLLSREIRN

SEQ ID NO: 3895 - protein, 73 aa, Pisum sativum
  G3821,3rd SCR domain
VGGPSRSGEIKFHNWREKLQQCGFRGVSLAGNAATQASLLLGMFPSEGYTLVEDNGILKLGWKDLCLLTASAW

SEQ ID NO: 3896 - protein, 67 aa, Zea mays
  G3822,1st SCR domain
FQVFNGISPFVKFSHFTANQAIQEAFEREERVHIIDLDIMQGLQWPGLFHILASRPGGPPRVRLTGL

SEQ ID NO: 3897 - protein, 89 aa, Zea mays
  G3822,2nd SCR domain
AVAVHWLHHSLYDVTGSDSNTLWLIQRLAPKVVTMVEQDLSHSGSFLARFVEAIHYYSALFDSLDASYGEDSPERHVVEQQLLSREIRN

SEQ ID NO: 3898 - protein, 73 aa, Zea mays
  G3822,3rd SCR domain
VGGPARTGDVKFGSWREKLAQSGFRAASLAGSAAAQASLLLGMFPSDGYTLVEENGALKLGWKDLCLLTASAW

SEQ ID NO: 3899 - protein, 67 aa, Solanum lycopersicum
  G3825,1st SCR domain
MYILYEICPYLKFGYMAANGAIVEACRNEDRIHIIDFQIAQGTQWMTLLQALAARPGGAPYVRITGI

SEQ ID NO: 3900 - protein, 41 aa, Solanum lycopersicum
  G3825,2nd SCR domain
RFVEALDYYHAMFESIDVTLLRDMKERINVEQHCLARDIVN

SEQ ID NO: 3901 - protein, 73 aa, Solanum lycopersicum
  G3825,3rd SCR domain
CEGKERVERHELLGKWKSRFMMAGFQQYPLSSYVNSVIKDLMKRYSEHYTLVEKDGAMLLGWKERNLVSASAW

SEQ ID NO: 3902 - protein, 90 aa, Zea mays
  G3839,CAAT domain
REQDRLMPVANVSRIMRQVLPPYAKISDDAKEVIQECVSEFISFVTGEANERCHTERRKTVTSEDIVWAMSRLGFDDYVAPLGAFLQRMR

SEQ ID NO: 3903 - protein, 64 aa, Arabidopsis thaliana
  G384,HB domain
QRPNKKKRYHRHTQRQIQELESFFKECPHPDDKQRKELSRELSLEPLQVKFWFQNKRTQMKAQH

SEQ ID NO: 3904 - protein, 65 aa, Solanum lycopersicum
  G3841,AP2 domain
KGRHYRGVRQRPWGKFAAEIRDPAKNGARVWLGTYETAEEAAIAYDKAAYRMRGSKAHLNFPHRI

SEQ ID NO: 3905 - protein, 65 aa, Solanum lycopersicum
  G3843,AP2 domain
KAKHYRGVRVRPWGKFAAEIRDPAKNGARVWLGTYETAEDAALAYDKAAFRMRGSRALLNFPLRI

SEQ ID NO: 3906 - protein, 65 aa, Medicago truncatula; identical to SEQ ID NO: 3837
  G3844,AP2 domain

SEQ ID NO: 3907 - protein, 65 aa, Nicotiana tabacum
  G3845,AP2 domain
RGRHYRGVRRRPWGKFAAEIRDPAKNGARVWLGTYETDEEAAIAYDKAAYRMRGSKAHLNFPHRI

SEQ ID NO: 3908 - protein, 65 aa, Nicotiana tabacum
  G3846,AP2 domain
KGRHYRGVRQRPWGKFAAEIRDPAKNGARVWLGTYETAEEAALAYDKAAYRMRGSKALLNFPHRI

SEQ ID NO: 3909 - protein, 65 aa, Oryza sativa (japonica cultivar-group)
  G3848,AP2 domain
RGKHYRGVRQRPWGKFAAEIRDPAKNGARVWLGTFDTAEDAALAYDRAAYRMRGSRALLNFPLRI

SEQ ID NO: 3910 - protein, 65 aa, Solanum lycopersicum
  G3849,AP2 domain
KKKNYRGVRRRPWGKFAAEIRDPSRKGSRIWLGTFDTDIDAARAYDCAAFKMRGRKAILNFPLDA

SEQ ID NO: 3911 - protein, 64 aa, Solanum lycopersicum
  G3851,AP2 domain
RKNLYRGIRQRPWGKWAAEIRDPRKGVRVWLGTFNTAEEAARAYDREARKIRGKKAKVNFPNED

SEQ ID NO: 3912 - protein, 66 aa, Solanum lycopersicum
  G3852,AP2 domain
PKGRHYRGVRQRPWGKFAAEIRDPAKNGARVWLGTYESAEEAALAYGKAAFRMRGTKALLNFPHRI

SEQ ID NO: 3913 - protein, 65 aa, Zea mays
  G3856,AP2 domain
RGKHYRGVRQRPWGKFAAEIRDPAKNGARVWLGTYDSAEDAAVAYDRAAYRMRGSRALLNFPLRI

SEQ ID NO: 3914 - protein, 65 aa, Solanum tuberosum; identical to SEQ ID NO: 3904
  G3857,AP2 domain

SEQ ID NO: 3915 - protein, 65 aa, Solanum tuberosum
  G3858,AP2 domain
KGRHYRGVRQRPWGKFAAEIRDPAKNGARVWLGTYESAEEAALAYDIAAFRMRGTKALLNFPHRI

SEQ ID NO: 3916 - protein, 56 aa, Flaveria trinervia
  G3859,1st ZF-HB domain
VAYKQCLKNHAVGIGCHAVDGCGEFMPAPTYNPSQPSSFKCAACGCHRNFHRREPT

SEQ ID NO: 3917 - protein, 64 aa, Flaveria trinervia
  G3859,2nd ZF-HB domain
RKRFRTKFSQDQKEKMLTFAEKVGWKLQRCDDKMVADFCSEIGIRRRVLKVWMHNNKNTSAKKE

SEQ ID NO: 3918 - protein, 61 aa, Arabidopsis thaliana
  G386,HB domain
PRKKRYHRHTPQQIQELESMFKECPHPDEKQRLELSKRLCLETRQVKFWFQNRRTQMKTQL

SEQ ID NO: 3919 - protein, 56 aa, Flaveria bidentis
  G3860,1st ZF-HB domain
VSYRECLKNHAAAMGGHAVDGCGEFMPSPSSSPTDPTSLKCAACGCHRNFHRRDPD

SEQ ID NO: 3920 - protein, 64 aa, Flaveria bidentis
  G3860,2nd ZF-HB domain
KKRFRTKFTQDQKEKMHELAERVGWKMQKKDEDLIIGFCNEIGVDKGVFKVWMHNNKMTFGGKK

SEQ ID NO: 3921 - protein, 31 aa, Flaveria bidentis
  G3861,1st ZF-HB domain
MPSPAATPADPTSIKCAACGCHRNFHRREPD

SEQ ID NO: 3922 - protein, 64 aa, Flaveria bidentis
  G3861,2nd ZF-HB domain
KKRFRTKFTQDQKQKMHELAERVGWKMQKKDEDLIINFCNEIGVDKGVFKVWMHNNKMTSAGKK

SEQ ID NO: 3923 - protein, 65 aa, Triticum aestivum
  G3864,AP2 domain
RGKHFRGVRQRPWGKFAAEIRDPAKNGARVWLGTFDSAEDAAVAYDRAAYRMRGSRALLNFPLRI

SEQ ID NO: 3924 - protein, 65 aa, Triticum aestivum; identical to SEQ ID NO: 3923
  G3865,AP2 domain

SEQ ID NO: 3925 - protein, 97 aa, Zea mays
  G3866,CAAT domain
REQDRFLPIANISRIMKKAIPANGKTIPANGKIAKDAKETVQECVSEFISFITSEASDKCQREKRKTINGDDLLWAMATLGFEDYIEPLKVYLQKYR

SEQ ID NO: 3926 - protein, 97 aa, Physcomitrella patens
  G3867,CAAT domain
QEMEQVNDFKTHQLPLARIKKIMKSDEDVKMIAAEAPVLFSKACEMFILELTLRSWIHTEENKRRTLQRNDIAGAITRGDIFDFLVDIVPRDELKEE

SEQ ID NO: 3927 - protein, 96 aa, Physcomitrella patens
  G3868,CAAT domain
EQDRFLPIANVSRIMKKALPSNAKISKDAKETVQECVSEFISFITGEASDKCQREKRKTINGDDLLWAMSTLGFEDYVEPLKVYLHKYRELEGEKA

SEQ ID NO: 3928 - protein, 95 aa, Physcomitrella patens
  G3870,CAAT domain
REQDRFLPIANVSRIMKKALPSNAKISKDAKETVQECVSEFISFITGEASDKCQREKRKTINGDDLLWAMSTLGFEDYVEPLKVYLHKYRELEGE

SEQ ID NO: 3929 - protein, 90 aa, Glycine max
  G3873,CAAT domain
REQDRFLPIANISRIMKKALPPNGKIAKDAKETVQECVSEFISFVTSEASDKCQREKRKTINGDDLLWAMTTLGFEEYIDPLKVYLAAYR

SEQ ID NO: 3930 - protein, 90 aa, Glycine max
  G3874,CAAT domain
REQDRYLPIANISRIMKKALPANGKIAKDAKETVQECVSEFISFITSEASDKCQREKRKTINGDDLLWAMATLGFEDYMDPLKIYLTRYR

SEQ ID NO: 3931 - protein, 90 aa, Glycine max
  G3875,CAAT domain
REQDRYLPIANISRIMKKALPANGKIAKDAKETVQECVSEFISFITSEASDKCQREKRKTINGDDLLWAMATLGFEDYIDPLKIYLTRYR

SEQ ID NO: 3932 - protein, 90 aa, Zea mays
  G3876,CAAT domain
REQDRFLPIANISRIMKKAIPANGKIAKDAKETVQECVSEFISFITSEASDKCQREKRKTINGDDLLWAMATLGFEDYIEPLKVYLQKYR

SEQ ID NO: 3933 - protein, 97 aa, Gossypium raimondii; identical to SEQ ID NO: 3344
  G3883,CAAT domain

SEQ ID NO: 3934 - protein, 97 aa, Nicotiana benthamiana
  G3884,CAAT domain
QEIEQVNDFKNHQLPLARIKKIMKADEDVRMISAEAPILFAKACELFILELTIRSWLHAEENKRRTLQKNDIAAAITRTDIFDFLVDIVPRDEIKEE

SEQ ID NO: 3935 - protein, 97 aa, Solanum tuberosum; identical to SEQ ID NO: 3814
  G3885,CAAT domain

SEQ ID NO: 3936 - protein, 97 aa, Glycine max
  G3886,CAAT domain
QEIEHVNDFKNHQLPLARIKKIMKADEDVRMISAEAPILFAKACELFILELTIRSWLHAEENKRRTLQKNDIAAAITRTDIFDFLVDIVPRDEIKDD

SEQ ID NO: 3937 - protein, 99 aa, Zea mays; identical to SEQ ID NO: 3804
  G3889,CAAT domain

SEQ ID NO: 3938 - protein, 64 aa, Arabidopsis thaliana
  G389,HB domain
PPAAKKKRYHRHTASQIQQMEALFKENAHPDTKTRLRLSKKLGLSPIQVKFWFQNKRTQIKAQQ

SEQ ID NO: 3939 - protein, 97 aa, Solanum tuberosum; identical to SEQ ID NO: 3812
  G3892,CAAT domain

SEQ ID NO: 3940 - protein, 97 aa, Solanum tuberosum; identical to SEQ ID NO: 3812
  G3893,CAAT domain

SEQ ID NO: 3941 - protein, 97 aa, Solanum lycopersicum; identical to SEQ ID NO: 3812
  G3894,CAAT domain

SEQ ID NO: 3942 - protein, 97 aa, Medicago truncatula; identical to SEQ ID NO: 3807
  G3896,CAAT domain

SEQ ID NO: 3943 - protein, 64 aa, Arabidopsis thaliana
  G390,HB domain
DSGKYVRYTPEQVEALERVYAECPKPSSLRRQQLIRECPILCNIEPRQIKVWFQNRRCREKQRK

SEQ ID NO: 3944 - protein, 61 aa, Arabidopsis thaliana
  G391,HB domain
KYVRYTPEQVEALERVYTECPKPSSLRRQQLIRECPILSNIEPKQIKVWFQNRRCREKQRK

SEQ ID NO: 3945 - protein, 60 aa, Oryza sativa (japonica cultivar-group)
  G3924,CAAT domain
EPVYVNAKQYHGILRRRQSRAKAELEKKVVKSRKPYLHESRHQHAMRRARGTGGRFLNTK

SEQ ID NO: 3946 - protein, 62 aa, Zea mays
  G3929,AP2 domain
KEGKYRGVRKRPWGKFAAEIRDPERGGSRVWLGTFDTAEEAARAYDRAAFTMKGATAVLNFP

SEQ ID NO: 3947 - protein, 45 aa, Arabidopsis thaliana
  G3930,MYB-related domain
INMTEQEEDLIFRMYRLVGDRWDLIARRVVGREAKEIERYWIMRN

SEQ ID NO: 3948 - protein, 56 aa, Glycine max
  G3934,1st ZF-HB domain
VVYKECLKNHVASLGGHALDGCGEFMPSPAATADDPSSIKCAACGCHRNFHRREPE

SEQ ID NO: 3949 - protein, 64 aa, Glycine max
  G3934,2nd ZF-HB domain
RKRFRTKFTQEQKEKMHEFADKVGWKMQRRDEEMVMEFCNEIGVDRGVLKVWMHNNKNTFAKKD

SEQ ID NO: 3950 - protein, 90 aa, Zea mays
  G3937,CAAT domain
REQDRLMPIANVIRIMRRVLPAHAKISDDAKETIQECVSEYISFITGEANERCQREQRKTITAEDVLWAMSRLGFDDYVEPLGAYLHRYR

SEQ ID NO: 3951 - protein, 96 aa, Oryza sativa (japonica cultivar-group)
  G3938,CAAT domain
EQDRFLPIANVSRIMKRSLPANAKISKESKETVQECVSEFISFVTGEASDKCQREKRKTINGDDLLWAMTTLGFEAYVGPLKSYLNRYREAEGEKA

SEQ ID NO: 3952 - protein, 90 aa, Oryza sativa (japonica cultivar-group)
  G3939,CAAT domain
REQDRLMPIANVIRIMRRVLPAHAKISDDAKETIQECVSEYISFITGEANERCQREQRKTITAEDVLWAMSRLGFDDYVEPLGVYLHRYR

SEQ ID NO: 3953 - protein, 63 aa, Capsicum annuum
  G3957,AP2 domain
KNQYRGIRQRPWGKWAAEIRDPRKGIRVWLGTFNSAEEAARAYDVEARRIRGKKAKVNFPDGS

SEQ ID NO: 3954 - protein, 63 aa, Solanum lycopersicum
  G3974,AP2 domain
KNQYRGIRQRPWGKWAAEIRDPRKGIRVWLGTFNSAEEAARAYDAEARRIRGKKAKVNFPDEA

SEQ ID NO: 3955 - protein, 64 aa, Arabidopsis thaliana
  G398,HB domain
YGGETCRKKLRLSKDQSAVLEDTFKEHNTLNPKQKLALAKKLGLTARQVEVWFQNRRARTKLKQ

SEQ ID NO: 3956 - protein, 56 aa, Glycine max; identical to SEQ ID NO: 3759
  G3980,MADS domain

SEQ ID NO: 3957 - protein, 56 aa, Glycine max; identical to SEQ ID NO: 3759
  G3981,MADS domain

SEQ ID NO: 3958 - protein, 56 aa, Antirrhinum majus
  G3982,MADS domain
GRGKIVIQRIDKSTSRQVTFSKRRSGLLKKAKELAILCDAEVGVVIFSSTGKLYEF

SEQ ID NO: 3959 - protein, 56 aa, Solanum lycopersicum
  G3984,MADS domain
AREKIQIKKIDNSTARQVTFSKRRRGLFKKAEELSVLCDADVALIIFSSTGKLFDY

SEQ ID NO: 3960 - protein, 56 aa, Zea mays
  G3985,MADS domain
ARERREIKRIESAAARQVTFSKRRRGLFKKAQELSVLCDADVALIVFSSTGKLSQF

SEQ ID NO: 3961 - protein, 56 aa, Zea mays
  G3986,MADS domain
ARERREIRRIESAAARQVTFSKRRRGLFKKAEELAVLCDADVALVVFSATGRLSQF

SEQ ID NO: 3962 - protein, 56 aa, Zea mays
  G3987,MADS domain
ARERREIKRIESAAARQVTFSKRRRGLFKKAEELSVLCDADVALIVFSSTGKLSQF

SEQ ID NO: 3963 - protein, 56 aa, Oryza sativa (japonica cultivar-group)
  G3988,MADS domain
ARERREIKRIESAAARQVTFSKRRRGLFKKAEELSVLCDADVALIVFSSTGKLSHF

SEQ ID NO: 3964 - protein, 56 aa, Glycine max
  G3989,MADS domain
TRKRIQIKKIDNISSRQVTFSKRRKGLFKKAQELSTLCDADIALIVFSATSKLFEY

SEQ ID NO: 3965 - protein, 56 aa, Zea mays
  G3990,MADS domain
VGTGKRERIAIRRIDNLAARQVTFSKRRRGLFKKAEELSILCDAEVGLVVFSATGK

SEQ ID NO: 3966 - protein, 56 aa, Glycine max; identical to SEQ ID NO: 3964
  G3991,MADS domain

SEQ ID NO: 3967 - protein, 56 aa, Glycine max
  G3992,MADS domain
VREKIQIKKIDNATARQVTFSKRRRGLFKKAEELSVMCDADVALIIFSSTGKLFEY

SEQ ID NO: 3968 - protein, 56 aa, Brassica rapa
  G3998,MADS domain
AREKIQIRKIDNATARQVTFSKRRRGLFKKAEELSVLCDADVALIIFSSTGKLFEF

SEQ ID NO: 3969 - protein, 56 aa, Eucalyptus occidentalis
  G3999,MADS domain
AREKIQIKKITNATARQVTFSKRRRGLFKKAEELSVLCDADVALIVFSSSGKLFEY

SEQ ID NO: 3970 - protein, 68 aa, Arabidopsis thaliana
  G40,AP2 domain
HPIYRGVRQRNSGKWVSEVREPNKKTRIWLGTFQTAEMAARAHDVAALALRGRSACLNFADSAWRLRI

SEQ ID NO: 3971 - protein, 46 aa, Glycine max
  G4019,Z-CO-like domain
CELCGLQASLYCQADDAYLCRKCDKRVHEANFLALRHIRCFLCNTC

SEQ ID NO: 3972 - protein, 56 aa, Oryza sativa (japonica cultivar-group)
  G4060,MADS domain
AGGGGGGGRGEGEGRAATGKRERIAIRRIDNLAARQVTFSKRRRGLFKKAEELSIL

SEQ ID NO: 3973 - protein, 56 aa, Solanum lycopersicum
  G4061,MADS domain
VRGKVEMKRIENSTSRQVTFSKRRNGLTKKAYELSVLCDAEVAFIIFSHKGRLYEF

SEQ ID NO: 3974 - protein, 56 aa, Brassica rapa
  G4062,MADS domain
VRGKTQMKRIENATSRQVTFSKRRNGLLKKAFELSVLCDAEVSLIIFSPKAKLYEF

SEQ ID NO: 3975 - protein, 56 aa, Glycine max
  G4063,MADS domain
VRGKTQLRRIENATSRQVTFSKRRNGLLKKAFELSVLCDAEVALIIFSPRGKLYEF

SEQ ID NO: 3976 - protein, 56 aa, Glycine max
  G4064,MADS domain
VRGKTQMRRIENATSRQVTFSKRRNGLLKKAFELSVLCDAEVALIIFSPRGKLYEF

SEQ ID NO: 3977 - protein, 56 aa, Zea mays
  G4065,MADS domain
VRGKTQMKRIENPTSRQVTFSKRRNGLLKKAFELSVLCDAEVALVVFSPRGKLYEF

SEQ ID NO: 3978 - protein, 56 aa, Oryza sativa (japonica cultivar-group)
  G4066,MADS domain
VRGKTQMKRIENPTSRQVTFSKRRNGLLKKAFELSVLCDAEVALIVFSPRGKLYEF

SEQ ID NO: 3979 - protein, 56 aa, Oryza sativa (japonica cultivar-group)
  G4067,MADS domain
VRGRTELKRIENPTSRQVTFSKRRNGLLKKAFELSVLCDAEVALIVFSPRGRLYEF

SEQ ID NO: 3980 - protein, 63 aa, Solanum lycopersicum
  G4079,AP2 domain
RKKFRGVRQRPWGRWAAEIRDPTRGKRVWLGTYDTPEEAAVVYDKAAVKLKGPDAVTNFPVST

SEQ ID NO: 3981 - protein, 63 aa, Nicotiana tabacum
  G4080,AP2 domain
RKKFRGVRQRPWGRWAAEIRDPTRGKRVWLGTYDTPEEAAIVYDAAAVKLKGPDAVTNFPKVL

SEQ ID NO: 3982 - protein, 68 aa, Arabidopsis thaliana
  G41,AP2 domain
HPIYRGVRQRNSGKWVCELREPNKKTRIWLGTFQTAEMAARAHDVAAIALRGRSACLNFADSAWRLRI

SEQ ID NO: 3983 - protein, 54 aa, Arabidopsis thaliana
  G412,HB domain
KLTDEQVNMLEMSFGDEHKLESERKDRLAAELGLDPRQVAVWFQNRRARWKNKR

SEQ ID NO: 3984 - protein, 62 aa, Arabidopsis thaliana
  G42,AP2 domain
HPIYRGVRRRNSGKWVCEVREPNKKTRIWLGTFQTAEMAARAHDVAALALRGRSACLNFADS

SEQ ID NO: 3985 - protein, 101 aa, Glycine max
  G4218,MYB-(R1)R2R3 domain
KGPWSAEEDRILTGLVERYGPRNWSLISRYIKGRSGKSCRLRWCNQLSPAVEHRPFSAQEDDTIIAAHAQYGNRWATIARLLPGRTDNAVKNHWNSTLKRR

SEQ ID NO: 3986 - protein, 101 aa, Glycine max
  G4219,MYB-(R1)R2R3 domain
KGPWSAQEDRILTRLVEQYGPRNWSLISRYIKGRSGKSCRLRWCNQLSPTVEHRPFSTQEDETIIAAHARYGNRWATIARLLPGRTDNAVKNHWNSTLKRR

SEQ ID NO: 3987 - protein, 101 aa, Glycine max
  G4220,MYB-(R1)R2R3 domain
KGPWSPEEDEALRALVQAHGPRNWSVISKSIPGRSGKSCRLRWCNQLSPQVAHRPFSQEEDEAIIMAHAKFGNKWATIARLLNGRTDNAVKNHWNSTLKRK

SEQ ID NO: 3988 - protein, 102 aa, Glycine max
  G4221,MYB-(R1)R2R3 domain
KGPWSPEEDEALRRLVQAHGPRNWSVISKSVPGRSGKSCRLRWCNQLSPQVAHRPFSPDEDEAIVRAHARFGNKWATIARLLNNGRTDNAVKNHWNSTLKRK

SEQ ID NO: 3989 - protein, 101 aa, Glycine max
  G4222,MYB-(R1)R2R3 domain
KGPWSPEEDEALQKLVEKHGPRNWSLISKSIPGRSGKSCRLRWCNQLSPQVEHRAFTAEEDDTIIRAHARFGNKWATIARLLHGRTDNAIKNHWNSTLKRK

SEQ ID NO: 3990 - protein, 101 aa, Glycine max
  G4223,MYB-(R1)R2R3 domain
KGPWSPEEDEALQKLVEKHGPRNWSLISKSIPGRSGKSCRLRWCNQLSPQVEHRAFTHEEDDTIIRAHARFGNKWATIARLLHGRTDNAIKNHWNSTLKRK

SEQ ID NO: 3991 - protein, 101 aa, Glycine max
  G4224,MYB-(R1)R2R3 domain
KGPWSPEEDEALRRLVQTYGPRNWSVISKSIPGRSGKSCRLRWCNQLSPEVERRPFTAEEDEAILKAHARFGNKWATIARFLNGRTDNAIKNHWNSTLKRK

SEQ ID NO: 3992 - protein, 101 aa, Glycine max
  G4225,MYB-(R1)R2R3 domain
KGPWSAKEDRILTGLVEAHGPRNWASISRHIKGRSGKSCRLRWCNQLSPTVEHRPFSTREDEVILHAHARFGNKWATIARMLPGRTDNAVKNHWNATLKRR

SEQ ID NO: 3993 - protein, 101 aa, Zea mays
  G4226,MYB-(R1)R2R3 domain
KGPWSPEEDEALRRLVERHGARNWTAIGRGIPGRSGKSCRLRWCNQLSPQVERRPFTPEEDAAILAAHARLGNRWAAIARLLPGRTDNAVKNHWNSSLKRK

SEQ ID NO: 3994 - protein, 101 aa, Zea mays
  G4227,MYB-(R1)R2R3 domain
KGSWSPEEDALLTRLVEQHGPHRWSLISAPIPGRSGKSCRLRWCNQLSPDVHHRPFTPHEDALILAAHARYGNKWATIARLLPGRTDNSIKNHWNSNLRRC

SEQ ID NO: 3995 - protein, 101 aa, Zea mays
  G4228,MYB-(R1)R2R3 domain
KGPWSPEEDEALQRLVARHGARNWSLISRSIPGRSGKSCRLRWCNQLSPQVEHRPFTAEEDDTILRAHARFGNKWATIARLLSGRTDNAIKNHWNSTLKRK

SEQ ID NO: 3996 - protein, 101 aa, Zea mays
  G4229,MYB-(R1)R2R3 domain
KGPWSPEEDEALQRLVRRHGARNWSLISRSVPGRSGKSCRLRWCNQLSPRVEHRPFTPDEDDAILRAHARFGNKWATIARLLSGRTDNAIKNHWNSTLKRE

SEQ ID NO: 3997 - protein, 101 aa, Zea mays
  G4230,MYB-(R1)R2R3 domain
RGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRK

SEQ ID NO: 3998 - protein, 101 aa, Zea mays
  G4231,MYB-(R1)R2R3 domain
RGPWSPEEDEALRRLVERHGARNWTAIGRGVPGRSGKSCRLRWCNQLGRGGARRPFTADEDAAIARAHARLGNRWAAIARLLPGRTDNAVKNHWNCSLKRK

SEQ ID NO: 3999 - protein, 93 aa, Zea mays
  G4232,MYB-(R1)R2R3 domain
RGPWSPEEDDALRRLVERHGARNWTAIGREIPGRSGKSCPLRWCNQLSPQVERPPFTPEEDAAILAAHARLGNRWAAIARLLPGRTDNAVKNH

SEQ ID NO: 4000 - protein, 101 aa, Oryza sativa (japonica cultivar-group)
  G4234,MYB-(R1)R2R3 domain
KGPWSPEEDEALQRLVGRHGARNWSLISKSIPGRSGKSCRLRWCNQLSPQVEHRPFTPEEDDTILRAHARFGNKWATIARLLAGRTDNAIKNHWNSTLKRK

SEQ ID NO: 4001 - protein, 101 aa, Oryza sativa (japonica cultivar-group)
  G4235,MYB-(R1)R2R3 domain
RGPWSPEEDEALRRLVERHGARNWTAIGREIPGRSGKSCRLRWCNQLSPQVERRPFTAEEDATILRAHARLGNRWAAIARLLQGRTDNAVKNHWNCSLKRK

SEQ ID NO: 4002 - protein, 101 aa, Oryza sativa (japonica cultivar-group)
  G4236,MYB-(R1)R2R3 domain
KGSWSPEEDEQLRGAVARHGPRNWTAISEEVPGRSGKSCRLRWCNQLSPGVHRRPFTPDEDALIVAAHAKYGNKWATIARLLDGRTDNSVKNHWNSSLRRN

SEQ ID NO: 4003 - protein, 101 aa, Oryza sativa (japonica cultivar-group)
  G4237,MYB-(R1)R2R3 domain
KGSWRAEEDALLTRLVAQHGPHRWSIISGAIPGRSGKSCRLRWCNQLSPAVQHRPFTPQEDALLAAAHARHGNKWATIARLLPGRTDNSVKNHWNSNLRRC

SEQ ID NO: 4004 - protein, 101 aa, Oryza sativa (japonica cultivar-group)
  G4238,MYB-(R1)R2R3 domain
KGPWSPEEDEALRRLVERHGARNWTAIGRGIPGRSGKSCRLRWCNQLSPQVERRPFTAEEDAAILRAHARLGNRWAAIARLLPGRTDNAVKNHWNSSLKRK

SEQ ID NO: 4005 - protein, 49 aa, Zea mays
  G4240,GARP domain
WTPQLHKRFVDVVAHLGMKNAVPKTIMQLMNVEGLTRENVASHLQKYRL

SEQ ID NO: 4006 - protein, 49 aa, Oryza sativa (japonica cultivar-group)
  G4241,GARP domain
WTPQLHKRFVEVVAHLGMKNAVPKTIMQLMNVEGLTRENVASHLQKYRL

SEQ ID NO: 4007 - protein, 49 aa, Glycine max; identical to SEQ ID NO: 2748
  G4243,GARP domain

SEQ ID NO: 4008 - protein, 49 aa, Glycine max; identical to SEQ ID NO: 2748
  G4244,GARP domain

SEQ ID NO: 4009 - protein, 49 aa, Solanum lycopersicum
  G4245,GARP domain
WTPQLHKRFIEVVAHLGIKGAVPKTIMQLMNVEGLTRENVAGHLQKYRL

SEQ ID NO: 4010 - protein, 61 aa, Arabidopsis thaliana
  G425,HB domain
RRAGKLPGDTTSVLKEWWRTHSKWPYPTEEDKAKLVQETGLQLKQINNWFINQRKRNWNSN

SEQ ID NO: 4011 - protein, 77 aa, Zea mays
  G4253,CAAT domain
PAARIKKIMQADEDVGKIALAVPVLVSRSLELFLQDLIDRTYEITLQSGAKTLNSFHLKQCVKRYSSFDFLTEVVSK

SEQ ID NO: 4012 - protein, 77 aa, Zea mays
  G4254,CAAT domain
PAARIKKIMQADEDVGKIALAVPVLVSRALELFLQDLIDRTYEITLQSGAKTLNSFHLKQCVKRYSSFDFLTEVVSK

SEQ ID NO: 4013 - protein, 77 aa, Zea mays
  G4255,CAAT domain
PAPRIKKIMQTDEDVGKIAQAVPVLVSKALELFLQDLCDRTYDITIRKGVKTVGSSHLKQCIQTYNVYDFLREVVSK

SEQ ID NO: 4014 - protein, 97 aa, Zea mays
  G4256,CAAT domain
DEIKQANDFKIHTLPLARIKKIMKADEDVRMISAEAPVVFAKACEVFILELTLRSWMHTEENKRRTLQKNDIAAAITRTDIYDFLVDIIPRDEMKEE

SEQ ID NO: 4015 - protein, 97 aa, Zea mays
  G4257,CAAT domain
TEIEATADFRNHNLPLARIKKIMKADEDVRMISAEAPVVFAKACEIFILELTLRSWMHTEENKRRTLQKNDIAAAITRTDIYDFLVDIVPRDEMKDD

SEQ ID NO: 4016 - protein, 99 aa, Zea mays; identical to SEQ ID NO: 3804
  G4259,CAAT domain

SEQ ID NO: 4017 - protein, 60 aa, Zea mays
  G4261,CAAT domain
EPVYVNAKQYHGILRRRQSRAKAELEKKVVKARKPYLHESRHQHAMRRARGNGGRFLNTK

SEQ ID NO: 4018 - protein, 60 aa, Zea mays
  G4267,CAAT domain
EPVYVNAKQYNAILRRRQSRAKAESERKLVKGRKPYLHESRHQHALKRARGAGGRFLNSK

SEQ ID NO: 4019 - protein, 60 aa, Zea mays
  G4268,CAAT domain
EPVYVNAKQYNAILRRRQSRAKAESERKLIKGRKPYLHESRHQHALKRARGAGGRFLNSK

SEQ ID NO: 4020 - protein, 64 aa, Arabidopsis thaliana
  G427,HB domain
LRKRRAGKLPGDTTSVLKSWWQSHSKWPYPTEEDKARLVQETGLQLKQINNWFINQRKRNWHSN

SEQ ID NO: 4021 - protein, 97 aa, Zea mays
  G4272,CAAT domain
REQDRFLPIANVSRIMKKALPANAKISKDAKETVQECVSEFISFITGEASDKCQREKRKTINGDDLLWAMTTLGFEDYVEPLKHYLHKFREIEGERA

SEQ ID NO: 4022 - protein, 90 aa, Zea mays
  G4276,CAAT domain
REQDMFLPITNITRIMKKAVPANAKITKDAKEIMQYCVSEFIFFVTSEAREKSKKEERKRINVDDLLWSVDTAGFEYVELLRICLQKYRE

SEQ ID NO: 4023 - protein, 63 aa, Zea mays
  G4283,AP2 domain
STKFRGVRRRPWGKFAAEIRDPWRGVRVWLGTFDTAEEAARVYDTAAVQLRGANATTNFAASA

SEQ ID NO: 4024 - protein, 63 aa, Zea mays
  G4284,AP2 domain
AVRFRGVRRRPWGRWAAEIRDPHNRRRLWLGTFDTAEEAANAYDAANIRFRGVSATTNFPAAR

SEQ ID NO: 4025 - protein, 63 aa, Glycine max
  G4285,AP2 domain
RNKFRGVRQRPWGRWAAEIRDPTRRKRLWLGTFDTAEEAATEYDRAAVKLKGPNAVTNFPLAP

SEQ ID NO: 4026 - protein, 63 aa, Glycine max
  G4286,AP2 domain
RSKFRGVRQRPWGRWTAEIRDPNQRKRVWLGTFDTAEEAAAVYDDAALKLKGPNAVTNFPLSA

SEQ ID NO: 4027 - protein, 63 aa, Glycine max
  G4287,AP2 domain
GKKFRGVRQRPWGKWAAEIRDPARRVRLWLGTYDTAEEAAMVYDNAAIRLRGPDALTNFVTPP

SEQ ID NO: 4028 - protein, 63 aa, Oryza sativa (japonica cultivar-group)
  G4288,AP2 domain
EPRFRGVRRRPWGKYAAEIRDPWRRVRVWLGTFDTAEEAAKVYDTAAIQLRGRDATTNFNQSG

SEQ ID NO: 4029 - protein, 63 aa, Oryza sativa (japonica cultivar-group)
  G4289,AP2 domain
ERKFRGVRKRPWGKYGAEIRVSQQSARVWLGTFDTAEEAARVYDHAALRLRGPSATTNFPMTP

SEQ ID NO: 4030 - protein, 63 aa, Oryza sativa (japonica cultivar-group)
  G4290,AP2 domain
STKFRGVRRSPWGKFAAEIRDPWRGVRVWLGTFDTAEAAARVYDNAAIQLRGPSATTNFSAST

SEQ ID NO: 4031 - protein, 63 aa, Oryza sativa (japonica cultivar-group)
  G4291,AP2 domain
TARFRGVRQRPWGRFAAEIRDPHLRRRLWLGTFDTAEEAAAAYDAASVRLRGSSAATNFASVR

SEQ ID NO: 4032 - protein, 63 aa, Oryza sativa (japonica cultivar-group)
  G4292,AP2 domain
SRRFRGVRRRPWGRFSAEIRDPSLQKRLWLGTFDTAEEAAAVYDDAALRIKGSHAVTNFPSDS

SEQ ID NO: 4033 - protein, 64 aa, Oryza sativa (japonica cultivar-group)
  G4293,AP2 domain
ERRFTGVRRRPWGRWAAEIRDPKENGRRVWLGTFDTAEAAAAAYDDACLRLRGPGAALNLPSRR

SEQ ID NO: 4034 - protein, 68 aa, Oryza sativa (japonica cultivar-group)
  G4294,AP2 domain
KKKFRGVRQRHWGSWVSEIRHPLLKRRVWLGTFETAEEAARAYDEAAILMSGRNAKTNFPVARNATGE

SEQ ID NO: 4035 - protein, 103 aa, Glycine max
  G4306,MYB-(R1)R2R3 domain
KKGPWAPEEDQILTSYIDKHGHGNWRALPKQAGLLRCGKSCRLRWINYLRPDIKRGNFTIEEEETIIKLHDMLGNRWSAIAAKLPGRTDNEIKNVWHTNLKKR

SEQ ID NO: 4036 - protein, 103 aa, Solanum lycopersicum
  G4307,MYB-(R1)R2R3 domain
KKGPWTPQEDNILISYIQNNGHSNWRALPKLAGLLRCGKSCRLRWTNYLRPDIKRGNFTKEEEDTIIKLHENLGNRWSAIAARLPGRTDNEIKNIWHTNLKKK

SEQ ID NO: 4037 - protein, 103 aa, Oryza sativa (japonica cultivar-group)
  G4308,MYB-(R1)R2R3 domain
KRGPWTAEEDRILVAHIERHGHSNWRALPRQAGLLRCGKSCRLRWINYLRPDIKRGNFTREEEDAIIHLHDLLGNRWSAIAARLPGRTDNEIKNVWHTHLKKR

SEQ ID NO: 4038 - protein, 103 aa, Zea mays
  G4309,MYB-(R1)R2R3 domain
KRGPWTAEEDRILVAHVERHGHSNWRALPKQAGLLRCGKSCRLRWINYLRPDIKRGNFSREEEDAIIQLHQMLGNRWSTIAARLPGRTDNEIKNVWHTHLKKR

SEQ ID NO: 4039 - protein, 103 aa, Zea mays
  G4310,MYB-(R1)R2R3 domain
KKGPWTPEEDKVLVAHIQSFGHSNWRALPKQAGLLRCGKSCRLRWINYLRPDIKRGNFSKEEEDAIISLHEQLGNRWSAIAARLPGRTDNEIKNVWHTHLKKR

SEQ ID NO: 4040 - protein, 58 aa, Glycine max
  G4311,HLH/MYC domain
RRGQATDPHSIAERLRRERIAERMKALQELVPSINKTDRAAMLDEIVDYVKFLRLQVK

SEQ ID NO: 4041 - protein, 58 aa, Glycine max
  G4312,HLH/MYC domain
RRGQATDPHSIAERLRRERIAERIRALQELVPSVNKTDRAAMLDEIVDYVKFLRLQVK

SEQ ID NO: 4042 - protein, 58 aa, Zea mays; identical to SEQ ID NO: 3862
  G4313,HLH/MYC domain

SEQ ID NO: 4043 - protein, 65 aa, Solanum tuberosum
  G4328,AP2 domain
DLIKYRGVRKRTWGKFAAEIRDPTRQGARQWLGTFDTAEDAARAYDKAAFNLRGHLATLNFPNEY

SEQ ID NO: 4044 - protein, 65 aa, Petunia x hybrida
  G4329,AP2 domain
GEIKYRGVRRRPWGKFAAEIRDSARQGARVWLGTYNTAEEAARAYDRAAYSMRGHLAILNFPEEY

SEQ ID NO: 4045 - protein, 65 aa, Populus trichocarpa x Populus nigra
  G4330,AP2 domain
GENAYRGIRRRPWGKFAAEIRDPTKNGARRWLGTYDTAEEAARAYDRAAFAFRGHLAILNFPNEY

SEQ ID NO: 4046 - protein, 61 aa, Zea mays
  G4369,HB domain
KLRLSKEQSRLLEESFRLNHTLTPKQKEALAVKLKLRPRQVEVWFQNRRARTKLKQTELEC

SEQ ID NO: 4047 - protein, 61 aa, Zea mays
  G4370,HB domain
KLRLSKEQSRLLEESFRLNHTLSPKQKEALAIKLKLRPRQVEVWFQNRRARTKLKHTEMEC

SEQ ID NO: 4048 - protein, 61 aa, Glycine max
  G4371,HB domain
PPRKKLRLTKEQSLLLEESFRQNHTLNPKQKESLAMQLKLRPRQVEVWFQNRRARSKLKQT

SEQ ID NO: 4049 - protein, 64 aa, Arabidopsis thaliana
  G438,HB domain
SSGKYVRYTAEQVEALERVYAECPKPSSLRRQQLIRECSILANIEPKQIKVWFQNRRCRDKQRK

SEQ ID NO: 4050 - protein, 10 aa, Arabidopsis thaliana
  G448,1st IAA domain
ETELCLGLPG

SEQ ID NO: 4051 - protein, 13 aa, Arabidopsis thaliana
  G448,2nd IAA domain
VVGWPPVRSYRKN

SEQ ID NO: 4052 - protein, 18 aa, Arabidopsis thaliana
  G448,3rd IAA domain
AFVKVSMDGAPYLRKIDL

SEQ ID NO: 4053 - protein, 35 aa, Arabidopsis thaliana
  G448,4th IAA domain
SYEDKDGDWMLVGDVPWPMFVDTCKRLRLMKGSDA

SEQ ID NO: 4054 - protein, 9 aa, Arabidopsis thaliana
  G455,1st IAA domain
TELCLGLPG

SEQ ID NO: 4055 - protein, 12 aa, Arabidopsis thaliana
  G455,2nd IAA domain
VGWPPVRNYRKN

SEQ ID NO: 4056 - protein, 17 aa, Arabidopsis thaliana
  G455,3rd IAA domain
LVKVSMDGAPYLRKVDL

SEQ ID NO: 4057 - protein, 34 aa, Arabidopsis thaliana
  G455,4th IAA domain
YEDKDGDWMLVGDVPWEMFVESCKRLRIMKGSEA

SEQ ID NO: 4058 - protein, 8 aa, Arabidopsis thaliana
  G456,1st IAA domain
TELRLGLP

SEQ ID NO: 4059 - protein, 11 aa, Arabidopsis thaliana
  G456,2nd IAA domain
VVGWPPVRSFR

SEQ ID NO: 4060 - protein, 34 aa, Arabidopsis thaliana
  G456,3rd IAA domain
YVKVSMDGAPYLRKIDLKLYKTYQDLSNALSKMF

SEQ ID NO: 4061 - protein, 37 aa, Arabidopsis thaliana
  G456,4th IAA domain
VPTYEDKDGDWMLVGDVPWEMFVDSCKRIRIMKGSEA

SEQ ID NO: 4062 - protein, 154 aa, Glycine max
  G4570,AT-hook domain
RRPRGRPPGSKNKPKPPVVITKESPNALCSHILEISDGSDVAECIAIFATRRHRGVSVLSGNGFVTNVTLRQPAAPGGVITLQGRFEILSLSGAFLPAPSPPEATGLTVYLAGGQGQVVGGSVVGPLVTSGPVIVVAATFANATYERLPLEDEK

SEQ ID NO: 4063 - protein, 69 aa, Arabidopsis thaliana
  G46,AP2 domain
ARHYRGVRRRPWGKFAAEIRDPAKKGSRIWLGTFESDVDAARAYDCAAFKLRGRKAVLNFPLDAGKYEA

SEQ ID NO: 4064 - protein, 65 aa, Solanum lycopersicum
  G4626,AP2 domain
KGRHYRGVKQRPWGKFAAEIRDPAKNGARVWLGTYETAEEAAIAYDKAAYRMRGSKAHLNFPHRI

SEQ ID NO: 4065 - protein, 13 aa, Oryza sativa (japonica cultivar-group)
  G4627,1st bZIP domain
ESDEEIRRVPEMG

SEQ ID NO: 4066 - protein, 80 aa, Oryza sativa (japonica cultivar-group)
  G4627,2nd bZIP domain
RKRGRSAGDKEQNRLKRLLRNRVSAQQARERKKAYMTELEAKAKDLELRNAELEQRVSTLQNENNTLRQILKNTTAHAGK

SEQ ID NO: 4067 - protein, 43 aa, Oryza sativa (japonica cultivar-group)
  G4628,1st RING/C3HC4 domain
LCPICMAVIKDAFLTACGHSFCYMCIVTHLSHKSDCPCCGNYL

SEQ ID NO: 4068 - protein, 84 aa, Oryza sativa (japonica cultivar-group)
  G4628,2nd RING/C3HC4 domain
FRYALQQGNDMAVKELDSLMTLIAEKKRHMEQQESETNMQILLVFLHCLRKQKLEELNEIQTDLQYIKEDISAVERHRLELYRT

SEQ ID NO: 4069 - protein, 297 aa, Oryza sativa (japonica cultivar-group)
  G4628,3rd RING/C3HC4 domain
VSSIEFDRDDELFATAGVSKRIKVFEFSTVVNEPSDVHCPVVEMATRSKLSCLSWNKYSKNVIASSDYEGIVTVWDVQTRQSVMEYEEHEKRAWSVDFSRTEPSMLVSGSDDCKVKVWCTKQEASAINIDMKANICSVKYNPGSSHYVAVGSADHHIHYFDLRNPSAPVHVFGGHKKAVSYVKFLSTNELASASTDSTLRLWDVKENCPVRTFRGHKNEKNFVGLSVNNEYIACGSETNEVFVYHKAISKPAANHRFVSSDLDDADDDPGSYFISAVCWKSDSPTMLTANSQGTIKV

SEQ ID NO: 4070 - protein, 43 aa, Pisum sativum
  G4629,1st RING/C3HC4 domain
LCPICMQIIKDAFLTACGHSFCYMCIITHLRNKSDCPCCGHYL

SEQ ID NO: 4071 - protein, 84 aa, Pisum sativum
  G4629,2nd RING/C3HC4 domain
FRQAVQKGCEVTMKELDTLLLLLTEKKRKMEQEEAERNMQILLDFLHCLRKQKVDELKEVQTDLQFIKEDIGAVEKHRMDLYRA

SEQ ID NO: 4072 - protein, 297 aa, Pisum sativum
  G4629,3rd RING/C3HC4 domain
VSSIEFDRDDDLFATAGVSRRIKVFDFSAVVNEPTDAHCPVVEMTTRSKLSCLSWNKYAKNQIASSDYEGIVTVWTMTTRKSLMEYEEHEKRAWSVDFSRTDPSMLVSGSDDCKVKVWCTNQEASVLNIDMKANICCVKYNPGSGNYIAVGSADHHIHYYDLRNISRPVHVFTGHKKAVSYVKFLSNDELASASTDSTLRLWDVKQNLPVRTFRGHANEKNFVGLTVRSEYIACGSETNEVFVYHKEISKPLTWHRFGTLDMEDAEDEAGSYFISAVCWKSDRPTILTANSQGTIKV

SEQ ID NO: 4073 - protein, 13 aa, Oryza sativa (japonica cultivar-group)
  G4630,1st bZIP domain
ESDEEIGRVPELG

SEQ ID NO: 4074 - protein, 80 aa, Oryza sativa (japonica cultivar-group)
  G4630,2nd bZIP domain
RRRGRSPADKEHKRLKRLLRNRVSAQQARERKKAYLNDLEVKVKDLEKKNSELEERFSTLQNENQMLRQILKNTTVSRRG

SEQ ID NO: 4075 - protein, 13 aa, Glycine max
  G4631,1st bZIP domain
ESDEEIRRVPEIG

SEQ ID NO: 4076 - protein, 80 aa, Glycine max
  G4631,2nd bZIP domain
KKRGRSPADKESKRLKRLLRNRVSAQQARERKKAYLIDLETRVKDLEKKNSELKERLSTLQNENQMLRQILKNTTASRRG

SEQ ID NO: 4077 - protein, 13 aa, Zea mays
  G4632,1st bZIP domain
ESDEEIRRVPELG

SEQ ID NO: 4078 - protein, 80 aa, Zea mays
  G4632,2nd bZIP domain
RRRVRSPADKEHKRLKRLLRNRVSAQQARERKKAYLTDLEVKVKDLEKKNSEMEERLSTLQNENQMLRQILKNTTVSRRG

SEQ ID NO: 4079 - protein, 43 aa, Glycine max
  G4633,1st RING/C3HC4 domain
LCPICMQIIKDPFLTACGHSFCYMCIITHLRNKSDCPCCGDYL

SEQ ID NO: 4080 - protein, 84 aa, Glycine max
  G4633,2nd RING/C3HC4 domain
RQISKTASPVEHFRQVLQKGSDVSIKELDTLLSLLAEKKRKMEQEEAERNMQILLDFLHCLRKQKVDELKEVQTDLHFIKEDIN

SEQ ID NO: 4081 - protein, 297 aa, Glycine max
  G4633,3rd RING/C3HC4 domain
LRHGDIFHSANIVSSIEFDCDDDLFATAGVSRRIKVFDFSAVVNEPTDAHCPVVEMSTRSKLSCLSWNKYAKNQIASSDYEGIVTVWDVTTRKSLMEYEEHEKRAWSVDFSRTDPSMLVSGSDDCKVKIWCTNQEASVLNIDMKANICCVKYNPGSGNYIAVGSADHHIHYYDLRNISRPVHVFSGHRKAVSYVKFLSNDELASASTDSTLRLWDVKENLPVRTFKGHANEKNFVGLTVSSEYIACGSETNEVFVYHKEISRPLTCHRFGSPDMDDAEDEAGSYFISAVCWKSDRPT

SEQ ID NO: 4082 - protein, 43 aa, Solanum lycopersicum
  G4635,1st RING/C3HC4 domain
LCPICMQIIKDAFLTACGHSFCYMCIVTHLHNKSDCPCCSHYL

SEQ ID NO: 4083 - protein, 84 aa, Solanum lycopersicum
  G4635,2nd RING/C3HC4 domain
FRHSLEQGSEVSIKELDALLLMLSEKKRKLEQEEAERNMQILLDFLQMLRKQKVDELNEVQHDLQYIKEDLNSVERHRIDLYRA

SEQ ID NO: 4084 - protein, 297 aa, Solanum lycopersicum
  G4635,3rd RING/C3HC4 domain
VSSIEFDRDDELFATAGVSRRIKVFDFSSVVNEPADAHCPVVEMSTRSKLSCLSWNKYTKNHIASSDYDGIVTVWDVTTRQSVMEYEEHEKRAWSVDFSRTEPSMLVSGSDDCKVKVWCTKQEASVLNIDMKANICCVKYNPGSSVHIAVGSADHHIHYYDLRNTSQPVHIFSGHRKAVSYVKFLSNNELASASTDSTLRLWDVKDNLPVRTLRGHTNEKNFVGLSVNNEFLSCGSETNEVFVYHKAISKPVTWHRFGSPDIDEADEDAGSYFISAVCWKSDSPTMLAANSQGTIKV

SEQ ID NO: 4085 - protein, 103 aa, Zea mays
  G4637,MYB-(R1)R2R3 domain
KGAWTKEEDQRLVAYIKAHGEGCWRSLPKAAGLLRCGKSCRLRWINYLRPDLKRGNFTEEEDDLIIKFHELFGNKWSLIAGRLPGRTDNEIKNYWNTHIKRKL

SEQ ID NO: 4086 - protein, 103 aa, Zea mays
  G4638,MYB-(R1)R2R3 domain
KGAWTKEEDQRLVAYIKAHGEGCWRSLPKAAGLLRCGKSCRLRWINYLRPDLKRGNFTQEEDDVIIKLHQVLGNKWSLIAAQLPGRTDNEIKNYWNTHIKRKL

SEQ ID NO: 4087 - protein, 103 aa, Glycine max
  G4639,MYB-(R1)R2R3 domain
KGAWTKEEDHRLISYIRAHGEGCWRSLPKAAGLLRCGKSCRLRWINYLRPDLKRGNFTLEEDQLIIKLHSLLGNKWSLIARRLPGRTDNEIKNYWNTHIRRKL

SEQ ID NO: 4088 - protein, 9 aa, Arabidopsis thaliana
  G464,1st IAA domain
LELGLGLSL

SEQ ID NO: 4089 - protein, 12 aa, Arabidopsis thaliana
  G464,2nd IAA domain
VGWPPIGLHRMN

SEQ ID NO: 4090 - protein, 17 aa, Arabidopsis thaliana
  G464,3rd IAA domain
FVKVNMDGVGIGRKVDM

SEQ ID NO: 4091 - protein, 38 aa, Arabidopsis thaliana
  G464,4th IAA domain
YEDKEGDWMLVGDVPWRMFINSVKRLRIMGTSEASGLA

SEQ ID NO: 4092 - protein, 103 aa, Zea mays
  G4640,MYB-(R1)R2R3 domain
KGAWTKEEDQRLIAYIRAHGEGSWRSLPKAAGLLRCGKSCRLRWMNYLRPDLKRGNFTGDDDELIIKLHALLGNKWSLIAGQLPGRTDNEIKNYWNTHIKRKL

SEQ ID NO: 4093 - protein, 332 aa, Arabidopsis thaliana
  G472,ARF domain
ELWKLCAGPLVDVPQAQERVYYFPQGHMEQLEASTQQVDLNTMKPLFVLPPKILCNVMNVSLQAEKDTDEVYAQITLIPVGTEVDEPMSPDPSPPELQRPKVHSFSKVLTASDTSTHGGFSVLRKHATECLPPLDMTQQTPTQELVAEDVHGYQWKFKHIFRGQPRRHLLTTGWSTFVTSKRLVAGDTFVFLRGENGELRVGVRRANLQQSSMPSSVISSHSMHLGVLATARHATQTKTMFIVYYKPRTSQFIISLNKYLEAMSNKFSVGMRFKMRFEGEDSPERRYSGTVIGVKDCSPHWKDSKWRCLEVHWDEPASISRPNKVSPWEIEP

SEQ ID NO: 4094 - protein, 146 aa, Arabidopsis thaliana
  G502,NAC domain
GFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSVRKKKNSLRLDDWVLCRI

SEQ ID NO: 4095 - protein, 143 aa, Arabidopsis thaliana
  G514,NAC domain
GFRFHPTDEELITHYLHNKVLDTSFSAKAIGEVDLNKSEPWELPWMAKMGEKEWYFFCVRDRKYPTGLRTNRATEAGYWKATGKDKEIYRGKSLVGMKKTLVFYRGRAPKGQKTNWVMHEYRLEGKFSAHNLPKTAKKWVCRV

SEQ ID NO: 4096 - protein, 144 aa, Arabidopsis thaliana
  G515,NAC domain
GLRFCPTDEEIVVDYLWPKNSDRDTSHVDRFINTVPVCRLDPWELPCQSRIKLKDVAWCFFRPKENKYGRGDQQMRKTKSGFWKSTGRPKPIMRNRQQIGEKKILMFYTSKESKSDWVIHEYHGFSHNQMMMTYTLCKVMFNGG

SEQ ID NO: 4097 - protein, 15 aa, Oryza sativa (japonica cultivar-group)
  G5158,1st bZIP domain
DSDDEEIVGRVPEFG

SEQ ID NO: 4098 - protein, 80 aa, Oryza sativa (japonica cultivar-group)
  G5158,2nd bZIP domain
RRRGRSPADKEHRRLKRLLRNRVSAQQARERKKAYMSELEARVKDLERSNSELEERLSTLQNENQMLRQVLKNTTANRRG

SEQ ID NO: 4099 - protein, 32 aa, Oryza sativa (japonica cultivar-group)
  G5159,1st Z-CO-like domain
KVQCDVCAAEAASVFCCADEAALCDACDRRVH

SEQ ID NO: 4100 - protein, 43 aa, Oryza sativa (japonica cultivar-group)
  G5159,2nd Z-CO-like domain
CDICQEKRGFLFCKEDRAILCRECDVTVHTTSELTRRHGRFLL

SEQ ID NO: 4101 - protein, 136 aa, Arabidopsis thaliana
  G516,NAC domain
GFRFRPTDGEIVDIYLRPKNLESNTSHVDEVISTVDICSFDPWDLPSHSRMKTRDQVWYFFGRKENKYGKGDRQIRKTKSGFWKKTGVTMDIMRKTGDREKIGEKRVLVFKNHGGSKSDWAMHEYHATFSSPNQGE

SEQ ID NO: 4102 - protein, 148 aa, Arabidopsis thaliana
  G517,NAC domain
GFRFRPNDEEIVDHYLRPKNLDSDTSHVDEVISTVDICSFEPWDLPSKSMIKSRDGVWYFFSVKEMKYNRGDQQRRRTNSGFWKKTGKTMTVMRKRGNREKIGEKRVLVFKNRDGSKTDWVMHEYHATSLFPNQMMTYTVCKVEFKGE

SEQ ID NO: 4103 - protein, 69 aa, Solanum lycopersicum
  G5170,AP2 domain
EKHYIGVRKRPWGKYASEIRDSTRNGIRVWLGTFDTAEEAALAYDQAALSMRGPWSLLNFPMEHVKKSL

SEQ ID NO: 4104 - protein, 65 aa, Oryza sativa (japonica cultivar-group); identical to SEQ ID NO: 3697
  G5171,AP2 domain

SEQ ID NO: 4105 - protein, 69 aa, Glycine max
  G5184,AP2 domain
EKSYRGVRRRPWGKFAAEIRDSTRHGMRVWLGTFDSAEAAALAYDQAAFSMRGSAAILNFPAEIVRESL

SEQ ID NO: 4106 - protein, 66 aa, Zea mays
  G5185,AP2 domain
YIGVRKRPWGKFAAEIRDSTRKGARVWLGTFDSPEAAAMAYDQAAFSVRGAAAVLNFPVERVQESL

SEQ ID NO: 4107 - protein, 69 aa, Glycine max
  G5186,AP2 domain
KRPFRGVRRRPWGKFAAEIRDSTRNGVRVWIGTFDTAEAAALAYDQAALSTRGSMAVLNFPEEVVRESL

SEQ ID NO: 4108 - protein, 150 aa, Arabidopsis thaliana
  G521,NAC domain
APGFRFHPTDVELVRYYLKRKVMGKKFQVDAIAEVDIYKFEPPDLPDKSCLGTGDLKWYFFCPREKKYPKGGKANRSTECGYWKTTGRDRDVSYNDEVTGKIRTLIYHYGKIPRGDRTDWVIHEYRLEDKVLAQKNVPQDTYVLCVLFKK

SEQ ID NO: 4109 - protein, 121 aa, Arabidopsis thaliana
  G523,NAC domain
GFRFHPTDEELITHYLHKKVLDLGFSAKAIGEVDLNKAEPWELPYKAKIGEKEWYFFCVRDRKYPTGLRTNRATQAGYWKATGKDKEIFRGKSLVGMKKTLVFYRGRAPKGQKTNWVMHEY

SEQ ID NO: 4110 - protein, 140 aa, Arabidopsis thaliana
  G524,NAC domain
GFRFHPTDEELVVQYLRRKVTGLPLPASVIPETDVCKSDPWDLPGDCESEMYFFSTREAKYPNGNRSNRSTGSGYWKATGLDKQIGKKKLVVGMKKTLVFYKGKPPNGTRTNWVLHEYRLVDSQQDSLYGQNMNWVLCRV

SEQ ID NO: 4111 - protein, 8 aa, Arabidopsis thaliana
  G528,GF14 domain
LRDNLTLW

SEQ ID NO: 4112 - protein, 237 aa, Arabidopsis thaliana
  G533,GF14 domain
RDQYVYMAKLAEQAERYEEMVQFMEQLVSGATPAGELTVEERNLLSVAYKNVIGSLRAAWRIVSSIEQKEESRKNEEHVSLVKDYRSKVETELSSICSGILRLLDSHLIPSATASESKVFYLKMKGDYHRYLAEFKSGDERKTAAEDTMIAYKAAQDVAVADLAPTHPIRLGLALNFSVFYYEILNSSEKACSMAKQAFEEAIAELDTLGEESYKDSTLIMQLLRDNLTLWTSDMQE

SEQ ID NO: 4113 - protein, 9 aa, Arabidopsis thaliana
  G534,GF14 domain
LRDNLTLWA

SEQ ID NO: 4114 - protein, 8 aa, Arabidopsis thaliana
  G536,GF14 domain
LRDNLTLW

SEQ ID NO: 4115 - protein, 259 aa, Arabidopsis thaliana; identical to SEQ ID NO: 2528
  G537,GF14 domain

SEQ ID NO: 4116 - protein, 21 aa, Arabidopsis thaliana
  G545,1st Z-C2H2 domain
CSVCDKTFSSYQALGGHKASH

SEQ ID NO: 4117 - protein, 19 aa, Arabidopsis thaliana
  G545,2nd Z-C2H2 domain
HVCTICNKSFPSGQALGGH

SEQ ID NO: 4118 - protein, 61 aa, Arabidopsis thaliana
  G554,bZIP domain
PDKIQRRLAQNREAARKSRLRKKAYVQQLETSRLKLIQLEQELDRARQQGFYVGNGIDTNS

SEQ ID NO: 4119 - protein, 73 aa, Arabidopsis thaliana
  G555,bZIP domain
RSKSKMDQKTLRRLAQNREAARKSRLRKKAYVQQLENSRLKLTQLEQELQRARQQGVFISSSGDQAHSTAGDG

SEQ ID NO: 4120 - protein, 13 aa, Arabidopsis thaliana
  G557,1st bZIP domain
ESDEEIRRVPEFG

SEQ ID NO: 4121 - protein, 80 aa, Arabidopsis thaliana
  G557,2nd bZIP domain
RKRGRTPAEKENKRLKRLLRNRVSAQQARERKKAYLSELENRVKDLENKNSELEERLSTLQNENQMLRHILKNTTGNKRG

SEQ ID NO: 4122 - protein, 61 aa, Arabidopsis thaliana
  G561,bZIP domain
KEVKREKRKQSNRESARRSRLRKQAETEQLSVKVDALVAENMSLRSKLGQLNNESEKLRLE

SEQ ID NO: 4123 - protein, 61 aa, Arabidopsis thaliana
  G578,bZIP domain
KLDQKTLRRLAQNREAARKSRLRKKAYVQQLEDSRLKLTQVEQELQRARQQGVFISSSGDQ

SEQ ID NO: 4124 - protein, 58 aa, Arabidopsis thaliana
  G584,HLH/MYC domain
NGREEPLNHVEAERQRREKLNQRFYSLRAVVPNVSKMDKASLLGDAISYISELKSKLQ

SEQ ID NO: 4125 - protein, 58 aa, Arabidopsis thaliana
  G589,HLH/MYC domain
RRGQATDPHSIAERLRRERIAERMKSLQELVPNGNKTDKASMLDEIIDYVKFLQLQVK

SEQ ID NO: 4126 - protein, 53 aa, Arabidopsis thaliana
  G602,DBP domain
WENSKKAAVEAQLRKIEEKLEKKKAQYGEKMKNKVAAIHKLAEEKRAMVEAKK

SEQ ID NO: 4127 - protein, 9 aa, Arabidopsis thaliana
  G605,1st AT-hook domain
KKRRGRPRK

SEQ ID NO: 4128 - protein, 116 aa, Arabidopsis thaliana
  G605,2nd AT-hook domain
FTPHIITVNAGEDVTKRIISFSQQGSLAICVLCANGVVSSVTLRQPDSSGGTLTYEGRFEILSLSGTFMPSDSDGTRSRTGGMSVSLASPDGRVVGGGVAGLLVAATPIQVVVGTF

SEQ ID NO: 4129 - protein, 55 aa, Arabidopsis thaliana
  G617,TEO domain
KDRHSKVCTVRGLRDRRIRLSVPTAIQLYDLQDRLGLSQPSKVIDWLLEAAKDDV

SEQ ID NO: 4130 - protein, 58 aa, Arabidopsis thaliana
  G618,TEO domain
KDRHSKVCTAKGPRDRRVRLSAPTAIQFYDVQDRLGFDRPSKAVDWLITKAKSAIDDL

SEQ ID NO: 4131 - protein, 90 aa, Arabidopsis thaliana
  G620,CAAT domain
REQDQYMPIANVIRIMRKTLPSHAKISDDAKETIQECVSEYISFVTGEANERCQREQRKTITAEDILWAMSKLGFDNYVDPLTVFINRYR

SEQ ID NO: 4132 - protein, 57 aa, Arabidopsis thaliana
  G627,MADS domain
MVRGKTEMKRIENATSRQVTFSKRRNGLLKKAFELSVLCDAEVALVIFSPRSKLYEF

SEQ ID NO: 4133 - protein, 61 aa, Arabidopsis thaliana
  G629,bZIP domain
DKMKRRLAQNREAARKSRLRKKAYVQQLEESRLKLSQLEQELEKVKQQGHLGPSGSINTGI

SEQ ID NO: 4134 - protein, 91 aa, Arabidopsis thaliana
  G632,TH domain
SSGEDHEVKAPKKRAETWVQDETRSLIMFRRGMDGLFNTSKSNKHLWEQISSKMREKGFDRSPTMCTDKWRNLLKEFKKAKHHDRGNGSAK

SEQ ID NO: 4135 - protein, 22 aa, Arabidopsis thaliana
  G652,1st Z-CLDSH domain
FGFITPSDGGDDLFVHQSSIRS

SEQ ID NO: 4136 - protein, 15 aa, Arabidopsis thaliana
  G652,2nd Z-CLDSH domain
SCFKCGEPGHMAREC

SEQ ID NO: 4137 - protein, 15 aa, Arabidopsis thaliana
  G652,3rd Z-CLDSH domain
CYSCGESGHFARDCT

SEQ ID NO: 4138 - protein, 52 aa, Arabidopsis thaliana
  G654,1st Z-LIM domain
CKACEKTVYAVELLSADGVGYHKSCFKCTHCKSRLQLSSYSSMEGVLYCKPH

SEQ ID NO: 4139 - protein, 52 aa, Arabidopsis thaliana
  G654,2nd Z-LIM domain
CATCSKTVYPIEKVTVESQTYHKSCFKCSHGGCPISPSNYAALEGILYCKHH

SEQ ID NO: 4140 - protein, 102 aa, Arabidopsis thaliana
  G668,MYB-(R1)R2R3 domain
KGPWTPEEDIILVSYIQEHGPGNWRSVPTHTGLRCSKSCRLRWTNYLRPGIKRGNFTEHEEKTIVHLQALLGNRWAAIASYLPERTDNDIKNYWNTHLKKKL

SEQ ID NO: 4141 - protein, 109 aa, Arabidopsis thaliana
  G670,MYB-(R1)R2R3 domain
KGLWSPEEDEKLLTHITNHGHGCWSSVPKLAGLQRCGKSCRLEQIWYRRLRWINYLRPDLKRGAFSPEEENLIVELHAVLGNRWSQIASRLPGRTDNEIKNLWNSSIKK

SEQ ID NO: 4142 - protein, 102 aa, Arabidopsis thaliana
  G678,MYB-(R1)R2R3 domain
KGRWTAEEDRTLSDYIQSNGEGSWRSLPKNAGLKRCGKSCRLRWINYLRSDIKRGNITPEEEDVIVKLHSTLGTRWSTIASNLPGRTDNEIKNYWNSHLSRK

SEQ ID NO: 4143 - protein, 64 aa, Arabidopsis thaliana
  G713,HB domain
KKMKKSNNQKRFNEEQIKSLELIFESETRLEPRKKVQVARELGLQPRQMTIWFQNKRARWKTKQ

SEQ ID NO: 4144 - protein, 332 aa, Arabidopsis thaliana
  G716,ARF domain
TELWKVCAGPLVEVPRAQERVFYFPQGHMEQLVASTNQGINSEEIPVFDLPPKILCRVLDVTLKAEHETDEVYAQITLQPEEDQSEPTSLDPPIVGPTKQEFHSFVKILTASDTSTHGGFSVLRKHATECLPSLDMTQATPTQELVTRDLHGFEWRFKHIFRGQPRRHLLTTGWSTFVSSKRLVAGDAFVFLRGENGDLRVGVRRLARHQSTMPTSVISSQSMHLGVLATASHAVRTTTIFVVFYKPRISQFIVGVNKYMEAIKHGFSLGTRFRMRFEGEESPERIFTGTIVGSGDLSSQWPASKWRSLQVQWDEPTTVQRPDKVSPWEIEP

SEQ ID NO: 4145 - protein, 49 aa, Arabidopsis thaliana
  G729,GARP domain
WTSSLHARFVHAVELLGGHERATPKSVLELMDVKDLTLAHVKSHLQMYR

SEQ ID NO: 4146 - protein, 145 aa, Arabidopsis thaliana
  G760,NAC domain
GFRFHPTDEELVRYYLKRKVCNKPFKFDAISVTDIYKSEPWDLPDKSKLKSRDLEWYFFSMLDKKYSNGSKTNRATEKGYWKTTGKDREIRNGSRVVGMKKTLVYHKGRAPRGERTNWVMHEYRLSDEDLKKAGVPQEAYVLCRI

SEQ ID NO: 4147 - protein, 147 aa, Arabidopsis thaliana
  G761,NAC domain
GFRFHPTDEELVDYYLRKKVASKRIEIDFIKDIDLYKIEPWDLQELCKIGHEEQSDWYFFSHKDKKYPTGTRTNRATKAGFWKATGRDKAIYLRHSLIGMRKTLVFYKGRAPNGQKSDWIMHEYRLETDENGTPQEEGWVVCRVFKK

SEQ ID NO: 4148 - protein, 151 aa, Arabidopsis thaliana
  G767,NAC domain
LQFPPGFRFHPTDEELVLMYLCRKCASQPIPAPIITELDLYRYDPWDLPDMALYGEKEWYFFSPRDRKYPNGSRPNRAAGTGYWKATGADKPIGRPKPVGIKKALVFYSGKPPNGEKTNWIMHEYRLADVDRSVRKKNSLRLDDWVLCRIY

SEQ ID NO: 4149 - protein, 60 aa, Arabidopsis thaliana
  G791,HLH/MYC domain
ESSSATSSKACREKQRRDRLNDKFMELGAILEPGNPPKTDKAAILVDAVRMVTQLRGEAQ

SEQ ID NO: 4150 - protein, 92 aa, Arabidopsis thaliana
  G807,HS domain
PFLSKTYDMVDDPLTNEVVSWSSGNNSFVVWSAPEFSKVLLPKYFKHNNFSSFVRQLNTYGFRKVDPDRWEFANEGFLRGRKQLLKSIVRRK

SEQ ID NO: 4151 - protein, 504 aa, Arabidopsis thaliana
  G820,AKR domain
EYIPCLDNVEAIKRLNSTARGERFERNCPNDGMGLNCTVPIPQGYRSPIPWPRSRDEVWFNNVPHTKLVEDKGGQNWIYKENDKFKFPGGGTQFIHGADQYLDQISQMIPDISFGNHTRVVLDIGCGVASFGAYLMSRNVLTMSIAPKDVHENQIQFALERGVPAMVAAFTTRRLLYPSQAFDLVHCSRCRINWTRDDGILLLEVNRMLRAGGYFVWAAQPVYKHEKALEEQWEEMLNLTTRLCWVLVKKEGYIAIWQKPVNNTCYLSRGAGVSPPLCNSEDDPDNVWYVDLKACITRIEENGYGANLAPWPARLLTPPDRLQTIQIDSYIARKELFVAESKYWKEIISNYVNALHWKQIGLRNVLDMRAGFGGFAAALAELKVDCWVLNVIPVSGPNTLPVIYDRGLLGVMHDWCEPFDTYPRTYDLLHAAGLFSIERKRCNMTTMMLEMDRILRPGGRVYIRDTINVTSELQEIGNAMRWHTSLRETAEGPHSSYRVLLCEK

SEQ ID NO: 4152 - protein, 496 aa, Arabidopsis thaliana
  G833,AKR domain
DYTPCQDQRRAMTFPRDSMIYRERHCAPENEKLHCLIPAPKGYVTPFSWPKSRDYVPYANAPYKALTVEKAIQNWIQYEGDVFRFPGGGTQFPQGADKYIDQLASVIPMENGTVRTALDTGCGVASWGAYLWSRNVRAMSFAPRDSHEAQVQFALERGVPAVIGVLGTIKLPYPTRAFDMAHCSRCLIPWGANDGMYLMEVDRVLRPGGYWILSGPPINWKVNYKAWQRPKEDLQEEQRKIEEAAKLLCWEKKYEHGEIAIWQKRVNDEACRSRQDDPRANFCKTDDTDDVWYKKMEACITPYPETSSSDEVAGGELQAFPDRLNAVPPRISSGSISGVTVDAYEDDNRQWKKHVKAYKRINSLLDTGRYRNIMDMNAGFGGFAAALESQKLWVMNVVPTIAEKNRLGVVYERGLIGIYHDWCEAFSTYPRTYDLIHANHLFSLYKNKCNADDILLEMDRILRPEGAVIIRDDVDTLIKVKRIIAWNEMGCEACRS

SEQ ID NO: 4153 - protein, 66 aa, Arabidopsis thaliana
  G852,1st SCR domain
MQVLFEVCPCFKFGFLAANGAILEAIKGEEEVHIIDFDINQGNQYMTLIRSIAELPGKRPRLRLTG

SEQ ID NO: 4154 - protein, 89 aa, Arabidopsis thaliana
  G852,2nd SCR domain
FQLHHMPDESVTTVNQRDELLHMVKSLNPKLVTVVEQDVNTNTSPFFPRFIEAYEYYSAVFESLDMTLPRESQERMNVERQCLARDIVN

SEQ ID NO: 4155 - protein, 74 aa, Arabidopsis thaliana
  G852,3rd SCR domain
CEGEERIERYEAAGKWRARMMMAGFNPKPMSAKVTNNIQNLIKQQYCNKYKLKEEMGELHFCWEEKSLIVASAW

SEQ ID NO: 4156 - protein, 57 aa, Arabidopsis thaliana
  G859,MADS domain
MGRKKVEIKRIENKSSRQVTFSKRRNGLIEKARQLSILCESSIAVLVVSGSGKLYKS

SEQ ID NO: 4157 - protein, 56 aa, Arabidopsis thaliana
  G860,MADS domain
GRGKIAIKRINNSTSRQVTFSKRRNGLLKKAKELAILCDAEVGVIIFSSTGRLYDF

SEQ ID NO: 4158 - protein, 56 aa, Arabidopsis thaliana; identical to SEQ ID NO: 3968
  G861,MADS domain

SEQ ID NO: 4159 - protein, 63 aa, Arabidopsis thaliana
  G864,AP2 domain
EKKFRGVRQRPWGKWAAEIRDPLKRVRLWLGTYNTAEEAAMVYDNAAIQLRGPDALTNFSVTP

SEQ ID NO: 4160 - protein, 66 aa, Arabidopsis thaliana
  G867,1st AP2 domain
SSKYKGVVPQPNGRWGAQIYEKHQRVWLGTFNEEDEAARAYDVAVHRFRRRDAVTNFKDVKMDEDE

SEQ ID NO: 4161 - protein, 93 aa, Arabidopsis thaliana
  G867,2nd AP2 domain
AEALFEKAVTPSDVGKLNRLVIPKHHAEKHFPLPSSNVSVKGVLLNFEDVNGKVWRFRYSYWNSSQSYVLTKGWSRFVKEKNLRAGDVVSFSR

SEQ ID NO: 4162 - protein, 66 aa, Arabidopsis thaliana
  G9,1st AP2 domain
SSKYKGVVPQPNGRWGAQIYEKHQRVWLGTFNEQEEAARSYDIAACRFRGRDAVVNFKNVLEDGDL

SEQ ID NO: 4163 - protein, 94 aa, Arabidopsis thaliana
  G9,2nd AP2 domain
REVLFEKAVTPSDVGKLNRLVIPKQHAEKHFPLPSPSPAVTKGVLINFEDVNGKVWRFRYSYWNSSQSYVLTKGWSRFVKEKNLRAGDVVTFER

SEQ ID NO: 4164 - protein, 25 aa, Arabidopsis thaliana
  G903,Z-C2H2 domain
CEVCGKGFQRDQNLQLHRRGHNLPW

SEQ ID NO: 4165 - protein, 44 aa, Arabidopsis thaliana
  G911,RING/C3H2C3 domain
CTVCLSDFESDDKVRQLPKCGHVFHHHCLDRWIVDYNKMKCPVC

SEQ ID NO: 4166 - protein, 68 aa, Arabidopsis thaliana
  G912,AP2 domain
HPIYRGVRQRNSGKWVCEVREPNKKSRIWLGTFPTVEMAARAHDVAALALRGRSACLNFADSAWRLRI

SEQ ID NO: 4167 - protein, 67 aa, Arabidopsis thaliana
  G913,AP2 domain
HSIFRGIRLRNGKWVSEIREPRKTTRIWLGTYPVPEMAAAAYDVAALALKGPDAVLNFPGLALTYVA

SEQ ID NO: 4168 - protein, 102 aa, Arabidopsis thaliana
  G925,ABI3/VP-1 domain
KESLFEKSLTPSDVGKLNRLVIPKQHAEKYFPLNAVLVSSAAADTSSSEKGMLLSFEDESGKSWRFRYSYWNSSQSYVLTKGWSRFVKDKQLDPGDVVFFQR

SEQ ID NO: 4169 - protein, 58 aa, Arabidopsis thaliana
  G926,CAAT domain
EPVYVNAKQYEGILRRRKARAKAELERKVIRDRKPYLHESRHKHAMRRARASGGRFAK

SEQ ID NO: 4170 - protein, 105 aa, Arabidopsis thaliana
  G932,MYB-(R1)R2R3 domain
KGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKK

SEQ ID NO: 4171 - protein, 11 aa, Arabidopsis thaliana
  G940,EIL domain
AQDGILKYMLK

SEQ ID NO: 4172 - protein, 171 aa, Arabidopsis thaliana
  G957,NAC domain
GQSKVPPGFRFHPTEEELLHYYLRKKVNSQKIDLDVIREVDLNKLEPWDIQEECRIGSTPQNDWYFFSHKDKKYPTGTRTNRATVAGFWKATGRDKIICSCVRRIGLRKTLVFYKGRAPHGQKSDWIMHEYRLDDTPMSNGYADVVTEDPMSYNEEGWVVCRVFRKKNYQK

SEQ ID NO: 4173 - protein, 144 aa, Arabidopsis thaliana
  G960,NAC domain
FRFRPTDEELVNHYLRLKINGRHSDVRVIPDIDVCKWEPWDLPALSVIKTDDPEWFFFCPRDRKYPNGHRSNRATDSGYWKATGKDRSIKSKKTLIGMKKTLVFYRGRAPKGERTNWIMHEYRPTLKDLDGTSPGQSPYVLCRL

SEQ ID NO: 4174 - protein, 61 aa, Arabidopsis thaliana; identical to SEQ ID NO: 3254
  G964,HB domain

SEQ ID NO: 4175 - protein, 58 aa, Arabidopsis thaliana
  G986,WRKY domain
KDGYQWRKYGQKITRDNPSPRAYFRCSFSPSCLVKKKVQRSAEDPSFLVATYEGTHNH

SEQ ID NO: 4176 - DNA, 780 bp, Artificial Sequence
  P3354 (opLexA::G156, G156 is from A. thaliana)
aggaagagggagccactcataagaggaagaagagagagatgggtagagggaagatagagataaagaagatagagaatcagacggcgaggcaagtgaccttctccaagagaagaactggtcttataaagaagactcgtgagctctctattctctgtgacgctcacatcggtctcatcgtcttctcagccaccggaaagctttccgagttctgctccgaacagaacaggatgcctcaactcattgaccgatacttgcataccaacggattgcgacttcctgatcatcatgacgaccaggagcaattgcaccatgagatggaactactaagaagagagacatgtaaccttgagcttcgtctgcgtccattccatggacatgacttagcctccattcctcctaatgagcttgacggactcgagagacagctagaacattctgtcctcaaagtccgtgagcgtaagaggaggatgctagaagaagataacaacaacatgtaccgttggcttcatgagcatcgtgcagcgatggagtttcaacaagctgggatagataccaaaccaggggagtatcaacagtttatagagcagcttcagtgctataaaccaggggagtatcagcagtttctagagcagcagcaacaacaaccaaacagcgttcttcagcttgctacacttccttctgagattgatcctacttacaatctccagcttgctcagcctaatcttcaaaacgatccaacggcccagaatgattaatacaattctcaatagatatctactc

SEQ ID NO: 4177 - DNA, 1095 bp, Artificial Sequence
  P3357 (opLexA::G189, G189 is from A. thaliana))
ccacaactctctccttgtagagagagagattttatggcggtggagctcatgactcggaattacatctccggcgtcggagctgatagcttcgccgttcaagaagcagctgcttcaggactcaaaagtatcgaaaatttcatcggtttaatgtctcgtgatagctttaactctgatcagccatcttcttcttccgcctccgcctccgcctccgccgccgcagatcttgaatcagctcgtaacacaacggcggacgcggctgtttcaaagtttaaaagagtcatatctctcttagatcgaactcgaaccggacacgcccggtttagacgtgctccggttcatgttatttctccggttcttttacaagaagaaccaaaaacgacgccgtttcagtctcctcttcctcctccgccgcaaatgatccgaaaaggttcgttttcttcatcgatgaaaacgattgatttctcatctctctcctctgtaacaacggaatcagacaaccagaagaagattcatcatcatcaacgtccctctgaaacggcgccgtttgcgtctcaaactcaaagcctctccacgacggtctcgtctttctcaaaatcaacaaagagaaaatgtaactctgagaatcttctcaccggaaaatgcgcttccgcttcttcctccggtcgttgtcattgctcgaagaaaagaaagataaaacagaggagaataattagggttccggcgataagtgcaaaaatgtccgatgtaccaccggacgattattcatggaggaaatacggacaaaaaccaattaaaggatctccacatccaagaggatattataagtgtagtagcgtaagaggttgtccagcacgtaaacatgttgagagagcagctgatgattcgtccatgttgattgttacttatgaaggagatcataatcattctctctccgccgctgatctcgccggagccgccgttgctgatcttattttggaatcgtcttgaaaagaacaaatctttatttaaggcttttataatataaatttagatccttacttagtgaagtactcaaactatgaatgaaatcaatgtaatcaaaatcaaaaagctttt

SEQ ID NO: 4178 - DNA, 1606 bp, Artificial Sequence
  P3363 (opLexA::G748, G748 is from A. thaliana))
agaagacggaacagaggctccaaaaaaatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgttatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaatgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttagagttacatatgtatatgtatatatgtatgattgattgtatgtatagatgatactggagaatgatgagtttttgagaatcaaactcttttcttctttctagtgattgcctttattcctttacatgttttggttctctgtacactatttgatttaccttttttactttctttcttcatttgtcaggaaatgttggaagataacattaatggtaaaaagttggtgtggaccgttg

SEQ ID NO: 4179 - DNA, 686 bp, Artificial Sequence
  P3367 (opLexA::G975, G975 is from A. thaliana)
attactcatcatcaagttcctactttctctctgacaaacatcacagagtaagtaagaatggtacagacgaagaagttcagaggtgtcaggcaacgccattggggttcttgggtcgctgagattcgtcatcctctcttgaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaaatcttatttgcttatatatatgtacctat

SEQ ID NO: 4180 - DNA, 1012 bp, Artificial Sequence
  P3371 (opLexA::G1760, G1760 is from A. thaliana)
ccctaaaaaagagaagaaccagaggagattcaattagaggataaaattgatgggaagagggaagattgtgatccaaaggatcgatgattcaacgagtagacaagtcactttctccaaacgaagaaagggccttatcaagaaagccaaagagctagctattctctgtgatgccgaggtcggtctcatcatcttctctagcaccggaaagctctatgactttgcaagctccagcatgaagtcggttattgatagatacaacaagagcaagatcgagcaacaacaactattgaaccccgcatcagaagtcaagttttggcagagagaagctgctgttctaagacaagaactgcatgctttgcaagaaaatcatcggcaaatgatgggagaacagctaaatggtttaagtgttaacgagctaaacagtcttgagaatcaaattgagataagtttgcgtggaattcgtatgagaaaggaacaactgttgactcaagaaatccaagaactaagccaaaagaggaatcttattcatcaggaaaacctcgatttatctaggaaagtacaacggattcatcaagaaaatgtggagctctacaagaaggcttatatggcaaacacaaacgggtttacacaccgtgaagtagctgttgcggatgatgaatcacacactcagattcggctgcaactaagccagcctgaacattccgattatgacactccaccaagagcaaacgaataacagagagattgaagttggaagataccatgatgttgaagaacactccaaaggccttggtttgaataaggttcttgaactggaaacctctatacaccaagccacgtacgataagcagcatggttcttctaacatagtcatattttcaatcctaaatataattaaagcatatataattaaaatccggtgttgttatactcatcttgagtattaatattgtacttgtttataaccatagattcgtcaattaatagagaaaaatcatatgaattattatcc

SEQ ID NO: 4181 - DNA, 505 bp, Artificial Sequence
  P3375 (opLexA::G3, G3 is from A. thaliana)
gtttgtcttttatcaatggaaagagaacaagaagagtctacgatgagaaagagaaggcagccacctcaagaagaagtgcctaaccacgtggctacaaggaagccgtacagagggatacggaggaggaagtggggcaagtgggtggctgagattcgtgagcctaacaaacgctcacggctttggcttggctcttacacaaccgatatcgccgccgctagagcctacgacgtggccgtcttctacctccgtggcccctccgcacgtctcaacttccctgatcttctcttgcaagaagaggaccatctctcagccgccaccaccgctgacatgcccgcagctcttataagggaaaaagcggcggaggtcggcgccagagtcgacgctcttctagcttctgccgctccttcgatggctcactccactccgccggtaataaaacccgacttgaatcaaatacccgaatccggagatatatagtcaatttatatacatgtagtttgttttg

SEQ ID NO: 4182 - DNA, 904 bp, Artificial Sequence
  P3376 (opLexA::G22, G22 is from A. thaliana)
atacacaactacttatctcttcacttcattagtctccaagaagaaaacatctctcactctctaaaatacacactctcatcaaaaaccttctcttcggttcagaagcattcaagaatccattatgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccggctggacaccctccgttcctcccgttacctctccggcggaggaaaataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcgagtctagtttggttgtaccggagttggatttcacggtggatcagttttacttcgatggtagtttattaatggaccaatcagaatgttcttattctgataatcggatataattagttttaagattaagcaaaatttgtccaacgagttttgctgtatgaaatatctatcgatgactcaacaggttttgatcatgatcatatgtaatgtgatgg

SEQ ID NO: 4183 - DNA, 732 bp, Artificial Sequence
  P3404 (opLexA::G489, G489 is from A. thaliana)
ctggtagtgaatggatcaacaagaccatggacagtctggagctatgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaaccacagccttccccttgcgagaatcaagaaaatcatgaaagcggatgaagatgtccgtatgatctcggctgaggcgccggtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccaggaaaattagcaagaaactgtgagtcttccagcttc

SEQ ID NO: 4184 - DNA, 1311 bp, Artificial Sequence; identical to SEQ ID NO: 61
  P3410 (opLexA::G1137, G1137 is from A. thaliana)

SEQ ID NO: 4185 - DNA, 1190 bp, Artificial Sequence
  P3411 (opLexA::G1228, G1228 is from A. thaliana)
gcatttataattactcactcatcttcttttcattacattacataccaaacaagagctctcaaatggaaaggtttcaaggacacatcaacccctgtttcttcgatcgaaaaccggatgtgagaagcctcgaggttcaaggatttgcagaggctcaaagctttgctttcaaagaaaaagaggaagaaagcttacaagatacagttccatttctacagatgctgcaaagtgaagacccctcatcgtttttttcaatcaaagagccaaactttctgacgctactgtctcttcaaaccctcaaggagccttgggaactcgaaagatatctttcacttgaggattcacaatttcattcaccggtccaatctgagaccaaccgcttcatggaaggagccaatcaagctgtgtcaagccaagaaattccctttagccaagcaaacatgacactcccttcttctacctcatcaccactcagtgcacattcaagacgaaagcgcaaaatcaaccacttgctgcctcaagaaatgactagagaaaagagaaagaggaggaaaacaaaaccaagtaaaaacaatgaagagattgagaatcaaagaataaaccacattgctgttgaacgaaacagaagacgtcaaatgaacgaacatatcaactctctccgggcccttctcccaccttcctacatccaacgaggagaccaagcttccatagtaggaggagcaataaactacgtgaaggtcctcgagcaaatcatacaatctctcgaatcgcaaaagagaacgcaacaacaaagtaacagtgaggtagtagaaaacgcacttaatcatctctcaggcatttcgtcgaacgacctgtggacaactcttgaagatcaaacttgtatccccaaaatcgaagctacagtgatacaaaaccatgtcagccttaaagttcaatgtgagaagaaacaaggacaacttctcaaaggaatcatatcacttgaaaagcttaaactcactgttcttcatctcaatatcactacttcgtctcattcctctgtttcttattccttcaacctcaagatggaagatgagtgcgacttagagtcagccgacgagattacggcggctgttcatcggattttcgatattccgacaatttgattaaacacatataattccaaaaatattaacagctgacaaaatggtatcttt

SEQ ID NO: 4186 - DNA, 748 bp, Artificial Sequence; identical to SEQ ID NO: 107
  P3412 (opLexA::G1275, G1275 is from A. thaliana)

SEQ ID NO: 4187 - DNA, 903 bp, Artificial Sequence
  P3413 (opLexA::G1309, G1309 is from A. thaliana)
ctcttaattaagacgacttgagagagaaagaaagatacgtggaagatgaccaaatctggagagagaccaaaacagagacagaggaaagggttatggtcacctgaagaagaccagaagctcaagagtttcatcctctctcgtggccatgcttgctggaccactgttcccatcctagctggattgcaaaggaatgggaaaagctgcagattaaggtggattaattacctaagaccaggactaaagagggggtcgtttagtgaagaagaagaagagaccatcttgactttacattcttccttgggtaacaagtggtctcggattgcaaaatatttaccgggaagaacagacaacgagattaagaactattggcattcctatctgaagaagagatggctcaaatctcaaccacaactcaaaagccaaatatcagacctcacagaatctccttcttcactactttcttgcgggaaaagaaatctggaaaccgaaaccctagatcacgtgatctccttccagaaattttcagagaatccaacttcatcaccatccaaagaaagcaacaacaacatgatcatgaacaacagtaataacttgcctaaactgttcttctctgagtggatcagttcttcaaatccacacatcgattactcctctgcttttacagattccaagcacattaatgaaactcaagatcaaatcaatgaagaggaagtgatgatgatcaataacaacaactactcttcacttgaggatgtcatgctccgtacagattttttgcagcctgatcatgaatatgcaaattattattcttctggagatttcttcatcaacagtgaccaaaattatgtctaagaagagtgaatatgatcgtaagaggaacataagctagttacttgtgttaca

SEQ ID NO: 4188 - DNA, 876 bp, Artificial Sequence
  P3417 (opLexA::G1326, G1326 is from A. thaliana)
ggtacggtggagatagagatagcatccatggagatgtctagaggaagcaacagttttgacaataagaagcctagttgccaaagaggtcactggagacctgttgaagatgacaatctccggcaactcgttgaacaatacggtcccaagaactggaattttattgctcaacatctctatggaagatcagggaaaagctgtagattaagatggtacaaccaacttgatccaaacatcaccaagaaacccttcaccgaggaggaagaagagagactgcttaaagctcatcggatccaagggaatcgttgggcctccatagcccgactgttccccgggaggaccgacaacgctgtcaaaaaccattttcatgtcatcatggctagacgcaaacgggaaaacttctcttccacagctacttctacgttcaaccaaacttggcatactgttttgagccctagttctagtcttacaaggctaaatagatcccatttcgggctatggaggtatcgaaaggataagagttgcggtctctggccttactcttttgtttcaccacctacgaatggtcaatttggatcttcatctgtctctaacgtacaccacgaaatttatcttgagaggagaaagtcgaaagagttggtggatcctcagaattacacatttcatgcagccacaccagatcataagatgacttcaaatgaagatggaccatccatgggagatgatggtgagaagaacgatgttactttcattgattttcttggtgttggattagcttcttaggttataacatcacaagtcaaagcttttaagggtttctatcattagggttaggcatcattttcagccttttgcttccttaaactctcatatggatct

SEQ ID NO: 4189 - DNA, 1018 bp, Artificial Sequence
  P3423 (opLexA::G1540, G1540 is from A. thaliana)
ctctttactaccagcaagttgttttcttgctaacttcaaacttctctttctcttgttcctctctaagtcttgatcttatttaccgttaactttgtgaacaaaagtcgaatcaaacacacatggagccgccacagcatcagcatcatcatcatcaagccgaccaagaaagcggcaacaacaacaacaagtccggctctggtggttacacgtgtcgccagaccagcacgaggtggacaccgacgacggagcaaatcaaaatcctcaaagaactttactacaacaatgcaatccggtcaccaacagccgatcagatccagaagatcactgcaaggctgagacagttcggaaagattgagggcaagaacgtcttttactggttccagaaccataaggctcgtgagcgtcagaagaagagattcaacggaacaaacatgaccacaccatcttcatcacccaactcggttatgatggcggctaacgatcattatcatcctctacttcaccatcatcacggtgttcccatgcagagacctgctaattccgtcaacgttaaacttaaccaagaccatcatctctatcatcataacaagccatatcccagcttcaataacgggaatttaaatcatgcaagctcaggtactgaatgtggtgttgttaatgcttctaatggctacatgagtagccatgtctatggatctatggaacaagactgttctatgaattacaacaacgtaggtggaggatgggcaaacatggatcatcattactcatctgcaccttacaacttcttcgatagagcaaagcctctgtttggtctagaaggtcatcaagacgaagaagaatgtggtggcgatgcttatctggaacatcgacgtacgcttcctctcttccctatgcacggtgaagatcacatcaacggtggtagtggtgccatctggaagtatggccaatcggaagttcgcccttgcgcttctcttgagctacgtctgaactagctcttacgccggtgtcgctcggg

SEQ ID NO: 4190 - DNA, 1008 bp, Artificial Sequence
  P3424 (opLexA::G1543, G1543 is from A. thaliana)
ggttgatgagataccaaacgcatcttaatattttctccttaatttactttggttatgtctttctatgataaaactactatttacgtacatatgcacatacacatataaactatatgctctatatcatatggattacgcatgcgtgtgtatgtataaatataaaggcatcgtcacgcttcaagtttgtctcttttatattaaactgagagttttcctctcaaactttaccttttcttcttcgatcctagctcttaagaaccctaataattcattgatcaaaataatggcgattttgccggaaaactcttcaaacttggatcttactatctccgttccaggcttctcttcatcccctctctccgatgaaggaagtggcggaggaagagaccagctaaggctagacatgaatcggttaccgtcgtctgaagacggagacgatgaagaattcagtcacgatgatggctctgctcctccgcgaaagaaactccgtctaaccagagaacagtcacgtcttcttgaagatagtttcagacagaatcatacccttaatcccaaacaaaaggaagtacttgccaagcatttgatgctacggccaagacaaattgaagtttggtttcaaaaccgtagagcaaggagcaaattgaagcaaaccgagatggaatgcgagtatctcaaaaggtggtttggttcattaacggaagaaaaccacaggctccatagagaagtagaagagcttagagccataaaggttggcccaacaacggtgaactctgcctcgagccttactatgtgtcctcgctgcgagcgagttacccctgccgcgagcccttcgagggcggtggtgccggttccggctaagaaaacgtttccgccgcaagagcgtgatcgttgatttgtgtatcttaattatttgagtatggtttagaagtcaacgaaggtctgctattgagcctacaaaatattaacgatcacatgatttcgtgtaaatactaagagactctgttccgc

SEQ ID NO: 4191 - DNA, 1366 bp, Artificial Sequence
  P3573 (opLexA::G558, G558 is from A. thaliana)
cagcgcccagaatgctccgggtgaccaacatttgttcctgattcatttcctattggttcgtattgtctgtgcacacaagagaaatttcaagaagttgttactaaaagagaggccacaagtggatattgtctttgttatcaagtgttagtacagaaaagtggtgagaaagtaatatggctgataccagtccgagaactgatgtctcaacagatgacgacacagatcatcctgatcttgggtcggagggagcactagtgaatactgctgcttctgattcgagtgaccgatcgaagggaaagatggatcaaaagactcttcgtaggcttgctcaaaaccgtgaggcagcaaggaaaagcagattgaggaagaaggcttatgttcagcagctagagaacagccgcttgaaactaacccagcttgagcaggagctgcaaagagcaagacagcagggcgtcttcatttcaggcacaggagaccaggcccattctactggtggaaatggtgctttggcgtttgatgctgaacattcacggtggttggaagaaaagaacaagcaaatgaacgagctgaggtctgctctgaatgcgcatgcaggtgattctgagcttcgaataatagtcgatggtgtgatggctcactatgaggagcttttcaggataaagagcaatgcagctaagaatgatgtctttcacttgctatctggcatgtggaaaacaccagctgagagatgtttcttgtggctcggtggatttcgttcatccgaacttctaaagcttctggcgaatcagttggagccaatgacagagagacagttgatgggcataaataacctgcaacagacatcgcagcaggctgaagatgctttgtctcaagggatggagagcttacaacagtcactagctgatactttatcgagcgggactcttggttcaagttcatcagggaatgtcgcaagctacatgggtcagatggccatggcaatgggaaagttaggtacactcgaaggatttatccgccaggctgataatttgagactacaaacattgcaacagatgataagagtattaacaacgagacagtcagcacgtgctctacttgcaatacacgattacttctcacggctacgagctctaagctccttatggcttgctcgacccagagagtgaaactgtattttggtcacatgtcagctgtacaaaatccatatggacacaaaaccaggagagactattaatcaacacttgtcagattcttcttaccaaatccatcaacaaataagcaaatttctgggaaacaaaagactctttgtatgtaggtttcttctacatggttgtggtaattcatgttgttttagttgtagtcatca

SEQ ID NO: 4192 - DNA, 800 bp, Artificial Sequence
  P3579 (opLexA::G1065, G1065 is from A. thaliana)
ttcctctctatttcttcggctgagaggcggcgactatggcggaggaacagaagatagcgttagaatcagaatctccggcgaaggttacgactcctgctccagcagatacaccggctccagctccggcagagattccggctccagctccagctccgactccggctgatgtcacgaaagacgttgcagaggagaaaattcaaaacccacctccggagcaaattttcgatgactccaaagcccttactgttgttgagaaacctgtagaagagcctgcaccggcgaaacctgcgtctgcatcgctcgatagagatgttaagctagctgatttgtcaaaggaaaagagattgtctttcgtcagagcgtgggaagaaagcgaaaagagcaaagcagagaacaaagctgagaagaagattgcagatgttcatgcttgggaaaacagcaagaaagcagctgtcgaagcgcaactcaagaaaatcgaggagcaactagagaagaagaaagcagagtatgcagagaggatgaagaataaggttgcagcgattcacaaggaagcagaagagagaagagcaatgattgaagctaagcgtggagaagacgttcttaaagcagaagaaacggctgctaaatacagagccactggaattgttccaaaggcaacttgtggatgtttctaatcttgaatttgcgaatcaaagtttcaagacttcgtaactgtaaagtgtaatcaaatttctctgttctctttaatggcttgtaatgttgtttgtatattgattttgtgtgtgacaatcagagtgaaa

SEQ ID NO: 4193 - DNA, 1564 bp, Artificial Sequence
  P3580 (opLexA::G1078, G1078 is from A. thaliana)
cggttagtaattcgatgagacggcatcatcaacaaccttcaccaatgccgcaagtatacggcggcgctgaacaaagtaaatatgataaagcagatgatgctacgatatcttctggtagctatagaggcggaggagatatcgctgacatgaagatggtagttaggcatagggatttgaaagaaatcatcgatgccattaaggaaaatttcgataaggctgctgcctcaggggagcaagtctctcagatgctcgagcttggcagagctgagctcgatcgtagtttcagccaattgaagaaaacggtgattcattcgagtagtttattaagcaacttgagctcgacatggacctcgaagccgccattggcagtcaagtataggatagacacgactgcgctggatcaaccgaacagttcgaagagcctttgttccactcttgaccgtctcttggcatgggagaagaagctttatgaagaaattaaggctagagaaggtttcaagattgagcatgagaagaagttatcacagcttcaaagccaagaatataaaggggaggatgaagctaagttagacaagacaaaggcctctataacgaggttacagtcactgatcattgttacttctcaagctgttactaccacatctactgccatcatccgtcttcgtgatactgaccttgttccacaactcgttgagctctgtcatggctttatgtacatgtggaaatctatgcatcaataccatgagactcagaacagcatcgtggagcaagtccgggggctcattaacagatcgggcaaaggcgaatcaacatctgagctacaccgacaagctacacgtgacttggaatcagctgtctcttcttggcactccagtttcagtagtttgattaaattccaacgtgacttcatacactcagttcacgcctggttcaagctgacccttcttccggtttgccaagaagacgccgccaatcatcacaaagagccgctcgatgcttacgccttctgcgatgagtggaaactcgctctagatcgtattcccgatacagttgcatctgaggcaatcaagagcttcatcaacgttgtacacgtgatatccgcaaaacaagccgatgaacacaagataaagaaaagaacagaatcagcatcaaaagagcttgagaagaaggcttcgtcggttagaaacctagagagaaaatactaccagtcatactcaatggttggtgtcggtttaccagagtcaggacccgataaccgacacatgttagacgctcgagacccgttaagcgataaaaagtcagagcttgcggtttgccaaaggagagttgaggaagagatggtgaaatactcaaaggcaatagaagtgacaagagccatgactttgaataatctgcagacagggttgcctggtgtgttccaatctttaacaagtttctctgctttgttcatggagtctcttcaaacggtatgcactcgctcatactctatcaaataggacattatatattatatatatatatatattgatatgcttacagagtttacagtaacaattgtgagccg

SEQ ID NO: 4194 - DNA, 1099 bp, Artificial Sequence
  P3582 (opLexA::G194, G194 is from A. thaliana)
gccatttgatagattgtttccggtaaagctcagcgagagaagaagaagaacaacaatggagtttacagatttctcaaagacgagtttttactacccgtcgtcacaaagcgtttgggatttcggagatttagcggcggcggagaggcattctttagggttcatggagttattaagttctcagcagcatcaagactttgctactgtttctcctcattccttccttctccaaacgtctcaaccgcaaacgcaaacgcaaccatcggcgaagctgtcttcaagtatcattcaagctccaccgtcagagcaattagtgacgtcaaaggtggagtctttgtgttcggatcatttgttgataaacccaccggcgactcctaactcgtcatcgatttcgtctgcttcaagcgaggctctaaatgaagagaaaccgaaaacagaagacaatgaagaagaaggaggtgaagatcaacaagagaagagtcatactaagaaacagttgaaagcaaagaagaataatcagaagagacagagagaggcaagagtcgcattcatgacaaagagtgaagttgatcatctcgaagatggttatcgctggcgaaaatatggtcaaaaagctgtcaaaaacagtccttttcccaggagttactaccgttgcacaacggcttcatgtaacgtgaagaagagagtggagagatcattcagagatccaagcactgtggttacaacctacgaaggtcaacacactcacattagtccactcacgtctcgtcctatttccactggaggtttcttcggatcgtcaggagctgcttcgagtctcggtaatggttgctttgggtttcctattgatggctccacgttaatctctcctcagttccaacagcttgtccaataccatcaccaacagcagcaacaagaactcatgtcttgttttggaggagtcaacgagtaccttaatagccacgctaatgagtatggtgatgataatcgtgtgaagaagagtcgagttttggttaaagataatggacttctgcaagatgttgttccgtctcatatgttgaaggaagagtagtagtatatatatagtcttatagttttaatc

SEQ ID NO: 4195 - DNA, 1773 bp, Artificial Sequence
  P3585 (opLexA::G559, G559 is from A. thaliana)
caataatcgtttgcagggtcgttgatttggtgataagtcagtagaaatggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggtaattggttttcgtttttcttctgtgattctctggtttcttaaatcctgtttatagtgtggatggacacggtgactatttgtgtgcttttggtttgaaccttaatgccaccagtcatttagttgcttcagctgttcccacataacttcagctttttaatgagtggagcaagtgtataatttgtttttgtttcatacaataggatatgggcaaacaggcagtccgcagcacgatcaaaagaaaggaagacgagatacatatttgagcttgagagaaaagtacagactttgcaaacagaggctacaactctctcagcccagttgaccctcttacaggttagttttgactcattgtacggttgttctttcttcatgctaaatgaaactaaatctagccttacaacgtttgttcgtgcattgtgattttttatgggttgaaaacttgtgctcttttcttcctgtttgtatagagagacacaaatggcttgactgttgaaaacaatgagctgaagctgcggttacaaacaatggagcagcaggttcacttgcaggatggtgagtctctcttttatcacaaacaatatccctctgtgccaagactgctatagttggttcatatcatcgaattgaatcttctctattaacagaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactgaggaatatgaatatgtcccacgtaagtgagaggttctccttctgaacaattcctttctcattcataaattgttgttcatccatcacttgcagtctcttggatg

SEQ ID NO: 4196 - DNA, 1591 bp, Artificial Sequence
  P3590 (opLexA::G939, G939 is from A. thaliana)
cagattctatggatatgtataacaacaatatagggatgttccggagtttagtttgtagctcggcgcctccatttacagagggacatatgtgttctgattcgcatacggctttgtgcgatgatctgagtagtgatgaggaaatggaaatagaggagcttgagaagaagatctggagagacaagcagcgtttaaagcggctcaaggaaatggcgaagaacggtctaggaacaagattgttgttgaagcagcaacatgatgattttccagagcactctagtaagagaaccatgtacaaggcacaagatgggatcttgaagtacatgtcgaagacaatggagcgatataaagctcaaggttttgtttatgggattgtgttagagaatgggaaaacggtagcgggatcttctgataatctccgtgaatggtggaaagacaaagtgaggtttgataggaacggcccagctgctataatcaagcaccaaagggatatcaatctttctgatggaagtgattcagggtctgaggttggggattctaccgcacagaagttgcttgagcttcaagatactactcttggagctctgttatcggctctgtttcctcactgcaaccctcctcagaggcggtttccgttggagaaaggcgtgacaccgccatggtggccaacggggaaagaagattggtgggatcaactgtctttacccgttgattttcgaggtgttccgccaccttacaagaagcctcatgatctcaagaagctgtggaaaattggtgttttgattggtgtaatcagacatatggcttctgacattagcaacatacccaatctcgtgagacggtctagaagtttgcaggagaaaatgacgtcaagagaaggcgctttatggctcgctgctctttaccgagaaaaggctattgttgatcaaatagccatgtctagagaaaacaacaacacttctaactttcttgttcctgcaaccggtggagacccagatgttttgtttcctgaatctacagactatgatgttgaactgattggtggcactcatcggaccaatcagcagtatcctgaatttgaaaacaactacaactgtgtttacaagagaaagtttgaagaagattttgggatgccaatgcatccaacactcctaacatgtgagaacagtctctgtccttatagccaaccacatatgggatttcttgacaggaacttaagagagaatcaccaaatgacttgtccttataaagtcacttccttctaccaaccaactaaaccctatggtatgacgggtttaatggttccttgtccggattataacgggatgcagcagcaggttcagagctttcaagaccagtttaatcatcccaacgatctctacagaccaaaagctccacaaagaggcaacgatgacttggttgaggatttgaatccttctccttcgacgctgaatcagaatcttggtttagtcttacctactgacttcaatggaggtgaggaaacagtaggaacagagaacaatctgcataatcaagggcaagagttgcccacatcttggattcagtaaagaaagcttcagagttttctttttat

SEQ ID NO: 4197 - DNA, 533 bp, Artificial Sequence
  P3599 (opLexA::G1053, G1053 is from A. thaliana)
cctcatataaaccaaactaaaaccatgattccggcagaaatcaacggatatttccaatatctatcaccggaatacaacgtaataaacatgccttcatctccaacctcttccttaaactacctaaacgatttgatcatcaacaacaacaactattcctcatcatccaacagtcaagatctcatgataagcaacaactcaacttccgacgaagatcatcatcaaagcatcatggtactcgacgagaggaaacagagaaggatgctttcgaacagagaatctgcaaggaggtcaaggatgaggaaacagagacatcttgatgaactctggtctcaggtaataaggcttcgcaacgagaacaactgtcttatcgataagctgaaccgcgtatcggagactcaaaattgtgtattgaaggagaactctaaactcaaagaagaagcttctgatctccgacagcttgtttgtgaactgaaatctaacaagaacaacaacaatagttttccaagagagtttgaagataattagtattactc

SEQ ID NO: 4198 - DNA, 668 bp, Artificial Sequence; identical to SEQ ID NO: 381
  P3603 (opLexA::G1836, G1836 is from A. thaliana)

SEQ ID NO: 4199 - DNA, 1127 bp, Artificial Sequence; identical to SEQ ID NO: 285
  P3604 (opLexA::G1640, G1640 is from A. thaliana)

SEQ ID NO: 4200 - DNA, 1300 bp, Artificial Sequence
  P3606 (opLexA::G1635, G1635 is from A. thaliana)
tcaagtctagattcgcgaatttatcttggtgtttccttttctgtgttccacacctttcgagtttttttttgttttcctccgccgagatcttaatccgggaagttatggcgtcgtctccgttgactgcaaatgttcagggtaccaacgcttctttgaggaatagagatgaagaaactgcagacaagcagatacaattcaatgaccaaagttttgggggaaatgactatgcacccaaggtacggaagccatacacgataacaaaagagagagagagatggacagatgaagagcacaagaagtttgttgaagccttgaaattatacgggcgagcttggagacgaatagaagaacatgtgggctcaaagaccgcagttcagattcgaagccatgctcagaagtttttctctaaggttgctcgagaagcaactggaggtgatgggagctcagtagagccgattgtaatacctcctcctcgtcccaagagaaagccagcgcatccgtaccctcgtaagtttgggaacgaggcagatcaaacaagtagatcggtttctccctcagaacgtgatactcaatctccaacctctgtgttgtccactgttggatcagaagcattgtgttcccttgattcgagttcacccaatcgaagcttgtccccagtttcttctgcatcaccaccagctgctcttacaaccactgcaaatgcacctgaagagcttgagactctgaagctggagttgtttcctagtgagagactcttaaacagggagagctcgatcaaggaaccaacgaagcaaagtcttaaactctttgggaagacagttttggtatctgattcaggcatgtcctcttctctaacaacttcaacatattgtaaatccccaattcagccattaccacggaaactctcatcatccaagacactacccataataagaaactcacaagaagaactcttgagctgctggatacaagtccctcttaagcaagaagatgtggaaaatagatgtttggattcaggaaaggctgtccaaaacgaaggatcatcgactggatcaaacactggttcggtggatgatacgggacacacggaaaagaccacagaacccgaaacaatgctatgtcaatgggagtttaaaccaagtgagaggtctgcattttctgagctcagaagaacaaactccgagtcaaattcaagaggatttggtccatacaagaagagaaagatggtaacagaagaagaagagcatgagattcatctccacttataacacattttcttacgtaccctaaagaagagact

SEQ ID NO: 4201 - DNA, 803 bp, Artificial Sequence
  P3616 (opLexA::G1419, G1419 is from A. thaliana)
ttcatcatctatggcttcttcacatcaacaacagcaagaacaagaccagtcagctttagatctcataacccaacaccttcttactgatttcccttccttagacacctttgcctccaccatccaccactgcaccacctcaactctaagccaacgcaaaccacctcttgccactatagcagttcctactactgcaccggtggttcaagagaatgatcaaaggcattacagaggcgtcaggagaagaccatggggtaagtatgcggctgagatcagagacccaaacaagaaaggtgttcgtgtctggttaggcacttttgacacagccatggaagctgcaagaggttatgacaaggcagcttttaaactacgaggaagcaaagctattcttaacttcccacttgaagcaggaaagcatgaggacttgggagacaacaagaagactatttctttaaaagcaaagaggaagagacaggtgacggaggatgaaagccagctgatcagccgtaaagctgttaagagggaagaagctcaggttcaggctgatgcttgtccattaacgccatcaagttggaaggggttttgggacggagcagacagtaaagacatgggaatattttccgtgcctctgttatctccttgtccatctcttggacactctcaactcgtagttacttaagcttcagagggtcaaactggaaaaaatcaacattggattgttttcaaagcttctagattagctgattgtaaaaaaatgttttactatattcattcattcttcttaaatgcaattctttctacccttc

SEQ ID NO: 4202 - DNA, 1243 bp, Artificial Sequence
  P3617 (opLexA::G1903, G1903 is from A. thaliana)
cttcatatctctagaagtttcataattagttatgtctaaatctagagatacggagataaagttgtttgggaggacaatcacatctcttttagatgtgaattgttatgatccgtcgtcgttgtcccctgttcacgatgtttcttctgatccaagcaaggaggattcgtcttcttcttcatcttcttgttctccaactattggaccaatcagggttccggttaaaaaaagtgagcaagagagtaacaaattcaaagatccatatatattatccgatctaaacgaaccaccaaaagcagtatctgagatttcatcaccaagaagttccaagaacaactgtgatcaacagagcgagatcacaacaacaactaccacaagtactacatcaggagagaaatcaacggctctcaagaaaccggacaagcttattccatgtcctagatgtgaaagcgcaaacaccaaattctgttattacaacaactacaacgtgaaccagccacgttacttctgcaggaactgtcagaggtattggacagctggtggatctatgaggaacgttcctgttggctcaggtcgtcgcaagaacaaaggatggccttcttcaaaccattacttgcaagtcacttctgaggattgtgataataataactcggggacgatccttagtttcggttcttcggagtcttcggttacagagactggtaagcatcagtcaggtgatacagcaaagataagtgctgattcagtttctcaagaaaataaaagctaccaagggtttcttcctccgcaagtaatgttacctaataattcttctccttggccttaccaatggagtccaacgggtcctaacgctagtttctaccctgtccccttctactggggatgcacggttccgatataccctacctcagagacttcatcatgtttaggaaaacggtcaagagatcaaactgaaggaagaatcaatgatactaatacaacaataactactacaagagcaagattggtctcagaatctcttagaatgaatatcgaagctagtaagagcgctgtgtggtctaagttaccgacaaaacccgagaaaaaaacgcaaggattcagtttgttcaatggatttgacacaaagggaaacagcaacagaagtagcttggtctccgaaacttctcacagtctacaagcaaaccctgcagcgatgtctagagctatgaacttcagggagagcatgcaacaataatcagacactaat

SEQ ID NO: 4203 - DNA, 1065 bp, Artificial Sequence
  P3619 (opLexA::G635, G635 is from A. thaliana)
ccttccttgtatgattttctataatccagcatggagatcatgcgtccaggggtctcagaaaacactttgaaaggaaaaataagaatcacaacgcggtgcatgtggcttgacaaaggaagacttttagatgcacttcacaaagcagctcatgctgctctatcaagttgtcctgtgacatgtcccttgtctcacatggaaagaacagtctccgaagtcctgaggaagattgtaaggaagtacagtggtaaaaggcctgaagtcatcgctatagccactgagaatccaatggctgtccgagctgatgaggtcagtgcgagactgtctggtgatccaagtgttggttctggagttgcagctttaaggaaagttgttgaaggaaatgacaaaagaagtcgggcgaagaaagcaccttcacaagaagcttcccccaaagaagtagatcgcactttggaagatgatatcattgatagtgcaagactactggctgaagaagaaactgcggcatcaacatacacggaagaagttgatacgcccgttgggagttcttcagaagagtcagacgatttttggaaatcattcatcaatccatcatcgtcaccttcaccgagtgaaacagaaaatatgaataaggtagctgatacggagcctaaagcagagggtaaggaaaacagcagagacgacgatgaattagctgatgcttcagattctgaaaccaagtcatcaccaaaacgtgtgaggaagaacaaatggaaaccggaggagataaagaaggtaatcagaatgcgaggagagctgcacagtagatttcaagtggtgaaaggtagaatggcattgtgggaagagatctcttcaaatctatcagctgaaggaatcaatcgaagcccgggacaatgcaaatctctctgggcatcacttattcagaaatacgaggagagcaaggctgatgagagaagcaagacgagttggccacattttgaggatatgaacaacattttgtcagagctaggcacacctgcgtcttaagtaatgtgatttagatgacattatcttcccaaaagaatcatc

SEQ ID NO: 4204 - DNA, 1149 bp, Artificial Sequence
  P3631 (opLexA::G1421, G1421 is from A. thaliana)
ctccttctttagtgtcctccttcaccaaactcttgattccataagcatatattaaaaaagctctctgctttcttcaactttcccgggaaaatcttcttgttacaaagcatcaatctcttgttttaccaattttctctctttattccttttttgccctttacttttcctaactttggtctttatatataaacacacgacacaaagaagaacacacataagttaaaactattacaacagttttaaagagagagatttaaaaaatggagacagagaagaaagtttctctcccaagaatcttacgaatctctgttactgatccttacgcaacagattcgtcaagcgacgaagaagaagaagttgattttgatgcattatctacaaaacgacgtcgtgttaagaagtacgtgaaggaagtggtgcttgattcggtggtttctgataaagagaagccgatgaagaagaagagaaagaagcgcgttgttactgttccagtggttgttacgacggcgacgaggaagtttcgtggagtgaggcaaagaccgtggggaaaatgggcggcggagattagagatccgagtagacgtgttagggtttggttaggtacttttgacacggcggaggaagctgccattgtttacgataacgcagctattcagctacgtggtcctaacgcagagcttaacttccctcctcctccggtgacggagaatgttgaagaagcttcgacggaggtgaaaggagtttcggattttatcattggcggtggagaatgtcttcgttcgccggtttctgttctcgaatctccgttctccggcgagtctactgcggttaaagaggagtttgtcggtgtatcgacggcggagattgtggttaaaaaggagccgtcttttaacggttcagatttctcggcgccgttgttctcggacgacgacgtttttggtttctcgacgtcgatgagtgaaagtttcggcggcgatttatttggagataatctttttgcggatatgagttttggatccgggtttggattcgggtctgggtctggattctccagctggcacgttgaggaccattttcaagatattggggatttattcgggtcggatcctgtcttaactgtttaagaaataactggccgtttaacggcgt

SEQ ID NO: 4205 - DNA, 1380 bp, Artificial Sequence
  P3635 (opLexA::G979, G979 is from A. thaliana)
cctctgaggaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaagtttatctgggagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttggtctgagagagagagctttgccttctagtttgaa

SEQ ID NO: 4206 - DNA, 1307 bp, Artificial Sequence
  P3641 (opLexA::G639, G639 is from A. thaliana)
cgtattttttttaccttttcccgaaatggaacttctcgccggcgactgtcggaaacgagtcggcgacgactttgaggaagatattaacccattcgatggttcggacggtggttgcgggtggatgtacggtacccgtcaaatgggttctaacggaaacgacgacgctttggctacgctcgcagacttggcttcgcctcctcagaaattgaaacctataaggtgtggcgttaagcttccgtcgtcgtcggaggatcgacatcctcttgatattctcgccggaaccctagataggctgccggagatgggttttggctgcttcgaagctcctttgggatcgaagattgctgacgtggaggaaagtggtcaattgactcgtgggttttcaaaggaagaggatgattctcttcctcctcttcaaatggagtttcaagctcgaaatcgcatctcttgggatggtctctctctcagctcctctgttgatagcagcgatagtgactcatctccagacgttcgcaagaccgtcacgggtaaaagaaagcgggaaacaagggtaaagctggagcatttcttggagaagcttgtggggagtatgatgaagcggcaggagaagatgcataatcagttgattaatgtgatggagaagatggaagtggagagaatacgccgtgaggaagcttggaggcaacaggaaaccgagaggatgacacagaatgaagaagcacggaagcaagagatggcacgcaacttgtctctcatctctttcatcagaagtgttactggtgacgagatcgagatccctaaacagtgtgaattcccgcaaccactccagcagattcttccggaacaatgtaaagacgagaaatgtgaatccgctcagagagaaagagagataaagtttaggtactcaagcggcagtggcagcagtggtagaaggtggccgcaagaggaagtgcaggcattgataagttcgagaagcgatgtggaagagaagacggggatcaacaagggagcgatttgggatgagatatcagcaagaatgaaagaaagagggtacgaaagatctgcgaaaaagtgtaaggagaagtgggagaacatgaacaagtactataggagagtgacggaaggtgggcagaaacagcctgagcacagcaagactcgctcatactttgagaaacttggaaatttttacaagaccatttcctcgggagagagggaaaaatgagtgaaagattttaaatttaggtgtttttggcacgcaaaacgggagaacttgtagatgattacctcgagtttaatttttatatctg

SEQ ID NO: 4207 - DNA, 956 bp, Artificial Sequence
  P3645 (opLexA::G1865, G1865 is from A. thaliana)
caagaagaggacatgaagcacagagattctgcagactgcaggtgaccaatggacactttatcaataaaaacatacctactactctcttacactttcaattttccaatacaaatcccaatctttaatctctctttcttcttcatctctctttctctttctctcttcatggctacaaggattccattcacagaatcacaatgggaagaacttgaaaaccaagctcttgtgttcaagtacttagctgcaaatatgcctgttccacctcatcttctcttcctcatcaaaagaccctttctcttctcttcttcttcttcttcatcttcttcttcaagcttcttctctcccactctttctccacactttgggtggaatgtgtatgagatgggaatgggaagaaagatagatgcagagccaggaagatgtagaagaactgatggcaagaaatggagatgctctaaagaagcttaccctgactctaagtactgtgagagacatatgcatagaggcaagaaccgttcttcctcaagaaagcctcctcctactcaattcactccaaatctctttctcgactcttcttccagaagaagaagaagtggatacatggatgatttcttctccatagaaccttccgggtcaatcaaaagctgctctggctcagcaatggaagataatgatgatggctcatgtagaggcatcaacaacgaggagaagcagccggatcgacattgcttcatccttggtactgacttgaggacacgtgagaggccattgatgttagaggagaagctgaaacaaagagatcatgataatgaagaagagcaaggaagcaagaggttttataggtttcttgatgaatggccttcttctaaatcttctgtttctacttcactcttcatttgatcatcttttgttcttataaccttgtatttcttgttaagatggtaatgcaaattctc

SEQ ID NO: 4208 - DNA, 1055 bp, Artificial Sequence
  P3647 (opLexA::G1226, G1226 is from A. thaliana)
cagaaaacagttccattagagagactcataaagcttctcatctaattatgagtggattgatgagttttggtgaattagaagaccaatttggtcagatttcagacactactatggaagagaagataccatttctgcaaatgcttcaatgcatagaacacccttttacaacaacagaaccaaatcagtttctccaatcacttctccagatccaaaccctagaatcaaagagctgtctcacccttgaaacaaacatcaaaagagatccgggtcaaacagatgacccggaaaaggatccaagaacagaaaacggagcagtaacggtcaaagaaaaaagaaaacggaaacgtacaagagctccaaagaacaaagacgaagttgaaaaccaaaggatgactcacattgccgtcgaacgtaatcgaagacgacaaatgaacgaacacttaaactctctccgatctctcatgcctccttcgtttcttcaacggggtgaccaagcttcgattgtaggaggggcaatagatttcatcaaggaactagagcaactcttgcaatctctagaagctgagaaacgaaaggatggaactgatgaaactcctaaaacggcgtcgtgttcttcatcttcgtctcttgcatgcactaactcttctatttctagcgtgtctacgacgtcggaaaatggatttacggcgagattcggcggtggagatacgacagaagtggaggctacggtgatacagaaccatgtgagcttaaaagttcggtgtaagagaggaaaacgacagatcttaaaagctattgtctcgattgaagaactaaagcttgcgattctacatctcactatctcttcttcctttgactttgtcatctactctttcaatctcaagatggaagatggttgtaaattaggatcagcagatgagatagcgacagccgttcatcagatcttcgagcaaatcaacggtgaagtcatgtggtcaaatcttagtcgaacttagttgacttttgactcctagtaacgtgtgtaaactttaggttacaaagaaaagggacgtgat

SEQ ID NO: 4209 - DNA, 953 bp, Artificial Sequence
  P3650 (opLexA::G812, G812 is from A. thaliana)
atcgaaatcatcaagaatcttgtctttaatttccaattgggtttttcaaaacccgttacctcaggatgatgaacccgtttctcccggaaggctgcgatccaccaccaccaccacaaccaatggagggtttacacgaaaatgctccacctccatttctgaccaagacatttgagatggtggatgatccaaacactgaccacatcgtatcttggaacagaggaggaacaagttttgtcgtctgggatttgcattctttctccacgattctccttcctcgtcatttcaaacacagcaatttctcaagtttcatcagacaactcaatacttatggtttcagaaagatagaagcagagagatgggaatttgcaaacgaagagtttttgttaggacaaagacagttgttgaagaacatcaagaggagaaacccttttactccatcatcttcaccaagccatgacgcttgcaacgagcttcgcagagagaagcaagtgctaatgatggagatagtgagtctaagacagcagcaacaaacaacgaaaagctacatcaaagctatggaacagaggatagaaggaacagagaggaaacagagacaaatgatgtcgtttctggctagagcaatgcagagtccttcgtttttgcatcagttgttgaaacaaagagataaaaaaattaaggagcttgaggataatgagtcagcaaagaggaaaagaggttcttcttcgatgtcggaattggaagttttggctttggagatgcaagggcatggaaaacagaggaatatgttggaagaagaggatcatcaactggtggtagagagagagttggatgatggtttctgggaagagttgcttagtgatgagagtttggcttccacctcctaactagatggatttctttttggttttgtttttagtttcttctactttcaagctcattttcttctgtcacaa

SEQ ID NO: 4210 - DNA, 892 bp, Artificial Sequence
  P3651 (opLexA::G1950, G1950 is from A. thaliana)
ttctgaattcgaattcgaactttggaagaagaagaagctttgatcaatcatggaaattgcaaccgatacagcaaagcagatgagagacgaagagttgttcaaagcagcggaatggggagattcatcgttgttcatgtcattatctgaagaacagctctctaaatctctcaatttcagaaacgaagatggtcgctctctcctccatgtcgctgcttccttcggccattctcaaatagtgaagttgttatcaagttcagatgaagcaaagactgtaatcaatagcaaggatgatgaaggatgggctcctttgcattccgctgctagcatcggtaatgctgagctcgttgaggtgcttttgaccagaggtgctgatgtcaatgccaaaaataacggtggtcgcactgctcttcactatgctgctagcaaaggccggttggagattgctcagcttttattaacacacggtgcaaagattaacatcacagacaaggttggttgcactccgcttcacagggcagcaagcgtgggaaagttagaagtttgtgaatttcttattgaagaaggagcagagatcgatgctacggataaaatgggtcaaactgcactcatgcattcagttatctgcgatgacaaacaggttgcgttcctgcttataagacatggtgcagatgtggatgtagaagacaaggaaggctacactgttctaggccgagctaccaatgaattccgacctgcacttatcgatgctgctaaggccatgcttgaaggataaaatgactctggattactttaaaacttactaactctgagagttgtttagttacttaaaaggatttttctttactgtatcatgtttgcaaaatgtttctgccttatcaattcatgttctgtc

SEQ ID NO: 4211 - DNA, 982 bp, Artificial Sequence
  P3652 (opLexA::G1521, G1521 is from A. thaliana)
accgaacaatctctatctccggtcatgcctccattaccgtcctccacggcgccttcgtcttcgagacatcttcgatcgccggaaagtatcgcgaaatttgcagggagagcaatatttcctgctttacaggggaaatcgtgtccgatatgcctcgaaaatctaaccgagcgaagatccgccgccgtgatcacggtgtgcaagcacggatactgccttgcttgtattcggaagtggagcagcttcaagaggaattgtcctctttgtaacactcgttttgattcctggtttatcgttagtgattttgcttctagaaaataccataaggagcaattaccaattcttcgtgatcgtgagactttaacttatcatcggaataatccttccgatcgccggaggataattcaaaggtcgagggatgttttggaaaactctagctcaagatcaaggccattgccatggcggagatcatttggacgaccaggttcagttcctgattctgttatcttccagcgaaagcttcagtggcgagctagcatatacactaagcaattacgagctgttcgattacattcaaggcgcttggaactaagtttggcggtgaatgattacaccaaagcaaagataactgaaagaattgagccatggattagaagagagcttcaggcagtccttggagatcctgatccctcagttattgttcattttgcgtcagctcttttcatcaaaaggcttgagagagagaataatcgacaaaccgggcagaccgggatgttggtggaagatgaagtctcctctcttcgaaaattcttgtctgataaggtggatatattttggcatgaactaagatgttttgcggagagtatactcacgatggagacttatgatgcagtggttgaatacaatgaggtggagtaatagcagtaaaaaaaacagataaccgagcactatgctctcgtcaaatgaagtaaatagacagacttac

SEQ ID NO: 4212 - DNA, 918 bp, Artificial Sequence
  P3657 (opLexA::G580, G580 is from A. thaliana)
ctattctgttctgttctccaatgttgtcatcagcaaagcataataagatcaacaaccatagtgccttttcaatttcctcttcatcatcatcattatcaacatcatcctccctaggccataacaaatctcaagtcaccatggaagaagtatggaaagaaatcaaccttggttcacttcactaccatcggcaactaaacattggtcatgaaccaatgttaaagaaccaaaaccctaataactccatctttcaagatttcctcaacatgcctctgaatcaaccaccaccaccaccaccaccaccttcctcttccaccattgtcactgctctctatggctctctgcctcttccgcctcctgccactgtcctcagcttaaactccggtgttggattcgagtttcttgataccacagaaaatcttcttgcttctaaccctcgctcctttgaggaatctgcaaagtttggttgtcttggtaagaaaagaggccaagattctgatgatactagaggagacagaaggtataagcgtatgatcaagaacagagaatctgctgctcgttcaagggctaggaagcaggcatatacaaacgaacttgagcttgaaattgctcacttgcagacagagaatgcaagactcaagatacaacaagagcagctgaaaatagccgaagcaactcaaaaccaagtaaagaaaacactacaacggtcttccacagctccattttgagaaaaatctactatttctttttgggggagtttcaagtgtttcttatgaagatgagaaaaacagaaaaagtttgtacattttagctaagttaaatttgtggtggtaagtaatgtaaaagaaaagtgtgtgtagaagaaaagtgtctagaaaaagaaagcaactaactttcttcttcttctctggtttcctatcg

SEQ ID NO: 4213 - DNA, 795 bp, Artificial Sequence
  P3765 (opLexA::G209, G209 is from A. thaliana)
cagtccaagtcaaacctcctcaagccatcccctaatcctatatatcagtttcttctcgcaaaccacctcacaatctatcaacagttttaaaaaaagacataactcaaccaatctcactttgaaaaagacatgaacaaaacccgccttcgtgctctctccccaccttccggtatgcaacaccgtaagagatgtcgattgagaggtcgaaactacgtaaggccagaagttaaacaacgcaacttctcaaaagatgaagacgatctcatcctcaagcttcatgcacttcttggcaatagatggtcattgatagcgggaagattgccaggacgaaccgacaacgaagttaggatccattgggaaacttacctaaaaaggaagctcgtaaaaatgggaatcgacccaaccaatcatcgtctccaccatcacaccaactacatttgtagacgccacctccattcttcacataaggaacatgaaaccaagattattagtgatcaatcttcttcggtatccgaatcatgtggtgtaacaattttgcccattccaagtaccaattgctcggaggatagtactagtaccggacgaagtcatttgcctgacctaaacattggtctcatcccggccgtgacttctttgccgctctttgccttcaggactctagcgaatcctctaccaatggttcaacaggtcaagaaacgcttcttctattccgatgagaaatggtgtatttctttgtacacatttgttatattacaaatgcacatattataatattcactagagagatggtataac

SEQ ID NO: 4214 - DNA, 716 bp, Artificial Sequence
  P3771 (opLexA::G435, G435 is from A. thaliana)
gatgtcattgtatgtcttctatagtatatgttaaacttatatcactagaaacttatcttagttatgaatacaaagtttgtgttaattttgtttgcttatcttttacatagaacaccatcaatgttttaagtatgagtgcgtgtgtgtatatatacacatccttagccacaacgttgtacatagctcacaacaaaagaaaaaacaaaaaagaagagaaaaatggagaattctcagagtcagggtaaaaacaagaagaagaggctaacacaagatcaagttagacaactggagaagtgcttcactatgaacaagaagcttgagccagatctgaaacttcaactgtcgaaccagcttggtctacctcaaagacaagtcgctgtctggttccaaaacaagcgagccaggttcaagactcagtctcttgaggtccaacactgcactcttcagtccaagcacgaagcagctctctccgacaaggcaaagttagagcatcaagtgcagtttctccaagatgagctgaagagagcaaggaatcagcttgctctgttcacaaatcaagattctcctgttgataattctaatcttggttcttgtgatgaagatcatgatgatcaagtggtggtattcgacgagctttacgcttgctttgttagcaatggacatggatcttcatcaacctcatgggtctgattctgtttcgacgcagacaagattcc

SEQ ID NO: 4215 - DNA, 1347 bp, Artificial Sequence
  P3778 (opLexA::G553, G553 is from A. thaliana)
tagaatgccaagattcattcttcatctctcgagctcctcatgaatttcttctctgcttatcaatggagatgatgagctcttcttcttctactactcaagttgtatcattcagagacatggggatgtatgaaccatttcaacagttatctggttgggagagtcctttcaaatcagatatcaacaatattactagtaatcagaataacaatcagagttcttcaacaacacttgaggttgatgctagaccagaagcagatgataacaatagagtgaattatacttctgtgtataataactctcttgaagcagaaccgtcgagtaataatgatcaggacgaagaccggatcaatgataagatgaaacggcgtttggctcagaaccgagaagctgctcgcaaaagtcgtttgagaaagaaggcccatgttcaacagttagaagaaagccggttgaagttgtcacagctcgagcaggaacttgtaagagctaggcagcagggattatgcgtacgcaattcttcagatactagttatctaggaccagctgggaatatgaactcaggtattgctgcatttgagatggaatacacacactggctagaagagcaaaacaggagagttagtgagattcgaacagcgctccaagctcatataggtgacattgagctcaaaatgttggtagatagttgcttgaaccactacgcaaatctcttccgcatgaaagctgatgctgcaaaggctgatgtgttcttcttgatgtcgggaatgtggcgaacttcaactgaacgcttcttccaatggattggaggtttccgcccatccgagcttttaaatgttgtgatgccatacgttgagcccttaaccgatcagcaactgttggaggtgcgtaacctgcaacagtcgtctcagcaagcagaggaggctctctctcaaggcttagataaacttcagcagggtttggtcgaaagcatagcaattcagataaaagttgttgagtctgtgaatcacggggctccaatggcttcagccatggagaatcttcaagcattggagagttttgtgaaccaggcggatcatctgagacaacagaccctgcagcaaatgagtaagatattgacgacaagacaggctgctcgagggttgctcgctctaggagaatacttccacaggctgcgtgctcttagttctctctgggcagctcgtccacgagaacacacttgacaagttaggaggcaaacaaaacaaagagaaagaagcacaaggcagatgatgttagctatagggacttgctttatctctcagaaagtgttggctgatattttctccattagagagcatcatcttcctcatt

SEQ ID NO: 4216 - DNA, 841 bp, Artificial Sequence
  P3823 (opLexA::G976, G976 is from A. thaliana)
ggtcttatatataacaaataaacacataagttgacatatatactatatacaagtatattaattatacatatatggctgaccctaacaatcctatcactgaacctaaagctataatccaatcttctacttcatcgtcagttactattgtgccagttcccacgtgcggtgacagcctctctgactctgccacgtgtgaaaacccttgtccacttgatactatcactactactactactactgtttgttttgcggctccttcttctactgcaagtggtaatgatattaatactttaatggccactgacaccgacatctctcgccggaaaaagaatccggtttatcggggaattcgttgtcggagtggaaaatgggtgtctgaaatccgagagcctaaaaagactacacgtgtctggcttgggacttatccgacgccggagatggctgctgccgcatatgacgtggcggcgttagctcttaaaggtggagacactctcttgaacttcccggattccctgggatcttaccccattcccctttcctcttccgcagctcatatcagatgcgctgcagctgcggctgctgcgactaggggtgcggctggagcggccgtgaaggtaggtcaaaagaaggaagataaagtttatgatacggcggaatcttcaactatggggtttgtggatgaagaagagctattgaacatgcctggtttgctagcggatatggccaaagggatgatggtggctccaccgtggatgggatctccaccgtcagatgattcgccagagaattctgatggagagagcttgtggagctattgatcgattgaaagcagtttaatatc

SEQ ID NO: 4217 - DNA, 1061 bp, Artificial Sequence
  P3830 (opLexA::G1308, G1308 is from A. thaliana)
tctctgtctctcctattatgagtctaaaagtctactagctgttcaatagttttgtctttctgtgtttctcttcttcaaaaccgaaagaaattcaaaaagagtctttcgctgcttgttagtggggtgaggaacaaatgggaagaacaccttgttgtgacaagattggtttgaagaaaggtccttggacgcctgaagaagatgaggttcttgttgcgcatatcaagaaaaatggacatggaagctggagaacacttcctaaacttgctggtttacttcgctgtgggaagagttgcaggctgagatggacaaactatctgagaccagacataaagagaggtcctttcactgctgatgaagagaaacttgttatccagcttcatgccattctcggcaacaggtgggctgctattgcagcacagcttccaggaagaacagacaacgagatcaagaacttatggaacactcatttgaagaaacgtcttttatctatgggtcttgatcccagaactcatgagccattaccttcatatgggttagctaaacaagctccatcttcaccaacaactcgccacatggctcaatgggaaagtgctagggttgaagctgaggcaaggctttctagagaatcaatgctctttagcccttctttttactctggtgtagtaaaaactgaatgtgatcacttcttacgcatttggaattccgagattggtgaagctttcaggaatctcgctccattagatgaatcaactattactagtcaaagcccttgctcgagggcaacatcgacctcatctgcacttctgaagagctcaacaaattcttggggagggaaagaggttactgtggcgattcatggctcagattattctccatattcaaatgatcttgaagatgattcaacagactctgctcttcaacttctgcttgatttccctataagcgatgatgatatgagcttcttggaagagaacattgacagctactcacaggctcctcctattggtcttgtttccatggtttccaaattctagtcttatgagagcctaatatctaagaaa

SEQ ID NO: 4218 - DNA, 963 bp, Artificial Sequence
  P3832 (opLexA::G1315, G1315 is from A. thaliana)
caaagatatctcaaccggaacacttagaccaagagagacagatagagagatgggtagggctccatgttgtgacaaggcaaatgtgaagagaggtccatggtctcctgaagaagacgcaaagcttaaagattacatcgagaaacaaggaactggtggcaattggattgctctccctcacaaagctggtttaaggagatgtgcgaagagttgcagactgagatggttaaattatttgagaccaaacataagacatggagatttcactgaagaagaagacaatattatctacagcctctttgcctccattggaagcaggtggtcagtaatagcagctcacttgcaaggtagaactgataatgacatcaagaactattggaacactaagctcaagaagaagctcatagccaccatggctcctcctccacatcaccacttagccattgctacatcatcatcatcagcatccccatcatcatcatcacattacaacatgatcaatagtcttcttccgtataacccatcaacaaaccaacttctcacacctcatcagggtatcatgatgacaatgatgggccaacaacaacaactattttatcaagaagacatgggcaatttggtaaattctccaaacagaaacaatctcataatgagccatcaagaagacaaccaagagcaaagtacaaacaagggaataatgttgttgagtgatgtaagaagtgggtcgagtacaacaagtacagtaacaagagtgaagatggaacatcgtgatcatgatgatcatcatcatcatgaagaagatgagagatcaatgacctcggtagtgatggaagattatggaatggaggagatcaagcaattaataagtagtagttgtacgagtagtaacaatagcttgtggtttgacgaaaacaagacggaggataagttcatgttgtactactgatctcgagtaccaactttgat

SEQ ID NO: 4219 - DNA, 872 bp, Artificial Sequence
  P3834 (opLexA::G1320, G1320 is from A. thaliana)
gaagatcataaagatcaaaaggagagaggtattaaaaaatgatgtgtagtcgaggccattggagacctgcagaagacgagaagctaagagaactcgtcgagcaatttggtcctcataattggaacgccatagctcagaagctctctggtcgatctggtaagagttgtagattgagatggtttaatcaattggatcctaggattaaccgaaaccctttcacggaggaagaagaagaaaggcttttagcgcctcatcggatccatgggaacagatggtctgtgatcgctagattttttcccggtcgaactgataacgctgttaaaaaccattggcacgtcatcatggctcgtcgtggccgagaacggtccaagctccgtccacgaggccttggccatgatggcacggtggctgcgactgggatgattggtaattataaagactgcgataaggagagaagattggcaaccacaaccgctatcaattttccttatcaattctctcatattaatcattttcaagtcctcaaagagtccttgaccggaaagatcgggttcagaaatagtactactccaatacaagaaggagcaatagaccaaactaaacgaccgatggagttctacaattttctccaagtaaacacggattcgaagatacacgaattgatagataattcaagaaaagacgaagaagaagatgtcgatcaaaacaaccgaattcgtaacgagaattgtgttccatttttcgactttttgtctgttggaaactctgcctctcagggtttatgttaatttgtccgtaccacatgtactataaggtggaccatatgttaactaaagataatgtagaaagtactaatcaattagagctcctgt

SEQ ID NO: 4220 - DNA, 1304 bp, Artificial Sequence
  P3840 (opLexA::G1438, G1438 is from A. thaliana)
cttttatgcttctgaatttgctacatatataaactatctgaagaaagctagagaataagatgatgagtctaagtggaagtagcgggagaacaataggaaggcctccatttacaccaacacaatgggaagaactggaacatcaagccctaatctacaagtacatggtctctggtgttcctgtcccacctgagctcatcttctccattagaagaagcttggacacttccttggtctctagactccttcctcaccaatcccttggatgggggtgttaccagatgggatttgggagaaaaccagatccagagccaggaagatgcagaagaacagatggtaagaaatggagatgctcaagagaagcttacccagattcgaagtactgtgaaaaacacatgcacagaggaagaaaccgtgccagaaaatctcttgatcagaatcagacaacaacaactcctttaacatcaccatctctctcattcaccaacaacaacaacccaagtcccaccttgtcttcttcttcttcctctaattcctcttctactacttattctgcttcttcttcttcaatggatgcctacagtaacagtaataggtttgggcttggtggaagtagtagtaacactagaggttatttcaacagccattctcttgattatccttatccttctacttcacccaaacaacaacaacaaactcttcatcatgcttccgctttgtcacttcatcaaaatactaattctacttctcagttcaatgtcttagcctctgctactgaccacaaagacttcaggtactttcaagggattggggagagagttggaggagttggggagagaacgttctttccagaagcatctagaagctttcaagattctccataccatcatcaccaacaaccgttagcaacagtgatgaatgatccgtaccaccactgtagtactgatcataataagattgatcatcatcacacatactcatcctcatcatcatctcaacatcttcatcatgatcatgatcatagacagcaacagtgttttgttttgggcgccgacatgttcaacaaacctacaagaagtgtccttgcaaactcatcaagacaagatcaaaatcaagaagaagatgagaaagattcatcagagtcgtccaagaagtctctacatcacttctttggtgaggactgggcacagaacaagaacagttcagattcttggcttgacctttcttcccactcaagactcgacactggtaattaattaagtagagctggcatcaatgatggatctgcaccaacacacacaactgtg

SEQ ID NO: 4221 - DNA, 1462 bp, Artificial Sequence
  P3841 (opLexA::G1443, G1443 is from A. thaliana)
gaggtgggtttttgcttctctgtgtcgctagtttcaaaagctgtctcctttttcttggaattgaataaagcttccccaaaaatccaatttttgttatgaagatgcagagccctaaaatggagcaggaggaggttgaggaggagaggatgaggaataagtggccgtggatgaaggcggcgcagttaatggagtttcggatgcaagctttggtgtatagatacatagaggctggtctccgtgtgcctcatcatctcgtggtgcctatttggaacagtcttgctctctcttcttcctccaattacaactatcactcttcttctctgttgagtaacaagggagtaacccatatcgacacgttggaaactgaaccaactaggtgcaggagaacagatgggaagaaatggcgctgtagcaacacggtccttctattcgagaagtactgtgaacggcacatgcatagaggtcgtaaacgttcaagaaagcttgtggaatcttcttctgaggttgcttcatcatcaaccaaatacgacaacacttatggtttggataggtataacgagagtcagagtcatcttcatgggacaatctcgggttctagtaatgcgcaggtagttaccattgcttcactgcctagtgccagatcctgtgaaaatgtcattcgtccgtctttagtgatctctgaattcacaaacaaaagtgtgagtcacggcagaaagaacatggagatgagttatgatgactttattaatgaaaaagaggcgagtatgtgtgttggagttgttcctcttcaaggtgatgagagcaaaccttcggttcaaaagttcttccctgaggtatctgataaatgcttagaagctgcaaaattctcaagcaacaggaagaatgatataattgcaagaagcagagaatggaagaatatgaatgttaatggtggtttgtttcatggtatccacttttctccagacactgttcttcaagaacgtggttgttttcgtttacaaggagttgaaacagacaatgaaccaggaaggtgccgaagaacagatgggaagaagtggagatgcagcaaagatgttttgtctggtcagaagtactgcgataagcacatgcatagaggtatgaagaagaagcatccagttgatactactaactcacatgagaatgccgggtttagcccgttaaccgtggaaacagctgttagatcggttgtgccttgcaaagatggagatgaccagaagcattctgtttcagtcatgggaattacactgccccgagtttctgatgagaagagcactagcagttgcagtaccgacactaccattactgacacagctttaaggggtgaagacgacgatgaggagtacttgtctttgttttcaccaggtgtttagaaacatagaaatgttgtcgaggttcaaatgatgtttttagtttcaatctaaggatctttctgtgttagatg

SEQ ID NO: 4222 - DNA, 946 bp, Artificial Sequence
  P3843 (opLexA::G1638, G1638 is from A. thaliana)
gattcgatcaacaatcgttgaaaacatgaacagaggaatcgaagttatgtcaccagcaacatatctagagacatcaaactggttgtttcaagaaaacagaggaaccaaatggacagctgaagaaaacaagaaattcgaaaacgctttagccttttacgacaaagatactcccgacagatggtccagagtcgctgccatgcttcccggtaaaacagtcggagatgtgatcaaacaatacagagagcttgaggaagacgttagcgacatcgaagctggtcttataccaatccctggttacgcctctgattcattcacacttgattggggtggctacgacggagcaagcggtaacaatgggtttaacatgaacggttactacttttccgccgccggaggaaagagaggatccgccgcacgaacggcggagcatgagaggaagaaaggtgttccatggacagaagaagaacacagacaatttctgatgggtttgaagaaatatggaaaaggagattggagaaacatagctcgtaactttgtgaccacaagaacgccaacgcaagtcgcaagtcacgctcaaaagtatttcatacggcaagtcaatggtggcaaagacaaacgccgttcaagcatccatgatatcacaaccgtcaacatccccgactctcctgacgctgcagccgcggataacgcaaccgcaaacgcaccttgctcgccaccttccgtaggaggaaaccagcgggagacatcggagtgggaaggtcaaacactatacgatgaaacggcagctgcgttttataatcaaaacgcgttttcagaaacgctacttggaatgtcttcgacgccctacatggcaaaacttcaggagcagagttttctgaacgcatcgcaattcgaatcgtacaatgcgtatctccaaatgtagctcacaaggtgaagatctcggaga

SEQ ID NO: 4223 - DNA, 535 bp, Artificial Sequence
  P3852 (opLexA::G30, G30 is from A. thaliana)
ctcttctgacgcacaacagtatatacacatacacagatatatggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaataaagggaatacaatcggtattaactgaaagttatgtgaaagaccattttcagttataacaaataaaataaaatcccaagcgtacaaagctgtttc

SEQ ID NO: 4224 - DNA, 505 bp, Artificial Sequence
  P3853 (opLexA::G47, G47 is from A. thaliana)
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatctt

SEQ ID NO: 4225 - DNA, 1145 bp, Artificial Sequence
  P3950 (opLexA::G1131, G1131 is from A. thaliana)
tcctctcctgattgcttcaccttcttctttactacaggtttcagctcctcaatgtccatggattgcttaagctacttctttaactacgatcctcctgtccagctccaggattgctttattcccgagatggatatgattatccctgaaaccgatagtttcttcttccaatctcaaccgcaactggagtttcatcagccattgtttcaagaagaagctccttcacagacccactttgaccctttctgcgaccagtttctttctccgcaagaaatctttctccctaaccctaaaaacgaaatcttcaacgaaacacacgacctcgatttctttctccccacgccaaaacgccagagacttgttaactccagctacaattgtaacactcaaaaccatttccagagccgtaacccgaatttcttcgaccctttcggcgacactgatttcgttccagaatcttgtaccttccaggagtttcgagttccggatttctctttagctttcaaggtaggccggggagatcaagatgactcaaagaaaccgacgctttcatctcagagcatcgcggctagagggaggagaagaagaattgcagagaagactcacgagctcggaaaactcatccccggtggcaataaacttaacaccgccgagatgttccaagccgccgctaagtatgtcaagtttttgcagagtcaagttgggattctccaactgatgcagaccacaaagaaggtaataaccaaccccaaataagaactttatcatccaattgaaactctaatcgtgttttctcacaagcttcttaatttgtttacgcagggtagctctaatgtgcaaatggaaactcagtatttgcttgaatcgcaagcaatccaggagaagttatcaacagaggaagtgtgtttggtaccgtgtgaaatggttcaagatctaacaactgaagaaaccatttgcagaaccccgaatatttctcgagaaatcaacaagttactgtctaaacatctggctaactagttttagtttcaagcctgaagttctctatgcctaaatttgtgtctgttatcgttgttttgtcttcttagttagtgttttgtcttgttgatttaggggctaattatcctggttaatctcctcttaactgggaa

SEQ ID NO: 4226 - DNA, 1864 bp, Artificial Sequence
  P3952 (opLexA::G1498, G1498 is from A. thaliana)
gcctatccagtaccaacctcaattctctagagagagagatatgcatcattttgtccctgacttcgataccgatgatgattatgtcaacaaccataattcttctttgaatcatcttcctagaaaatccattactactatgggtgaagatgatgatcttatggagcttttatggcagaacggtcaagttgttgttcaaaaccagagacttcacaccaagaaaccttcttcttctccaccgaagcttcttccttctatggatcctcagcagcaaccttcttcagatcagaatctttttattcaagaagatgaaatgacttcttggcttcattatcctctccgtgacgatgatttctgctcagatcttctcttctccgccgcacctactgcgacggctaccgcgacggtgagtcaagtcaccgccgcgagaccgccagtatcttcgacgaatgagtcgaggccgccggtgaggaacttcatgaatttctcgaggctgagaggggattttaataacggtagaggtggtgaatctggaccgttgctttcgaaggcggttgtgagagaatctacgcaggtaagtcctagcgcaacaccgtcggcggcggcgagtgaatccggtttaacacggcggacggatggtactgacagttccgccgtagctggaggcggcgcgtataatcggaagggaaaagcagtggctatgacggcgccggcgatcgagataaccggtacatcgtcatctgtagtgtcaaagagcgaaatcgaaccggagaagacgaacgtcgatgataggaaacgaaaagagagagaagccaccactactgatgaaactgaatcccgtagcgaggaaacaaaacaagcacgtgtatcaacaacatctaccaagagatctcgtgctgctgaagttcataatctctctgaaagaaaacggagagataggatcaatgagagaatgaaagctttgcaagaacttatacctcgctgcaacaagtcagataaagcttcgatgctagatgaagctattgagtacatgaaatctcttcagcttcaaatacagatgatgtcaatgggatgtggaatgatgccaatgatgtatccgggcatgcaacagtacatgcctcatatggcgatgggtatgggtatgaaccagcctattcctcctccttccttcatgccattccccaacatgttagccgctcaaagacctttgcctacacaaactcacatggccgggtcaggaccgcaataccctgttcatgcttctgacccgtcaagagtctttgtaccgaaccagcagtatgatccaacctcgggccagcctcagtatccagctggttacacggatccatatcagcagttccgcggtctccacccgacccaaccacctcagtttcagaatcaagcaacatcgtacccaagttcgagcagggtgagtagtagtaaggaatctgaggatcacggaaaccacacaacaggttaataatgtccatggagcaacaagaagatctgttttcacaagcaaacacaatttcttatccgacccgacccaaccacctcagtttcagaatcaagcaacatcgtatccaagttcgagcagggtgagtagtagtaaggaatctgaggatcacggaaaccacacaacaggttaataatgtccatggagcaacaagaagatctgttttcacaagcaaacacaattttgagaaattgacagagagacctaacatgtatatatatcgccatctgtttcttgtttttctttggtttgttttgtcctctcttctcaggttgtatacttagagagctgtacatgtaatgatccagagatctaggaatcaatacatagaggttgcacggcttagtgcaa

SEQ ID NO: 4227 - DNA, 1231 bp, Artificial Sequence
  P3955 (opLexA::G328, G328 is from A. thaliana)
gcgtccgctcaccatcaaacaactacaacatctgcggttagtatgttgaaagtagagagtaactgggcacaagcctgtgatacatgccgatcagccgcctgcaccgtgtactgccgggctgattctgcctacttgtgctccagttgtgatgctcaagttcatgctgccaatcgtcttgcttcccgccatgaacgtgttcgagtctgtcaatcatgtgagcgagccccggctgcctttttctgcaaggcagatgctgcatctctatgcacaacctgtgattcagagattcattccgcaaacccacttgctagacgccatcaacgagttccaattctgcccatttctgagtactcttacagttccacggccactaaccattcatgtgagacaacagtgacagatccagagaacagacttgtgcttggtcaagaagaagaggatgaagatgaagcagaggcggcttcatggttgttgcctaattcagggaaaaacagtggtaacaacaatggcttctcgattggggatgagtttctgaaccttgttgattatagttcgagtgataagcaattcacagatcaatccaatcagtatcaactagactgcaacgtacctcagaggagctatggggaagatggagttgttccacttcaaattgaagtatcaaagggcatgtaccaagagcaacagaactttcagctgagtatcaactgtggctcctggggagctcttcgaagctccaatggttccctcagtcatatggtaagctttcatatatttaattcagatccgttactatgaccagcatgctgcttctttcacacaaatccatgaagtaaatttctaagaatgtctttgttactgtcattaggtgaatgtttcatctatggacctgggagttgtgccggagtcaacaacgagtgacgcaacagtatcaaacccaagatcgcccaaagcggtaacagaccaaccaccttaccctccagctcagatgctcagtccaagggacagagaagctagagtcctgagatacagagagaagaagaagatgaggaaatttgagaagacgataagatatgcttcaaggaaagcgtatgcagagaaaagaccacggatcaagggccggtttgcaaagaagaaagatgtcgatgaagaggcaaaccaagctttctccacaatgataacatttgacaccggatatggaattgttccatcattctgatgctgctatggc

SEQ ID NO: 4228 - DNA, 637 bp, Artificial Sequence
  P3960 (opLexA::G1965, G1965 is from A. thaliana)
aaaacctcttgagaaaaatggataacttcaatgttgttgccaatgaagacaatcaagtgaatgatgtgaagcctccaccacccccaccgcgagtgtgtgcaagatgtgattctgataacacaaaattttgttactacaacaattatagtgagtttcaaccgcgctacttctgcaagaactgtcgaagatactggactcatggtggggctttaagaaacgtaccaattggtgggagtagtcgtgccaagcggacaaggataaatcaaccttcagttgctcagatggtttctgttggaatccaaccagggaaccgttttagttctttgtctcatattcatggtggtatggtaacaaatgtgcatccaactcaaacttttcgaccaaatcatcgcctagctttccataatggatcatttgagcaagattattatgatgttgggtctgataatcttttggtaaaccaacaagttggtggatatgttgataatcacaacggttatcacatgaatcaagtggatcaatacaactggaaccagagcttcaataacgctatgaacatgaattataataacgctagcactagcggaaggatgcatcctagtcatttagagaagggtggtccttgaatcttaactat

SEQ ID NO: 4229 - DNA, 1135 bp, Artificial Sequence
  P3963 (opLexA::G1750, G1750 is from A. thaliana)
ccttttcctctctttctccaaatctctgaaaattttcaccagaatctctgttctttttttcaccagaatctctctgtttaaaataataggtgatgatgatggatgagtttatggatcttagaccagtgaagtacacagagcacaagactgttatcagaaagtacactaaaaagtcgtctatggagaggaagaccagtgttcgtgactcggccaggttggttcgggtctcaatgacggatcgtgacgccactgattcatcaagcgacgaggaagagtttctgttccctcgaagacgtgtcaagagattgattaacgagatcagagtcgagcctagcagctcttccaccggcgacgtctctgcttctccgacgaaggaccggaaaagaatcaacgttgattctacggttcaaaagccctctgtttccggccaaaaccagaagaagtaccgcggcgtgagacagcgaccatggggaaaatgggcggcggagattcgtgatcctgagcaacgccggagaatctggctcggtacttttgcaacggcggaggaagctgccatcgtctacgacaacgcagcaatcaaacttcgtggccctgatgctcttaccaacttcaccgtacaaccagaaccagaaccggtacaagaacaagaacaagaaccggagagcaacatgtcggtttcgatatcagaatcaatggacgattctcaacatctatcatctccgacatcggttctcaactaccaaacatatgtctcggaggaaccaatcgatagtcttatcaaaccggttaaacaagagtttcttgaaccagaacaagagccaataagctggcatcttggagaaggtaatactaatactaatgatgattcatttccattggacattacatttctcgacaactatttcaatgaatcattaccagacatctccatcttcgatcaacctatgtctcctattcaaccaacagagaatgatttcttcaacgaccttatgttattcgatagcaacgcagaagaatactactcctccgagatcaaagagattggttcatcgttcaacgatcttgatgattctttgatatccgatctcttacttgtgtgatatttttgccattaaccaaacaccggtttggttgc

SEQ ID NO: 4230 - DNA, 1358 bp, Artificial Sequence
  P3967 (opLexA::G432, G432 is from A. thaliana)
catcctcttcatcttacacccatccttttttatttttctagggttttatttttttttaatttattttttttctttgatttttatattctctctctctctcaaatctttactcatctgggtatggaagaataccagcatgacaacagcaccactcctcaaagagtaagtttcttgtactctccaatctcttcttccaacaaaaacgataacacaagtgataccaacaacaacaacaacaataataatagtagcaattatggtcctggttacaataatactaacaacaacaatcatcaccaccaacacatgttgtttccacatatgagctctcttctccctcaaacaaccgagaattgcttccgatctgatcatgatcaacccaacaacaacaacaacccatctgttaaatctgaagctagctcctcaagaatcaatcattactccatgttaatgagagccatccacaatactcaagaagctaacaacaacaacaatgacaacgtaagcgatgttgaagccatgaaggctaaaatcattgctcatcctcactactctaccctcctacaagcttacttggactgccaaaagattggagctccacctgatgtggttgatagaattacggcggcacggcaagactttgaggctcgacaacagcggtcaacaccgtctgtctctgcctcctctagagacccggagttagatcaattcatggaagcatactgtgacatgttggttaaatatcgtgaggagctaacaaggcccattcaggaagcaatggagtttatacgtcgtattgaatctcagcttagcatgttgtgtcagagtcccattcacatcctcaacaatcctgatgggaagagtgacaatatgggatcatcagacgaagaacaagagaataacagcggaggggaaacagaattaccggaaatagacccgagggccgaagatcgggaactcaagaaccatttgctgaagaagtatagtggatacttaagcagtttgaagcaagaactatccaagaagaaaaagaaaggtaaacttcctaaagaagcacggcagaagcttctcacgtggtgggagttgcattacaagtggccatatccttctgagtcagagaaggtagcgttggcggaatcaacggggttagatcagaaacaaatcaacaattggttcataaaccaaagaaagcgtcactggaaaccatctgaagacatgcagttcatggtgatggatggtctgcagcacccgcaccacgcagctctgtacatggatggtcattacatgggtgatggaccttatcgtctcggtccataagacatccaaaagctttagccacataataacaacctctcgtt

SEQ ID NO: 4231 - DNA, 618 bp, Artificial Sequence
  P3968 (opLexA::G1538, G1538 is from A. thaliana)
gcatctcataggactcaacctcaccaaagtcatatcctattgcatcactctcctttaaacacagtcagagaaaacagcaactcttgtctgaaaaactagagagagaaaatggatcatggtaggttaatggatgatcaaatgatgctaggctctcaagtgtacccctacacgacccaaccccaaaattcacactgcatcatcgttaaccagatcgatggaggcgaagaatcaaaaccggtgaagcggaggaggaagaggaggagtaaaggttcatcagccaccaacgaagaagacgtggcggagatcggagggatgttgaggaagaggaagttgaccgatgaacaagtgaacatgctcgaatatagcttcgggaacgagcataagctggagtcagggaggaaggagaagatcgccggagagttaggtcttgacccgagacaggtggctgtttggttccagaaccgccgtgcacgttggaagaacaagaaactagaggaagagtacgccaaactcaaaaaccaccacgacaacgtcgtactcggccaatgccaactcgagtctcaggtataaattttatgttttttcactataaaacagagtaaatttggtgattcttaa

SEQ ID NO: 4232 - DNA, 1786 bp, Artificial Sequence
  P3970 (opLexA::G1550, G1550 is from A. thaliana)
caagattttgttgtctccttcaacaatccatcagaagtagcagtttggtttccaggttaagttcttacgacctgatcagaaaacaagggactatggaactcaagtgagccaaaaagaacactccatttcgatggagaattatccagaaacacagtttattcccggagattcaatgatccagaatgctatagtttcttactctgaggaatcagccggtagagaaagaagaactgaagctaacaatgtctcagcctcacaagagaggcaagcattgtccagatttgggggagttccacaaatgcagaacattggtcaagatttcggttcttggagagatcaagcgagtgacaggaacggtttccagctaatgagcgcgatggcaggtgccacggggattcttcagaccggtcagggactgtcccttagccttggttcacagattcttccaggaattcatcagataagccatcaaaatatggcgccgagaggcaatgagtatgcaacacagagttttccgggcgggaatcagaacttggatgttgtgagaacaattcccaactcaaagtatcttaaggcggctcaacagcttctagatgaggctgttaatgtaaagaaagctctaaagcagtttcaggcagagggagataaaaacaatgagaaccctcaagaaccgaatcagagcactcaagactcgagcacgaatcctcctgcggacatctctcagtcggagagacaagaaatgcagagcaagttgacaaaactcttgtcaatgttggatgaggtggatagaagatataagcaatattaccagcagatgcagatagttgtatcctcgttcgatgtgatagctggttatggagcagctaagccatacacagcactcgcccttcaaacaatttctcgccattttcgtagcctaagggatgcgatatccggacaaatcctcgtgctacgtaaatgccttggggaacaacaagatggatcagatgggaaaagagttgggattataagccggcttaagtacgttgatcaacatttaagacaacaaagaggttttatgcaacctcaagcttggagacctcaacgcggtctacctgaaaactctgttttgattctccgtgcttggctctttgagcattttcttcacccttacccaaaggattctgataagatcatgctagcaagacaaacgggcttgagccgcggtcaggtttcaaactggttcataaatgcacgagtgcgtttatggaagccaatggtggaggagatatacaaggaggaattcacagagaatgattccaactcgtcttccgaaaatacaccgaaaatgtctgagataggacctgttgctgctgatgatgaagatcgagctcgagagttttcacaagaccagaccaaaccggaccatggacatggatatggcgaggaaactcgtggcatggtccaaggcagtcatatggatggtcgccggttcatggcagttgagcctacatatcatgtggctgatacgtcaagattgggtcgtggtgatgtgtccttgactctagggcttcaaaactctcaaggacaggacaatgttgtggctatgtctagtgaggcatacaacaacttttccggggtggatatttacgagaatgccatcccgggagatgaaatggagtatgtaaaccccggaagtcgccagaaccggataaattcttcacaattggtacatgattttgtagcttgaagaagtaagcaatggagaggaataaagcataggtgtgatgaacttatgatcagtctc

SEQ ID NO: 4233 - DNA, 725 bp, Artificial Sequence
  P3972 (opLexA::G1901, G1901 is from A. thaliana)
ccgatcaaagattgtgtgcagagtcagaaattttcccggggaaaagaaaaatgcaggatctgacgtcagcagcagcgtattatcatcagtcgatgatgatgacgacggcgaaacagaaccaaccagagttaccagaacaagaacagctaaagtgtcctcgctgtgactcacctaacactaaattctgttactacaacaattacaatctgtcacagccccgtcacttttgcaaaaactgtcgtcgttactggactaaaggcggtgctcttcgtaacatccccgtcggtggtggaactcggaaaagcaacaaacgatccggttcttctccgtctagtaatctcaagaaccaaaccgtcgctgagaaacctgatcatcatgggtccgggtcagaagaaaaagaagagagagtttcgggtcaagaaatgaatccgacccggatgttatacgggttaccagttggagatccgaatggtgcgagttttagttcgttgttggcgtcgaatatgcagatgggtgggcttgtttacgagtccgggtcgcgttggttaccaggtatggatttgggtttgggttcggtacggaggagtgatgacacgtggactgacttagctatgaacagaatggagaagaattgaagaggcgaagggtaatttggtcaatttgacatagatgtcttttttttagtcatctcatagtcaaacataacaacaaatgatgtcggtcca

SEQ ID NO: 4234 - DNA, 921 bp, Artificial Sequence
  P3975 (opLexA::G1906, G1906 is from A. thaliana)
tgaccagaaccctaataattacttacggcagctctcatcaccaccgacttctcaggttgcaggttcgagtcaagctagagtgaattcaatggtggaacgtgctcggatcgcaaaagtcccattgcctgaagcagctctaaattgccctagatgtgactcaaccaatactaagttctgttacttcaataactatagccttactcaacctcgccatttctgcaaaacatgtcgtcgctattggacacgtggcggttccttgaggaatgttcctgttggaggaggctttaggaggaacaagagaagcaaatccagatcgaaatctacggtcgtggtctcgactgataatactactagtacttcatcacttacttctcgcccaagttactcaaaccctagcaagtttcatagctacggtcaaatcccggagtttaattccaacttgcccatcttgcctcctctccaaagccttggagattacaattcaagcaacactggattagattttggtggaactcaaataagcaacatgataagtggtatgagttctagtggtgggatcttggatgcatggagaatacctccatcacaacaagctcagcaattccctttcttgatcaacactaccggattggtgcaatcttcaaacgcgttatatccattactagaaggcggggttagcgccacgcaaacaagaaatgtgaaggcggaagagaatgatcaggatcggggtagggatggggatggagtgaataacttatcaagaaactttttgggtaatatcaacataaactcaggcaggaacgaggaatacacatcatggggaggtaacagttcttggaccggtttcacctccaacaactcaacaggccatctctcattctaagtactcagcactagctattcttgatgattcttttgttg

SEQ ID NO: 4235 - DNA, 2010 bp, Artificial Sequence
  P3976 (opLexA::G1354, G1354 is from A. thaliana)
tcgactctttctccactctctctctctctcgttgcaagcaacttgttttctgaatccaaagaagacgataacgatgaatggagctataggaggtgaccttttgctcaattttcctgacatgtcggtcctagagcgccaaagggctcacctcaagtacctcaatcccacctttgattctcctctcgccggcttctttgccgattcttcaatgattaccggcggcgagatggacagctatctttcgactgccggtttgaatcttccgatgattagaagtcttgcataaataagaagaaggtttcaagtaagtttctttcagtacatagagaaaccatgtatatgatttatgattgtcaagatgttacacagtcgtatatataattataagtatttcataaaagtaatttatgaaaccatgcacataactaacttttgtttttgattttgtaaattgagtagtttttgtttttattatcatttttatgtgtttatagttggttcagccgagatattatgagtaaccaaacgtaacctttttcataatgaaacggatcaaatatactttaatctttttcctacatatgcttagttacttgaaaacttgatttcacattacttctatgcatatcttttctatgtaccgcgcgatgataaagtatgtgttacaaattgccacattgcagaaaatataaaattaaaaagatcaaatggaaagtctcgcacacattcctcccggttatcgattccatccgaccgatgaagaactcgttgactattatctcaagaacaaagttgcattcccgggaatgcaagttgatgttatcaaagatgttgatctctacaaaatcgagccatgggacatccaaggtatgtatgcattaccaacattcattatgatttcatcagttatatcatatactactaatactaataaaaactcaaattcttctcattcaaaatcactgctgaaaatgttaccttttgggaacatatagagttatgtggaagagggacaggagaagagagggaatggtatttctttagccacaaggacaagaaatatccaactgggacacgaaccaatagagcaacgggctccggattttggaaagcaacgggtcgagacaaggccatttactcaaagcaagagcttgttgggatgaggaagactcttgtcttttacaaaggtagggccccaaatggtcagaaatctgattggataatgcacgaataccgtcttgagaccgatgaaaatggaccgcctcatgaggaaggatgggtggtttgtcgcgctttcaagaagaagctaaccacgatgaactacaacaatccaagaacaatgatgggatcatcatcaggccaagaatctaactggttcacgcagcaaatggatgtggggaatggtaattactatcatcttcctgatctagagagtccgagaatgtttcaaggctcatcatcatcatcactatcatcattacatcagaatgatcaagacccttatggtgtcgtactcagcactattaacgcaaccccaactacaataatgcaacgagatgatggtcatgtgattaccaatgatgatgatcatatgatcatgatgaacacaagtactggtgatcatcatcaatcaggattactagtcaatgatgatcataatgatcaagtaatggattggcaaacgcttgacaagtttgttgcttctcagctaatcatgagccaagaagaggaagaagttaacaaagatccatcagataattcttcgaatgaaacatttcatcatctctctgaagagcaagctgcaacaatggtttcgatgaatgcttcttcctcttcttctccatgttccttctactcttgggctcaaaatacacacacgtaagatcaatcctcaaaacgtgtgtgtaaatccacacggctatatataattaattcatgtggctcatgcttattgattacaaatcatatacatatgtcttaacgattactgattataattttatacgaaat

SEQ ID NO: 4236 - DNA, 1645 bp, Artificial Sequence
  P3978 (opLexA::G1456, G1456 is from A. thaliana)
agtgatggacttgtcggttgagaacggaggtttagctccaggttttaggtttcatccgacggacgaagaacttgtcgtctattatctcaaaagaaagatccgtcggaaaaaactcagagtcgaagcaatcggcgagactgatgtctataagtttgatcctgaggaattacctgagaaagcgttgtataagactagagatcgtcaatggttctttttcagcttaagggataggaaacatggaagtaggtcaagtagagctactgaacgtggctattggaaagcaacagggaaggatagagtcattcattgtgattcgagacccgttggagagaagaagactcttgttttccatagaggcagggcacctaatggcgaacggactaattgggtgatgcatgagtatacattgcacaaagaggagctcaagaggtgtggtggtgaagatgttaaggatgcttatgttctttacaagatttataagaaaagtgggtctggtcctaagaatggtgagcaatatggagctccttttattgaagaagaatgggctgaagatgatgatgatgatgttgatgagcctgctaatcagctcgttgtttcggctagtgttgataatagtttatgggggaaagggcttaaccaatctgaattggatgataatgatattgaagagctgatgagtcaggttagagatcagtctggtccaacattgcagcagaatggggtgtctggactgaactctcatgtagacacgtataatctggagaacctggaggaagatatgtatttggaaatcaatgatcttatggaacctgaacctgaaccaacttctgtggaagtcatggagaataactggaacgaggatggttctggtctcctgaatgatgatgatttcgttggtgctgattcatatttccttgatttgggagtgacaaatcctcagttagattttgttagtggtgatttgaaaaatgggtttgcacaaagtcttcaggtgaatacttctttaatgacttaccaggccaataataaccagttccagcagcaatcagggaagaaccaagctagtaactggccactccgtaacagctataccagacagataaacaatggatcatcgtgggtgcaggagctaaacaatgacggacttaccgttacccggtttggtgaggcgcctggtacaggtgattcatctgaattcctaaaccctgttccttctggtataagtacaactaatgaagatgacccgtcaaaagacgagtctagtaagtttgcttctagtgtatggactttcctggaatccattcctgcaaagccagcatatgcatcagagaatccatttgtgaagctgaaccttgttagaatgtcaaccagtggtggtcgtttcaggtttacttctaaaagcacaggtaataatgttgttgttatggatagtgactcagcagtgaagaggaacaagtctggaggaaacaacgataagaagaagaagaagaacaaaggtttcttttgcttatcgatcattggggctttatgtgctttgttttgggtgatcataggaacaatgggaggttcagggaggcctttgttatggtgagaaccgaaaaatccaagaggttaagagacataaaggcttggttttgtgtgaacc

SEQ ID NO: 4237 - DNA, 1128 bp, Artificial Sequence
  P3981 (opLexA::G579, G579 is from A. thaliana)
ccgcattgctcctccgttactatcttcgccggcgaaaatttgttttctttttccctggaggtaaattcgaatcatgtcaaggcctgctccgcttccacctcgttgcccgattccaaagaaactttctttgagtccagttgcagatacattctactcttcttcctcacccattgaatcatacattggtcaatacaagtcttctactcaagattccaggctcgaagatcaacctgcttggcttgatgagttgctctgtgacaaaactgatgggttgctcactagaggaggtcctctgcgccgctcagctagcgactcagttgtgcttttgggagacatttctgctactttttctggttttgatcaaagtgaggatgaagaaagtttgagttctgaagcttgtggggacttggagtctgcttgtgtatatggtcccaactcgccaagagcaaagaacaactctagcttctctaacaaccctattgcttctgccttttcggattatggttctcagacaccgcctcagaacttggatgatacggtgaaagggatcaaccgttcacctgttgctgaaaatgcgtgtggttcaatgggcataccaaatgcaaaaaggaacccgggacagcgttcaagggttcgtaagctccagtacattgctgaacttgagagaacagtaggcatgttgcagacggtggaagcagatttatcagtgagagtggcttcacttcttcagacacgagcaacactgtccctggagaatagccagttgaagcagcagatggcgatactaaagcaggacaagctcataagggaaggtgagtatcagttactgaagaaggaagctcagagattgaaatctggattgggatacttagggagcactaacaacagtaacaggctggtgaggtcatattctgctggttcaaatgtagctccaaggacagcttcgtcccacttggactggaatttgctagatctgaccaaactcaatctcaactaaagacaaaaccctccataagaataagtagcttaaggaattcaagagttaacagttctatgttcggaaaatgaacaaatctttgtcgatttgtataaatatgatttaggagtataaagtatcccactgtcttg

SEQ ID NO: 4238 - DNA, 542 bp, Artificial Sequence
  P3982 (opLexA::G1809, G1809 is from A. thaliana)
cctattctcgtctttagcaaaatctcaaaagacaaaaagatattgatgtctctccaacgacccaatgggaactcgagttcgtcttcttcccacaagaagcacaaaactgaggaaagtgatgaggagttgttgatggttcctgacatggaagcagctggatcaacatgtgttctaagcagcagcgccgacgatggagtcaacaatccggagcttgaccagactcaaaatggagtctctacagctaaacgccgccgtggaagaaaccctgttgataaagaatatagaagcctcaagagattattgaggaacagagtatcagcgcaacaagcaagagagaggaagaaagtgtatgtgagtgatttggaatcaagagctaatgagttacagaacaacaatgaccagctcgaagagaagatttctactttgacgaacgagaacacaatgcttcgtaaaatgcttattaacacaaggcctaaaactgatgacaatcactaaatatttaccctttaatccattgttcagtgttgtatgattatctttcg

SEQ ID NO: 4239 - DNA, 1307 bp, Artificial Sequence; identical to SEQ ID NO: 485
  P3983 (opLexA::G2057, G2057 is from A. thaliana)

SEQ ID NO: 4240 - DNA, 727 bp, Artificial Sequence
  P3993 (opLexA::G1249, G1249 is from A. thaliana)
cgttcttctcaatctcaccaatcggtttaagctgaaaacccgaattagcaaaatcttcgttcgggctgttttggttaatccggtttacatgttttctcattgctcattttcattttcccgccgtgacagagcgcgtaaatctcaaaaccctaaaaatgtcgaacatatacaattcattaccttaatcagattttctcaacagaatcaaaatcaaaatccatggaggaagaagaaggatcaatccgaccagagtttccaatcggaagagtaaagaagataatgaaactggacaaagacatcaacaaaatcaactcagaagctcttcacgtcatcacttactccaccgaactcttcctccacttcctcgccgagaaatctgctgttgttacggcggagaagaagcgtaagactgttaatctcgatcatttaagaatcgccgtgaaaagacaccaacctactagtgatttcctcttagactcgcttccgttgccggctcagcctgtcaaacataccaaatcggtttccgacaagaagattccggcgccgccaattgggactcgtcgtatcgatgatttcttcagtaaagggaaagcaaagactgattcagcctaaagtaaaatttctcattttgttcacaattgcaaattttactctgttctcaaatcaaaatcttgttttgctaaaagtgtagtgagaatgtatggatcatgaggaacttttataggaa

SEQ ID NO: 4241 - DNA, 1421 bp, Artificial Sequence
  P3994 (opLexA::G1273, G1273 is from A. thaliana)
tcagattttcttcgttccctaactcctaaaaaggagagattcttcaaatccttatcacaacttcagtttttgcattcaccgtcgtgagtgttctacttttggtcaagtaatggaggtgaatgatggtgaaagagtggtaatagcaaaaccagttgcctcaagaccttcttcaagttctggcttcaggacattcactgagcttcttactgattcagttaccgtatctccgcaaacgacttgccacgagattgtagacgctgctataagaccaaagactttgagattcaatcagccagtagcagcttcggtctcatgtccacgggctgaagtaaaaggtattggaaatggaatgtcttgtgatgatgattcagatagcagaaactacgtcgtttataaaccgaaagcaaagcttgtctccaaagcaaccgtctctgcattggctaatatggggaatcgtcaacaaacttggagacaaagcgaagcagtatcctatgggaagagtgtgagccaaggtacacatcgagcaggtcctaatctagtccagaaagttccatcttttacggaatcagagacatctactggggatagatcttctgtggatggatacaactggaggaaatacggacagaagcaagttaaaggaagtgagtgtccaaggagttattacaaatgcacacacccgaaatgtccggtgaagaagaaagtagagagatcagtggaaggtcaagtttcagagattgtgtatcaaggtgaacataatcactcaaagccatcttgtcctcttccacggcgtgcttcatcatcaatctcttcagggtttcaaaaaccaccaaaatcgattgcttctgaaggatcaatgggacaagaccctaacaataatctctattctcctctatggaacaatcaaagcaatgactctactcaaaacagaacagagaagatgagtgaaggttgtgttattacaccatttgagtttgctgttccaagatcgacaaattcaaatcccggaacttcagattccggttgcaagagtagccaatgtgatgaaggagagcttgatgatccaagcagaagcaaaagaaggaagaacgagaagcaatctagtgaagcaggagtatcgcaaggctcagtggaatcagacagtcttgaagatggattcaggtggagaaagtatggacaaaaagtggtaggaggcaatgcgtatccaagaagttattacagatgcacaagtgctaattgcagagcaaggaaacatgttgaacgagcgagtgatgatccaagagctttcattacaacctacgagggtaaacataatcatcatttgctcttgagccctccatcttcctctactcttccctttaactccccacaactttctaagcaaacaatttgatttgatgatccattcatgctttttcttt

SEQ ID NO: 4242 - DNA, 1347 bp, Artificial Sequence
  P3998 (opLexA::G1243, G1243 is from A. thaliana)
gagcttccaagaagttagccttgatgctctggttattcaacaagggagattggcagaacagaaaactgtcaataaggatgagttgcttcaaatggtaagatatggtgctgagatggtgttcagttctaaagatagcacaatcacagacgaggatattgatagaatcattgccaaaggagaagaggcaacagctgaacttgatgctaagatgaagaaattcacagaagatgctatacagtttaaaatggatgacagtgctgacttctatgattttgatgatgacaataaggatgaaaacaagctcgattttaaaaagattgtaagcgacaattggaatgatccccccaagcgggagagaaagcgcaactactctgaatctgagtactttaagcaaacattgcggcaaggtgctccagctaaacctaaagagcctagaattccgcgcatgccccagttgcacgatttccagttctttaacattcagagattgaccgagttgtatgaaaaggaagtacgttatctcatgcaaacacatcagaaaaatcagttgaaagacacaattgatgttgaagaaccagaagaaggtggggatcccttaactactgaagaagtagaagaaaaggagggattattggaggagggtttctcaacatggagcagaagagattttaatactttcctcagggcttgtgagaagtatggccgcaacgacataaaaagcattgcctctgagatggaagggaaaacagaggaagaagttgaaagatatgccaaagtatttaaagagcggtacaaggagctgaacgactatgatagaatcattaagaacattgagaggggagaggcaaggatctctaggaaagacgaaatcatgaaggccatagggaagaaactggatcgctacagaaacccttggctggaactgaagattcaatatggtcagaacaaaggcaagctgtacaatgaagagtgtgaccgtttcatgatctgcatgattcacaaacttggttatgggaattgggatgagctaaaggcagcatttaggacatcgtctgtgttcaggtttgactggtttgtgaaatcccgcacgagtcaggaacttgcaagaagatgcgacactctgattcgactgatcgagaaagagaaccaggagtttgatgaaagagagaggcaagcccgcaaagagaagaagctcgcgaagagtgcaacaccatcaaagcgacctttaggaagacaagcaagtgagagtccttcatcgacgaagaagcggaagcacctgtcgatgagatgagattatgtgtttacggatctgtcgagtctttgttgttacatatagttaagctaatg

SEQ ID NO: 4243 - DNA, 898 bp, Artificial Sequence
  P4002 (opLexA::G1007, G1007 is from A. thaliana)
attccttcttgcctaggaactaattgttgcacacttcggtacacaattttttgagcacttcgacatcaaaacgagagagaaaagaatggtggattctcatggctccgacacggaatgttcctccaagaagaaaaaggagaaaacgaaagaaaagggggtatatcgtggggctcgcatgaggagctgggggaaatgggtctcggagattcgggagccccgtaagaaatcaagaatctggctcgggactttccccacggcggagatggcagcgcgtgcccatgatgttgcggcattgagtatcaaaggaagttccgcaatccttaacttccctgagctcgcggattttctgccaagaccagtctcgctcagccaacaggatatccaggccgcagccgccgaagccgctcttatggatttcaaaactgtaccattccatcttcaggatgactcaacgccgttgcaaactaggtgtgatactgagaagatcgaaaagtggtcatcctcatcgtcctcagcctcatcctcatcctcatcttcgtcctcgtcctcatcatctatgctttcgggggagctaggagatattgtggagttgccgagtcttgaaaacaatgtaaaatacgattgtgcgctgtatgactcgttggaggggctggtgtcgatgcccccatggttagatgctaccgaaaatgattttaggtatggagatgattcggtactgttggacccatgtctcaaagaaagctttttgtggaattatgagtaaggtttttttttggaaagaaatgtggttttttgtttcctcctctcttttatactttcgatctttttttctaagcatatatatcttctacatatgtaatacttttccattagtaaacaatgattcggtttcgggtac

SEQ ID NO: 4244 - DNA, 780 bp, Artificial Sequence
  P4012 (opLexA::G450, G4505 is from A. thaliana)
gacatatatagacagcaagaagagatatgaaccttaaggagacggagctttgtcttggcctccccggaggcactgaaaccgttgaaagtccggccaagtcgggtgttgggaacaagagaggcttctccgagaccgttgatctcaaacttaatcttcaatctaacaaacaaggacatgtggatctcaacactaatggagctcccaaggagaagaccttccttaaagacccttctaagcctcctgctaaagcacaagtggtgggttggccaccggtgaggaactaccggaaaaatgttatggctaatcagaagagcggcgaagcagaggaggcaatgagtagtggtggaggaaccgtcgcctttgtgaaggtttccatggatggagctccttatcttcggaaggttgacctcaagatgtacaccagctacaaggatctctctgatgccttggccaaaatgttcagctcctttaccatggggagttatggagcacaagggatgatagatttcatgaacgagagtaaagtgatggatctgttgaacagttctgagtatgttccaagctacgaggacaaagatggtgactggatgctcgttggtgatgtcccctggccgatgtttgtcgagtcatgcaaacgtttgcgcataatgaaaggatccgaagcaattggacttgctccaagagcaatggagaagttcaagaacagatcatgaacaaaaaaaaaagaggacaatatgcattgatttttttttttttggtattgttatgatcatgtgtttt

SEQ ID NO: 4245 - DNA, 1258 bp, Artificial Sequence
  P4019 (opLexA::G675, G675 is from A. thaliana)
tcagagagagatggggaggtcgccttgttgcgacgagaatggtctaaagaaagggccatggactcctgaagaagatcaaaagcttattgattacattcataaacatggtcatggaagctggagagctctccccaagctcgcagatttgaataggtgtggaaagagttgtagactgaggtggacaaattatttgagaccagacatcaaaagaggaaagttttcagccgaagaagagcaaacaatcctccatctccactccattctcgggaataaatggtcagctattgcgacgcatttgcaaggtcgtacagataatgagataaaaaacttttggaacacacatctaaagaagaaattgatccagatggggatcgatcctgtgactcatcagccaagaaccgacctcttcgcaagtttacctcagctcatagccttggcaaatctaaaagacctaatcgaacaaacatcacaattctcatccatgcaaggcgaagcagcccaactagccaatctacaatatctccaacgtatgtttaattcttcggcttcattaaccaacaacaacggcaacaattttagcccgagtagtattctcgatatcgatcagcaccatgccatgaacctcttaaactccatggtctcttggaacaaagatcaaaaccccgcttttgatccggttcttgaactcgaggctaacgatcaaaatcaagatttatttccactagggtttatcattgatcaacccacccaaccactccaacaacaaaaataccatttaaacaatagtcctagtgagctaccatcgcaaggtgacccacttcttgatcatgtccctttcagtctccaaacacctttgaatagtgaggatcactttatagataatttggtcaaacatccaactgatcatgagcatgaacatgatgacaatccatcttcatgggttctcccttctcttatagacaataaccctaaaactgtcacgtcttctcttccacacaacaatccggcggatgcaagtagcagctcaagctatggaggttgtgaagctgcgtcgttttattggcctgacatttgcttcgacgaaagcctcatgaacgttatatcttagttactcttggtttagtgttttttttttagatctctgttattttatacaagttttttatttggtgttggtgttttgtaagtagaaaaggtgcgaatgtgtgatccgtttatccctttatgtaattaaacaggagatctctgtgatccgtta

SEQ ID NO: 4246 - DNA, 1011 bp, Artificial Sequence
  P4020 (opLexA::G1319, G1319 is from A. thaliana)
ccacagcattgcaacatgaagagacattcttgttgttacaaacaaaagctgagaaaaggtctttggtctcctgaagaagatgagaaacttctcaattacattaccaaacatggccatggttgctggagttctgtccctaaactcgcaggtctcgagagatgtggaaagagctgtagactcagatggatcaattacttaagacctgatttaaagagaggagctttctcttcagaggaacagaatctcattgtcgagcttcatgctgttcttggaaacagatggtcgcaaattgctgcgaggcttcccgggagaaccgacaacgagataaagaacttgtggaattcgtgcattaagaagaagctgatgaagaaaggcattgaccctattacacataaacccctctccgaggttggtaaagaaacaaacagaagcgacaataacaattccacaagtttttcctcagaaactaatcaagacttgtttgtcaagaaaacgtctgattttgccgagtattctgcgtttcagaaagaagaatccaactctgtttcactcagaaattcgctctcttccatgatcccaacgcaattcaacatcgacgatggttctgtctcaaatgcgggttttgatacacaagtatgcgtgaaaccctcgattattcttcttcctcctccaaacaacacttcaagcactgtctctggacaggatcatgtaaacgtgtcagagcctaattgtgaatcaaacagtggaaccacaagccacctcaacaatcccggtatggaagaaatgaaatggtccgaggagtacctaaacgaatcgttattctctacccaagtttacgtgaaatcagagacggatttcaactccaacattgcctttccttggagccaaagccaagcttgtgacgtattccccaaggatcttcagagaatggccttctcttttggtggtcagaccctttagtttctttttcttatcagatttagacatattgatacgtgtaatgaatggatc

SEQ ID NO: 4247 - DNA, 972 bp, Artificial Sequence
  P4021 (opLexA::G227, G227 is from A. thaliana)
gatccggcgatgtcaaacccgacccgtaagaatatggagaggattaaaggtccatggagtccagaagaagatgatctgttgcagaggcttgttcagaaacatggtccgaggaactggtctttgattagcaaatcaatccctggacgttccggcaaatcttgtcgtctccggtggtgtaaccagctatctccggaggtagagcaccgtgctttttcgcaggaagaagacgagacgattattcgagctcacgctcggtttggtaacaagtgggctacgatctctcgtcttctcaatggacgaaccgataacgctatcaagaatcattggaactcgacgctgaagcgaaaatgcagcgtcgaagggcaaagttgtgattttggtggtaatggagggtatgatggtaatttaggagaagagcaaccgttgaaacgtacggcgagtggtggtggtggtgtctcgactggcttgtatatgagtcccggaagtccatcgggatctgacgtcagcgagcaatctagtggtggtgcacacgtgtttaaaccaacggttagatctgaggttacagcgtcatcgtctggtgaagatcctccaacttatcttagtttgtctcttccttggactgacgagacggttcgagtcaacgagccggttcaacttaaccagaatacggttatggacggtggttatacggcggagctgtttccggttagaaaggaagagcaagtggaagtagaagaagaagaagcgaaggggatatctggtggattcggtggtgagttcatgacggtggttcaggagatgataaggacggaggtgaggagttacatggcggatttacagcgaggaaacgtcggtggtagtagttctggcggcggaggtggcggttcgtgtatgccacaaagtgtaaacagccgtcgtgttgggtttagagagtttatagtgaaccaaatcggaattgggaagatggagtag

SEQ ID NO: 4248 - DNA, 1595 bp, Artificial Sequence
  P4024 (opLexA::G1506, G1506 is from A. thaliana)
tgtataagctcaattagtagcaaacaagaaaaaacaatcttaaactcaatttcacaaaatctctgattcttgtgaaaatttgtatattgcaaaactttggaaaaaaaagagaaaaaagatggggaagcaaggtccttgctatcactgtggagttacaagtacacctctatggagaaacgggccaccagagaagccggtgttgtgcaatgcgtgtggttcgaggtggagaactaaaggatcattagtaaactacacacctcttcatgctcgtgctgaaggtgatgagactgagattgaggatcatagaactcaaacggtgatgattaagggaatgtctttgaacaaaaagattcccaagaggaaaccatatcaagaaaacttcacagtgaaaagagctaacttggaattccataccggtttcaagaggaaggctctggatgaagaagctagcaatagatcgagttcaggatcggttgtatcaaactccgagagctgtgcacaatctaatgcgtgggactcgacttttccttgtaagagaaggacatgtgtgggacgtccaaaggcagcttcttctgttgaaaagctcacaaaggatctttatactattctacaagaacagcaatcttcttgtctctctggtacttcagaggaagatttgctttttgagaatgaaacaccaatgctgttaggacatggtagtgttcttatgagagatcctcactcaggtgctcgagaagaggaatctgaagctagctcactcttagttgagagcagcaagtcttcatcagttcattctgttaaatttggtggaaaagcaatgaagcaggagcaagtgaagaggagcaaatctcaagtcttaggaagacatagttcactactctgtagcatagatttgaaggatgttttcaactttgatgagttcatagaaaatttcacagaggaagaacagcaaaaactgatgaaattacttcctcaagttgactctgttgatcgtcctgatagcctcagaagcatgtttgagagttctcaattcaaagagaacttatccttgtttcagcaacttgtggcagatggtgtttttgagacaaattcgtcttatgcaaaacttgaagacattaagacacttgcaaagcttgctttatcagatcctaacaaatcccatttgttggaaagctattacatgctcaagagaagagagattgaagactgtgttactacaacatcaagggtctcaagcttgagtccatcgaataataatagtcttgtaaccattgaaagaccttgtgaaagcttaaaccaaaacttctcagagacaagaggtgtgatgagaagcccgaaagaagtgatgaagattagatcaaagcacaccgaagagaatttagagaatagtgtatcttcctttaaacctgtgagctgtggtggacctctggtgtttagctatgaagataatgatatttctgatcaggatcttcttcttgatgtgccgtcgaacggctcattccctcaagcagagcttctaaacatgatatgaaagaagataaagtttctcaaactcattggttaaactcattgtgtttctcagaacaaagacagac

SEQ ID NO: 4249 - DNA, 1266 bp, Artificial Sequence
  P4025 (opLexA::G579, G579 is from A. thaliana)
cggtgagaaagagacgatcgcttattttcttcttctcctacactctgcgtttttgctctctttttactccgcattgctcctccgttactatcttcgccggcgaaaatttgttttctttttccctggaggtaaattcgaatcatgtcaaggcctgctccgcttccacctcgttgcccgattccaaagaaactttctttgagtccagttgcagatacattctactcttcttcctcacccattgaatcatacattggtcaatacaagtcttctactcaagattccaggctcgaagatcaacctgcttggcttgatgagttgctctgtgacaaaactgatgggttgctcactagaggaggtcctctgcgccgctcagctagcgactcagttgtgcttttgggagacatttctgctactttttctggttttgatcaaagtgaggatgaagaaagtttgagttctgaagcttgtggggacttggagtctgcttgtgtatatggtcccaactcgccaagagcaaagaacaactctagcttctctaacaaccctattgcttctgccttttcggattatggttctcagacaccgcctcagaacttggatgatacggtgaaagggatcaaccgttcacctgttgctgaaaatgcgtgtggttcaatgggcataccaaatgcaaaaaggaacccgggacagcgttcaagggttcgtaagctccagtacattgctgaacttgagagaacagtaggcatgttgcagacggtggaagcagatttatcagtgagagtggcttcacttcttcagacacgagcaacactgtccctggagaatagccagttgaagcagcagatggcgatactaaagcaggacaagctcataagggaaggtgagtatcagttactgaagaaggaagctcagagattgaaatctggattgggatacttagggagcactaacaacagtaacaggctggtgaggtcatattctgctggttcaaatgtagctccaaggacagcttcgtcccacttggactggaatttgctagatctgaccaaactcaatctcaactaaagacaaaaccctccataagaataagtagcttaaggaattcaagagttaacagttctatgttcggaaaatgaacaaatctttgtcgatttgtataaatatgatttaggagtataaagtatcccactgtcttgggatgtagtcttttttagctaaaatgctctgatattggagacattttaagggttcctattttgtagctcg

SEQ ID NO: 4250 - DNA, 2586 bp, Artificial Sequence
  P4026 (opLexA::G577, G577 is from A. thaliana)
cacttgaatcattagaaggagatacaacaatgggatgcacggcctccaagctcgacagtgaggatgctgtccgtcgctgcaaggagcggcgccgtcttatgaaggacgccgtctacgctcgtcaccatctcgccgccgctcactctgactactgccgctcccttcgtctcactggctctgccctctcctccttcgccgccggcgagcccctctccgtctccgagaatactcccgctgtttttctccgcccttcctccagtcaggacgcgccacgtgtcccttcttcccattccccagaaccccctcctccgcccatccgcagcaagcctaagcctactaggcctaggaggcttccacacattctctccgactcctctccttcttcctctcctgccaccagtttctatcccactgctcaccagaactctacttactctcgctctccatctcaagcttcctctgtctggaactgggagaatttctaccctccctctccccccgactccgagtacttcgaacgcaaagctcgccagaaccacaagcaccgtcctccttccgactacgacgccgaaactgaaagatccgaccacgattactgccactcacggagagatgccgccgaggaagttcactgcagcgagtggggcgacgaccacgaccgtttcactgccacctcttcgtccgacggagatggggaggtcgaaactcacgtttccagatccggtattgaagaagagcctgtgaaacaaccacatcaagacccaaatggcaaagagcactctgaccatgttaccacttcttccgactgctacaagaccaaattggtggtaaggcacaagaatttgaaggagatccttgacgccgttcaagactacttcgacaaggctgcctccgctggggaccaggtctccgccatgcttgagatcggccgggctgagctcgaccgcagcttcagcaagctgaggagtaagtctcacactctactaactagatgtagatgatgatgcattgaaacccatctcattctcttactctctctatatttgttgtctgcagagacggtgtatcattcaagcagtgtgttcagcaacttgagcgcaagctggacctcaaaacccccattggcagtcaaatacaagctcgatgcatctaccctgaatgatgaacaaggcggcctcaagagcctctgctccactctagaccgactcctcgcttgggaaaagaagctttatgaggatgtcaaggtacattccctgtttttgttttcggttttcggcttaccaacggttacgaaataaacttgtgaattcgaatttaggcaagagaaggagttaagattgagcacgagaagaagctgtctgcgctgcagagtcaggagtataagggaggtgatgaatccaagctagacaagactaaaacttccataaccagactgcaatcactcatcattgtttcttcagaagctgttttaaccacgtctaatgccattctccgcctccgggacactgaccttgtccctcagcttgttgaactctgccacgggtcagtcttttttttgtagttgtgtttgtgtttcattgttccttgagggctgctggttcggtctaggcttgtttatatgcttctgcaaactcatgtgaacccgaattaggcatatgtaataccaaacccattgctgttctgccagtgggggattttataggtaagttcgaaataaaagtagggaggatttgtatgtgtctctaaccaccttgaaatgcagattaatgtacatgtggaagtcaatgcacgagtatcacgaaatccagaacaacatcgtgcaacaagtccgtggcctgatcaaccaaacagagagaggtgagtcaacatcagaggtacaccggcaggtgacgcgggacctagagtcagctgtgtccttgtggcattcgagcttctgtcgcatcattaaattccagagggagttcatatgctctctccacgcatggttcaagctgagcctggttcccctgagcaacggagacccaaagaaacagcggccagactcatttgccttgtgcgaggagtggaagcagagcctggaacgggtgcctgacacagtggcgtcagaagccataaagagctttgtaaacgtggtacatgtgatatcaataaagcaggcggaagaggtgaagatgaagaaacgcacggagagtgcaggaaaggagctggagaagaaagcatcctcactgaggagcatagagaggaagtactaccaggcatactcgacggttgggataggccctggaccggaggtgttggactcacgggacccgctatctgagaagaaatgtgagctggcggcatgtcagaggcaggtggaggatgaggtaatgaggcacgtgaaggctgtggaggtgacacgagctatgactctcaacaatctacaaaccggcctgcccaatgtattccaggccttgaccagcttctcatctctcttcactgaatctctccagactgtctgttctcgttcctactccatcaactgattatgtccaagtttctcatttatttttaagctctcattacgttggtatcatgtaaatttgg

SEQ ID NO: 4251 - DNA, 1575 bp, Artificial Sequence
  P4037 (opLexA::G1786, G1786 is from A. thaliana)
ccctgacgttctaccaatcacccgggacgcagagggggcaatgatcgtgtacggtgggggagcatccgaggacggtgaaggtggaggggtggttctgaagaaagggccatggacggtggccgaggacgagacactggcggcttacgtacgggaatacggtgaagggaactggaattctgttcagaagaagacatggctggctaggtgtggcaagagctgccgcctccgctgggctaaccacttacgacctaatctcaggaaaggctccttcacccccgaggaagaacgtctcatcatacaactccactctcagctaggcaacaaatgggctcgcatggctgctcaggttaatgatcaatcctacacttatataaatctgataaaactgcattgcttctctctgttttctaggcttcttagttcttcatgctctcttcttcttcttccagctctcaaaaaactttaaccattgtcttcttctactgtttgttttgaatagttaccaggcagaacagataacgagatcaagaactactggaacacgaggttgaaacgcttccaacgccaaggcctccctctctaccctccagaatattcccaaaacaatcatcaacaacaaatgtatcctcaacagccctcctcacctctcccgtcccaaacacctgcttcttcctttacctttcctctcctccaaccgccttctctgtgtcccaaacgttgttataacactgccttctctcccaaggcctcatatatttcttctccaaccaatttccttgtctcgtctccgacctttcttcacacccattcctctctttcctcctatcagtctaccaatccggtttactccatgaaacatgagctctcttcaaaccaaattccatactctgcctctttaggagtctatcaagtaagcaagttctcagacaatggggattgtaaccaaaacctgaacaccggtttgcatacaaatacctgtcagctgttagaggatcttatggaggaggccgaggctctagctgatagctttcgtgctcctaagcggagacaaatcatggctgcgcttgaggacaacaacaacaacaacaactttttctcgggaggtttcggacatcgtgtttcttccaacagtctatgttccttgcaaggtaataataatcagacaactcaaaatgcttcaatctgcaaaaacaagtgtttgaattttattttattttgattgacacaggtttaacaccaaaggaagatgagtctctccagatgaacacaatgcaagatgaggacataacaaagcttcttgactggggaagtgaaagtgaagaaatctcaaacgggcaatcctctgtgataacaacagagaacaaccttgtccttgacgatcaccagttcgcttttctgtttccagttgatgatgacaccaacaacttgccagggatctgctagagaaagacgaaacaactaaatggaaacatgttcctgattgtacaattaaaatcctgaatatacctgtcaaatatgttattaaagcaatatgatcctcatgtatagagatcttagcattgttcatctgttaca

SEQ ID NO: 4252 - DNA, 800 bp, Artificial Sequence
  P4039 (opLexA::G1819, G1819 is from A. thaliana)
aatagttgggctgatttcgtagcccacttaatcagcctttaaatatggaaaccctagcctagaaagtgaacaagaaaaacgtaaagatcaaaatggaagagaacaacggcaacaacaaccactacctgccgcaaccatcgtcttcccaactgccgccgccaccattgtattatcaatcaatgccgttgccgtcatattcactgccgctgccgtactcaccgcagatgcggaattattggattgcgcagatgggaaacgcaactgatgttaagcatcatgcgtttccactaaccaggataaagaaaatcatgaagtccaacccggaagtgaacatggtcactgcagaggctccggtccttatatcgaaggcctgtgagatgctcattcttgatctcacaatgcgatcgtggcttcataccgtggagggcggtcgccaaactctcaagagatccgatacgctcacgagatccgatatctccgccgcaacgactcgtagtttcaaatttaccttccttggcgacgttgtcccaagagacccttccgtcgttaccgatgatcccgtgctacatccggacggtgaagtacttcctccgggaacggtgataggatatccggtgtttgattgtaatggtgtgtacgcgtcaccgccacagatgcaggagtggccggcggtgcctggtgacggagaggaggcagctggggaaattggaggaagcagcggcggtaattgaaaagtgttgattgggttttagggttgtaatgcttttgtgagaatttgtatctctatggagtcatgtttg

SEQ ID NO: 4253 - DNA, 746 bp, Artificial Sequence
  P4040 (opLexA::G1821, G1821 is from A. thaliana)
accgcgcatgcagacgtcatcgaagccattatgcactaaaacttccatttttcttatttttgttaggattagcagcgaattttctgatggcagagggcagtatgcgtcctccagaattcaaccagcctaacaaaaccagtaatggtggtgaggaggagtgcacggtgagggagcaagacaggttcatgcctattgccaacgtgatacggatcatgcggaggatcttacctgctcacgccaagatctcagatgactccaaggagacgatccaagagtgtgtttcggagtacatcagcttcataacaggggaggctaatgagcggtgccagcgggaacagcgcaagaccatcactgctgaggacgtcttgtgggcaatgagcaagctcggttttgatgactacatcgaacccctcacgttgtacctccaccgctacagagagttggaaggtgaaagaggggttagctgcagtgctgggtccgttagtatgaccaacggcttggtggtcaagaggcctaatgggaccatgaccgagtatggagcctacgggcctgtgccagggattcacatggcgcagtaccattatcgtcatcagaacgggtttgttttcagtggtaacgaacctaattctaagatgagtggttcatcttcaggagcaagtggcgccagagttgaagtatttccgactcaacaacataagtactgagaacaatggctaataacatagacagctgacagagtcataact

SEQ ID NO: 4254 - DNA, 1014 bp, Artificial Sequence
  P4044 (opLexA::G790, G790 is from A. thaliana)
tttgcagattctctcgttctgcattctctgttcttcttctgatgtatccatcaatcgaagacgatgatgatcttctcgctgctctttgttttgatcaaagcaatggagtagaagatccttatggatatatgcaaacaaatgaagataacatatttcaggattttgggtcttgtggtgtgaatctgatgcagccacaacaagaacaatttgattcttttaatggaaatcttgagcaagtttgtagtagctttagaggaggaaacaatggagttgtttatagtagtagcattggatcagcacaattggatttggctgcatcgtttagtggagttttgcagcaagagacacatcaagtctgtggctttagaggacaaaacgacgattctgcagtgcctcatttgcagcagcaacaaggacaggtgtttagtggtgtagtggaaatcaattcttcgtcatctgttggagctgttaaggaagagtttgaggaagaatgttcggggaagaggagacgaactggatcatgtagcaagccaggaaccaaagcctgtcgcgagaaactaagaagggaaaagctaaatgacaagttcatggacttgagctctgttttagagcctggcaggactccaaagacggataaatcagctatactcgacgatgcaatccgggttgtgaatcagcttagaggtgaagctcatgagcttcaagaaaccaaccaaaagcttctagaagagatcaagagtctaaaggcggataaaaacgagctacgagaggaaaagctggtgttgaaggcggagaaggagaagatggagcaacagttaaaatctatggtggttccatcaccaggtttcatgccctcccagcatccagcagctttccattcccataagatggcggtggcttacccttacggctactatcctccaaacatgccaatgtggtcacccttacctcctgctgaccgtgatacgtctcgtgatctcaaaaatcttcctcctgttgcttaatcttcttcat

SEQ ID NO: 4255 - DNA, 1440 bp, Artificial Sequence
  P4146 (opLexA::G1944, G1944 is from A. thaliana)
cttcctaatttccaacctctgttcttagcaatatattttttctccaaaaataattctcagtttgattttcttcttctagctcttaagtatatttctttgttgttatttatcttttaatcctttaatctcatctttgtttatctttaatcaaaacccaaaatttacatgggttcttgaaaatctagaagaaataaaggaaacataacaaaaatagaaagaaaaagaagctaatggtcttaaatatggagtctaccggagaagctgttagatcaaccaccggtaacgacggtggtattacggtggttagatccgacgcgccgtcagatttccacgtagctcaaagatcagaaagctcaaaccaatctcccacctctgtcactcctcctccaccacagccatcgtctcatcacacagctcctccgccgctgcaaatttcgacggtgacgactacgactacgacggccgcgatggaaggtatctccggtggactgatgaagaagaagcgtggacggccaaggaagtatggaccggacgggactgttgtagcgttatctcctaaaccgatttcatcagcgccggcgccgtcgcatcttccgccgccgagttcacacgtcatcgatttctccgcttctgagaaacgtagcaaagtgaaaccaacgaactcgtttaacagaacaaagtatcatcaccaagttgagaatttgggtgaatgggctccttgctccgtcggtggtaatttcacacctcatataatcacagtcaacaccggcgaggatgtaacaatgaagataatctcgttttcgcaacaaggacctcgctctatttgtgttctgtcagcaaacggtgttatttcaagcgttacacttcgtcagccagattcctctggcggcacattgacatacgaaggtcggtttgagatattatcattatccgggtcattcatgcctaatgattcaggcggaacacgaagtagaacgggaggaatgagtgtatcgttagcaagtcccgatggacgtgtagtaggcggtggcctcgccggtttactagtagccgcgagtccggttcaggtggttgtaggaagttttttagcgggcactgaccatcaagatcagaaaccgaaaaagaacaaacatgatttcatgttgtcgagtcctaccgctgcaattcctatctctagtgcagctgatcaccggacaatccattcggtctcgtctcttccggtcaataataatacatggcagacttctttagcttccgatccaagaaacaagcataccgatattaatgtcaatgtaacttgaaatccaatctttctctgtattttctgttaacaagtttgatttggttgtttatctacattaggattttactaaaatggtagtattatttatagggttttagggtctttattttggttccactgttgtcacttgtaggata

SEQ ID NO: 4256 - DNA, 895 bp, Artificial Sequence
  P4147 (opLexA::G1759, G1759 is from A. thaliana)
aacgcttagtatctccggcgacttgaacccaaacctgaggatcaaattagggcacaaagccctctcggagagaagccatgggaagaaaaaaactagaaatcaagcgaattgagaacaaaagtagccgacaagtcaccttctccaaacgtcgcaacggtctcatcgagaaagctcgtcagctttctgttctctgtgacgcatccgtcgctcttctcgtcgtctccgcctccggcaagctctacagcttctcctccggcgataacctggtcaagatccttgatcgatatgggaaacagcatgctgatgatcttaaagccttggatcatcagtcaaaagctctgaactatggttcacactatgagctacttgaacttgtggatagcaagcttgtgggatcaaatgtcaaaaatgtgagtatcgatgctcttgttcaactggaggaacaccttgagactgccctctccgtgactagagccaagaagaccgaactcatgttgaagcttgttgagaatcttaaagaaaaggagaaaatgctgaaagaagagaaccaggttttggctagccagatggagaataatcatcatgtgggagcagaagctgagatggagatgtcacctgctggacaaatctccgacaatcttccggtgactctcccactacttaattagccaccttaaatcggcggttgaaatcaaaatccaaaacatatataattatgaagaaaaaaaaaataagatatgtaattattccgctgataagggcgagcgtttgtatatcttaatactctctctttggccaagagactttgtgtgtgatacttaagtagacggaactaagtcaatactatctgttttaagacaaaaggttgatgaactttgtaccttattcgtgtgag

SEQ ID NO: 4257 - DNA, 1798 bp, Artificial Sequence
  P4153 (opLexA::G1592, G1592 is from A. thaliana)
gtgttgtttgtgtttgattctgaaacagatgactccttgtttgatctgatcataagaagaagaagactatggccacttattacaaaactggctcaagtgagatttattccagaccagaatttgtccctggaaacgcaatgaactacacaaattctttcacagagacatttcctagagattcaactaataatgtgtcaccttcaaaagagattcaagtgttgtcaagccttggtggagtttcacaaatggttgagattcaagattctggttcttggagagatcaagaagacaatgacaggaatcgcttcccggtgatgaggcgtcttggcctcagctcgcagattgagacatcgagaggcaataataacaatgagtatgcaacacaggttgtttcgggatttactcgaaccattcacaactcaaagtatctcaaagctgctcaagagcttcttgatgaaactgttaatgttaagaaagctctaaagcagtttcagccagagggagataagattaatgaagtgaaagagaagaatcttcagacgaatactgctgaaatccctcaagcagagaggcaagaattgcagagcaagttgtcgaaacttttatcgatattagacgaggtaatccgccttacaacatatcttctacacttgttaatgattctcgtggtaacataaatgttgtttgtttctttgttgtttgaaggtggatagaaattacaagcagtattaccatcagatgcagatagtcgtgtcgtctttcgatgtaatagccggatgtggagcagccaaaccatacacagcccttgcgcttcagaccatctcgaggcatttccgttgcttaagggatgcgatatccggacaaatcttggtgataaggaaaagtttaggaggggaacaggatggatcagatgggagaggagtggggataagcaggttaaggaatgttgatcaacaggtaaggcaacaaagagcgttgcagcggttaggtgtgatgcaacctcacacttggcggcctcaacgcggtttaccagattcttctgttttggttctccgtgcttggctatttgagcatttcctccacccgtaagtctctctactactcttgtgaattttttgattgaccacaagagactctgaccatttgtttcaaaaccttgagcttagttatccaaaggattcagacaagatcatgctcgctagacaaacggggttgagccgaggccaggtattgcactgttagcttttgtgccgtttctctcatttaatacttttctttctggtgtgttcatttttcattgtttcgtttgatgattgttgaaaggtatcgaactggttcataaatgcgcgtgtgcgtctctggaaaccgatggtggaggagatgtacaaggaggaattcacagatgcattgcaggagaatgatcccaaccagtcttctgaaaacacaccagaaatcaccgagattcaagagctgcaaactgagtctagttccaacaatgggcatgtacctggtgtggcaagcagtagcatgagacaaaacacagtggcccatggtggtgaccggttcatgatggtgactgacatgacaagaaatggtaatggtgggatgtctttaacgttggggattcagaattccgatgctcgtggcgatgttcctatgtccggtgggatagataactacaagaataccatctcgggaaccgatctacagtacttaaactctcgcaaccaccagcaccagattggctcttcacaattgttgcatgattttgtagcttgaggagaatagaaaggtgtag

SEQ ID NO: 4258 - DNA, 1123 bp, Artificial Sequence
  P4156 (opLexA::G1656, G1656 is from A. thaliana)
gacgtctctcgatttatctttgtcttaatcaggaaactatttgacatttctttatcgattattacttcatattcgggtatggatgaagattttttcttacccgatttctcactagtagacattgatttcgactttaatatttacgaagaaaataatttatcacctgatgaatctttatcaaattcacgaagagctgatcaatcgtcaaagtttgatcatcaaatgcattttgagtgcctcagagagaagccaaaggcagcggtgaagcctatgatgaagatcaacaacaagcaacaactgatttcttttgatttctctagtaatgttatttcttctccagccgcggaggagatcattatggataaattggttggtcgtggaaccaaaagaaaaacatgttctcatggcacaagatctccggttcttgcgaaagaacatgttttagccgagagaaagcgccgtgagaagctttctgaaaaattcattgctctttcagctctccttcccgggcttaagaaggcggacaaggtaacgattcttgatgacgcgatctcgcgtatgaaacaactccaagaacaactaagaacgctcaaggaagaaaaagaagcaacgagacaaatggaatccatgattcttgtaaagaaatctaaagtgtttttcgacgaggaacctaacctatcatgttctccttcagttcatattgaattcgatcaagcattaccagaaatcgaagcgaaaatttctcaaaatgacattctcatccgaatcctttgcgagaaaagcaaagggtgcatgatcaacatactaaacacaattgaaaactttcaattgcgcattgaaaatagcatcgtattgccattcggagactcgactctcgacatcacagtccttgcacagatggataaagatttttcgatgagtatacttaaggatcttgtacggaacctgagactcgcaatggtttaggtcttctttcaagttttagtaacctgagactgtacattgacacaatcgtttcgtggatttgctatcgttttcttcttgagattttttcacacgtgcccacatgtttgatgtgtttttttagcaaagctatttccgataacgaccgttgagaattaat

SEQ ID NO: 4259 - DNA, 1316 bp, Artificial Sequence
  P4162 (opLexA::G556, G556 is from A. thaliana)
gaagcccttttgacacaaaagaccagaacaagttgaagaaatatgaatacaacctcgacacattttgttccaccgagaaggtttgaagtttacgagcctctcaaccaaatcggtatgtgggaagaaagtttcaagaacaatggagacatgtatacgcctggctctatcataatcccgactaacgaaaaaccagacagcttgtcagaggatacttctcatgggacagaaggaactcctcacaagtttgaccaagaggcttccacatctagacatcctgataagatacagagaaggctagcacagaatcgagaggcagctaggaaaagtcgtttgcgcaagaaagcttatgttcagcagctagagactagccggttaaagctaattcatttagagcaagaactcgatcgtgctagacaacagggtttctatgtggggaacggagtagataccaatgctcttagtttctcagataacatgagctcagggattgttgcatttgagatggaatatggacattgggtggaagaacagaacaggcaaatatgtgaactaagaacggttttacatggacaagttagtgatatagagcttcgttctctagtcgagaatgccatgaaacattactttcaactcttccgaatgaagtcagccgctgcaaaaatcgatgttttctatgtcatgtccggaatgtggaaaacttcagcagagcggtttttcttgtggataggcggatttagaccctcagagcttctcaaggttctgttaccgcattttgatcctttgacggatcaacaacttttggatgtatgtaatctgaggcaatcatgtcaacaatcagaagatgcgttatcccaaggtatggagaaactgcaacatacattagcagagagtgtagcagccgggaaacttggtgaaggaagttatattcctcaaatgacttgtgctatggagagattggaggctttggtcagctttgtaaatcaagctgatcatctgagacatgagacattgcaacagatgcatcggatcttaaccacgcgacaagcggctagaggtttgttagcattaggggagtatttccaaaggcttcgagctttgagttcgagttgggcggctaggcaacgtgaaccaacgtaattaaggtgtttagatgtcaagaaaggtttgagaccttaacaatcaagaatggagtttgctggtgagtggatttttgggtcaagaacaagagcaataacacaagctgctgtgtgatgatgaatcttgtcttgcggctaaaggaaatgtttgaggaaagttgtacatatgatcagcaacgt

SEQ ID NO: 4260 - DNA, 625 bp, Artificial Sequence
  P4166 (opLexA::G1839, G1839 is from A. thaliana)
gtttccattcattggctataaaaaccatgctcactcccttttgttcttcacaccatttgcaggaaaaaatgaatagttgtcagtctaatcccaccaaaatggataattcagaaaatgttctatttaatgatcaaaacgaaaatttcacacttgttgcaccacacccttcttcttcgtacttgacaagagatcaagagcacgagatcatggtctctgctctgcgacaagtgatatctaactccggagctgacgacgcgtcatcatcaaacttgatcatcacaagcgttccgcctccagacgctggcccttgtcctctctgtggcgtcgccggttgctacggctgcacattacaacggccgcaccgagaggtaaagaaggagaagaaatacaaaggagtaaggaaaaaaccatcgggtaaatgggcggcggagatatgggatccgagatcgaaatcaaggaggtggcttggaacgtttcttacggcggagatggcggcacaatcttacaatgatgcggcggctgagtatcgagcaagacgtggtaaaacaaacggagaaggaattaaacggcggtggagatgactgagaaggacatggtcggtgatcatacacggcgaggtggaaat

SEQ ID NO: 4261 - DNA, 896 bp, Artificial Sequence; identical to SEQ ID NO: 725
  P4172 (opLexA::G259, G259 is from A. thaliana)

SEQ ID NO: 4262 - DNA, 1316 bp, Artificial Sequence; identical to SEQ ID NO: 399
  P4179 (opLexA::G1863, G1863 is from A. thaliana)

SEQ ID NO: 4263 - DNA, 3070 bp, Artificial Sequence
  P4181 (opLexA::G1272, G1272 is from A. thaliana)
gtttcggctagggtttcgtttttgtttcatcgataaactcaaaggagatggattcaacaaatggtaacggagctgatcttgaatcagcaaatggggcaaacgggagtggggttactgaggcattaccacctcctccaccagttatacctccaaatgtggaaccagttcgtgttaaaactgaacttgctgagaagaaggggccagttcgagttcctatggctcgaaaaggatttggaacaaggggccaaaagatccccttgttaacaaatcatttcaaagtcgatgtggctaatcttcagggtcatttcttccactacagtgtggctctattctatgatgatggtcgtcctgttgaacaaaagggtgttggaagaaaaatccttgacaaggtgcatcagacttaccattctgatctggatggtaaagagtttgcttatgacggtgagaagacgttgtttacatatggagctttgcctagtaacaagatggatttttctgtggtgcttgaggaagtatctgctacaagggctaatggaaacggaagccccaatgggaatgaaagtccaagtgatggtgataggaaaagactgcgtaggcctaaccggtccaaaaactttagagtggagatcagctatgcggccaaaattcctcttcaagctcttgctaatgcaatgcggggacaagaatcagagaattcccaggaggcaatacgggttcttgatatcatattgaggcaacatgctgctagacaaggttgcttgcttgttcgacagtcttttttccacaatgatccaaccaactgtgaaccagttggtggtaacatcttaggatgtaggggatttcactccagtttcagaacaacgcagggtggcatgtcacttaatatggatgttacaaccaccatgatcatcaagcctggtccagtggttgatttcctaattgctaaccaaaatgctagggacccttattcgattgactggtctaaggctaaacgaacccttaagaacctaagggtaaaggtcagcccctcaggccaagaattcaagataaccggattgagtgacaagccttgcagggaacaaacgtttgaattgaagaaaaggaacccaaatgaaaatggagagttcgaaactactgaagttacagttgctgactacttccgcgatacaaggcatattgatttgcaatattctgcggatttgccttgcatcaatgttgggaagccaaagcgacccacttacattcccctcgagctctgcgcgttggttccacttcagaggtacacaaaagcacttaccacgttccaaagatctgcccttgttgagaaatccagacagaaaccccaagagaggatgactgttctgtccaaagctctgaaagttagcaactatgatgcggaaccactcctgcgatcctgtggcatttcgatcagctccaactttactcaggtggagggtcgtgttctaccagctcccaagctgaaaatgggatgtggatctgaaacctttcccagaaatggtcgctggaacttcaacaacaaggaatttgttgagcccaccaaaattcaacgatgggttgttgtcaatttctctgctcgctgtaatgtacgtcaagttgttgatgatctgataaaaattggaggatcaaaaggaattgaaattgcttctccctttcaagtgtttgaggagggtaatcaattccgccgtgctcctcctatgattcgtgttgagaacatgtttaaggacatccaatcgaaactccctggtgtcccacaattcatactatgtgtgctccctgacaaaaagaacagtgatctctatggtccatggaagaaaaaaaacttaactgaatttggcattgttactcaatgcatggctccaacgcggcaacctaatgatcagtatcttactaacttacttctgaagattaatgcaaagcttggaggcctgaactcaatgttaagtgtagagcgtacacctgcgttcactgtgatttctaaggttccaaccattatccttgggatggatgtttcacatggatctcctggacagtctgatgtcccgtccatcgctgctgtggtgagttctagggagtggccactgatatccaaatatagagcatctgttcggacacagccttctaaggctgagatgattgagtcccttgtcaagaaaaatggaactgaagacgatggcattatcaaggagttgctggtagatttctacaccagctcgaataagagaaaaccagacatatcataattttcagggatggtgtgagtgaattcaattcaatcaggttctgaatattgaacttgatcagatcatcgaggcttgcaagctcttagacgcaaattggaacccaaagttccttttgttggtggctcaaaagaatcatcataccaagttcttccagccaacgtctcctgaaaatgttcctccagggacaatcattgacaacaaaatatgtcacccaaagaacaatgatttctacctctgtgctcacgctggaatgattggaactacccgcccaactcactaccacgtcctgtatgatgagattggtttttcagctgacgaacttcaggaacttgtccactcgctctcctatgtgtaccaaagaagcaccagtgccatttctgttgttgcgccgatctgctatgctcacttggcagctgctcagcttgggacgttcatgaagtttgaagatcagtctgagacatcatcaagccatggtggtatcacagctccaggaccaatctctgttgcacagctcccaagactcaaagacaacgtcgccaactccatgttcttctgttaaatgagcagccctacttggctcagtaagtaagtagtagttcaataggctatctgactttcagcttaggatctctctcggccttgaagccaggcatcgacactaaggcttggaatgttttttgtgactattatcgccagccttgtttgcctgttggggtttgaatatgcttttgtcccccttaacaattcggttgtttaattaaagacttattgtagtgaatatctaagttcaggaagttacccttttgtct

SEQ ID NO: 4264 - DNA, 1400 bp, Artificial Sequence
  P4185 (opLexA::G1127, G1127 is from A. thaliana)
tctctctgtatgtgtgcgagaagcgagaagcgagagagagagagagagagttgttagctcacacgctttctctattttctcggaattcacaaaacagaaagtttcatcctttacgagaattaagccgaaagaaacaatctttgagtttgatttcttcttccttccttctctctctctgctctaatggattccagagacatcccaccgtcacataaccagcttcaaccaccaccgggaatgttaatgtctcattaccgtaaccctaacgccgccgcttcaccattaatggttcccacttccacatctcaaccgattcaacaccctcgtcttccttttggcaatcaacaacaatctcaaacgtttcatcagcagcaacaacaacaaatggatcagaagactcttgaatctcttggatttggtgatggatcaccttcttctcaaccgatgcgattcgggatcgatgatcagaatcagcaactgcaagtgaagaagaagcgaggaaggccgagaaagtatactcctgatggtagcattgctttaggtttagctcctacgtctcctcttctctctgcagcttctaattcttacggtgagggtggtgttggagatagtggtggaaatggaaactctgttgatccacctgttaaacgtaacagaggaaggcctcctggttctagtaagaaacagcttgatgctttaggaggaacttcaggagttgggtttacacctcatgtcattgaagtgaacacaggagaggacatagcgtcaaaggtgatggctttttcggatcaagggtcaagaacaatttgtattctctctgcaagtggtgcagtttctagagtgatgcttcgtcaagcttctcattctagtggaatcgttacttatgagggacgatttgagatcattactctctcaggctcagtcttgaattatgaggtaaatggttccaccaacagaagtggtaacttgagtgtggctttggctggacctgatggcggcatcgtaggtggcagtgtagttggtaatctagtagctgcaacacaagtccaggtgatagtgggaagctttgttgcagaagcaaagaaaccgaaacaaagtagtgttaacattgctcgggggcagaatcctgaaccggcttcagcgccggctaacatgttgaactttggatcagtctctcaaggaccatcgagcgagtcatcagaagagaatgagagcggttctcctgcaatgcaccgtgacaataataatgggatatatggagctcaacaacaacaacaacaacaacctcttcatcctcatcagatgcaaatgtaccaacatctttggtctaatcatggtcaataaaatgaagcggaaattaatttgtttccgttttggttacggttatggtttgatttctt

SEQ ID NO: 4265 - DNA, 3329 bp, Artificial Sequence
  P4186 (opLexA::G1665, G1665 is from A. thaliana)
aagtcttgtctccttctctctctctctccctctctaactgtatcttcttcttcttcttcaaccttcagacttttctagttgcaactctcattcaattgttcaatttctctgtaaaaatcaaagctttttggaatctttcttcggcgagatatttcttcaccggcgcaagcttctcttgagcgtgattcatcactgggtttgcattttttcctggtgggtattcttcaaattgttcaaagctccgaccttttcttccttagaatctgattactggaatcttgaagctggagagactcgagtttatatggtttcaagcatcgttgagtcaatcattgagttgtgtagaagaaaggtttggttttcttctccgtttaagtggttttgggtttggtaggatttggtgtaatctgggagataaagaaagatgaatatgagtgatttaggttgggatgatgaagataaatcggtggttagtgctgttttagggcatttagcttctgattttcttcgagcaaactctaattcgaatcagaatctctttcttgttatgggaactgatgatactctgaataagaagctctctagtctcgttgattggccaaactcggagaatttcagctggaactacgctattttctggcaacaaaccatgtctagatccggacaacaagtcttaggttggggagatgggtgttgtcgagagcctaatgaggaagaggaatcaaaagttgttaggtcttataattttaacaacatgggggcagaggaagagacatggcaagatatgaggaagagagtgttgcagaagcttcataggttgtttggtggatctgatgaagacaattatgctttgagcttagagaaagttactgctactgagattttcttcttagcttccatgtatttcttcttcaatcacggtgaaggcggtcctgggaggtgttattcttcagggaaacatgtgtggctctctgatgcagttaactctgagtctgactattgtttcaggtcttttatggcgaaatctgcgggaatcagaacgatcgttatggttcctactgatgctggtgttcttgagcttggttctgtttggtctttgcctgaaaacattggcttggttaagtctgttcaagctttgttcatgaggagagttacgcaaccagtaatggtgacttcaaacactaacatgactggagggattcacaagcttttcgggcaggatttgagtggagctcacgcgtatcctaagaagctcgaagtgagaagaaacttggatgagagattcactcctcaaagttgggaaggctataataacaataaaggtccaacatttggttacacacctcagagggatgatgtgaaagtgctagagaatgtgaatatggttgtagataataacaattacaagacgcagattgagtttgcgggatcatcagttgctgcttcttcgaatccatctacaaacactcagcaagaaaaatcagaatcttgtacagagaaaagaccagtgagcttgttagcaggagcaggaatagtttctgttgttgatgagaagagaccgagaaagagagggagaaagcctgcaaacggaagagaagagccattgaaccatgtggaagctgagaggcagagacgcgagaagcttaaccaaagattctacgctttacgatcagttgttccaaacatttctaaaatggacaaggcttctctacttggagacgcaatttcttacatcaaagagcttcaagagaaagtcaagataatggaagatgaaagagtaggaacagataagagcttatcagaatcaaacacaataacagtagaagaaagtccagaagttgacattcaagctatgaatgaagaggttgttgtaagagtaatctcgcctttggattcacatccagcttcaagaatcatacaagcaatgagaaactcaaatgttagtctaatggaggctaagttatcattagctgaagacacaatgtttcacacttttgtgataaagtctaacaacgggtcggatccattgacgaaagagaagcttatagcagcgttttaccccgagaccagctcgacgcaaccgccattgccttcttctagttcacaggtctctggtgatatataagtttcacatgatggtgaagcttttgtctattcttgtttcagtatagataactttcaggttcaactagaaatagataaaatccttttttcttttctctttcttatagtgaaaggaatccggtttaagtatattcattaactttatttagaccattgattcacatatttgtatcttgggaaaatatttcctatactttagaaaatcaaataaagtatgaaagatatttgacttctctttctttgttatggatgctttattcagttacaatttgggatccattctttttttttttcaaataaagcaatagttataacaagttaatattatccaatcaatgttattcaggtaaatatttgattaattatcttgtagaatgttcatgtacatttgaattttgaagtgaccaaatcttatatattggtcatgaatatgatatattgacatttcaagagactgagctaaaaattacttaaaaatgagaatcaattattttttttccattggtccattattttatgcaatgcagcacataataatctattttggttttggtttgggcttctggtagttctgaaaagcccagtataaagcccaactccattaatgcatcttcacctctacgacgagaattgtgcttccgattcatttcacatagggtttgtttctccgatcagatccaatttcaatccttctccgtcagattatctcctcggccacgatgtctctccgccgcactatcctcgatctccaccgtcaaacccagagagccactctctcaaagtctctacctttctcgatgagtcacatctcctccgcatccgccaccgccgccgtgagaaacccactgggaagagacctctcttcaatccccttcgcacaagcccagaaactgaaaccagattcaaccaatctcgtcaccgatcgctcgatttcgtcttcaattgggcaatctgaactcaacaaggcagccaaattctcgcgtcaatcgtcttctcgaggttacactaatggctctttcttacgcaaaatccctgtagtctttcacatacatgaaggaatggaagagattttggcggattatgttcaccaagaaatgacaaggaatttgattgtgatgtctttgggattgttccagattatcgttcttaaagatattatcttgtttcttctctgaaaccaagtaaacatcttttgggatctaagg

SEQ ID NO: 4266 - DNA, 685 bp, Artificial Sequence
  P4190 (opLexA::G485, G485 is from A. thaliana)
tcctctctgatccaacggacccaaaacatctatctctctttctcgaccttttgtctcctcgatctaaagatggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaattgtaaaatgataaaagcaaattttcatttttattaattaatgatatatatatatatatgtttaacttttagtataatgtttacagaattttttttttaaaactaggttcaacccactaacgtaacagcg

SEQ ID NO: 4267 - DNA, 996 bp, Artificial Sequence
  P4194 (opLexA::G258, G258 is from A. thaliana)
agtgaccaccctgctggttaatcaacaccaagagaccttgtaatatataagttaggaagatgagagagaagtgggaaatgaaaagagatgaaatgggacatcgatgttgtggaaaacacaaagtgaagagaggtctttggtctccagaggaagacgagaagcttcttcgttatatcaccactcatggtcatcctagttggagttccgttccaaagcttgccgggttgcagagatgtgggaagagttgcagattaaggtggataaactatctaaggcctgatctgaggagaggttcgtttaatgaggaagaagagcagattatcatcgacgtacatcgtattcttggtaacaaatgggctcagattgctaagcacttacctggacgcactgataatgaagtcaagaacttttggaactcatgcattaagaagaaacttctttctcaaggcttagatccttctacacataatcttatgccttcacacaaaagatcttcttcttcaaacaataataatatccccaagccaaacaaaacgacgtccatcatgaagaaccctactgatcttgatcaatcaaccactgctttttcaatcacaaacatcaatccacccacttccactaaaccaaacaaacttaaatctcctaaccagactacaatcccatctcaaaccgtgatccctatcaatgataacatgtcaagtactcaaaccatgatccctatcaatgatcccatgtcaagtcttttagatgatgagaatatgattcctcactggtcagatgttgatggaatggcgatccacgaagctccgatgttgcctagtgataaggcagtagtgggagtggatgatgatgatctcaacatggacattttgtttaacactccttcttcttctgcttttgatcctgattttgcttccattttctcctctgcaatgtctatcgatttcaatcccatggatgatcttggcagctggaccttttagcttttactctaca

SEQ ID NO: 4268 - DNA, 722 bp, Artificial Sequence; identical to SEQ ID NO: 523
  P4196 (opLexA::G2108, G2108 is from A. thaliana)

SEQ ID NO: 4269 - DNA, 870 bp, Artificial Sequence
  P4201 (opLexA::G323, G323 is from A. thaliana)
tgctcatatcagccattgacacagttgctttgggtttccctcaaacggcgccgattgtctggattttgaccactgatggccttagatcaatcttttgaagatgctgctttacttggagaactctatggagaaggtgcattttgtttcaagagcaagaaacctgaacccattacagtctcggttccttctgatgatactgatgattcgaattttgactgcaatatttgcttagactcggtgcaagaacctgttgtgactctctgtggtcacctcttttgctggccttgtattcacaaatggcttgatgtacagagcttctcaacaagtgatgaataccaaagacatagacagtgtcctgtttgtaaatctaaagtttctcattctactttggttcctttgtatggtagaggccgttgtactactcaggaggaaggtaaaaacagtgtgcctaaaagacccgtaggaccggtttatcggcttgaaatgccgaattcaccttatgcaagtactgatctgcggttatcacaacgggttcatttcaatagcccacaggaaggttactaccctgtctcaggggtgatgagctcgaacagtttatcatactctgctgttttggatccggtgatggtgatggttggagaaatggtagctacgaggttgtttggaacacgagtgatggatagatttgcgtatccggacacttacaatctcgcagggactagcgggccgaggatgagaaggcggataatgcaggcagataaatcgctgggaagaatcttcttcttctttatgtgttgtgttgttctgtgtcttctcttgttttaggttttcatagctagcttggttctgctactgttcagtttcttcagg

SEQ ID NO: 4270 - DNA, 1472 bp, Artificial Sequence
  P4204 (opLexA::G988, G988 is from A. thaliana)
gaaaaagactcatttgatcgagagagaaaaagaatcatttgaaccaaaagcatctttttctatcttttcaaatgcttacttccttcaaatcctctagctcctcctccgaagatgccaccgctaccaccaccgagaatcctcctcctttgtgcatcgcctcctcctcggccgcaacctccgcctcacatcacctccgtcgtcttcttttcaccgctgcgaatttcgtctcccagtcaaacttcaccgccgctcaaaacttactctcaatcctctcccttaactcttctcctcacggcgactccaccgagcgacttgtacacctcttcactaaagccttgtccgtacgaatcaaccgtcagcaacaagatcagacggctgaaacggttgccacgtggacgacgaacgaaatgacgatgagtaactccacggtgttcacgagcagtgtatgcaaagaacagttcttgtttcgaaccaagaacaacaattctgacttcgagtcttgttactatctttggctaaaccaactaacgccgtttattcggttcggtcatttaacggcgaaccaagctatcctcgacgcgacggagacaaacgataacggagctctacatatacttgatttagatatatcacaaggacttcaatggcctccattgatgcaagccctagcagagaggtcatcaaaccctagcagtccacctccatctctccgcataaccggatgcggtcgagatgtaaccggattaaaccgaactggagaccggttaacccggttcgctgactctttaggtctccaattccagtttcacacgctagtgatcgtagaagaagatctcgccggacttttgctacagatccgattgttagctctctcagccgtacaaggagagaccattgccgtcaattgtgttcacttcctccacaaaatatttaacgacgatggagatatgatcggtcacttcttgtcagcgatcaagagcttaaactctagaatcgttacaatggcagagagagaagctaatcatggagatcactcgttcttgaatagattctctgaggcagtggatcattacatggcgatctttgattcgttggaagcgacgttgccgccaaatagccgagagagactaaccctagagcaacggtggttcggtaaggagattttggatgttgtggcggcggaagagacggagagaaagcaaagacatcggaggtttgagatttgggaagagatgatgaagaggtttggtttcgttaacgttcctattggaagctttgctttgtctcaagctaagcttcttcttagacttcattatccttcagaaggttataatcttcagttccttaacaattctttgtttcttggctggcaaaatcgtcccctcttctccgtttcgtcgtggaaatgatccaaagagaaggacaaaaaaacctatatatctaggtatatagtagacaaaaaaaaagatcga

SEQ ID NO: 4271 - DNA, 1718 bp, Artificial Sequence
  P4205 (opLexA::G1767, G1767 is from A. thaliana)
caaagtattaaatcttagatattgtgggtctccctttcttctattcattttcttattcattaaaaaaaaaaaatggatactctctttagactagtcagtctccaacaacaacaacaatccgatagtatcattacaaatcaatcttcgttaagcagaacttccaccaccactactggctctccacaaactgcttatcactacaactttccacaaaacgacgtcgtcgaagaatgcttcaactttttcatggatgaagaagacctttcctcttcttcttctcaccacaaccatcacaaccacaacaatcctaatacttactactctcctttcactactcccacccaataccatcccgccacatcatcaaccccttcctccaccgccgcagccgcagctttagcctcgccttactcctcctccggccaccataatgacccttccgcgttctccatacctcaaactcctccgtccttcgacttctcagccaatgccaagtgggcagactcggtccttcttgaagcggcacgtgccttctccgacaaagacactgcacgtgcgcaacaaatcctatggacgctcaacgagctctcttctccgtacggagacaccgagcaaaaactggcttcttacttcctccaagctctcttcaaccgcatgaccggttcaggcgaacgatgctaccgaaccatggtaacagctgcagccacagagaagacttgctccttcgagtcaacgcgaaaaactgtactaaagttccaagaagttagcccctgggccacgtttggacacgtggcggcaaacggagcaatcttggaagcagtagacggagaggcaaagatccacatcgttgacataagctccacgttttgcactcaatggccgactcttctagaagctttagccacaagatcagacgacacgcctcacctaaggctaaccacagttgtcgtggccaacaagtttgtcaacgatcaaacggcgtcgcatcggatgatgaaagagatcggaaaccgaatggagaaattcgctaggcttatgggagttcctttcaaatttaacattattcatcacgttggagatttatctgagtttgatctcaacgaactcgacgttaaaccagacgaagtcttggccattaactgcgtaggcgcgatgcatgggatcgcttcacgtggaagccctagagacgctgtgatatcgagtttccgacggttaagaccgaggattgtgacggtcgtagaagaagaagctgatcttgtcggagaagaagaaggtggctttgatgatgagttcttgagagggtttggagaatgtttacgatggtttagggtttgcttcgagtcatgggaagagagttttccaaggacgagcaacgagaggttgatgctagagcgtgcagcgggacgtgcgatcgttgatcttgtggcttgtgagccgtcggattccacggagaggcgagagacagcgaggaagtggtcgaggaggatgaggaatagtgggtttggagcggtggggtatagtgatgaggtggcggatgatgtcagagctttgttgaggagatataaagaaggtgtttggtcgatggtacagtgtcctgatgccgccggaatattcctttgttggagagatcagccggtggtttgggctagtgcgtggcggccaacgtaaagggttgtttttattttttcataaggaattcgcaagttcgatttttactt

SEQ ID NO: 4272 - DNA, 938 bp, Artificial Sequence
  P4207 (opLexA::G1751, G1751 is from A. thaliana)
ctcatattttcaatctccaggtgctttacaccaacagagtcgcaagaaaacaaaaaccaaactcggatttagtttgacagaagaaggaatcgagagtcgggtatgcattatcctaacaacagaaccgaattcgtcggagctccagccccaacccggtatcaaaaggagcagttgtcaccggagcaagagctttcagttattgtctctgctttgcaacacgtgatctcaggggaaaacgaaacggcgccgtgtcagggtttttccagtgacagcacagtgataagcgcgggaatgcctcggttggattcagacacttgtcaagtctgtaggatcgaaggatgtctcggctgtaactactttttcgcgccaaatcagagaattgaaaagaatcatcaacaagaagaagagattactagtagtagtaacagaagaagagagagctctcccgtggcgaagaaagcggaaggtggcgggaaaatcaggaagaggaagaacaagaagaatggttacagaggagttaggcaaagaccttggggaaaatttgcagctgagatcagagatcctaaaagagccacacgtgtttggcttggtactttcgaaaccgccgaagatgcggctcgagcttatgatcgagccgcgattggattccgtgggccaagggctaaactcaacttcccctttgtggattacacgtcttcagtttcatctcctgttgctgctgatgatataggagcaaaggcaagtgcaagcgccagtgtgagcgccacagattcagttgaagcagagcaatggaacggaggaggaggggattgcaatatggaggagtggatgaatatgatgatgatgatggattttgggaatggagattcttcagattcaggaaatacaattgctgatatgttccagtgataaatgagctctttcttgttggcgttttt

SEQ ID NO: 4273 - DNA, 1084 bp, Artificial Sequence
  P4209 (opLexA::G1800, G1800 is from A. thaliana)
ccattatcatatcctcttcttccttcttcactatcaatcttcttctccactacaacacaaatggagaaatcatcctcaatgaaacaatggaagaagggtcctgctcggggtaaaggcggtccacaaaacgctctttgtcagtaccgtggagtcaggcaaaggacttggggcaaatgggtggctgagatcagagagcccaagaagagggcaagactttggcttggctctttcgctacagctgaagaagcagctatggcttatgatgaggctgccttgaaactctatgggcacgacgcatacctcaacttacctcatcttcagcggaatacaagaccttctctgagtaactctcagaggttcaaatgggtaccttcaaggaagtttatatctatgtttccttcatgtggtatgctaaacgtgaatgctcagcctagtgttcacataatccagcaaagactagaagaactcaagaaaactggacttttatctcaatcctattcttctagttcttcctccaccgaatcaaaaactaatactagctttcttgatgagaagaccagcaagggagaaacagacaatatgttcgaaggtggtgatcagaagaaaccagagatcgacctgaccgagtttcttcagcaactaggaatcttgaaggatgaaaatgaagcagaaccaagtgaggtagcagagtgtcattcccctccaccatggaacgagcaagaagaaactggaagtcctttcagaactgagaatttcagctgggataccctgatcgagatgccaagaagtgaaaccacaactatgcaatttgactccagcaacttcggaagctatgattttgaggatgatgtatccttcccttccatctgggactactacggaagcttagattgagtaaaagcaatttaaggtagatcaagattcagaagtacacaaatggttttggatttagtgtagcgttttggaaaagagacataggtagtgagagtgcagtcttttattatgcagcaataaagtgagtcagtgtacaaccgagttgttcgctttttttggtatattaatgaagcatgttcattttttcgct

SEQ ID NO: 4274 - DNA, 950 bp, Artificial Sequence
  P4214 (opLexA::G1936, G1936 is from A. thaliana)
ccaccttgaatctgagagagagagagaagtacgtccccacaccttgacatggtcatggagcccaagaagaaccaaaatctaccaagtttcttaaacccatcacgacagaatcaggacaacgacaagaagaggaaacaaacagaggttaaaggtttcgacattgtggtcggcgaaaagaggaagaagaaggagaatgaagaggaagaccaagaaattcagattctttatgagaaggagaagaagaaaccaaacaaagatcgtcaccttaaagttgaaggaagaggtcgtagagttaggttacctccactctgtgcagcaaggatttatcaattgactaaagaattaggtcacaaatcagatggtgagactcttgaatggttgcttcaacatgctgagccatcgatactctctgctactgtaaatggtatcaaacccactgagtctgttgtttctcaacctcctctcacggctgatttgatgatttgtcatagcgttgaagaagcttcaaggactcaaatggaggcaaatgggttgtggagaaatgaaacaggacagaccattggagggtttgatctgaattacggaattgggtttgatttcaatggtgttccagagattggttttggagataatcaaacgcctggacttgaattaaggctgtctcaagttggggttttgaatccacaggtttttcaacaaatgggtaaagaacagttcagggttcttcatcatcattcacatgaagatcagcagcagagtgcagaggaaaatggttcataaagctcaaacctttaaatggcttttaattagatatatttagcgagaatgtgattgctagtgaaatctcaaacttgatagcttattcatagcttattttacttcgatcagcaagagaacaatggttcctaaagctcaaaccttttttggcgtttgctttagattgtgcatac

SEQ ID NO: 4275 - DNA, 809 bp, Artificial Sequence
  P4219 (opLexA::G1888, G1988 is from A. thaliana)
gaaaatagaaagatgaagatttggtgtgctgtttgtgataaagaagaagcttcggtgttttgttgtgcggatgaagcagctctttgtaatggttgcgatcgccatgttcatttcgccaataaactagccgggaaacatctccggttctctctcacttctcctactttcaaagatgctcctctttgtgatatttgcggggagaggcgtgcattattattttgccaagaagacagagcaatactatgcagagaatgtgacattccaatacatcaagctaatgagcacactaagaaacacaatagattcctccttaccggcgttaagatctctgcctccccgtcagcctacccaagagcctccaattccaactctgctgctgcatttggtcgagccaaaacccgaccaaaatcagtatcgagcgaggtcccgagctcggcctccaatgaggtatttacgagctcttcttcgacgaccacgagcaattgctattatgggatagaagaaaactaccatcacgtgagcgattcggggtcgggatcgggttgtacaggtagtatatccgagtatttgatggagacattaccgggttggagagtggaggatttgcttgaacacccttcttgtgtctcctatgaggataacattattactaataacaataacagtgagtcttatagggtttatgatggttcttcacaattccatcatcaagggttttgggatcacaaacccttctcttgaacttatttctgtcgaattatagtcttttttttataagttggggtttgtaatcatgaatccaaaccaac

SEQ ID NO: 4276 - DNA, 830 bp, Artificial Sequence
  P4225 (opLexA::G352, G352 is from A. thaliana)
acgtgcttacaatacaccacacacttcactctttcttcatcttcttcttcttaaatagctcgaaatcacatctcacagaattaaatcttatggctctcgagactctcaattctccaacagctaccaccaccgctcggcctcttctccggtatcgtgaagaaatggagcctgagaatctcgagcaatgggctaaaagaaaacgaacaaaacgtcaacgttttgatcacggtcatcagaatcaagaaacgaacaagaaccttccttctgaagaagagtatctcgctctttgtctcctcatgctcgctcgtggctccgccgtacaatctcctcctcttcctcctctaccgtcacgtgcgtcaccgtccgatcaccgagattacaagtgtacggtctgtgggaagtccttttcgtcataccaagccttaggtggacacaagacgagtcaccggaaaccgacgaacactagtatcacttccggtaaccaagaactgtctaataacagtcacagtaacagcggttccgttgttattaacgttaccgtgaacactggtaacggtgttagtcaaagcggaaagattcacacttgctcaatctgtttcaagtcgtttgcgtctggtcaagccttaggtggacacaaacggtgtcactatgacggtggcaacaacggtaacggtaacggaagtagcagcaacagcgtagaactcgtcgctggtagtgacgtcagcgatgttgataatgagagatggtccgaagaaagtgcgatcggtggccaccgtggatttgacctaaacttaccggctgatcaagtctcagtgacgacttcttaacgt

SEQ ID NO: 4277 - DNA, 739 bp, Artificial Sequence
  P4226 (opLexA::G1898, G1898 is from A. thaliana)
taaaaaccacatcaccactctcacaacatccccttctctttcgctttctctcttctctcttctctccattaacttctctctcgttttctcatactctcaacttaatatgccgtcggaaccaaaccaaacccgacccaccagagttcagccctcaacggcggcttacccaccgccaaatctggctgagcctcttccttgtcctcgctgcaactccaccaccaccaagttctgttactacaacaactataacctcgctcagcctcgctactactgcaaatcttgccgccgttactggactcaaggtggtacactccgtgacgtccccgtcggtggtggaactcgtcgaagctcctcaaaacgtcaccgttctttctccaccactgccacctcctcttcctcctcttcttccgtcatcaccaccacgacacaagaaccagccacgactgaagcgagtcaaactaaggttactaatttaatttcaggtcatggaagctttgcttctctgttaggtttaggaagtggaaatggtgggttggattacgggtttgggtacgggtacgggcttgaggagatgagtattgggtatcttggagattcttccgtaggagagattccggtggttgatggttgtggtggtgacacgtggcagattggggagattgaaggtaaaagtggaggagacagtttgatatggcctggtcttgagatctcaatgcaaaccaacgatgttaagtgaaaa

SEQ ID NO: 4278 - DNA, 1064 bp, Artificial Sequence; identical to SEQ ID NO: 539
  P4229 (opLexA::G2132, G2132 is from A. thaliana)

SEQ ID NO: 4279 - DNA, 1382 bp, Artificial Sequence
  P4330 (opLexA::G963, G963 is from A. thaliana)
tcccatatcatatcttcttcagagtctcatctttttaattatatatagtcaccttcatatgtcgtacgaacatcctaatcactttaattaatctctctcatctctttctctctcgttttctaacgcatacactttgaatggcgcccatgagtttgcctccaggattcaggtttcatcccactgatgaagaactggtggcttactatcttgataggaaggtcaacggccaagccattgagctcgagatcatcccagaagttgatctttataaatgcgagccatgggacttgcctggtacgatccaactctttatatctctctctatatatggttcagcttgtttatgtcaatctgacgttatagattacatatattggtcatgatgcattcatacatatgatattggaggttttatgagttatttatttggataatacgcggaacagaaaagtcatttttgccgggaaacgacatggaatggtacttttacagcacaagggataagaagtatccaaatggctctaggacgaaccgtgcgacccgagcgggttactggaaggccacggggaaagatcgtacagtagaatcaaagaagatgaagatgggaatgaagaagacactggtttattatagaggaagggctcctcatggccttcgtactaattgggtcatgcatgaatatcgtctcacgcacgctccttcctcctccttgaaggtaaattatttcccatgcacaaacttctattaacatatatatctatattcatttctgatctaatttttttttttttgataaaccatatcgactaatattaatgttgatctaaaacaggagtcgtatgcattgtgccgagtgtttaagaagaacatacaaattccaaagagaaaaggggaagaagaagaagcagaagaagagagcactagtgtaggaaaagaagaggaagaagaaaaggagaagaagtggagaaaatgtgatggtaattatattgaagacgagagcttgaaaagagcatccgcggagacatcttcatcagagctaactcaaggggtccttttagacgaagcaaacagctcatccatatttgctcttcatttctcatcttctcttctggacgatcatgatcatcttttctcaaactattctcatcagcttccatatcatcctcctcttcaactccaagatttccctcaactttctatgaacgaagcagagattatgtcaatccaacaagactttcaatgcagagactctatgaacgggacacttgacgaaatcttctcttcttccgccactttccccgcttccctttgataaatccatatctcatactatcatctagtacttcttttctcaacttatttaaatatactcgggtacttca

SEQ ID NO: 4280 - DNA, 1092 bp, Artificial Sequence; identical to SEQ ID NO: 205
  P4336 (opLexA::G1462, G1462 is from A. thaliana)

SEQ ID NO: 4281 - DNA, 743 bp, Artificial Sequence; identical to SEQ ID NO: 311
  P4340 (opLexA::G1670, G1670 is from A. thaliana)

SEQ ID NO: 4282 - DNA, 1633 bp, Artificial Sequence
  P4342 (opLexA::G2505, G2505 is from A. thaliana)
tatataatcaagaacttgtagctgcttagaaagaaaggcagtggttaaatgttttaagctgtctttagttggagacaagagaaggaaaacgtaaatcgaaatgggttcttcgtcgaacggaggagtgccacctggtttccggtttcatccgacggacgaagagcttctccattactacttgaagaagaaaatttcttaccaaaagtttgagatggaagtcatcagagaggttgacttaaacaagcttgagccttgggatttgcaaggtactcttttacttaaacatatcacaattcattcattgcttattaattggtatcattttttgagactttgataggtcttcttgacttcttaattattggatatatatatacatgaacagttcattgttatacaattctctaatttgtatgttatctttttattttttggaagagagatgcaagataggatcaacaccacaaaacgaatggtacttcttcagccacaaggacaggaaatatccgacggggtcaaggaccaaccgtgctactcatgcagggttctggaaggcgacgggacgtgacaagtgcataaggaactcttacaaaaagataggaatgaggaagacacttgtgttctacaaaggtagagctcctcatggccaaaagactgattggatcatgcatgagtaccgtcttgaagacgctgatgatcctcaagccaaccctagtgtatgtcttttatttgagcaatatttaaattataatatagatcattatcattattcaaacagtgaaatttcacagaatctctgatttccatactaggttttctaatattgttgttaaatatgaatataataaatgtcttttaataagtatctacaacaattttccgaagctttaaaaatagtttgagagtgcactgtatattatgctgcgttaaattcaatttattggttaggaaggtggtctattaaatttaatccatttgcaacatattttatacgatcatgtaggaagatggatgggtggtatgtagagtgttcatgaagaaaaatttgttcaaggtagtaaatgaaggtggctcaagcattaactcattggaccaacacaaccatgatgcatctaacaacaaccatacacttcaagctcgtagctttatgcaccgagacagtccataccagctagtacgtaaccacggagccacgacattcgaactcaacaagcctgaccttgctcttcatcaatacccaccaatcttccacaagccagcttcacttggatttgactactcttcaggacttgcaagagacagtgagagtgcggctagtgaagggttacaataccagcaagcgtgtgagccgggtttagacgttggtacatgtgagacagtggctagtcataatcatcaacaaggtctaggtgaatgggcaatgatggatagacttgtgacttgtcacatgggaaatgaagattcctctagagggattacgtatgaggatggtaacaacaattcttcctctgttgttcagccagttcccgcgacgaaccagcttacattgcgtagtgagatggatttctggggttattctaaatagatgtttatatgtctttcttatgagtctacgacaatataagtgttggtt

SEQ ID NO: 4283 - DNA, 920 bp, Artificial Sequence; identical to SEQ ID NO: 337
  P4343 (opLexA::G1765, G1765 is from A. thaliana)

SEQ ID NO: 4284 - DNA, 1313 bp, Artificial Sequence
  P4348 (opLexA::G2086, G2086 is from A. thaliana)
tcttctcaccgtgaaggcgtcgtcaccgccgatgttattatctccggcgatgttttctgatcatcactgctttactcttactgcgaggttggttattttcaaatcttcttctctccgttctttctttcgaagtcagaaactttgccgccattttcagtaaaagggttgattctacattccctagaatcatctaataactagggttttcattaggttacgtattggttaaaattagttgaaatcatgtttcttatttctcttttcgaactaaatttggtaatcagatctctagagtgtatgatttgtcataacatctaatcgaaattagaatccgtatatgtttcattcagagaataaatcctgacttgttaatttgatatagaatgtcagattctgatgaagctaaaacgtcggaggaagaatctcaacttgctgagcaagaaacagagactcaagaaggtgaaatgactaaaaacttaaagaaaagagatcttgatgcagtagaagatgaagattcgaataacgaaagctccagattagagaaactagagaagaagataaaaaaagaaacagcgaggaagcttgaaactgactttgtgctaacaggggaagaggatgatgatgcattgcccttagcctgttccatttgccaaaacccattcttggatcctgttgtcaccaactgcaaccattacttctgcgacaagtgtgctctaaaggtaatcttttccttacaacaagtttcgtaatttctgaaaacacactcaaaacagattttccttgttattttttttcataatgcagcatcacactgagaacgatacttgttttgtgtgtaacgagccaactctagggcttttcgacacagccgtggagatcaaggaaagaatagaggaagaacgtgagaaagccagaggtttgttaaaaacgcaaaactctctgttttgacaccaaaaacctactcttacaaaactcgctcggtgatgtctctttgtagccatggtaaaggaagtgacagcaatgttagaaaaggcatcgacaatggcggatgacgccaagggcgtagcgcaaaaggttgtaaaaatggtggaggagattgaaacaatggtggaaaaagtggcggctatggccacaaaggcgggagaaacggcgacaatggcggcagatatggtgaaagaagctgaggagacgatggaaacagctaaagctaatatgtccaaagcctttgtggtaatgaagtcggtgaattggaacgtgtaaatcgggtcaaaacagagttttattgtgatctcatgctgacatcagctacaatc

SEQ ID NO: 4285 - DNA, 966 bp, Artificial Sequence
  P4352 (opLexA::G383, G383 is from A. thaliana)
cgtggactctttctttgttttggctgactcttctttcaccgtttccttagagaacttattcatctcataaacaccacacacaacacacacttctctttctccttctctctatatattttaatatcaactttctagggtttccaagttcatatatagtgatgggtttctcaatgttcttctcccccgaaaacgacgtcagccatcattcctctccatatgcttctgttgactgcactctctcacttggaactccctccactcgcctctgcaacgaggatgatgaacgtagattctcgtctcatacctccgacaccataggctgggacttcttgaacggttccaagaaaggcggtggaggcggcggacataacctcctcgctcgccgttgcgccaactgcgacaccacttctactcctctttggagaaacggtccaagaggtcccaaggtatttaatatgtaacctttacatcaaatattttatcatttcttgatgtgggactaatatttctctctgtacaacaaaacaaatattgataataactttatatgatttttaatttggtcagtcgttgtgtaatgcgtgtggaatccgattcaagaaagaagagagacgtgcatcgaccgccagaaactcgacctccggcggaggatcaactgcagctggagttccaactttggatcatcaagcaagtgcaaattattattataacaataataaccaatatgcttcatcgtcgccttggcaccatcagcataatacgcagagagttccatattactcgccggccaataacgaatactcatacgttgatgatgtcagagttgttgatcatgacgtcacaaccgacccgttcttgtcttggaggcttaacgtcgccgaccggaccggccttgtccacgattttacgatgtgatgagtgatcatttcatagatattccccttataagtcttagccttggatacc

SEQ ID NO: 4286 - DNA, 1331 bp, Artificial Sequence
  P4357 (opLexA::G1364, G1364 is from A. thaliana)
ttgtgttaattgttgtaaagttagggtttttttttctttctgagatggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgagtatgtcttttttaaccttttaacaatgctatgttgtgtttgctcttgctgaatgtttagaggcttgataggaactttgagttttagtttcaagtcttaaactttatagtgatttttgggtttttcttaactagtgaaagttgaggcctttttagtccttacattggttactctttcttgttgttcatctttgtttggctttgatgttgcatatttgatgatgcaatggtttttctatgacgttgatgagcagagcgagtgataaatgtcaaagagagaaaaggaagactattaatggagatgatttgctttgggcaatggctactttaggatttgaagactacatggaacctctcaaggtttacctgatgagatatagagaggtatgttctgagtacgatgtttattagttatgctgttgtgtgaagagagtttttgaatttcactaacttactctgtttctccttttccttttcttgctctactacgtgaactggaatatcacagatggaggtcagtggttcttcttattctatttcttgttcattcctaaaacttgcaacgatctatgatctttatggcttccgtgaatcatctctttttgtcaacttatgtatcaaactatttatgctttccttatccttttcaatgatcaatagggtgacacaaagggatcagcaaaaggtggggatccaaatgcaaagaaagatgggcaatcaagccaaaatggccaggtatatgtctcaaatctcatgcctttgaccattttttcgtcttcgcattcatctgcacgtattctctcttccgctttagctaagttagtctgacattcatggggtttgtttaccatttggcagttctcgcagcttgctcaccaaggtccttatgggaactctcaagtaacttttcctctcttctcttcacactcaagcaatacgcatcattctcttctaatttgttaagaattgaaaacttgtaaagcatcacttatgttataatctatgaatacctcaaaatctgtgaactaatttgacattggactcggtataattgtaggctc

SEQ ID NO: 4287 - DNA, 943 bp, Artificial Sequence
  P4358 (opLexA::G1789, G1789 is from A. thaliana)
aaggactctgcgacatctgtgcaacatatcatttcctcagaatctctttcttttctaggtttattactacacaaaaccaaacatcatcaactttagttactaaacaatggcatcaggctcaatgtcttcttatggctctggctcatggactgttaagcagaacaaagcctttgagcgtgctctagcagtctatgaccaagacactccggaccgttggcacaatgttgctagagctgttggtggtaaaacaccagaagaagctaagagacagtatgaccttctagttcgtgacatcgaaagcatcgagaatggtcacgtgccattccctgactacaagactactacaggaaacagcaacagaggcaggctgcgtgatgaggaaaagaggtatatttgttgcaatctaataagacacaatttatgctaataacaagtaatcaactttgtttatccataatagcccactataagatacttctatagacaagttctattccaataccatgacaagaaaacataaagggcatgtctgtttcagcataaagcttgttactttacagagattctcttgactttctatcatattgagttataagaggctctaaatcagccaagtgttctcttctcagtgttcttcaggctttatcagaaccaaaactaaaagctcccacaacaaaaaatatgcctagaaatagaatcattccttgtcaatatggtatctaatattaatcgattcccaaatctttcccctaagaaacttccagaaacaaaaataaacccactcatcatcatgaaactcgaaccaacaacattttaacctgtttaacattttttttttttattgcaggatgagaagcatgaagctgcagtgagacaagaagcaacaaaacctaactacgtatgatcgtcaaaataaaagagaatcacttcagagagatgtgtt

SEQ ID NO: 4288 - DNA, 892 bp, Artificial Sequence
  P4359 (opLexA::G211, G211 is from A. thaliana)
actcatagagatcacgaaaccctagtggaaagagagaaagctttgttgaagacggcggagatgatgtcatgtggtgggaagaagccagtgtctaagaaaacaacgccgtgttgcacgaagatggggatgaagagaggaccatggacggtggaggaagacgagattcttgtgagcttcattaagaaagaaggtgaaggacggtggcgatcgcttcctaagagagctggtttactcagatgtggaaagagctgtcgtctacggtggatgaactatctccgaccctcggttaaacgtggaggaattacgtcggacgaggaagatctcatcctccgtcttcaccgcctcctcggcaacaggtggtcattgatcgcgggaaggataccgggaaggactgataatgaaattaagaactattggaacactcatcttcgtaagaaacttttaaggcaaggaattgatcctcaaacccacaagcctcttgatgcaaacaacatccataaaccagaagaagaagtttccggtggacaaaagtaccctctagagcctatttctagttctcatactgatgataccactgttaatggcggggatggagatagcaagaacagtatcaatgtctttggtggtgaacacggctacgaagactttggtttctgctacgacgacaagttctcatcgtttcttaattcgctcatcaacgatgttggtgatccttttggtaatattatcccaatatctcaacctttgcagatggatgattgtaaggatgggattgttggagcgtcgtcttctagcttaggacatgactagatacaggaagatatatagttgatcgaatcttgatgtcttctatatctaccatgcttcaagaaggggtcacagatgcgatgcg

SEQ ID NO: 4289 - DNA, 1017 bp, Artificial Sequence
  P4363 (opLexA::G2135, G2135 is from A. thaliana)
acttttaaaacttatactttgaaccctttagttctgagaaaatgtgcggaggagctgtaatttccgattacatagcgccggagaagattgcgagatcatctggaaagtcttcctggagaagtaatggcgtctttgactgctcaatctacgatttcgatggaaatttcgatgaattagagtccgatgagccatttgtcttctcctctactcacaaacatcatgcttcaggctcagcatcagatgggaagaagaaacagagcagtcggtacaaaggaatcagaagaaggccttggggaagatgggcggctgagatacgtgatccaatcaaaggagttcgagtttggctcgggactttcaacacagctgaagaagctgcaagagcttatgatcttgaagctaagagaatccgtggagccaaagctaagctcaatttccctaacgaatcctctggaaagaggaaagccaaggctaagactgtgcaacaggtagaggagaatcatgaggctgatcttgatgtggcggtggtaagctcagcgcctagtagtagctgtcttgatttcttgtgggaggagaataatccggacacgcttctgattgatacacaatggctcgaagatatcatcatgggcgatgcgaataagaaacatgaacctaatgatagtgaagaagccaacaacgttgatgcttctctgctttctgaagagcttcttgcttttgagaaccagaccgaatatttctcgcagatgccttttacggagggaaactgtgattcctcaacgtctctgagtagtctctttgatggaggcaatgacatgggtctatggtcctgaacggttctattgtacaaatgacatgagtgttttaaatgagttcttcttcgacttgtctgtttgctatttattcttcaaaccttagccagtgtcaaacaaaaacggccactacgactattgttttgaagattgcgatattttaagttgtaagaatgtagagaataatgtttgggaagaacaaagcatt

SEQ ID NO: 4290 - DNA, 940 bp, Artificial Sequence
  P4364 (opLexA::G21, G21 is from A. thaliana)
tctctaaagcttcttctctcataacaatggcaagacaaatcaacatagagagtagtgtttctcaagttacctttatctcctccgccatccccgccgtatcttcctcctcctccatcaccgcttccgcctcattgtcctcttcacctactacatcttcctcttcttcgtcatcaacaaattctaacttcattgaggaagacaactctaaaagaaaagcatctcgaagatcattgtcatcgttagtctccgttgaagacgatgatgatcaaaacggtggaggtgggaaacggcgaaagaccaacggtggagataaacatccgacgtatagaggagtgaggatgaggagttggggaaaatgggtgtcggagattagagagccgagaaagaaatcaagaatctggctcgggacttatccaacggctgagatggcagctcgagctcatgacgtagcggctttagccattaaaggtacaacggcttacctcaattttcccaagttagccggcgagcttcctcgtccagtcacaaattctcctaaagacattcaagccgccgcctctttagcggccgttaactggcaagattcggtcaacgatgtgagtaattctgaagtggctgaaatagttgaagccgagccgagtcgagccgtggtggctcagttgttttcttcggacacaagcacgacgacgacgactcagagtcaagagtattcggaagcttcgtgtgcttcgacttcggcgtgtacggacaaagacagtgaggaagagaagctgtttgatttgccggatttgtttaccgatgagaatgagatgatgatacgaaacgatgcgttttgctactactcgtccacgtggcagctttgtggagccgatgctgggtttcggcttgaagagccgttttttctatctgaatgactaaagtacccctctcgagagagctc

SEQ ID NO: 4291 - DNA, 1483 bp, Artificial Sequence; identical to SEQ ID NO: 427
  P4367 (opLexA::G1918, G1918 is from A. thaliana)

SEQ ID NO: 4292 - DNA, 778 bp, Artificial Sequence
  P4375 (opLexA::G1471, G1471 is from A. thaliana)
ttttacaaaacaaattgtaatggagaaccaatctatgtcttcatcaagctcctccacacacaaacatgatcaaaaactcaaaagttccgttgtggccatggaggtcctggaggagaaggagacagtgaacaatccgccccagtattataataagatctacatctgttacttgtgcaagagagcgttcccaacccctcatgcccttggcggtcacggaaccacccacaaggaggaccgagaattggagaggcaacagatcgagtcaaggctttctaacaaagacaagtctaacttgctctttggtgggtcttcacaagatgttttatcaaatgataatcaccttggactctctcttggtccattgaagtccatagaaggtagcagcagcagcaacaacgttaacccattgcttaatgttggagtccctagaggaaccacagatatgaacatgaacaactatagctcacatgctttatcaactgatgatattaatcttgatcttactcttggtccatctaagtccataggagatagcaacaatatcattaataacaacactaactcatccttcgatgggaatctgatcattcccgttcgtcctcgtgtgtctagataccattttgttgctgggaacccccttgattcaatctctagaaacattcctccttctattacttttcctcatctaaacatcaatctttctcatgattcgttttctttacaagagaatggttcgggctctagtcactcataaagtctcatctcaaatgggaaagaa

SEQ ID NO: 4293 - DNA, 390 bp, Artificial Sequence
  P4378 (opLexA::G1478, G1478 is from A. thaliana)
aaagatgtgtagagggtttgagaaagaagaagagagaagaagcgacaatggaggatgccaaagactatgcacggagagtcacaaagctccggtaagctgtgagctttgcggcgagaacgccaccgtgtattgtgaggcagacgcagctttcctttgtaggaaatgcgatcgatgggtccattctgctaattttctagctcggagacatctccggcgcgtgatctgcacgacctgtcggaagctaactcgtcgatgtcttgtcggtgataattttaatgttgttttaccggagataaggatgatagcaaggattgaagaacatagtagtgatcacaaaattccctttgtgtttctctgattttatgttttgtttttcgcgtaattaagatt

SEQ ID NO: 4294 - DNA, 746 bp, Artificial Sequence
  P4382 (opLexA::G2313, G2313 is from A. thaliana)
acaatcgctcttccgtaacatattccacaaaacgatcttcttgtttcttgaatttttagccatctcttttttttttttctcattttctcggatactatggcttcgagtccacgctggacggaggacgacaacaggcgttttaagtcagctctgtcgcaattccctccggataacaagcgtttggtgaatgtcgcccagcatctgccgaaacctttggaggaggtgaagtactactacgaaaagttggtcaacgatgtttatctgccgaaacctttagagaatgtcacccagcatctgcagaaacctatggaaatggaggagatgaagtacatgtacgaaaagatggccaacgatgttaatcagatgcccgagtacgtaccactggcggaatcgagtcagtccaaacgcaggaagaaggatacgccaaatccttggacagaagaggaacacagattgtttctgcaaggattgaaaaagtatggggaaggagcttcgacgttgacatcaacgaattttgtgaagacaaagactccacggcaagtgtcaagccatgcacagtattacaaaaggcaaaaatcggacaataagaaggagaaacgccggagtatttttgacataactttggagtctaccgagggcaatccagattctggaaatcagaaccctccggatgatgatgatccgtcccaaggtcaaggcacttgtcttggagtttagatgttggaagatagaagaatggtgtgaaa

SEQ ID NO: 4295 - DNA, 794 bp, Artificial Sequence
  P4390 (opLexA::G1752, G1752 is from A. thaliana)
aaaaaaaacttatggaatattcccaatcttccatgtattcatctccaagttcttggagctcatcacaagaatcactcttatggaacgagagctgtttcttggatcaatcatctgaacctcaagccttcttttgccctaattatgattactccgatgactttttctcatttgagtcaccggagatgatgattaaggaagaaattcaaaacggcgacgtttctaactccgaagaagaagaaaaggttggaattgatgaagaaagatcatacagaggagtgaggaaaaggccgtgggggaaatttgcagcggagataagagattcaacgaggaatggaattagggtttggctcgggacatttgacaaagccgaggaagccgctcttgcttatgatcaagcggctttcgccacaaaaggatctcttgcaacacttaatttcccggtggaagtggttagagagtcgctaaagaaaatggagaatgtgaatcttcatgatggaggatctccggttatggccttgaagagaaaacattctcttcgaaaccggcctagagggaaaaagcgatcctcttcttcttcttcttcttcttctaattcttcttcttgctcttcttcttcgtctacttcttcaacatcaagaagtagtagtaagcagagtgttgtgaagcaagaaagtggtacacttgtggtttttgaagatttaggtgctgagtatttagaacaacttcttatgagctcatgttgatcttgtaattgatttcagcaaaagccactattaaactttaattttgtgata

SEQ ID NO: 4296 - DNA, 625 bp, Artificial Sequence; identical to SEQ ID NO: 493
  P4392 (opLexA::G2062, G2062 is from A. thaliana)

SEQ ID NO: 4297 - DNA, 1406 bp, Artificial Sequence
  P4394 (opLexA::G2417, G2417 is from A. thaliana)
ataccggtggaagattctgctttactacgctctccgcttcttcttctcctcgattcgattctcctcatgggtttatcatgaatttttaggttttgagtaattcagaaactcgagtgatgatcccgaatgatgatgatgatgcaaattctatgaagaattatccgttaaatgatgatgatgcaaattctatgaagaattatccgttaaatgatgatgatgcaaattctatggagaattatccgttaaggtcaattccgacggagctttcacacacttgttcattgataccaccttctttaccaaacccttcagaagcagcagcagacatgtccttcaattcagaactcaatcaaatcatggcaaggccttgtgatatgctccctgccaatggtggagctgttggtcataacccttttttggaaccaggattcaactgccccgagacaacagattggattccctctccactcccccatatttattttccttcgggttctcccaatctaataatggaggatggtgtcattgatgagattcacaaacaaagtgacttgccactttggtatgacgacttgattaccactgatgaagatccactcatgtctagtatcttgggcgatcttctccttgacactaatttcaactcagcttcaaaggtccagcaaccaagtatgcaatcgcagattcaacaaccccaagctgttctgcagcagccttcttcttgtgtggaattgcgcccacttgataggacagtatcctcaaacagcaacaacaatagcaacagtaataatgcagcagcagcagctaagggacgtatgcgttggacgcctgaacttcatgaggtttttgttgacgctgttaaccagctcggtggcagtaatgaagcaactcctaaaggtgtcctgaagcatatgaaagtcgaaggtttgactatttttcatgtcaaaagtcatttgcagaaatatagaacagctaaatatataccagtaccatcagaaggttcgccggaggcaaggttgacaccgcttgagcaaattacatctgatgatacgaaacgtgggatagatatcactgagactctgcgaattcagatggaacatcagaagaaactgcatgagcagcttgagagtctaagaacaatgcaacttcggatagaagagcaaggaaaggcgctgttgatgatgattgagaagcaaaatatgggtttcggcggaccagaacaaggagagaaaacaagtgcgaaaacgcctgaaaatggttcagaggagtcggaatccccgcggccaaagcgtccgagaaatgaagaatgaaggaaacctttcttcggatggtagatcataaaactgtggttttggtggagttgtagagtatgacttattaggagtagagctttcagtcttcttcag

SEQ ID NO: 4298 - DNA, 980 bp, Artificial Sequence
  P4396 (opLexA::G2425, G2425 is from A. thaliana)
gagatctgattgctcaccggagagaacaaaacaagaaatggggaggacgacgtggttcgacgttgacgggttgaggaaaggagagtggacggcggaggaagaccggaagctcgtggtttacatcaacgaacacggtctaggcgagtggggttcactgcctaagagagccggtctacaaagatgtggaaagagttgtagattaagatggctgaattatttgaggcctgggattaaaagaggcaagttcactcctcaggaagaagaagaaatcatcaaataccatgctcttcttggaaacaggtgggcagcaatagctaagcaaatgccaaacagaacagataatgacataaagaaccattggaactcatgccttaagaaaagacttgctaaaaaaggaatcgatccaatgacccatgagccaacaacaacaacaagcctcaccgtcgatgtcacctcctcatcaactacgtcgtctcctacaccgagccctacttcttcttctttttcctcctgttcctctactggctctgcacgtttccttaacaagctcgctgctggaatctcgtcaagaaaacacggactagagagtatcaagacagtgatattggcagaacaaccaagagaagccgttgatgaagagaagatgatgacaattaacatgaaagagaaggaattgattagttgttacatggagattgatgagacgatgagtattgatgaactaccttgtgatgactcgacgtctggcttcgtggcttttgacgactactcattaatcgacccatacagagacggtgtgtacgtatctgatttctacgatgagactgaacaccttgacctgttccttctttgaatcacatttcctttgtctaaataaatccgtttctttagtgtgacgagagagagacagtggagagagagacagtggagagagatgtctgaaaaaaacaagtgcggattagtactttgaatgacatgcg

SEQ ID NO: 4299 - DNA, 1039 bp, Artificial Sequence
  P4400 (opLexA::G2007, G2007 is from A. thaliana)
ggtgagcttaggtgcttataggcttttgacagaaatcttctaatttgtcaaatataaattaatgggaaggcagccatgttgtgacaagctcatggtgaagaaggggccgtggacggcggaggaagacaagaaactgataaactttatcttgaccaacggccactgttgctggagggctttgccgaagctggccggtctccgtcgctgtgggaagagctgccgtctacggtggaccaattatctccgacctgacttgaagagaggtcttctctccgacgccgaggaacagcttgtcatcgaccttcatgctcttctcggcaacagatggtccaagatcgctgcaagattaccaggaagaacagacaacgaaataaaaaatcattggaatactcatatcaagaagaagctccttaagatggaaatcgatccttcgacccatcaacctttaaacaaagtatttaccgatacaaacttagtcgataaatctgaaacttcatcgaaagccgacaatgtaaatgataataaaatcgtagagatcgatgggacaacgacaaatacaatagatgatagcattatcactcatcaaaatagttcaaatgatgattatgaattacttggtgatataattcataattatggagatttatttaatattctatggaccaacgatgaacctcctctagtcgatgatgcatcatggagcaatcataacgttggtattggaggaacagctgcagttgcagcctcagacaagaacaacactgctgccgaggaagatttcccggaaagatcatttgaaaaacagaacggcgaaagttggatgttcttggattattgccaagaatttggtgttgaagattttgggttcgagtgttaccatggttttggtcaaagctccatgaagacgggtcacaaggactagcatttgcaagaatacataacatatataccgatatactacataatatgtgtatataatttatacgtacgcataataaaagtaatgtaagaaaaatcatgtaaagcagtaaagaagcac

SEQ ID NO: 4300 - DNA, 772 bp, Artificial Sequence
  P4402 (opLexA::G1843, G1843 is from A. thaliana)
caaattaggtcagaagaattagtcggagaaaacagccatgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcaggtgatagcatggccaagatcctcagtcgttatgaattagaacaggctgatgatcttaaaaccttggatctagaagaaaaaactcttaattatctttcgcacaaggagttgctagaaacaatccaatgcaagattgaagaagcgaaaagcgataatgtaagtatagattgtctaaagtccctggaagagcagctcaagactgctctgtctgtaactagagctaggaagacagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggaga

SEQ ID NO: 4301 - DNA, 825 bp, Artificial Sequence
  P4403 (opLexA::G1844, G1844 is from A. thaliana)
ggggattagatgtgtcggaagagtgaagccatgggaagaagaagagtagagatcaaacgaattgagaacaaaagcagtagacaagtcactttctgtaagagacgaaatggtctcatggagaaagctcgtcaactctcaattctctgtggatcctccgtcgctcttttcatcgtctcttccaccggcaaactctacaactcctcctccggcgacagcatggccaagatcatcagtcgttttaaaatacaacaagctgatgatcctgaaaccttggatcttgaagacaaaactcaggattatctttcacacaaggagttactagaaatagttcaaagaaagattgaagaagcaaaaggggataatgtaagtatagaatctctaatttccatggaagagcagctcaagagtgctctgtctgtaattagagctaggaagacagagttattgatggagcttgtgaagaaccttcaggataaggagaagttgctgaaagaaaagaacaaggttctagctagcgaggtggggaagctgaagaaaattttggaaacaggggatgaaagagcagtaatgtcaccggaaaatagctctggccacagcccaccggagactctcccgcttctcaagtaaccaccaatcatcaacggctgatttttcatcatcctgattcaaaaaaggtaaaaaaaattcatgtgtaaaaatcataaagaagctacatgttttaaaatcctcttctccccctgcatacggataaatttatagaccaaaaatataatgttttccctcaaataagatatcgacctttgtgttaccttggaagacaggatc

SEQ ID NO: 4302 - DNA, 722 bp, Artificial Sequence
  P4407 (opLexA::G1755, G1755 is from A. thaliana)
gccatcttctttgctactactaatctactattacactgaatcgtttgggttcttcttcttcttcagctgctactttgttcgagtgattgctgacatgccgtcagcgtcggagattgttgacaggaaacggaagtctcgtggaacacgagatgtagctgagattctaaggaaatggagagagtacaatgagcagaccgaggcagattcttgcatcgatggtggtggttcaaaaccaatccgaaaggctcctccaaaacgttcgaggaagggttgtatgaaaggtaaaggtggacctgaaaatgggatttgtgactatacaggagttagacagaggacatggggtaaatgggttgctgagatccgtgagccaggccgaggtgctaagttatggctcggtactttctctagttcatatgaagctgcattggcttatgatgaggcttccaaagctatttacggtcagtctgcccgactcaatcttccactgctgccactgtgtcaggctcggttactgcattttctgatgaatctgaagtttgtgcacgtgaggatacaaatgcaagatctggttttggtcaggtcagactagaggattgtattgatgaatatgttctcctagatagttctagtgtattgttaatcgtagttgactattgtgaggtcttaagttgtagattgaaaatgagatagctcatatggagctttattgaaatgcaagaaag

SEQ ID NO: 4303 - DNA, 895 bp, Artificial Sequence
  P4414 (opLexA::G1505, G1505 is from A. thaliana)
cttcaccggagcaacgatttctccaccgctgatttccacactagcgggctttccgttccgatggatgatatagcggaacttgaatggttatcaaatttcgtagatgattcttctttcacgccgtattctgctccgacgaataaaccggtttggttaaccggaaatcggagacatcttgtacaaccggttaaagaggagacctgcttcaaatcccaacatccggccgtcaaaaccagacccaaacgagccagaaccggagtcagagtctggtctcatggttcgcagtcgttaaccgactcatcttcaagctctacaacatcttcgtcgtcctctcctcgtccttcaagccctctatggctcgccagcggtcagtttcttgatgagccaatgactaaaacacaaaagaagaagaaagtttggaaaaacgctggtcagacgcaaacgcaaacgcagacgcagacgcggcagtgtggtcattgtggagttcagaaaacgccgcagtggagagcaggaccattaggagcgaagacgttgtgtaatgcgtgtggtgtgcgttacaaatcgggtcggttactacccgaatatagacccgcttgtagcccaacattttcgagtgagcttcactcaaaccaccacagtaaagtcattgagatgcgtaggaagaaagagacttctgacggtgctgaagaaaccggtttgaaccagccggttcagacggttcaggttgtctcgagtttttgaagaaattgtggaaggtttttaaaggagcagaattaggatccgacccggttcagatttatcaccagttagtatgttaacgggttatgtatgttttaaattacaaatttgattttttgtttgttagtcgtagtaggtttttagatttagtaactgg

SEQ ID NO: 4304 - DNA, 1237 bp, Artificial Sequence
  P4418 (opLexA::G2156, G2156 is from A. thaliana)
tcacatcaattaatacgacaccgtctcgggtgaagaatctctcctctcttgccctaaagcgagttagggtttaacacacaaagcataccctttagatttgtgtctcttagctctgtttttgtcggcttgtgtaaccgatcaactcaagctattggctcctcacctcctgaaatttgacttctccaatggatctcaaagtttctcttatatgaattctatcttcaccctcacaatatctttatatatatgagccacaagaacaagaagagtcagtagatgcggctgccatggacggtggttacgatcaatccggaggagcttctagatactttcacaacctcttcaggcctgagcttcatcaccagcttcaacctcagcctcaacttcaccctttgcctcagcctcagcctcaacctcagcctcagcagcagaattcagatgatgaatctgactccaacaaggatccgggttccgacccagttacctctggttcaaccgggaaacgtccacgtggacgtcctccgggatccaagaacaagccgaagccaccggtgatagtgactagagatagccccaacgtgcttagatctcatgttcttgaagtctcatctggagccgacatagtcgagagcgttaccacttacgctcgcaggagaggaagaggagtctccattctcagtggtaacggcacggtggctaacgtcagtctccggcagccggcaacgacagcggctcatggggcaaatggtggaaccggaggtgttgtggctctacatggaaggtttgagatactttccctcacaggtacggtgttgccgccccctgcgccgccaggatccggtggtctttctatctttctttccggcgttcaaggtcaggtgattggaggaaacgtggtggctccgcttgtggcttcgggtccagtgatactaatggctgcatcgttctctaatgcaactttcgaaaggcttccccttgaagatgaaggaggagaaggtggagagggaggagaagttggagagggaggaggaggagaaggtggtccaccgccggccacgtcatcatcaccaccatctggagccggtcaaggacagttaagaggtaacatgagtggttatgatcagtttgccggtgatcctcatttgcttggttggggagccgcagccgcagccgcaccaccaagaccagccttttagaattgaaaattatgtccgtaacatagctgtaaccaaatttc

SEQ ID NO: 4305 - DNA, 1347 bp, Artificial Sequence
  P4419 (opLexA::G2157, G2157 is from A. thaliana)
ccatgtcttgtgtgtctgcttcatgcaacatgttggtttggatttggttaatctaaaagtttaagataaggttttcggattctcttcctgtcttgtaatagtttcttgtcggagagccatcaacaccaacttcaacaaaaaaaacaagaaaaagaaaaagattctctttctcgttttatttccattagagaagaaaaaaagaatggcgaatccttggtgggtagggaatgttgcgatcggtggagttgagagtccagtgacgtcatcagctccttctttgcaccacagaaacagtaacaacaacaacccaccgactatgactcgttcggatccaagattggaccatgacttcaccaccaacaacagtggaagccctaatacccagactcagagccaagaagaacagaacagcagagacgagcaaccagctgttgaacccggatccggatccgggtctacgggtcgtcgtcctagaggtagacctcctggttccaagaacaaaccaaagagtccagttgttgttaccaaagaaagccctaactctctccagagccatgttcttgagattgctacgggagctgacgtggcggaaagcttaaacgcctttgctcgtagacgcggccggggcgtttcggtgctgagcggtagtggtttggttactaatgttactctgcgtcagcctgctgcatccggtggagttgttagtttacgtggtcagtttgagatcttgtctatgtgtggggcttttcttcctacgtctggctctcctgctgcagccgctggtttaaccatttacttagctggagctcaaggtcaagttgtgggaggtggagttgctggcccgcttattgcctctggacccgttattgtgatagctgctacgttttgcaatgccacttatgagaggttaccgattgaggaagaacaacagcaagagcagccgcttcaactagaagatgggaagaagcagaaagaagagaatgatgataacgagagtgggaataacggaaacgaaggatcgatgcagccgccgatgtataatatgcctcctaattttatcccaaatggtcatcaaatggctcaacacgacgtgtattggggtggtcctccgcctcgtgctcctccttcgtattgattagttagataggcggtggttggtgcgttctttttactggaatgattatattttccattaggatggttaggcttttgtttattaaagctatcaagtttcttttttttttacggataattcggatgacaattagctagtgtttgtttgtttgttttgtggcggcttttctgacttgactattttgatcgcggatagctttgtatgaaagtgaa

SEQ ID NO: 4306 - DNA, 1305 bp, Artificial Sequence
  P4521 (opLexA::G2535, G2535 is from A. thaliana)
atactttggttagttataaactcgttctattttcttctcctttttctatctttagcaatgaacatatcagtaaacggacagtcacaagtacctcctggctttaggtttcacccaaccgaggaagagctcttgaagtattacctccgcaagaaaatctctaacatcaagatcgatctcgatgttattcctgacattgatctcaacaagctcgagccttgggatattcaaggttcatcatttatcttttattcttgatgaaacgtattaatagggcttgtatatattaattaaattagttttttaatgcatgtgttgagtcaagaactaaagctctgaattcaggaaattttgcagagtaatatatactttttgtgataataaaatttgcagtaacaaaattcagtcaaaacttaacacaactcttgttttttctatgtagagatgtgtaagattggaacgacgccgcaaaacgattggtacttttatagccataaggacaagaagtatcccaccgggactagaaccaacagagccaccacggtcggattttggaaagcgacgggacgtgacaagaccatatataccaatggtgatagaatcgggatgcgaaagacgcttgtcttctacaaaggtcgagcccctcatggtcagaaatccgattggatcatgcacgaatatagactcgacgagagtgtattaatctcctcgtgtggcgatcatgacgtcaacgtagaaacgtgtgatgtcataggaagtgacgaaggatgggtggtgtgtcgtgttttcaagaaaaataacctttgcaaaaacatgattagtagtagcccggcgagttcggtgaaaacgccgtcgttcaatgaggagactatcgagcaacttctcgaagttatggggcaatcttgtaaaggagagatagttttagaccctttcttaaaactccctaacctcgaatgccataacaacaccaccatcacgagttatcagtggttaatcgacgaccaagtcaacaactgccacgtcagcaaagttatggatcccagcttcatcactagctgggccgctttggatcggctcgttgcctcacagttaaatgggcccaactcgtattcaataccagccgttaatgagacttcacaatcaccgtatcatggactgaaccggtccggttgtaataccggtttaacaccagattactatataccggagattgatttatggaacgaggcagatttcgcgagaacgacatgccacttgttgaacggtagtggataacggaaatggaagagaggaagtgactaagtgagt

SEQ ID NO: 4307 - DNA, 911 bp, Artificial Sequence
  P4523 (opLexA::G530, G530 is from A. thaliana)
aacagcgttcgccgagagatatacatactcggatcagtcgtcaaaagctttggaatttgatacttttgatttttcgagaatcttgaaaatcagtcatgggttctggaaaagagcgtgacactttcgtctacctcgctaagctctctgagcaagctgagcgttatgaagaaatggtggaatcaatgaaaagtgttgcgaaattgaatgttgatctgacggtggaagagaggaacttactctctgtgggttacaagaacgtgattggttcaaggagagcttcgtggaggatcttctcgtcgattgaacaaaaggaagcagtgaaagggaatgatgttaatgtaaagaggatcaaagagtatatggagaaggttgagttagagctttctaacatatgcattgatattatgtctgtcttagatgagcatctcattccttcggcttccgagggtgaatctactgtcttcttcaacaagatgaaaggtgactattaccgctatcttgctgagttcaaatcagggaacgagaggaaagaggctgctgatcagtctttgaaagcctatgagattgctactactgctgctgaggctaagctccctccaacacaccctatcagattgggtttggctttgaatttctctgtcttctactacgagatcatgaacgcacctgaaagggcatgtcaccttgctaagcaggcgttcgatgaagctatctcagagcttgacactctgaacgaggaatcctacaaagatagcaccttaataatgcaactccttagggacaatctgaccttgtggacttctgacatctcagaagaaggaggagacgatgctcataagacgaatggttctgccaaacctggtgctggtggagacgatgcagagtgatatgatatgtgtgcacctggacaa

SEQ ID NO: 4308 - DNA, 1199 bp, Artificial Sequence; identical to SEQ ID NO: 1301
  P4527 (opLexA::G937, G937 is from A. thaliana)

SEQ ID NO: 4309 - DNA, 1147 bp, Artificial Sequence
  P4533 (opLexA::G406, G406 is from A. thaliana)
gtttaagagagtaaagatcatcaagtactatgcattaaattgagaagttattaaaaatttcgaaagtaattaaagattgttgatgatgaagagattaagtagttcagattcagtgggtggtctcatctctttatgtcctacaacttccacagatgagcagagtccgaggagatacggtgggagagagtttcagtcgatgcttgaaggatacgaggaagaagaagaagctatagtagaagaaagaggacacgtgggcttgtcggagaagaagagaaggttaagcattaaccaagttaaagctttggagaagaattttgagttagagaataagcttgagcctgagaggaaagttaagttagctcaagaacttggtcttcaacctcgtcaagttgctgtttggtttcaaaaccgtcgtgctcggtggaagacaaaacagcttgagaaagattacggtgttcttaaaacccagtacgattctctccgtcataactttgattccctccgccgtgacaatgaatctctccttcaagagattagtaaactgaaaacgaagcttaatggaggaggaggagaagaagaagaagaagagaacaacgcggcggtgacaacggagagtgatatttcggtcaaggaggaagaagtttcgttgccggagaagattacagaggcaccgtcgtctcctccacagtttcttgaacattctgatggtcttaattaccggagtttcacagatctacgtgatcttcttccattaaaggcggcggcttcttcattcgccgccgcagctggatcttcagacagtagcgattcaagcgctctgctgaatgaagaaagcagctctaatgtcactgtggcggctccggtgacggttccaggaggtaatttcttccagtttgtgaaaatggagcagacggaggatcatgaggactttctgagtggagaagaagcttgtgaattcttttccgatgaacaaccgccgtctctacactggtactccaccgttgatcattggaattgaagctgaaaacaccaccggaagagattttggattggattagatgctcttttcttctctgtggaaaaaacagaggagggcaaaatgggaataaagttaaaattgaagggtgaaagggcaattaaggaaggg

SEQ ID NO: 4310 - DNA, 575 bp, Artificial Sequence
  P4535 (opLexA::G354, G354 is from A. thaliana)
ttcaaaatggttgcgagaagtgaggaaattgtgatagtggaagaagatacgactgcgaaatgtttgatgttgttatcaagagtcggagaatgcggcggcggctgcgggggagatgaacgtgttttccgatgcaagacttgtcttaaagagttctcatcgtttcaagctttgggaggtcatcgtgcaagccacaagaaacttatcaacagtgacaatccatcacttcttggatccttgtccaacaagaaaactaaaacgtctcatccttgtccgatatgtggagtgaagtttccgatgggacaagctcttggtggtcacatgaggagacataggaacgagaaagtctcaggctcgttggttacacgttcttttctaccggagacgacgacggtgacggctttgaagaaatttagtagtgggaagagagtggcttgtttggatttggacttagattcgatggagagtttggtcaattggaagttggagttgggaagaacgatttcttggagttaagtttttgggttgtatacagtttcacatgattttgtaatctttgttgatccaattatcgtacc

SEQ ID NO: 4311 - DNA, 965 bp, Artificial Sequence
  P4553 (opLexA::G1947, G1947 is from A. thaliana)
gctcaaatttatataggttttttgttcacaaaatggattataaccttccaattccattagagggtctcaaagaaacgccaccaacggctttcttgacgaaaacatacaacatagtggaggattcaagcacaaacaacatagtttcatggagcagagacaacaacagcttcattgtttgggaaccagagacttttgccctaatttgcctccctagatgctttaagcacaataatttctccagctttgttagacagctcaatacttatgggtttaagaagattgatacagagagatgggaatttgcaaatgagcattttctgaagggagagaggcatcttcttaagaacatcaagagaagaaagacatcatctcaaacgcaaacgcagtcgctagaaggagagatccatgagctgcgaagagacagaatggctttagaagtagaactggttagactgcgacgaaaacaagaaagcgtgaagacatatctgcatttgatggaagagaaactgaaagtcacagaagtaaagcaagaaatgatgatgaatttcttgctaaagaagattaagaaaccgagttttttacagagcttaaggaaacgtaatctgcaaggaatcaagaatcgagagcaaaagcaagaggtgatctcaagccatggtgttgaggataatggaaagtttgttaaagctgagccagaagagtatggtgatgacatcgatgatcaatgtggaggtgtgtttgattatggtgatgagcttcacatagcttcaatggagcatcaaggacaaggggaggatgaaattgaaatggatagtgaaggaatttggaagggtttcgtgttgagtgaggaggagatgtgtgatttagtggaacattttatataataaactaatgtattatgagaggtttttttttgtttttttgctttttttttccgagtttgtcatcaagcattgtatacaatttgg

SEQ ID NO: 4312 - DNA, 1763 bp, Artificial Sequence
  P4559 (opLexA::G843, G843 is from A. thaliana)
gccgggaagaagtgcgagcttggtgccgatgggtcgttcgaaactagcttctcgtcctgctgaggaagacctgaatccaggaaaatcaaaaaggaaaaagatatcattgggtcctgagaatgctgcggcatcaatttccaccggaattgaagctgggaatgagaggaaacctggcctttactgttgtaactattgcgataaagatctgtctggtttggttcgtttcaaatgtgctgtttgtatggactttgatctttgtgtggaatgcttttctgtcggcgttgaacttaatcgtcacaagaacagtcacccatatcgtgttatggacaatttgtctttttcgcttgttacttctgattggaatgccgatgaagagatactccttcttgaggccattgcgacatacgggtttggcaattggaaagaagttgcagaccatgttggtagtaagacaacgacagaatgtattaaacacttcaattctgcttacatgcagtcaccatgctttccacttccggacttgtcccatactattggaaagagcaaagatgagctgcttgctatgagtaaagatagtgcagtcaaaacagaaatacctgcatttgtgaggctatctccaaaagaagagttacctgtgtcagctgaaatcaaacacgaagcttcagggaaggtcaatgaaatagatccacctttgtctgccttagctggagtcaagaagaaaggcaatgtaccgcaggctaaggacatcatcaagttggaagctgcaaaacaacaatctgacaggagtgtcggggagaagaaactcagacttcctggagagaaagttccattagtaacagagttatatggttacaatctaaagagggaagaatttgagatcgaacatgacaacgatgctgagcaactgcttgctgacatggaatttaaggattctgacacagatgctgagcgtgagcagaaactgcaggttcttcgtatttactcgaaaaggcttgatgagaggaagcggaggaaggaatttgttctggaaagaaacttgttgtaccctgatcaatatgagatgagcctttcagcagaggagagaaaaatatataaaagctgtaaagtgtttgcgcggttccaatccaaagaagagcacaaggaactgattaagaaagtcattgaagagcaccaaattctcagaagaatcgaggatcttcaggaagctagaactgctggttgcaggacaacttcagacgcaaatagatttatagaagagaagagaaagaaggaagctgaagaaagtatgctgctgcggcttaaccacggtgcaccaggcagtatagccggtaaaacactaaaaagtccaagagggttacccagaaatttgcatccctttggttctgactcactgccaaaggtcacacctccaagaatatacagcggtttggacacttgggatgttgatggtctccttggagctgacttactctcagagaccgaaaagaagatgtgcaatgagaccagaatactgcctgtacactatttgaagatgttggatatcttaacaagagaaataaagaaggggcagataaagaaaaagtctgatgcttatagcttcttcaaagtagagccgagtaaagtagacagagtatatgatatgctggttcataagggaataggtgactcaacatgactcatagcttcatggtcctaacatgtacttctcgaacatatattagccatgtaaatataaaggaaggtgatgctgattttggttacac

SEQ ID NO: 4313 - DNA, 2877 bp, Artificial Sequence
  P4560 (opLexA::G294, G294 is from A. thaliana)
ctctaattcaaagtttggatccctaactgtaaaatccctaattcgagagagagagagagagagagagagagagaatgggaagtaaccgtcctaagaatttccggcggcgaggggacgacggcggcgatgaaattgacggtaaagttgctaccccctcgtcaaaaccgacttcgactctttcctcctcgaaacctaaaacactctcagcctcggccccgaagaagaaactcctaagtttcgccgacgacgaggaggaggaagaagatggagctccccgtgtgacgataaagcctaagaacggcagagaccgtgtcaaatcctcttcccgtctcggcgtttcgggatcttctcacagacactcttcaaccaaggaacgtcgtcccgcttcttctaacgtgcttcctcaggccggctcttattcgaaagaggcgctgctcgagctccagaagaacacacggacgcttccttattctcgctctagtgccaatgccgagccgaaggtagtgcttaagggtttaatcaaacctccgcaggatcatgagcagcagagtctgaaggatgtagttaaacaggtttcggatttggacttcgatgaggaaggggaagaagagcagcatgaagatgcgtttgctgatcaggcagcgattattagagccaagaaagagaggatgaggcagtcacgttcagctccggcgcctgattacatatcactagatggtggtatcgtaaatcattctgctgttgaaggagtcagcgacgaggatgcggattttcagggaattttcgtcggtccgagacctcagaaagatgataagaaaggtgtgtttgatttcggtgatgaaaatcctactgctaaagaaaccacgacaagtagtatttatgaggatgaggatgaagaagataagttgtgggaggaggagcaatttaagaagggtattggtaaaagaatggacgaagggtcgcataggactgtaactagtaatgggattggcgtgcctttgcattctaaacagcagacactgccacaacagcaaccgcagatgtatgcttatcatgccgggacaccaatgccgaatgtttctgtcgctcctaccattggcccagctactagtgttgatacattaccaatgtcacaacaagccgagcttgccaagaaggcattgaaagacaatgttaagaagcttaaggaatctcatgcaaaaacgttatcctcccttaccaagacagatgagaatctgactgcgtcgttgatgagtatcacagctcttgaaagttcgctatctgcagctggagataagtatgtgttcatgcaaaaactcagagacttcatttctgttatctgtgacttcatgcagaataagggttcattaattgaagaaattgaagatcaaatgaaggaacttaacgaaaaacatgctttatctattctagaaaggagaattgcagataacaatgatgaaatgatagagttgggggccgcagtgaaagcagcaatgacagttctaaacaaacatggaagcagtagttcagtgattgctgctgccacaggtgctgcgttggctgcctctacttctataaggcagcagatgaatcggacgcgtgggcttgatgaatttggcagagacgaaaatctgcagaagcgcagggaagtggaacagagggctgcagcccggcagaaaaggcgagctcgatttgaaaataagcgtgcatcagctatggaggttgatggaccttctctgaaaatagaaggagaatcaagcactgatgagagtgacactgagacttcagcttataaggagacaagagatagcttacttcagtgtgctgataaggtctttagtgatgcatctgaggagtactcccagctttcaaaggtgaaggcgagatttgagaggtggaagcgagactattcatcaacttatcgtgatgcttacatgtctttgaccgttccttccatcttttcaccttatgtaagactggagcttttgaaatgggatcctcttcatcaagatgtggatttctttgacatgaaatggcatgggttgctttttgattacgggaagccagaagatggggatgattttgcaccagatgatactgatgccaaccttgtccctgagctagtagaaaaggttgcaattccaattttgcaccatcagatagttcgttgctgggatatacttagcacccgggagacaagaaatgctgttgctgctacaagcttggtgacaaattatgtttctgcttcgagtgaggccttagcagaactatttgctgctattcgtgctcgccttgttgaagccattgcagctattagtgttccgacatgggatcctctggtattgaaggctgtacctaatactccacaagttgccgcatataggtttgggacatcagtccgtcttatgagaaatatatgtatgtggaaagacatcctggcgcttccagtgttggagaacttggctcttagtgaccttttgtttggaaaagttctaccccatgtcagaagcattgcatcaaatatccatgatgctgtgacaagaactgaaagaatcgttgcttctttgtctggagtgtggacaggaccaagcgtcacacgaacccacagtcgtccgctgcaacctcttgtggattgtactctgacacttagaagaattctcgagaaaaggcttggctcaggactggacgatgcggaaaccactggtctcgcccgcagattaaagagaatactagtcgagctccatgaacatgaccacgccagggaaattgtcagaacattcaatcttaaggaggcagtttgaccaaaagtttattgatgggaaactggaaagtcaacacagaaatctttagcctcaggttatcaggctcacctttcgg

SEQ ID NO: 4314 - DNA, 863 bp, Artificial Sequence
  P4563 (opLexA::G1884, G1884 is from A. thaliana)
ctcttgtcccatattgcaccatctccttcagaaaaaaataaaaagagtttataactcatgatgacgtcatcccatcagagcaacaccaccggctttaaaccgcggcggatcaagacgacggcgaagccaccacgtcagatcaataacaaagaaccatctccggcgacgcagccggtgctcaagtgtccgagatgtgattcagtcaacaccaaattctgctactacaacaactacagcttgtctcagccacgtcactactgcaagaactgtcgtcgttactggacacgtggcggcgccctccgtaacgttcccatcggtggctccactcgaaacaagaacaagccttgcagcctccaagtcatctcttctcctcctttgttctcgaacgggacgtcatcggcgtctcgtgagcttgtaagaaaccatccatcgacggcaatgatgatgatgagttctggtggattctccggctatatgtttccgttggatcctaacttcaaccttgcctcgtcttctatcgagtctttgagttcttttaaccaagatttgcaccagaagcttcagcaacaaagactcgtcacttccatgtttctccaagattctcttccggttaacgagaaaacggttatgtttcagaacgtagagttgattcctccttcgacggtgacgacggattgggttttcgataggttcgccactggaggaggtgcaacaagtggcaatcatgaagataatgatgatggggagggtaatttgggaaattggttccataatgctaataataatgctctgctctaattatcaattatcatttactctctatttctctaaatattgtagctagcatgcagaagctatggctg

SEQ ID NO: 4315 - DNA, 1281 bp, Artificial Sequence
  P4574 (opLexA::G2147, G2147 is from A. thaliana)
gtcaagagtttgaacacacaaagaagaaagaagaactcaacatttcaagcaagaagaaagagagaagagagaaggtccaataatagagagaacaaaaaaaaagagagcttaattgtcagtttattctctgcaaacgtgcggcctaagtaacacatgtcgaattatggagttaaagagctcacatgggaaaatgggcaactaaccgttcatggtctaggcgacgaagtagaaccaaccacctcgaataaccctatttggactcaaagtctcaacggttgtgagactttggagtctgtggttcatcaagcggctctacagcagccaagcaagtttcagctgcagagtccgaatggtccaaaccacaattatgagagcaaggatggatcttgttcaagaaaacgcggttatcctcaagaaatggaccgatggttcgctgttcaagaggagagccatagagttggccacagcgtcactgcaagtgcgagtggtaccaatatgtcttgggcgtcttttgaatccggtcggagcttgaagacagctagaaccggagacagagactatttccgctctggatcggaaactcaagatactgaaggagatgaacaagagacaagaggagaagcaggtagatctaatggacgacggggacgagcagcagcgattcacaacgagtccgaaaggagacggcgtgataggataaaccagaggatgagaacacttcagaagctgcttcctactgcaagtaaggcggataaagtctcaatcttggatgatgttatcgaacacttgaaacagctacaagcacaagtacagttcatgagcctaagagccaacttgccacaacaaatgatgattccgcaactacctccaccacagtcagttctcagcatccaacaccaacaacaacaacaacaacagcagcagcagcagcaacaacagcagcaacagtttcagatgtcgttgcttgcaacaatggcaagaatgggaatgggaggtggtggaaatggttatggaggtttagttcctcctcctcctcctccaccaatgatggtccctcctatgggtaacagagactgcaccaacggttcttcagccacattatctgatccatacagcgcctttttcgcacagacaatgaatatggatctctacaataaaatggcagcagctatctatagacaacagtctgatcaaacaacaaaggtaaatatcggcatgccttcaagttcttcgaatcatgagaaaagagattagtctagcgacctagtattattgatccat

SEQ ID NO: 4316 - DNA, 874 bp, Artificial Sequence
  P4575 (opLexA::G1551, G1551 is from A. thaliana)
ttctgagcgaaattctgacaaaagagatgatggaatgggataatcagctacaacccaataaccatcactcttctaatcttcaagggatcgacgttaatggcggctccggcgccggaggaggaatgtacgtgaaggtgatgaccgatgagcagtatgaaactctcaggaaacagattgctatttacggcaccatttgtgagcgtcttgttgagatgcataaaactctcactgctcaacaagatcttgcaggagggagaatgggaggactatatgcagacccaatgatgtcatctttaggtcataagatgacagctagacagaggtggactcctacgccagtccagcttcagattctggaacgtatattcgatcaaggcacgggaacaccgagcaagcagaagatcaaagacataacagaagagctgagccaacacggccagattgctgaacaaaatgtctataactggttccagaaccgacgtgctcgatccaagaggaagcagcatggtggaggttcttctggaaataataatggtgagtctgaggtagagactgaagttgaagcattgaatgagaagagagtagtgaggccagagagtcttcttggtcttccagatggaaatagcaacaataatgggttagggacaacaacagcaacaactactgctcctaggcctgaagatctttgctttcagagccctgagattagctcagaccttcacttgctagatgttctatcaaacccaagggatgagcatcttgttggaaagatgggactggcggaaagttacaacctttatgatcatgttgaagattatggcatgtcaggctgattgaatacaagctgaggaaacttctaattatcagagagatc

SEQ ID NO: 4317 - DNA, 1326 bp, Artificial Sequence
  P4583 (opLexA::G1491, G1491 is from A. thaliana)
tatctctgaactgagagtagcaggttgcaattaaaaactaaagattgtgtcagacttatgtattaccacaaccagcaccaaggaaagagcatcctctcttcatcgagaatgcccatttcttctgaaaggcatccgttcctcagaggaaatggcacaggagattctggactcattctctccactgatgcaaagccacgactaaaatggactccagatcttcacgagagatttgttgaagcggtcaaccagcttggaggaggagataaggctactcctaagacaatcatgaaagtcatgggcattccaggccttaccttataccatctcaagagtcatcttcagaaatataggctaagcaagaatcttaatggacaagctaacagcagtttaaacaagacaagtgtgatgaccatggtagaagaaaacccccctgaagtagacgaaagtcacagtgagagtttaagcattggaccacagccgagcatgaacttacccataagtgatgcccttcaaatgcaaatagaggtccagagacggctacacgagcaacttgagctcaggatagaggctcaaggaaagtacctgcaatcgattctggagaaagcacaagagactcttggaagacagaacctaggtgcagctgggattgaagcaacaaaagctcaactctcagaattagtatctaaagtatcagcagactatccagactctagtttcctcgaaccgaaagaactgcagaatctacaccatcaacagatgcaaaaaacgtatccacctaactcctccctggacagttgcctaacctcaagtgaaggaactcagaaagccccaaagatgcttgacaacagactgggattaagaacatatattggagattcaacttcagagcagaaagagataatggaagagccattcttccatagaatggagctcacatgggcagaagaagaaagcctcagagagaatcacaacaggccatatctttcaacaatggttaacaacgcagaaccgagaatctcgtcttcaagaagaagtcctggaagattgtcaataggagtgggattacatgaacacagaggaaggagtagcaacaacagtgagtatacagaagaaagattcaacgagaataatgaagattgcaagcttgaaacacacacaagaacagctctagatcttaacacacacgacgaaaactatggcacaacgcgtcctaaacagtttgatttaaatggtttcagctggaattgagaagaacaaataagctttagaagagtgcaacaacctttttatgataatcacacaggaaatgaaaagcctttcatttcc

SEQ ID NO: 4318 - DNA, 1100 bp, Artificial Sequence
  P4584 (opLexA::G1959, G1959 is from A. thaliana)
tgtccataaatccggagcctgacccgacgtttgacccggatccgaaactcccacaatctccataccacccaaattcatctcccctaaagctttctctcactttcccgggaaaatcggcgaccaaaattggaaaatgtactcagcgattcgctcgcttccactcgatggtggacacgttggtggtgactaccatggacctcttgacggaaccaatcttcccggtgacgcttgtttggttttaacgactgaccctaaacctcgtctccggtggacaactgagcttcatgagagattcgttgacgccgttactcagctcggtggtcctgacaaagcgactcccaaaactattatgagaacaatgggagtgaagggtctcactctctaccacctcaaatcacatcttcagaaattccgcctagggaggcaagctggcaaagaatcaactgagaactctaaagatgcttcttgtgtaggggagagtcaggacacaggttcatcttcgacatcatcaatgagaatggcgcagcaggagcagaacgagggttaccaagtcaccgaagctctacgtgctcagatggaagtccaaagaagactacacgatcaattggaggtgcaacggaggctccagctgaggatagaggcacaaggaaaatacctgcaatcgattcttgaaaaagcttgcaaggcctttgacgagcaagctgctacttttgctggacttgaggctgctagggaagagctatcagagctagccatcaaagtctccaatagctctcaaggaacatcagtcccgtacttcgatgcaacaaagatgatgatgatgccatcgttgtcagagcttgcagtagcaatagacaacaaaaacaacatcacaaccaactgttcagtagaaagctctctgacttccatcacacatgggagctctatatctgctgcatcaatgaagaagcgtcaacgtggagacaatttgggcgtagggtatgaatcaggctggattatgcctagtagcaccattggataaagtttaggagagggaaaaagttcattatgggaaaggtagagataagatttaactgttctttacttgctttgaggggcct

SEQ ID NO: 4319 - DNA, 1732 bp, Artificial Sequence
  P4592 (opLexA::G2546, G2546 is from A. thaliana)
gaccaaactcatcgaactaagaactcactgtaataaaacttttaaaaggtgtaaacaccaatggcagtttattacacaagtaatgtcggttgttaccagcaagaaccaatctttctcaaccatcaacaacaaaaccaacaagcttcttcttcatccgccgccgcttctttcaccgtcaccggcggcgatactgttcgaaacgagatggtttttatcccaccaaccaccacaggagacgttgtaacaggaaacggtaccgtttcaagcagcgatctaagctttcacgatggtcaaggactgtctttgagccttggtactcagatctctgttgctccgtttcactttcatcaataccaattggggtttactagtcagaatccttcaatttcagtcaaggaaacgtcaccgtttcatgtggatgagatgagtgtgaagagcaaagaaatgatcttgttgggtcaatctgatccttcctctggttatgctggtaatggtgggaatggcttctacaacaattatcggtataatgagacatcaggagggtttatgagcagcgttctgcgttctcggtatcttaaacctgctcagaatttgcttgatgaagtggttagtgtcaagaaagaactaaaccaaatggggaagaagaagatgaaagttaatgactttaacagtggttctaaggagatagaaggaggaggtggtgagttatcgagtgattcgaatgggaaatcgattgagttatctacaattgaacgtgaagagcttcagaacaagaagaacaagcttttaacaatggttgatgaggtagataaaagatataaccaatattaccatcaaatggaagcattagcttcatcatttgagatagtagcaggacttggatcagctaagccttacacatcagttgctctcaacagaatctctcgccattttcgtgctcttcgcgacgcaataaaggaacaaattcagattgttagagaaaaacttggggagaaaggaggagagtcgttggatgagcaacaaggagagaggataccaaggttgaggtatttagatcaacggttgagacagcaaagagctttgcatcaacagcttggaatggttcgacctgcttggagacctcaaagaggtcttcctgaaaactctgtctctgttcttcgcgcttggctctttgaacatttccttcatccatatccgaaagaatctgagaaaatcatgcttgcaaagcagacaggattgtcaaagaaccaggttgctaattggttcataaacgcgagagttcgtctgtggaaaccgatgatcgaagaaatgtataaagaagagtttggtgatgaatctgagttactaatctccaaatcttcccaagaacccaacagcacaaaccaagaagactcctcatcgcagcagcagcagcagcaagagaacaacaacaacagcaacctcgcttattcatctgcagacacaacaaacattgtcttctcatcagaaaccaaaccagatcgtgttctaggcaatgataacgacccacagcaacaacagataaaccgctcatcggattacgacactctgatgaactatcacgggtttggtgttgatgattaccgttacattagcggaagcaaccagcaagaaagcagattctccaattcccatcacttacacgactttgttgtgtgatattatctggttcttcttggtacagaggagatgattcttgaagcgcaagaaatgt

SEQ ID NO: 4320 - DNA, 461 bp, Artificial Sequence
  P4594 (opLexA::G1659, G1659 is from A. thaliana)
gcctgaaactcattctcaatcaaatggagccaaatattccgatccaaagaggagatgagcagtcaaaagttattaaggcatggaaggaactaaagataacaaaggtcaataacaagactcagaagaagctactagatatttcaggatgggagaaaaagaaaactacaaagatcgaatctgaactcgctagaattcagcggaagatggacagtaagaagatggagaaatctgagaaactaaggaacgaaaaagcggcagttcatgcaaaggcacaaaagaagaaggcagatgttcaaaccagacgggctcaagagatccttgatgcggaagaagctgctgctaggtttcaagccgcaggaaagatacccaagaagtcatctttgagctgcttctgagatcagcactaacctgtgatacagattatcacctatctccggtatcctatgttcatacttgtatct

SEQ ID NO: 4321 - DNA, 1890 bp, Artificial Sequence
  P4595 (opLexA::G1666, G1666 is from A. thaliana)
atcatgagcgtatgagagtaaattcttctcacatattaataacaacccttcaaagttataagatttttagagagagagctaccacgttttcgtatctccgggaacgatggatgaatcaagtattattccggcagagaaagtggccggagctgagaaaaaagagcttcaagggctgcttaagacggcggttcaatctgtggactggacttatagtgtcttctggcaattttgtcctcaacaacgggtcttggtgtgggggaatggatactacaacggtgcaataaagacgaggaagacaactcaaccagcggaggtgacggcagaagaggcggcgttagagaggagccaacagctcagggagctttatgagacacttttagccggagagtcaacgtcagaagcaagagcatgcaccgcattgtcaccggaggatttgacggagacagaatggttttatctaatgtgcgtctctttctcttttcctcctccatctgggatgccaggaaaagcgtatgcaaggaggaagcacgtatggctaagtggtgcaaatgaagttgacagtaaaactttttctagagctattctcgctaagagtgctaaaattcagacagtggtttgcattccaatgcttgatggtgttgtggaactaggcacaacgaaaaaggtaagagaagatgtagagtttgttgagctcacaaagagtttcttctatgaccactgcaagacgaacccaaagccggctctttctgaacactccacctacgaagtgcatgaagaagccgaagacgaagaagaagtagaagaagagatgacaatgtcagaggaaatgaggcttggctctcctgatgatgaagatgtttccaatcaaaatctacactctgatcttcatattgaatcaacccatacgttagacacacatatggacatgatgaatctaatggaggaaggtggaaactattctcagacagtaacaacacttctcatgtcacaccccacaagtcttctttcagattcagtttccacatcttcttacatccaatcatcgtttgccacgtggagggttgagaatggcaaagagcatcagcaagtgaaaacggcgccgtcgtcacaatgggtgctcaaacaaatgatcttcagagttcctttcctccatgacaacactaaagataagaggctaccgcgggaagatctgagccacgtagtagcagagcgacgcaggagggagaagctgaacgagaaattcataacgttgagatcaatggttccatttgtgaccaagatggataaagtctcaatccttggagacaccattgcgtacgtaaatcatcttcgaaagagggtccatgagcttgagaatactcatcatgagcaacagcataagcggacgcgtacttgtaagagaaaaacatcggaggaggtggaggtttccatcatagagaatgatgttttgttagagatgagatgtgagtaccgagatggtttgttgcttgacattcttcaggttcttcatgagcttggtatagagactacggcagttcatacctcggtgaacgaccatgatttcgaggcggagataagggcgaaagtaagagggaagaaagcaagcatcgctgaggtcaaaagagccatccaccaagtcataatacatgatactaatctatagaccctaactttattgatgccaactctagagaaggataattaagcgtatttttgttttagcctcacatgtattaagacatcagttacatatatagccggatgcaacatataaatgaaaatgtactagatgatattgttcatttgtccaatgtagtacttgtgtatgatgcaattgcaacatataaatgcaaatgtactagatgacgatgttgttcgttgtccaattta

SEQ ID NO: 4322 - DNA, 1334 bp, Artificial Sequence
  P4597 (opLexA::G2144, G2144 is from A. thaliana)
gctgaatttggtttcgattattggtgttattgttttcgaagatttccagtgagtttccgtttatggatctgactggaggatttggagctagatccggcggtgttggaccgtgccgggaaccaataggccttgaatcgctacatctcggtgacgaatttcggcaactagtgacgactttacctcccgagaaccccggcggttcgttcacggctttgcttgagcttccacctacacaagcagtggagcttctccatttcactgattcttcgtcttctcaacaagcggcagtgacagggatcggtggagagattcctccgccgcttcactctttcggtgggacattggcttttccttctaactcagttctcatggagcgagcagctcgtttctcggtgattgccactgagcaacaaaacggaaatatctccggggagactccgacgagctctgtaccttccaattcaagtgctaatctcgacagagtcaagacggagcctgctgagaccgattcatctcagcggttgatttctgattcagcgattgagaatcaaatcccttgccctaaccagaacaatcgaaatgggaagaggaaagatttcgaaaagaagggtaaaagctcgacgaagaagaacaaaagctctgaagagaacgagaagctgccatatgttcacgttagagctcgtcgtggtcaagcaaccgatagccatagcttagcagaacgagcaagaagagagaagataaatgcacgaatgaagctgttacaggaactggtcccaggctgtgataagattcaaggtaccgcgctggtgctggatgaaatcattaaccatgtccagtcattacaacgtcaagtggagatgctatcaatgagacttgctgcggtaaaccccagaatcgacttcaatctcgacaccatattggcttcagaaaacggttctttaatggatgggagcttcaatgccgcaccaatgcagcttgcttggcctcagcaagccattgagaccgaacagtcctttcatcaccggcaactgcaacaaccaccaacacaacaatggccttttgacggcttgaaccagccggtatggggaagagaagaggatcaagctcatggcaatgataacagcaatttgatggcagtttctgaaaatgtaatggtggcttctgctaatttgcacccaaatcaggtcaaaatggagctgtaagttgggaaaacggtagagatcatgaatgtgtatatacatcgtataagctcgtttctctctatataaatataatcataaatatagatatctgttaagaaggtatcagtcatttgattcagagagacaacactg

SEQ ID NO: 4323 - DNA, 1325 bp, Artificial Sequence
  P4598 (opLexA::G2150, G2150 is from A. thaliana)
tcttcagaattcccagagaagttgttggaattgaatttttcacttttttgttcataaaagttctagtctttttagatgaacatggacaaggaaacagagcaaaccctaaattacttacctttgggtcagagcgatccctttggcaatggcaatgaaggaacaattggagatttccttggaagatactgcaacaaccctcaggagatttcaccgttaactctacaatccttctctctgaattctcagatctccgagaatttcccaatctctggtggaatcagattccctccatatccaggtcaatttggatccgatcgtgaatttgggtcacaaccaacaacgcaggagagtaacaagagctctttgttggatccagattcagtttcggatcgagttcacaccacgaaatctaactctagaaagaggaagtcgattcctagtggtaatggcaaggagtctccagcttcatcgtctcttacagcttccaattcaaaggtttcaggagagaatggtggatctaaaggtgggaagagaagcaagcaagatgtagctgggagtagtaaaaacggagtagagaagtgcgatagtaaaggcgacaataaggacgatgctaagcctcctgaggcgcctaaagattatattcatgtcagagctagaaggggtcaagcaactgatagccatagtcttgctgaaagagcaagaagagaaaagattagtgagagaatgacgttgcttcaggatctggttcctggttgcaaccggattacagggaaagcagtcatgcttgatgaaattataaattatgtgcagtccttgcagagacaagttgagttcttgtccatgaagctggctaccgtaaatccaaggatggagtttaatgctaatgcttctttatccacagagatgattcaaccgggggagtcgttaacgcagtctctttacgcaatggcttgctcagagcaaagacttccatcagcatactattcacttggcaagaacatgccaagattctcagacacacaattcccctcaaacgatggatttgttcacactgagacaccaggattctgggaaaataatgacctgcaaagcattgttcagatgggttttggagatatcctccagcaacagagcaacaacaacaacaacaactgttctgagccaacgcttcagatgaagcttgaaccatagtccatagctatgattattatctctgttgtacatacagaaaaccaagtagtgatgagtaacggagtgaatcatattggaattttaatgtttacaatcgttgcttctttgcttgtgtctctgttgatttcttctca

SEQ ID NO: 4324 - DNA, 817 bp, Artificial Sequence
  P4601 (opLexA::G1808, G1808 is from A. thaliana)
ccccttctaatttctctcatctctctattagaaaaattattagcaattatgttgtccactgcaccggccttttcattctccgaaccgggtttggttaatcaattctcgggtttccaaaccgggttcactccttgggaatgggattgctctgatctctttttcgtggaccaaatgtctcttgaaccggccatccctagtccttgttatggtgaatccgacactggttccgtcaaaattaattccggttctcatgacatgaaaaccggttctgacgaatcttgtgccggtttcgtcaaaattaatcctcgttgtgacgacgccgacatatcaaacgatctaccgtgctctcaagcagatgaaccggactcggacgacacaaaacaattgacagccatcacaaatttcggttcgggagagaataaccataaccggaaaaaaatgatccaaccggagatgaccgacgagcggaagaggaagaggatggagtcaaaccgggaatcagcgaaacggtcaagaatgcgtaaacaaagtcacattgataacttacgagagcaagtaaaccggttggatttagaaaaccgtgagctcgggaaccgactccggttagttttacaccagcttcaacgagtgaattccgacaataaccggctcgtgacagaacaagagatactccggctaagattgtcggagatgcgtcggattctgatcattagacaacttcaacaacagcaacaatgggaactacataaccggagaatgatcatgactgaacaaaaccaccctcatcttcaatgatagatcaaaatatttaagaagg

SEQ ID NO: 4325 - DNA, 1590 bp, Artificial Sequence
  P4603 (opLexA::G2072, G2072 is from A. thaliana)
tatgccattttcctccccgtggaaggtctaacaatcacacgtctcctaatctcgtacgtcttcttaggtatgttctttgcatgttaaagaaactgtatcttcaattcttgtcattacatgataatggttttcttatacatgttttgctcataccttataggttttgaagaatggaaaatttaaggaggttgtcaaacccgggaaatttcggattcattggaagatcacaatcacgagttccccaaaaaaacatggaaaataacatttctcctcctaataatatgcaccaccatagtgcttctttagatgatcttttcacagaagaccaaccagcttggctcgatgagctcctaagtgagccagcatcacctaagattaacaaaggtcatagacgttcagctagtgacacagctgcttacttgaactcagctttaatgccttcgaaggaaaatcatgttgctggttcgtcttggcagttccagaactatgatttgtggcagtccaactcttatgaacaacacaataaattaggatgggatttctctacagcaaatggaactaatatccaaagaaatatgtcatgcggagctttaaatatgtcgtcgaaacccattgagaaacatgtaagcaaaatgaaagaaggaacttctacaaaaccagatggtcctagatcaaagactgactcaaaacgtatcaaacagtaagtagtcttatctttgtcatgtgtacttataataggttattaaaatgtcccacatcgattgagattaagatctttaggcattatctggcaatccttaactcttgagctaactgttgggataagttagaccacattcctaatataggttgataaacatatttctgatgcggtttaataatatacaattttatcgaaaattattaaaatgcagtcaaaatgctcatcgagcgcgtttgagaaggcttgagtacatatcagaccttgaaaggaccatccaagtgctacaagtaagattctaaaggctcgtgtatttctcgaagttctttaatttcattaataatatgaaaagattcctaatgttatattatacatgttggattttcttcaataggttgaaggatgtgaaatgtcatctgccattcactacttggatcagcagttactcatgcttagcatggaaaatagagctttaaaacaacgtatggatagtttagcagaaatccaaaagcttaaacatggtatttaacctttcatatcactactaaaatggatcaaaatgcatttattttgttctcttgtaaaattttgattttggttggttaatacagtggagcagcaattgcttgagagagagataggaaacctacagtttcgacgacaccaacaacaaccacagcaaaaccaaaaacaagtccaagcaatacaaaatcgatacaacaaatatcaaccacctgttacacaagaacccgatgcccaatttgcagccttggcaatatgatttaggaaatatggatacattgttcagattaagctgagctcctcttgctctaccttaatgtccatacaacataggtgaacttgatgtttgtagccttgaatgaaaaccg

SEQ ID NO: 4326 - DNA, 1149 bp, Artificial Sequence
  P4605 (opLexA::G2116, G2116 is from A. thaliana)
ttcatctccatcattatctccattgacattgttctcaattgcgaataataatcataattattcacacaaccaaagcattcatctctcagattctcttaaaaaaatggagaaatcagatcctccaccagtcccaaagcccggcgccactattatcccctcctccgatccaattcctaatgccgatccgattccatcttcttccttccaccgccgatctcgctccgacgatatgtccatgttcatgttcatggatcccctctcctccgccgcaccaccttcctccgacgaccttccctccgacgacgatctcttctcttctttcatcgatgtcgatagcctcacctctaatcccaatccctttcaaaatccttccctctcctccaactccgtttccggcgctgctaatcctcctcctcctccttcctctcgtcctcgccaccgtcacagcaattccgttgacgctggatgcgccatgtatgccggtgatatcatggacgctaagaaagctatgcctcctgaaaaactctctgagctttggaacatcgatcccaaacgcgccaaaaggattctagcgaatcgacaatctgcagctcgatccaaagagagaaaagctcgatacattcaagaacttgagcgcaaagttcaatctcttcaaaccgaagctaccactctctctgctcagcttactctctaccagagagacacaaatggactagcaaacgaaaacacagagctgaaacttaggttgcaagcaatggaacaacaagctcagcttcgtaatgctttaaacgaagcgttgaggaaagaagttgaaaggatgaagatggagacaggagaaatctctggtaattcagattcgtttgatatgggaatgcagcagattcagtattcttcctcaactttcatggctattccaccatatcatggctcaatgaacctccatgatatgcagatgcattctagtttcaatcctatggagatgtccaattctcaaagcgtgtcggactttctacagaacggccgaatgcaagggctggagattagtagcaatagctcaagcttagtcaaatctgaaggaccttctctctctgctagtgagagtagctctgcctattgacgacaagattatgatgaggctcatttttctgg

SEQ ID NO: 4327 - DNA, 508 bp, Artificial Sequence
  P4606 (opLexA::G2117, G2117 is from A. thaliana)
catacttgtcaacaaaaattttcttaaagaacgcataactgtttttttcatggctggttctgtctataaccttccaagtcaaaaccctaatccacagtctttattccaaatctttgttgatcgagtaccactttcaaacttgcctgccacgtcagacgactctagccggactgcagaagataatgagaggaagcggagaaggaaggtatcgaaccgcgagtcagctcggagatcgcgtatgcggaaacagcgtcacatggaagaactgtggtccatgcttgttcaactcatcaataagaacaaatctctagtcgatgagctaagccaagccagggaatgttacgagaaggttatagaagagaacatgaaacttcgagaggaaaactccaagtcgaggaagatgattggtgagatcgggcttaataggtttcttagcgtagaggccgatcagatctggaccttctaatcgtctcgtaagcttgttggttttttgttgtttatttaaagg

SEQ ID NO: 4328 - DNA, 884 bp, Artificial Sequence
  P4608 (opLexA::G2215, G2215 is from A. thaliana)
gagctatatacatagaggtctcatggtcttgtttgttctgtagatgtactcaattcatacagctctgcgtcatggaacgaaacagagcaaaacagaggagatggcgcttcatcggagaagaagagggaaaatggaacagtgaaagagacaactaagaagaggaaaatcaatgagagacacagagaacatagcgtgagaatcatcagcgatattactacctacacaactagttcagctccaacgacattgtcaaaggaaactgtctctcgctacttctacatgcccataactcaggctgcaatagcacttaacgttggtttaactctactaaaaaggagatgtcgcgaattgggtattcgccgatggcctcatcgtaaacttatgagcttaaacactttgatcagtaacgtcaaggtatgtagaacaaggcactacacttaatattattgttttcagataattgaactcaaatgttttatcatatgaataggagctgcagaagatggaaggcgaagagaatgcagaaaaactgcaggacgcgttggagatgcttgagaaggagaagaggacaattgaggatttgccggatttggagtttaaggacaagacaaagaggctaagacaagcttgtttcaaggctaaccacaagaggaagaagaagagaagtctcaagtccgatcagtctcaagtaccctcgtgttcaagcagcggatcagttcctagtgatgagtcggttgatgaagcaggaatggagagtgatgaagaaatgaagtatctcttgtgtggtttctcaagtgaatttactagtggtttgtgaaatctgtttttagtgagaaattggggattgtaaagccaaatgctttttgactaattcaatgaacagg

SEQ ID NO: 4329 - DNA, 1263 bp, Artificial Sequence; identical to SEQ ID NO: 637
  P4609 (opLexA::G2373, G2373 is from A. thaliana)

SEQ ID NO: 4330 - DNA, 1413 bp, Artificial Sequence
  P4610 (opLexA::G2376, G2376 is from A. thaliana)
acgagcttctgactcagatccggcgatatcgaattccatggaggacgatgaagacatccgatctcagggttccgattcacctgatccgtcttcctccccgccggcgggacgaatcacggttacggtggcttcggcaggtccgccttcttattctctgactcctccgggtaattcgtcgcagaaggatccggatgcgttggctctggcgctgcttccgattcaggccagcggtggagggaataacagcagtgggagaccaaccggcggcggcgggagggaggattgttggagcgaagcagctacggctgtgttgattgatgcgtggggtgagagatacttggagcttagcagagggaatctgaagcagaagcactggaaagaggtggctgagattgtgagcagcagagaggattacggtaaaattcccaaaactgatatacagtgtaagaataggatcgatacggtgaagaagaagtataaacaagagaaggtgagaatcgctaacggcggtggccgtagcagatgggtgttcttcgacaagcttgaccgtctgattggatcaacggcgaagatcccgacggcaacttctggagtcagcggtcctgtcggaggattgcataagattcctatgggtattccaatgggaagtcgttcgaatctgtaccatcagcaagctaaggctgcaacaccgcctttcaataatcttgaccggttaattggagctacggctagagtctcagctgcttctttcggtggcagtggtggaggaggcggaggaggatctgtcaatgtacctatgggaattccgatgagtagccgttcagctccgtttggacagcaagggaggactctgccacagcaaggtaggacactgccacagcaacagcagcaagggatgatggtgaaaaggtgtagtgagtcgaaacgctggcgtttcaggaagaggaacgcttctgattcagactcggaatctgaagcagcaatgtcagatgattccggtgacagtttaccacctcctcctctgtcgaagaggatgaagacggaggagaagaagaagcaagatggtgatggagtggggaacaaatggagggagctgactcgggcaatcatgagattcggtgaagcttatgagcaaacagagaatgcgaaactgcaacaggtggttgagatggagaaagagaggatgaagttcttgaaggagcttgagttgcagagaatgcagttctttgtgaagactcaattggagatatcacaacttaagcagcaacatgggaggagaatgggaaacaccagtaatgatcatcatcacagccgcaagaacaacatcaatgcgattgtcaacaacaacaacgatttgggtaataactagaatttagtgatgcagtgtcgtaattgatatattttagatttgag

SEQ ID NO: 4331 - DNA, 1062 bp, Artificial Sequence
  P4706 (opLexA::G1896, G1896 is from A. thaliana)
cttccttcatctttctctcctcccatcatcatcaccatgtcctcccataccaatctcccctctcccaaaccagttcctaaaccagatcaccgtatctccggtacatcccaaaccaagaaaccaccgtcttcctccgtagctcaagaccaacaaaacctaaaatgccctcgttgcaactctccaaacacaaagttctgttactacaacaactacagtctctctcaacctcgtcacttctgcaaatcttgtcgccgttactggacacgtggcggtgctctaagaaacgtccccatcggtggtggttgccggaaaaccaaaaaatctatcaaacctaattcctccatgaacacacttccttcgtcttcttcctctcagaggttcttctcatcaatcatggaagattcatccaaattcttccctcctccgacaacaatggattttcagctggccggattatctctcaacaaaatgaacgatcttcaacttttgaataaccaagaagttcttgatcttaggcccatgatgtcctcgggccgagaaaacacacccgttgatgtcgggtcgggtttatccctaatgggttttggagatttcaacaacaaccattcaccgacggggttcacaaccgccggagcaagcgacggaaacttagcttcttctatagagactttgagttgtttaaaccaagatttacactggaggcttcagcaacagaggatggcgatgctttttggtaattctaaggaagaaactgttgtcgtcgagaggccacaacctattctttatcggaatcttgagatcgtaaactcatcatcgccgtcgtcgccgacgaagaaaggagataatcagacagagtggtattttggtaataacagtgataatgaaggagtgattagtaataatgctaatacaggaggaggaggaagtgaatggaacaatggaattcaagcttggactgatcttaatcattataatgcattgccttgaatcttggtaagtttaagaaactatataatctataatttcatataatctatttgctatgtgttgtgatgtaatgcc

SEQ ID NO: 4332 - DNA, 1012 bp, Artificial Sequence; identical to SEQ ID NO: 709
  P4715 (opLexA::G2573, G2573 is from A. thaliana)

SEQ ID NO: 4333 - DNA, 1386 bp, Artificial Sequence
  P4721 (opLexA::G2715, G2715 is from A. thaliana)
gacagaaagaggacatatacagtaagaaaatataaagagagagacagtagtaagaaagaagaagaagaaaaatggaagatacgaagaagaaaaagaagaagaatattaacaacaaccaagattccaagaaaaaagagcgtcatattgttacttggtcacaagaggaagatgttatactaagagaacaaataactctacatggaactgaaaattgggcgatcattgcatcaaagttcaaagacaaaagcacaagacaatgcagaagaagatggtatacatacttaaactctgatttcaaaagaggaggttggtcccctgaagaagatatgcttttgtgtgaggcacaaagagtatttggtaatagatggactgagatagcaaaggtggtttcaggcagaactgataatgctgtgaagaacaggtttacaacactttgtaagaagagagccaagcatgaagctatgactaaagacagcaactcaaacaccaaaagaatgttgttcttagacggtatcagtacaccgcgaaaatccgagaatgaaactcctattgctaagaaattgaagagaagtcacattctagatctcacagagatcagtaactatggaagggccgaggcatgtgtgaatcagcagataaggtctccattttcggttttagctcgaaatgccactggtattgatagcttggaagaacagaatcaaacaagcaatgtgaatgagagtgatggtgaagggatgtttcttaagaaggatgatccaaaagtgacagctttgatgcaacaagctgaacttttaagctccttggcgcagaaagttaatgcagacaacacagaacagagtatggagaatgcttggaaggttcttcaggacttcttgaataaaggcaaggagaatgatttattcagatatggaatacctgatatagattttaagatcgaggaatttaaggaccttatagaggatttgaggagtggttatgaagacaatcaattatcttggaggcaacctgatcttcatgactcaccagctagctctgagtatagttccggatcaaccatcatggtggatcagtctggtgataaaacacaaccattctcagcagatactcagacagaacataagcaagttggagaggagttgctcgtcccgaaaaatcctgatgagaatatgcccatctcaggcgaagaaaagttcagctcgcctattcaggtcacgccattgttcagatctttggcagacggtataccaagtccacagttctccgaaagtgagaggagcttcctgctaaaaacactagggatcgagtcctcatctccatgtccaagtgctaatccttcaaaaccacccccttgcaaaagagtccttctccatagcttgtaaacca

SEQ ID NO: 4334 - DNA, 1166 bp, Artificial Sequence
  P4722 (opLexA::G2720, G2720 is from A. thaliana)
aaatcgagagagagatcgattagcgatgaggaaaatggaagcgaagaaggaagagataaagaaaggtccatggaaagccgaagaagacgaagtactcatcaaccatgtcaagagatacggtcctcgtgattggagctccattcgatccaaaggtcttcttcaacgcaccggcaaatcctgtcgtcttcgttgggtcaataaactccgtcccaatctcaaaaagtatacatttttctccttctctttgttgctctctctctgcaaattcaattttggttttgtttgcttcaaatttagggttttttgtgtttgtttatagtggatgcaagttctcggctgacgaagagaggactgtgattgagttacaatctgagtttggtaacaaatgggcgagaatcgctacgtatctaccgggaagaactgataacgatgtgaagaatttctggagtagcagacaaaagagactcgctaggattcttcataactcctctgatgcatcgagttcgagtttcaatcccaaatcttcttcttctcatcgactcaagggcaaaaacgtcaaaccaatccgtcaatcctctcaggtactaatgatgatttacaaaattcacaagctctgtttttcggttttttgattctcaattttgtggtctcagggttttggtttggttgaggaagaggttacagtttcttcttcatgttcccagatggttccttattcatctgatcaagttggtgatgaagtcttgaggttgccggatttgggtgttaagttagagcatcagcctttcgcttttggcactgatcttgtcctagcagagtactctgactcacagaatgatgcaaatcagcaagcaatcagccctttctctccagaaagcagagagcttttggctagacttgacgaccctttttactatgatatacttggaccagctgattcttctgagccattgttcgctctccctcagccgttcttcgagccttcgcctgtgccgagaagatgcagacatgtttcaaaggatgaagaagctgatgttttcttagacgatttcccagctgacatgtttgatcaggttgatccaatcccaagtccttagattgttgattttttgtttgtagatggtttcctttgtgtgtttaggtctataatctaactacattcttat

SEQ ID NO: 4335 - DNA, 1329 bp, Artificial Sequence
  P4723 (opLexA::G2719, G2719 is from A. thaliana)
tgcagttaggaaagctggtacaaaccaaatttcattttttttcttttaattaattttggccaaaaagaaaaaaaaatcgaaactttttttgtgtaaatggaaggagaaactcatcaatcggagccgttacctttagcatctggagattccgatgaagggatcagtgctgcgattgaggcggagcttgctgagttagctgctggagattcaagcggcggtggtggttgcggcggcggaggaggagggattaggagtaaagtcaaaggaccttggtctacggaggaagacgcggttcttacgaagcttgtgaggaaactaggaccgaggaattggagtttgatcgctcgtggaatccctggtcgttctggtaaatcttgtcgattgcgttggtgtaatcagcttgacccttgtctcaagcgtaaacctttctctgatgaggaagatcgtatgataatttctgctcacgcggttcacggaaacaaatgggcagtgattgcgaaactgttaactggaagaacagataacgctatcaagaaccattggaactcaactcttagacgtaaatacgcagatctatggaataatggtcaatggatggctaattcagttactaccgcttccgtcaaaaacgaaaatgtcgatgaaacaactaatcctccatcctcaaaacaacagttgcctcaaggagatatcaattcctccccgccaaagcctccacaagtgagtgatgttgtaatggaagaggcagctaatgaacctcaagaacctcaagaacaacaagaacaagctccaccggtagtgagtaacgttccaacagaaaataacgtgtttcgccccgtggctcgcgttggtgcattcagtatctataacccaaccagccagaaaaatggttacagagactacaatatagttccatgtgagggaccgttgattcaagcagctaaacccgattcattggctggtaaatttctacaatctctttgtgatgaacctcaaatcccgtcaaaatgtggtcacggctgctctactcttccagctgaaactaagttctcacgtaactcggtgttgggacctgagtttgtggattatgaagagccttctgcggttttcaaccaagaactaatatctatagcaaccgatttgaacaacattgcatggataaagagtggccttgacaatgctgttgtcagagaagcagaacagagtttgaagatggataattacaattataatgatcctcgaatcaagtttactggaatgatgcctagacaagatttcttctgtgcaagaagctgaaactcaaaagtagggcttgagattcatcaaccc

SEQ ID NO: 4336 - DNA, 1630 bp, Artificial Sequence
  P4724 (opLexA::G2427, G2427 is from A. thaliana)
gatttgtgagatctgggttctgtctgctttgtgttttacgatgattgcttttttagggtttctctgtttcttatcaaagtctggatcttttttttctttcattgagatgatggatcttcaggaagaaacaggtgaagtgaaaattgaggatcagtgtgtagaaaataagcaatcaacacctgcttcgtgctcttctgtatctgaaggcagtgctggtagttcccacaagtcacctacaattgcaagtcctgccacagtatcacctactcataggtacctcgggaggacgagtggccctataaggcgagccaaaggtgggtggactccggaagaggatgagacattgagacaagcagttgacacgtttaaaggcaagagctggaagaacatagcgaaatctttccctgatagaactgaagttcaatgcctgcatcggtggcagaaagttctaaatccagaccttattaagggaccttggacacatgaggaggatgagaaaatcgttgaactggttgaaaaatacgggcctgcgaaatggtctattatcgcacagtctttaccaggtcgaattgggaagcaatgccgagagaggtggcataaccatttgaatcctgatattaacaaggatgcttggaccacagaggaagaagtagctctcatgaatgctcatcgaagccacggaaacaaatgggctgaaattgctaaggtcttacccggcaggactgataatgcaataaagaaccattggaatagttcattgaaaaagaagtcagaattctacttattgactggtaggttaccaccaccaacaacaacaaggaatggtgttcctgatagtgtaaccaaacgttcatcgtctgctcagaaaagggtttttggttcagttgctcaaacctcatcagtaactacagatgtaaacaatctcgctgaagacggaaatggccaaataaactcatctgttcctgtcgaagaagtagtagctgcttcacgaatgactagtcttaatgagtatgctcgttctcctcagttgcctaacccagagccattgccagagaatggtggagctgcaaataatggttatcatctgtactacacgcctcaaatagactattacagggcgtcagaagtggatacgcagcgtatgtatgggaatgaatgtggttgcagtccaagcgcatcaccagttagcttcttcactccaccgccgtgtaggaatgtgcacagtaacggttcgactccaagaagtcctgaatcttacctgagagaagctggtagaacttacccaaacacaccatccatattcaggaaaagacgacccagggttgttgttcaggataacaacaacgccaagaaaacagatgaagctaaagaggttgatcaaaaggtgaatgatggtaaggatagttcagagattcaaaataatggatcaaatgcttacaatctatctcctccatatcggataagatcgaaaaggacagcagttttcaaatcaagacagcttgagtttatatctagagaggaagagaaagctgatgatgaaaccaaatcatctgagaaagatatgttgattgatggagattctcaactcctaggctaaacagtgactagatgattacacgctgaatgttgt

SEQ ID NO: 4337 - DNA, 756 bp, Artificial Sequence
  P4727 (opLexA::G2724, G2724 is from A. thaliana)
aagtagaacagaattcgcaaactgtaaaacccttataaatcataaagaagaagtcgaagaagtcgagaaaaagatggaaatagaaataaggagaggtccatggactgtggaagaagacatgaagctcgtcagttacatttctcttcacggtgaaggaagatggaactccctctctcgttctgctggactgaatagaacggggaaaagttgcagattgcggtggctaaattatctccggccggatatccgccgtggagacatatcccttcaagaacaatttatcatccttgaactccattctcgttggggaaatcggtggtcaaagattgctcaacatttaccgggaagaacagataacgagataaagaattattggagaacacgtgttcaaaagcatgcaaaacttctaaaatgtgacgtgaacagcaagcaattcaaagacaccatcaaacatctctggatgcctcgtctcatcgagagaatcgccgccactcaaagtgtccaatttacctctaaccactactcgcctgagaactccagcgtcgccaccgccacgtcatcaacgtcgtcgtctgaggctgtgagatcgagtttctacggtggtgatcaggtggaatttggaacgttggatcatatgacaaatggtggttattggttcaacggcggagatacgtttgaaactttgtgtagttttgacgagctcaacaagtggctcatacagtaggcatttcatgggtttattaatgaatgtaatgt

SEQ ID NO: 4338 - DNA, 1235 bp, Artificial Sequence
  P4729 (opLexA::G2893, G2893 is from A. thaliana)
cccaaatcataaaagcctctctcttagtctatttttatctcacggctctctctcccctctctacacacacaaacacaaataaagcgtaaaactgaaatattttaattacaattagaaagagaacatattaatatgtcaaatataacaaagaagaagtgtaatggaaatgaagagggtgcagagcagaggaaagggccttggacactcgaggaagacactcttctcaccaattacatttcccataacggtgaaggccgatggaatctgctcgctaaatcttctggtaatattcttttcttttatgttttctttgtactattccaacaaaatgcaattggtgaaaatgtcttcctcccacttcatatttttgtattaaaagtttgatctctttttacaaaaaaacaaaaaaacagggctaaagagagcaggaaaaagttgtagattgagatggttgaattaccttaaacccgacataaagcgtgggaatctcactcctcaagaacaacttttaatccttgagctccattctaaatggggtaataggtaagttagttactcaaatgctctctttagctttataattttcttataatctaacgtgtaacatgttgcttcttaattaggtggtcaaaaatttcgaagtatttaccaggaagaacagacaacgatatcaaaaactactggagaactagagtccagaaacaagcacgccagctcaacatagattccaatagccacaagttcatagaagttgttcgtagcttttggtttccaagactgatcaacgagattaaagacaactcatacaccaacaatattaaagctaatgctcctgatttacttggaccaattttacgagacagcaaagatttgggtttcaacaacatggattgttccacttccatgtcagaagatctcaagaaaacttcacaattcatggatttttctgatcttgaaaccacaatgtccttggaaggatcacgagggggtagtagtcaatgtgtgagtgaggtttatagctccttcccttgcctagaggaggagtacatggtggccgttatgggcagttcagacatttcagcattgcatgattgtcacgtggctgattccaagtacgaggatgatgtgacacaagatctaatgtggaacatggatgacatttggcagtttaacgagtatgcacactttaattaggttatattatatttatgtacttcttacaacttggaggggtt

SEQ ID NO: 4339 - DNA, 1042 bp, Artificial Sequence
  P4738 (opLexA::G2053, G2053 is from A. thaliana)
atggagaatccggtgggtttaagattccgtccgaccgacaaggagatcgtcgtcgattacctccgaccaaaaaactccgatagggacacgagtcatgttgatcgagtcattagcacagtcactatccgtagcttcgacccttgggagttaccttgccagtctaggatcaaactgaaagatgagtcttggtgtttcttcagccctaaggagaacaaatatggcagaggtgatcaacaaattagaaaaacgaaatctggttactggaagattactggcaaaccaaagcctatcttgcgtaaccgccaagagatcggtgagaaaaaggttttgatgttttacatgagtaaggaacttggtggatccaaatccgactgggttatgcacgagtaccatgctttctctcctactcagatgatgatgacatatacaatatgtaaagttatgtttaagggtgacgtgagagagatttcttcttcttctgcttcttatggtagtgaaattgagcagagtcgtgactctttaatccctcttcttgtgaacgattctgaggaagaagctcaaatcgaggatgctataccaatagaggaatgggaaacatggttgactgatgatggtgttgatgagcaggtgaatcatattatgaatatgaaagatgatcgcaacaaccacaggcctcaaaagccattgactggtgtcttgattgacgatagtagtgatgatgatgatgattctgatttgctatctccaacaacaaattctattgaaaattcgagcacttgtgatagttttggtagctcagaccaaatcaacttagtgtcactaactcaagaggtgagccaagctctgataaccagtattgatacacccgagaagattaagagtccttatgatgatgcacaagggactggggctggagggcaaaaattgggtcaagagactcgagagaagaaacgagctggtttctttcacaggatgatacaaatattcgtcaagaaaattcaccaatgttcttctatctcaagaacataatagcagtaaatga

SEQ ID NO: 4340 - DNA, 1099 bp, Artificial Sequence
  P4741 (opLexA::G2296, G2296 is from A. thaliana)
atcctaaacagaaaatatgtctcttgagattgatgcgaaggctgtctcagcactcctccttggccaaggatgcgctaacaatctcaagacgctcctcaaaaaccatgaaacaggctcagtttcaacagagccactcatcaactccattcttgattctttctcgtttgctctgtcttctcagaacataccacgtcatgtgtctcaaagatcatcaaagaagtaaattattaaaaactctaaatcaagtagaaaacacacacctgttttggtctatgttactctatttcttctaccactttcgatgcaagtatcctagtgaacattgctctgatacaacattgcagaaagatgtgtggaatacaaggtatggaagattctccgacaccggcccacattgatggcttcatctggaggaaatatggacaaaagaccatcaaaacctctccgcaccaaaggttagttaattaagtagattagaaagacatagctactgctctcttttcacaaatacagagctattttctagagtgtgtattgagcgatgactaattgtagagtaaaatttacaggtggtactaccgatgtgcctatgcgaaagaccaaaactgcgacgctaccaagcgggtacagaagatccaagacaatcctccagtgtacagaaacacctatgtcggacaacatgcatgtgaagctccagcttatgcagttaataatggtggtacatacggttcaaaaatgatcaaattcgactatgttattcctgaatcggttatgcctcaacctttatcaattgattcccaagaaattaccatggaggataaagacacagacgaccatattttgaactatattaacgagcatttgatggaagatgaggcgtatgatgttttccctgatgtacttggagaacgttgctgctttggattagaaccctttccaggattgaacattaataaatcttaaaagcttttcatgttcttcgatcttatggtggagaatgaatgattcattcttcatttcttttcatgttcatgttttgtaattttgatttacgtgttgtttttttgtaaaaggaagttttatcagtgatgtatttctt

SEQ ID NO: 4341 - DNA, 1005 bp, Artificial Sequence
  P4742 (opLexA::G2290, G2290 is from A. thaliana)
ctttctcttccaatcaagaacaaaccctagctcctctctttttctctctctacctctctttctctatcttctcttatcactacttctctcgccgatcaatcatcatgaacgatcctgataatcccgatctgagcaacgacgactctgcttggagagaactcacactcacagctcaagattctgacttcttcgaccgagacacttccaatatcctctctgacttcggttggaacctccaccactcctccgatcatcctcacagtctcagattcgactccgatttaacacaaaccaccggagtcaaacctaccaccgtcacttcttcttgttcctcatccgccgccgtttccgttgccgttacctctactaataataatccctcagctacctcaagttcaagtgaagatccggccgagaactcaaccgcctccgccgagaaaacaccaccaccggagacaccagtgaaggagaagaagaaggctcaaaagcgaattcggcaaccaagattcgcattcatgaccaagagtgatgtggataatcttgaagatggatatcgatggcgtaaatatggacaaaaagccgtcaagaatagcccattcccaaggagctactatagatgcacaaacagcagatgcacggtgaagaagagagtagaacgttcatcagatgatccatcgatagtgatcacaacatacgaaggacaacattgccatcaaaccattggattccctcgtggtggaatcctcactgcacacgacccacatagcttcacttctcatcatcatctccctcctccattaccaaatccttattattaccaagaactccttcatcaacttcacagagacaataatgctccttcaccgcggttaccccgacctactactgaagatacacctgccgtgtctactccatcagaggaaggcttacttggtgatattgtacctcaaactatgcgcaacccttgaggtaagcttggtacgtagcaatagctaaggaggtgct

SEQ ID NO: 4342 - DNA, 1036 bp, Artificial Sequence
  P4748 (opLexA::G904, G904 is from A. thaliana)
ctctcctctcatcaatggaatctctcatcaatcccagccatggcggaggaaaactacgattctcactcttcttctctcgatagtctcaaaccaagcgtactagtcatcattctcattctcctcatgactcttctcatctccgtttccatttgcttcctcctccgctgtctcaatcgctgtagccaccgctccgttctccctctttcatcttcctcttccgtcgcaaccgtaacttccgattcccgacgattctctggacatcgagtctctcccgaaacagaacggtcctccgtgcttgattcgcttccgattttcaaattctcctccgtcactcgccgatctagctccatgaattccggagattgcgccgtttgtttgtcgaaattcgaatcggaggatcagctccgtcttcttcctctctgttgtcacgcttttcacgccgattgtatcgatatctggctagtctctaaccagacttgtcctctctgtcgctctcctctcttcgcttcagaatctgatctcatgaagtctctcgccgtcgtcggctcaaacaacggcggaggagaaaacagcttccgtctcgaaatcggatccatcagccgtcgtcgtcaaacaccgattccagaatccgttgagcagcatcgaacttactcaatcggttcgttcgattacatagtagacgacgtagattcagaaatctcagagtcaaatttcaaccgtggaaaacaggaagacgcgactacaacaactgccacagcaacggcggttacgactaatccgacgtcgtttgaagctagtttagcggcggatataggtaacgatggttctagaagctggctcaaggattacgttgacagactctcacgaggtatatcgtcgcgtgcaatgtcgtttagaagctctggtagattttttactgggagtagtcgtcggagtgaggaattgacggtgatggatttagaagcgaatcatgccggagaagagataagtgagcttttccggtggctctcaggggtgtgagtgacaggtgagttgg

SEQ ID NO: 4343 - DNA, 1033 bp, Artificial Sequence
  P4750 (opLexA::G2789, G2789 is from A. thaliana)
tttagggacaccaaatctattcaacctaaaagccttcttttcccctatattgaccaactttttagcgaatcagaagaggaatggatgaggtatctcgttctcatacaccgcaatttctatcaagtgatcatcagcactatcaccatcaaaacgctggacgacaaaaacgcggcagagaagaagaaggagttgaacccaacaatataggggaagacctagccacctttccttccggagaagagaatatcaagaagagaaggccacgtggcagacctgctggttccaagaacaaacccaaagcaccaatcatagtcactcgcgactccgcgaacgccttcagatgtcacgtcatggagataaccaacgcctgcgatgtaatggaaagcctagccgtcttcgctagacgccgtcagcgtggcgtttgcgtcttgaccggaaacggggccgttacaaacgtcaccgttagacaacctggcggaggcgtcgtcagtttacacggacggtttgagattctttctctctcgggttcgtttcttcctccaccggcaccaccagctgcgtctggtttaaaggtttacttagccggtggtcaaggtcaagtgatcggaggcagtgtggtgggaccgcttacggcatcaagtccggtggtcgttatggcagcttcatttggaaacgcatcttacgagaggctgccactagaggaggaggaggaaactgaaagagaaatagatggaaacgcggctagggcgattggaacgcaaacgcagaaacagttaatgcaagatgcgacatcgtttattgggtcgccgtcgaatttaattaactctgtttcgttgccaggtgaagcttattggggaacgcaacgaccgtctttctaagataatatcattgataatataagtttcgtcttcttattctttttcactttttacctttttcactttcttaggttttgttttaacgtttgattaatacctgaaggtttttggaaaattttcgatcggataaaaggatttatgttgcgagccgaaac

SEQ ID NO: 4344 - DNA, 1520 bp, Artificial Sequence
  P4753 (opLexA::G2141, G2141 is from A. thaliana)
ttctgattagtgagtggtgttcatcaagtattagaagaagatggatttaagtgcgaaagatgagttttcagcagagaagaggaatcctgataactatgattctgttaataatccgtctggagattggcgagttgattcatatccttcagagaatctgatttcagctggtcctgcgtcttgttctccttctcagatgatggattcatttgggcaaactctttggtatgatcccacgagtgttcaggctgttggttatgccggttttaatggtggtaatgcttcgtcttcttcgtttaggggtagtattgatagatctcttgaaatgggttggaatctgcctaatttgttgcctcctaaaggcaatggtcttttcttaccgaatgcgagtagtttccttcctccgagtatggctcagttcccggctgattcaggttttatagagcgtgcagcgaggttttcgctctttagcggtgggaattttagtgatatggtgaatcaaccacttgggaattctgaggctattggtttgtttcttcaaggtggtggaacaatgcaagggcagtgtcaaagtaatgaacttaatgttggtgaacctcacaatgatgtatctgtagcagtgaaagaatcaactgttagatctagtgaacaagctaaaccgaatgttcctggatcgggcaatgtatccgaggatactcagtctagtggtggtaatggtcagaaaggcagagaaacctcttccaacacaaagaagaggaaaagaaatgggcagaagaactctgaagcagctcaatcacacagatcccagcagtctgaggaagaaccagacaacaatggtgatgaaaagcgcaatgatgagcaaagtccaaattcacctggaaagaagtcaaacagtgggaaacaacagggcaaacaaagttctgatcctccaaaagatggatatattcatgtacgggcacgaagaggccaggccacaaatagccatagtcttgcagaaagagttaggagagaaaaaattagtgaaaggatgaagtttcttcaagatctagtaccgggttgcaacaaggtgactgggaaggcagttatgcttgacgaaatcataaactacgtacaatcactacaacgccaagttgagtttttatcgatgaaacttgcaactgtgaacccacaaatggactttaaccttgaaggtcttcttgcaaaagatgcacttcaactacgagctggttcttcatctacaacaccattcccaccaaatatgtcaatggcttatcctcctctacctcatggattcatgcaacaaactctttccagcattggaaggaccattacctctccattgtctcctatgaatggtggattcaagcgacaggaaacaaatggatgggagggtgatttgcaaaatgtgatccacattaactatggagctggtgatgtcacacctgaccctcaagcagcagctacagcatctcttccagctgcaaatatgaaggttgagccatgatatttcgtcctgttagata

SEQ ID NO: 4345 - DNA, 1176 bp, Artificial Sequence
  P4754 (opLexA::G2145, G2145 is from A. thaliana)
aagaaaggcaagagttgatcagttagagcgatggacgtttttgttgatggtgaattggagtctctcttggggatgttcaactttgatcaatgttcatcatctaaagaggagagaccgcgagacgagttgcttggcctctctagcctttacaatggtcatcttcatcaacatcaacaccataacaatgtcttatcttctgatcatcatgctttcttgctccctgatatgttcccatttggtgcaatgccgggaggaaatcttccggccatgcttgattcttgggatcaaagtcatcacctccaagaaacgtcttctcttaagaggaaactacttgacgtggagaatctatgcaaaactaactctaactgtgacgtcacaagacaagtaagtggaagatccaatatataatgtttactttcattcactactactacgcaataaactaaataaaatatcattaatttgtgggatataggagcttgcgaaatccaagaaaaaacagagggtaagctcggaaagcaatacagttgacgagagcaacactaattgggtagatggtcagagtttaagcaacagttcagatgatgagaaagcttcggtcacaagtgttaaaggcaaaactagagccaccaaagggacagccactgatcctcaaagcctttatgctcgggttagaaaacatactttatattacttcggtctcaaaaccaaatgacaatgagtaaagtcgttcttaagtgtgttatcaattgttgcagaaacgaagagagaagattaacgaaaggctcaagacactacaaaaccttgtgccaaacgggacaaaagtcgatataagcacgatgcttgaagaagcggtccattacgtgaagttcttgcagcttcagattaaggtatgtagattgttaaaaggattttttgtttttagtcagaatcttatcataactcatgttcaagttaactaaccaaaatgcatattttataaatgtagttgttgagctcggatgatctatggatgtacgcaccattggcttacaacggcctggacatggggttccatcacaaccttttgtctcggcttatgtgaaggacttacaagttacaatgtcaatgtaaagaaacccatttagaacatatatatccctatttgagccaaactaaagagatctacgctaagat

SEQ ID NO: 4346 - DNA, 1504 bp, Artificial Sequence
  P4757 (opLexA::G2552, G2552 is from A. thaliana)
atgcatgacattacaagacgtaactgaataaactaatatcaaccaactatcaagagtacatttctttaaatttgttttaattgatttcttaacttattatgttaattaatacagtttatttcatactcactctattatataaactcattttgtctctctttcgttgtcaacaacttttcttcattgacaaaaacacacaaatggaaggaagagtcaacgctctgtcaaacataaacgatctcgaacttcacaatttcttggtcgatccaaacttcgatcagttcataaacctcataagaggagatcatcaaaccattgacgaaaacccagttcttgatttcgatcttggtccattacaaaacagcccctgtttcatagacgagaaccagttcatcccaacacctgtcgatgacctcttcgacgaattgcctgacttagactccaacgttgctgaatcattccgtagcttcgacggtgatagtgttagagccggtggtgaagaagatgaagaagattacaacgacggtgatgattcttcagccactactacgaataatgatgggacccgtaagacgaagactgatcggtctaggactttgatctctgagagaagaaggagagggcgtatgaaggataagctttatgcattgagatctcttgttcccaatattactaaggtaagtcacaacattttcaagatttggtaatgactaatgaaactgtaaatattgatgaagtatgtgtgtgttggcatttagatggataaagcatccattgttggagatgcagtgttgtatgttcaagaacttcagtcacaagcgaagaaactcaaatccgatatcgcgggtcttgaagcttctttaaactctactggagggtaccaagaacatgctcctgatgctcaaaagactcaaccttttcgcggtatcaatcctcctgcttccaaaaaaatcattcaggtaataacctaaaaaaaccaatcaatcttcttgaaacatcaaagtgtttaaagtttgtatgttttgttgtgttagatggatgttatacaagtggaggagaaagggttttatgtgagattggtgtgtaacaaaggagaaggtgttgctccatctctttacaagtctttggagtctcttacaagtttccaagtgcagaactctaacctaagctctccttctccggacacatacctcttaacatataccttagatgtaaatcaacttgtgcccttttactttgttttgtttccgagtataccgtttacttaccgagttttcttgtgtggtggaaacaggggacatgcttcgaacagagcttaaacttgcctaacctgaagctgtggatcactggatcacttttaaatcaaggttttgaattcatcaagtcatttacttgattctataacgcttgctctaacgtgagtcaaatccggttctgcactatattgattgtgtacctttcttacatgtttcataacttccagggctctaatttctattctagt

SEQ ID NO: 4347 - DNA, 1750 bp, Artificial Sequence
  P4759 (opLexA::G262, G262 is from A. thaliana)
aagcccatctttatgatatcgcgtttatatctgagtcacagagaaataaaagggtatgtttgtaaatttcaaatacttctctttctttatccgtacgaaaatggacggtgttaccggcggaggaacgaatatcggcgaggctgtgacggcgccaccaccgcggaatccgcatccagcgactttacttaatgcgaactctttaccgccccctttccttagcaagacgtatgacatggtggaagatccggcgacggacgcgattgtctcatggagtccgacgaacaatagcttcattgtttgggatccaccggagttttctcgtgatcttctacctaaatacttcaaacacaacaatttctccagctttgttcgccagttaaacacctatgtaagtataaattctctcgcgccctaatttctccaccattgatttctctaattgtactgtgtatagattatgatttcgttgaataatcttagtgcttgatgtgtttgataagatttatatgattcatgtgccaattttgatgaacagggttttaggaaagtggatccagatcgatgggaatttgctaatgaaggtttcttaagaggtcaaaaacatctattgaagaagataagccggagaaaatctgttcagggacatggtagtagtagtagtaatccacaatctcagcaattatctcagggtcaaggttcaatggctgcattatcttcatgtgttgaggttgggaaatttgggttagaggaagaagttgaacagcttaaaagagacaaaaacgtgttgatgcaggaactcgttaagttacgccagcagcaacaaacaacagataataaacttcaggttttggttaaacatcttcaggttatggagcagaggcaacaacagattatgtctttccttgctaaagctgtacagaatcctactttcctctctcagtttatacagaagcagactgatagtaatatgcatgtaaccgaggccaataagaagcggagactcagagaggatagtactgctgctactgagagtaatagtcatagccatagcttggaagcatcagatggacagatagttaagtatcagccacttagaaacgattcaatgatgtggaacatgatgaaaacagatgataagtatccgtttcttgacgggttctcatctccaaaccaggtatcaggagtcactcttcaagaggtactacccataacttcaggacagtcacaggcatatgcatctgtaccatcaggacagcctttatcatacttaccctctacttcaacttctctcccggataccataatgccagagacttcccagataccacaattgacacgagagagtatcaacgacttccctacagaaaacttcatggatacagagaagaatgttccagaggcattcatctctccaagcccattccttgatggtggttcagtcccgattcagcttgagggaatacccgaagaccccgagattgatgaactaatgagtaactttgaattccttgaagaatatatgccagaaagcccagtttttggagatgcaactacactagagaacaacaacaacaacaacaacaacaacaacaacaacaacaacaacaacaacaacaacaacacaaatggtagacatatggataagcttatagaagaattgggtcttctcacatcagaaacagaacactagtaaaggattatgtttagtatccattgtaaagtctttctctactaacattatcgttaggac

SEQ ID NO: 4348 - DNA, 1353 bp, Artificial Sequence
  P4762 (opLexA::G567, G567 is from A. thaliana)
cagattcttgaggagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgaatgttgattccgatgattatcgtcgtgttcttaagaacaagcttgaggctgagtgcgcgactggtgtttctcttcgggttgggtctgtgaagcctgaagattcgactagttctccagaaactcaacttcaaccagttcaatccagtcctcttactcaaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggatgctgtcaaatcgtgagtcagctaggcgatctagaaggagaaagcaggagcaaacaagtgacctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggccgaaaaaatgcgtggactgatcaaacaagaagcgggtttcgcactatattaatgtctatgcatctgtaatttgtaagtgttattaagttacgaatcatgagaaaacatcttgtggt

SEQ ID NO: 4349 - DNA, 1460 bp, Artificial Sequence
  P4763 (opLexA::G810, G810 is from A. thaliana)
gaacggtttgcgaatctgtagcgacggcgaaatcttcgacggcggtgatgagctccattccgccttttctgagcaaaacgtacgatatggttgacgatccattgacggacgacgtggtgtcttggagcagcggaaacaacagcttcgtggtttggaacgtgcctgagttcgccaaacagtttctaccaaagtatttcaagcacaacaatttctccagcttcgtcagacagctcaatacttatggttttagaaaagttgatccagaccgctgggagtttgcaaacgagggctttttaagaggccaaaagcaaatactaaagagtattgtccggcgaaaacctgcacaagtgcagcctccacaacaacctcaagttcagcactcatctgtgggtgcgtgcgttgaagtgggcaaatttggactcgaagaggaagtggaaagacttcagcgcgataagaacgtccttatgcaggaacttgtaaggttgaggcagcaacaacaagttaccgaacatcatctgcagaatgtggggcagaaagttcatgtgatggagcagaggcagcaacagatgatgtcctttctagcaaaggctgtccaaagtccaggtttcttaaaccaattttctcagcagagtaatgaagcaaaccaacacatttctgaaagcaacaaaaagaggaggctacctgttgaggaccagatgaattctggcagtcatggggttaatggtcttagccgccagattgtgagatatcagtcatcgatgaacgatgcaacaaacactatgcttcaacagatacagcagatgagtaatgcacctagccatgaatctctctcaagcaataatggtagctttcttttgggcgatgttccaaattctaacatttcagacaatgggagctcctcaaatggatcacctgaagttacattggcagatgtttcatccattcctgcaggcttctatcctgcaatgaagtaccacgagccttgtgaaacaaatcaagtcatggagaccaatttgcctttttctcaaggtgatctcttacctccaacgcaaggagcagcagcttctgggagctcaagttcggatcttgttggatgcgagacagataatggagagtgtttggatccaataatggctgttttggatggcgcactcgaactagaagctgataccttaaatgagttgcttcctgaagtccaagattctttttgggaacagttcattggtgagagcccagtgattggtgagacagatgagttaatctcaggatcagtggaaaatgaactgatattggagcaactagagttacaatcaaccctgagtaatgtgtggagcaagaatcaacaaatgaaccatcttactgaacagatgggacttctcacatcagatgctctcagaaaatgagattgccacaggccacaatctttcctcacgagatgggttaagattttgtggagccgc

SEQ ID NO: 4350 - DNA, 975 bp, Artificial Sequence
  P4764 (opLexA::G1004, G1004 is from A. thaliana)
cttaagctttttgaaaattttatcaatggcgactcctaacgaagtatctgcactttggttcatcgagaaacatctactcgacgaggcttctcctgtggctacagatccatggatgaagcacgaatcatcatcagcaacagaatctagctctgactcttcttctatcatcttcggatcatcgtcctcttctttcgccccaattgatttctctgaatccgtatgcaaacctgaaatcatcgatctcgatactcccagatctatggaatttcttcgattccatttgaatttgactcagaagtttctgtttctgatttcgattttaaaccttctaatcaaaatcaaaatcagtttgaaccggagcttaaatctcaaattcgtaaaccgccattgaagatttcgcttccagctaaaacagagtggattcaattcgcagctgaaaacaccaaaccggaagttactaaaccggtttcggaagaagagaagaagcattacagaggagtaagacaaagaccgtgggggaaattcgcggcggagattcgtgacccgaataaacgcggatctcgcgtttggcttgggacgtttgatacagcgattgaagcggctagagcttatgacgaagcagcgtttagactacgaggatcgaaagcgattttgaatttccctcttgaagttgggaagtggaaaccacgcgccgatgaaggtgagaagaaacggaagagagacgatgatgagaaagtgactgtggttgagaaagtgttgaagacggaacagagcgttgacgttaacggtggagagacgtttccgtttgtaacgtcgaatttaacggaattatgtgactgggatttaacggggtttcttaactttccgcttctgtcgccgttatctcctcatccaccgtttggttattcccagttgaccgttgtttgattagttttttttgagtttttgaacgatgtgtatgctgacgtggacgta

SEQ ID NO: 4351 - DNA, 747 bp, Artificial Sequence
  P4765 (opLexA::G1140, G1140 is from A. thaliana)
attcaagaacagtagtgaaggagagatctggtaaaatggcgagagagaagataaggataaagaagattgataacataacagcgagacaagttactttctcaaagagaagaagaggaatcttcaagaaagccgatgaactttcagttctttgcgatgctgatgttgctctcatcatcttctctgccaccggaaagctcttcgagttctccagctcaagaatgagagacatattgggaaggtatagtcttcatgcaagtaacatcaacaaattgatggatccaccttctactcatctccggcttgagaattgtaacctctccagactaagtaaggaagtcgaagacaaaaccaagcagctacggaaactgagaggagaggatcttgatggattgaacttagaagagttgcagcggctggagaaactacttgaatccggacttagccgtgtgtctgaaaagaagggcgagtgtgtgatgagccaaattttctcacttgagaaacggggatcggaattggtggatgagaataagagactgagggataaactagagacgttggaaagggcaaaactgacgacgcttaaagaggctttggagacagagtcggtgaccacaaatgtgtcaagctacgacagtggaactccccttgaggatgactccgacacttccctgaagcttgggcttccatcttgggaatgaatctgagagagagaaagatccagcagagttgacttcgatggaagcccac

SEQ ID NO: 4352 - DNA, 1564 bp, Artificial Sequence
  P4766 (opLexA::G1198, G1198 is from A. thaliana)
cgagactaatcaagaagagatatcatcaattgaagctgttttcttgagtagagatggcgaaccatagaatgagcgaagctacaaaccataaccacaatcatcatcttccttattcacttattcatggtctcaacaacaatcatccatcttctggtttcattaaccaagatggatcgtccagtttcgattttggagagctagaagaagcaattgttctgcaaggtgtcaagtataggaacgaggaagccaagccacctttattaggaggaggaggaggagctacgactctggagatgttcccttcgtggccaatcagaactcaccaaactcttcctactgagagttccaagtcaggaggagagagcagcgattcaggatcggctaatttctccggcaaagctgaaagtcaacaaccggagtctcctatgagtagcaaacatcatctcatgcttcaacctcatcataataacatggcaaactcaagttcaacatctggacttccttccacttctcgaactttagctcctcctaaaccttcggaagataagaggaaggctacaacttcaggcaaacagcttgatgctaagacgttgagacgtttggcccaaaatagagaagctgctcgcaaaagccgtcttaggaaaaaggcgtatgtgcaacagctagaatcaagtaggataaagctttcccaattggagcaagaacttcagcgagctcgttctcaggggctgttcatgggtggttgtggaccaccaggacctaacatcacttccggagctgcaatatttgacatggaatatgggagatggctagaggatgataaccggcatatgtcggagattcgaaccggtcttcaggctcatttatctgacaatgatttaaggttgatcgttgacggttacattgctcattttgatgagatattccgattaaaagccgtggcagcgaaagccgatgtttttcacctcatcattgggacatggatgtccccagccgaacgttgttttatttggatggctggtttccgtccatccgacctaatcaagatattggtgtcgcaaatggatctattgacggagcaacaactgatgggaatatatagcctacaacactcgtcgcaacaagcagaggaggctctctcgcaaggcctcgaacaacttcagcaatctctcatcgatactctcgccgcatctccagtcattgacggaatgcaacaaatggctgtcgctctcggaaagatctctaatctcgaaggctttatccgccaggctgataacttgaggcagcagaccgttcaccagctgaggcggatcttgaccgtccgacaagctgcacggtgtttcctagtcatcggagagtactatggacggctcagagctcttagctccctttggttgtcacgcccacgagagacactgatgagtgatgaaacctcttgtcaaacgacgacggatttgcagattgttcagtcatctcggaaccacttctccaatttctgaatggaatgaaactttgtataactaaaaggccaagtttcattgtctgtcgtaatttcacctatttc

SEQ ID NO: 4353 - DNA, 1674 bp, Artificial Sequence
  P4771 (opLexA::G1410, G1410 is from A. thaliana)
acgataacaagtctatttagaaccactagttgtgatttgtgaaactctgaagtaaagaagaaaccacaacaatggcgttgttctccccgccaatctcttcttcatctcttcaaaatcccaatttcattcccaaattttcattctccctcctctccagtaaccgcttctctctcctctccgtcactcgagcttcctccgacagtggatcaacctctcccaccgccgccgtctccgtggaggctcctgagcccgtggaagtgatagttaaagagcctccgcaatcaacaccggcggttaaaaaggaagaaaccgccaccgctaaaaatgtcgccgtcgaaggtgaagagatgaaaacaacggagagtgttgtcaaattccaggatgcgagatggattaatggaacttgggatctgaaacagttcgagaaagatggaaaaaccgattgggattctgtaatcgttgctggttagattagaattagatcctcgttaagtttttttgctctgttactttggtgaaaattcgaaatttgaatttgatgtttaatgtgttttgatttgaagaggcaaagagaagaaaatggctagaagagaatccagaaacaacgagtaacgacgaaccagtgcttttcgatacatcgattattccatggtgggcttggattaagagataccacttacctgaagctgaactcttaaatggtatttgtttcctctctcaaaagatcaaacacatacacaaagaatgttacttactcttactctttgtaggtcgtgcggcgatgataggattctttatggcttactttgtcgatagtcttaccggagtaggacttgttgatcaaatggggaatttcttctgcaagacactattgtttgtggctgtggctggagttttgtttattcgtaagaatgaggatgtggataaactcaagaacttgtttgatgagactacattgtatgataagcaatggcaagcagcttggaaaaatgatgatgatgagtcattgggttctaagaagaagtgataacaaagattcttgctttctttttttgttgttgttgtaattaggagatgaacttaccaaatgtaatatcaagagatttgaacaatgtttcctcagattaccgttaatcatgtctagtctctacttaacttaatctaattagaaaacaaaaaaggcccaataagaagcccaattttccaagtttattttcgttagttatatttatcccacatcgacaacagctcgtaagtgagataaatgttttaccaagaatctttggctttggctaccacgatattggctctggccacaatttctcattgtttaccaggttgcttgaccgatacgggtttaggaaacttgactctgagcaaagggaatttgctgatggtgactttgtgagaggtaaacctgagcttatccggaacatatataaacgcaccagagctcaaatactaaacactaaagaagggagagagctgcttaagcaagtcatggagatgaggaaacagaggagagaaaagatgaagaaagagattacgaaagcaaaggaactagctgatcggttgcaccatgtacatatttggaacatacaatgatgtttcgcgatttggaaatttatgtcaagaccaggctttgattactctgcttatagttctcctatttga

SEQ ID NO: 4354 - DNA, 1419 bp, Artificial Sequence
  P4772 (opLexA::G1494, G1494 is from A. thaliana)
agagttgtgttgggcgtggaacttggactagttccacatatcaggttatatagatcttctctttcaacttctgattcgtccagaagctttcctaatctgagatctgacatggaacaccaaggttggagttttgaggagaattatagtttgtccactaatagaagatctatcaggccacaagatgaactagtggagttattatggcgagatggacaagtggttctgcagagccaaactcatagagaacaaacccaaacccagaaacaagatcatcatgaagaagccctaagatccagcacctttcttgaagatcaagaaactgtctcttggatccaataccctccagatgaagacccattcgaacccgacgacttctcctcccacttcttctcaaccatggatcccctccagagaccaacctcagagacggttaagcctaagtccagtcctgaacctcctcaagtcatggttaagcctaaggcctgtcctgaccctcctcctcaagtcatgcctcctccaaaatttaggttaacaaattcatcatcggggattagggaaacagaaatggaacagtactcggtaacgaccgttggacctagccattgcggaagcaacccatcacagaacgatctcgatgtctcaatgagtcatgatcgaagcaaaaacatagaagaaaagcttaatccgaacgcaagttcctcatcaggtggctcctctggttgcagctttggcaaagatatcaaagaaatggctagtggaagatgcatcacaaccgaccgtaagagaaaacgtataaatcacactgacgaatctgtatctctatcagatgcaatcggtaacaagtcgaaccaacgatcaggatcaaaccgaaggagtcgagcagctgaagttcataatctctccgaaaggaggaggagagataggatcaatgagagaatgaaggctttgcaagaactaatacctcactgcagtaaaactgataaagcttcgattttagacgaagccatagattatttgaaatcacttcagttacagcttcaagtgatgtggatggggagtggaatggcggcggcggcggcttcggctccgatgatgttccccggagttcaacctcagcagttcatacgtcagatacagagcccggtacagttacctcgatttccggttatggatcagtctgcaattcagaacaatcccggtttagtttgccaaaacccggtacaaaaccagatcatctccgaccggtttgctagatacatcggtgggttcccacacatgcaggccgcgactcagatgcagccgatggagatgttgagatttagttcaccggcgggacagcaaagtcaacaaccgtcgtctgtgccgacgaagaccaccgacggttctcgtttggaccactaggttggtgagccactttgc

SEQ ID NO: 4355 - DNA, 719 bp, Artificial Sequence
  P4774 (opLexA::G1781, G1781 is from A. thaliana)
cagattgatcacatgtggttaacatcaatcaaaaaaaaaaacaaagagatagagatatgactgaggagagcccagaagaagatcatgggtctcctggagtagctgaaacaaatccaggaagcccttcttcaaagaccaacaacaacaacaacaacaacaaagaacaagaccggtttcttcccattgcgaatgtcggaaggatcatgaaaaaagttcttcccggtaacggtaagatctcaaaagacgctaaagaaaccgttcaagaatgtgtctcggagttcattagtttcgtcactggtgaagcttctgacaagtgtcaaagagaaaagaggaagaccatcaatggagatgatatcatttgggctatcacaactctcggtttcgaagactacgtggctccattaaaggtctacctctgcaaatatagagacaccgaaggagagaaagttaacagcccaaaacaacaacaacaaagacaacaacaacagcagattcaacaacagaatcatcataattatcagtttcaagaacaagaccaaaacaataacaacatgtcatgtactagttacatctctcatcatcatccttctccattcctaccagtggatcatcaaccttttcccaatattgctttctctcctaaatcattgcagaaacagttcccgcagcagcatgataataacattgattcaattcactggtgagagagacatttgctt

SEQ ID NO: 4356 - DNA, 1259 bp, Artificial Sequence
  P4777 (opLexA::G1021, G1021 is from A. thaliana)
tgagaaccacgacgacagacaaaacataaaagatggaggaagaaagagaaaacactaactctatctacatagtttccgagctacttgaagaaattttccttggattgcctttgaaatcaatcctcaaattcaaaaccgtctcaaaacaatggagatcaatcctggaatcgaacttgttcgtggagaggcgtagaactcttcaaaagaaccacccgaaaatcctggctgcttataactgcgactactgcacgcggccgggtatcctccctaagtctcagttcgaaggggacgaagagatcgtttatcttcataccgacgccacgcaaccctcgatgacttgcgacggtttagtctgcatcaccgaacctggttggttcaacgttttgaacgtctccaccggacaactccgaagatttctacccggtccagatccaggaccgcaagcaaattggctcttgggattcggtagagacaaagttacgggcaagtataaaatagtgaggatgtgttttcatgattgttatgaatttgggattcttgatattgaatctggcgaatggagcaaactgatgtcacctcctcatataatgcgagtgggaagtaaatcggtgtgtgtgaatggatcaatctactggttacaaattagtgtgagttacataatactggccttggatcttcaccaagaaacgttcaatggtgtctaccacctcccggctacgtgggtcacgcaagatacccaattagtgaaccttgaggaccgtctagccatggccatgacgaccaaagttgggcctgaatggatactagagatctggagcatggatatagaagaaaaaggatggagcaagcgttacacatggagcaaggcttactccataagtttagcccatagagttgttgtatcctggccatggcaaaaaaggtggttcacgccggtatcggtttctaagcaagggaatcttgtcttctatgataatcacaagaggctgttcaaatattattcaggtacagatgagattcgttgtctctcctctaacattaatgttatatcttcttacgttgaaaatttggccccacttccgttaaaaccaagccatacgcatcacgatcttgggaattcgaattccaagttcagcacatccagatgccacttgtttccgacgcgaggttcttggatatccaaagtttttagaaggaatgttttgtttacctctctagtagtagttggttatatatacttacctctctaagagtttact

SEQ ID NO: 4357 - DNA, 2844 bp, Artificial Sequence
  P4779 (opLexA::G1084, G1084 is from A. thaliana)
cttgagctctggatttgagcttaggaaagaagagtagagagaaatgggatgttctcattccaagttagatgatgaagaagcagttcagatctgtaaagacaggaaacgtttcatcaaacaagctattgaacatagaactaagtttgcttctggtcacattgcttatattcactctcttagaaaagtctctgatgctctccatgactttatcctccaaggagacaacaacaatgagtttgttcctactctctgtcaagactcattcgtcactccggtcaagagaatgccacagagacgtcgtcgaagcagccgtagtaatagcggtgagttcatctccatttcgccttcttcgattcctccgaaaatgattcaaggtaggccaagatcgaatgtgaaagcgaattatttgatggctaatagaagtagaccggttagagtcgaacagagatctcctgaaacgtttagagttgagacattttctccacctagtagtagtaaccaatatggtgaatcagatggtttctttggaatgaatatgaatatgaatacttctgcgtctacttcatcttcgttttggaatccgttgagctctcctgagcaaaggttaagtagtcataacattcctcctccttcaccgcagaattcgcagtgggatttcttctggaatccgttttcttcgttggattattatggatacaatagttatgaccgaggaagtgttgatagtaggagtggtatagatgatgagattagaggattgagacgtgttagagaggaagaagggattcctgatttggaagaagatgatgaacctcataaacctgaacctgtcgtcaatgtgcggtttcagaatcataatccgaatccgaaagcaacggaagagaatagaggtaaagttgataagagttgttgcaatgaggaagttaaagttgaagatgttgatgaggatgaagacgaggatggagatgaggatgatgatgagtttacggatagcgggtgtgagactgagaatgagggagacgagaaatgcgttgctcctccaacgcaagaacagcgaaaagctgaggtgtgtagaggaggagaagctacagggaatgttgttggagtaggtaaggttcaagagatgaagaatgttgttggtgttagagatgatgcaaagacgacggggttcacggtatatgtgaaccggagaccaactagcatggctgaagtaatcaaagatcttgaagatcagttcacaacaatttgtgatgcggctaaggaagtctcggggctattggaagctggtagagctcaatacacatcatcctttaatgaccatagtggtgagtttatgaacaatgttgcaatatttctctgtttaatgacttcacttataaatatgaagtccttttttatgtgtgtttgtagccaggaaaatgctgaatccagtagcgttgttccgctcgggttcatcaagatcttcctcgtcaagattcttgatcacttcttctggtggttcaagagagagcgggtctgaaagcagaagcgatgtttcagatgaatcttgcatgatttcaggtagccaccaaacaacattggacagacttttcgcgtgggagaagaaactctatgatgaagttagggtaagtaacaagagatataagcaactagtgactacatattaatctctgttggttataactgagccgtctttgtggtgttgtaacagtctggagaacgtgttcgaagagcatatgaaaagaaatgtatgcagctgaggaatcaggacgtgaaaggagatgatccgcttgcggttgataaaactagggctactatcagagatctagatacacagatcaaggtgtcaatacactccattgaatccatctccaaaagaatcgagactcttcgtgaccaagaactgttgcctcagcttcttgagctcgttgaagggtaacaacaccaacaacttctttttccttctcttcggtttcacttttaagcctcagactgacaaatggtaatcatgatcataacagattaacaaggatgtggaaagtaatggcggaaagtcaccagatacagaaacgaacactagacgaagccaaactgttacttgcaggcacaccggtttcaaagcgtcacaagaagagacaacctccaataatgccagaggctattaactctcaaagattagctcaatctgctttgaatcttgaagctcagcttcgaaactggagaacctgttttgaattctggatcacctctcagagatcctacatgaaagcattatctggttggcttctaagatgtttcagatgtgatcctgaccccgaaaaagttagattatcctcatgtcttcacccgatataccgagtctgcattcaatggtcaaggttgcttaacagcttgaatgaaaaaccagttttggacaaacttgagttctttgcctcagggatgggttcaatatatgcaaggcaagttagggaagatccaaactggagtggaagcgggtcaaggagatactccgggtcagaaagcatggagcttgtagtggctgataagggagaagaagatgttgtgatgactgctgagaaacttgcagaggttgctgtgaaggttctctgccatggaatgtctgttgcagttagttcactagctgagttttccatcaactcggccgatgaacactcgaagcttgttagccaaccagcagacgatgcgtcggagcagcagcccccggatgtaaatttcaattcctagtacttgttattaattttgtttggttttagagagtttagaattaggtaggtttttggcatcatcttttgctatcagaagatagtttcttagatggatgag

SEQ ID NO: 4358 - DNA, 1268 bp, Artificial Sequence
  P4780 (opLexA::G1278, G1278 is from A. thaliana)
cggcgattgggtaagcgatgcacatcgtcttctctgtcgatgatttgaccgaatccttctggcctgttcccgctccggcgccgtcgccgggatcgtcatcgactccgtcaccgacgcagaacgtggcggatgggatgactcgaagtcaatcggagtgggcgttccacaggcttatcaatgagttgtctggttccgattcgagccctacgactaacacaatcgagagatcacctccaccggttcagtctctttcgagattagaagaaaccgttgacgaaaccgaagatgttgttgagattcagaaaccgcagaatcatcgacggctccctgttgatgatcaagggaagaatcggaatcgtgctccgtcgtctgatccggttgattcttcagctcctgttgttgttgatcctaatcagtatcatgcgattcttaagagcaagctcgagcttgcttgcgctgctgttgctcgtcgtgtgggaactgtgaaaccggaagattcgagtgcttcagctagcaatcaaaaacaagctcaaggctccattgtggcacaaacctcacctggtgcttcatctgttagattttctcccacaacaagcacgcaaaagaaacctgatgttccagccagacaaactagtatttcatcacgagatgattctgatgacgatgatcttgatggagacgcagataatggagatcctactgatgtgaagcgtgctaggaggatgctctcaaaccgagaatccgctaggcgctctaggagaagaaagcaagaacaaatgaatgaatttgatacacaggtaggccaattaagagccgagcattcaactttaattaatcgtcttagtgacatgaatcataagtatgatgcagctgctgttgacaacagaattctaagagctgatatcgaaactttgagaacaaaggttaagatggcagaggaaactgtgaaaagagtgacaggagtgaaccctttgcattggtcaagaccaaacatgggcataccattcagcaacacaccgagtgcttcctctagtattccgccaaactctaaccacattttgaaaccagcaaattcaagtaccaacaccagtgctggtttagcacaaaatcagagagtggagacggcaaattttttgccggaacaggtgaaccgtgaaggcatgcagaatccatttgctcctgattttaatctgtatgaaaccctaccccattggaatcccaagcattaaccagaaaaagagtcattggttttgtgattttgattgagg

SEQ ID NO: 4359 - DNA, 1278 bp, Artificial Sequence
  P4783 (opLexA::G295, G295 is from A. thaliana)
cctgttttctaaggccactaatcactcggatttgtgtcaggtgaaatggatagttactggagacttaaaaacttggtgaatgatttgccagttagtacttctttaagccgacaaggatcaatatactcatggacagtagatcagtttcagaccagcttagggttagattgtggatcaatgaacatggatgagttggttaagcatatatcaagtgctgaagaaacacaagaggggtcgcagaggcaaggctcaactactctgcctccaacacttagcaaacaaaatgttggtgaagtttggaaatctatcacagaggaaaaacacaccaataacaatggaggagtaacaaacattactcatcttcagggacaacaaaccttaggggaaatcactcttgaagagtttttcatccgtgctggagcaagaggaggtaataccaatggtggctccattcatgactcatcgtcatcgatttccggtaatccacacactagtttgggtgttcagattcagccaaaagccatggtttctgattttatgaacaatatggttccaaggagtcatgattcttatttgcatcaaaatgtgaatggatctatgtcaacatatcaaccacaacaatctatcatgtctatgccaaatggttattcttatggaaaacaaatccgattctcaaatggttccttgggatctggtaaccaaagtctccaagatacgaagagaagcttggtcccaagtgttgcgacaattccaagtgaagccataacatgttcaccggttaccccatttccaacattaaatgggaaacaaaagattaacggtgagtcttcattactctcaccatctccatacattagtaatggtagtactagtacaagaggtgggaagattaatagtgaaattaccgcggaaaaacaattcgttgacaaaaagcttaggagaaagattaagaaccgagaatccgcagcgagatcacgggctcgaaagcaagctcaaactatggaggttgaagttgaacttgaaaacttaaagaaagattatgaagagctactaaaacaacatgtagagttgcggaaaagacaaatggaaccaggaatgattagccttcatgaacgaccggagagaaagctgaggagaacgaaatcggacatcaagtgaatcaatgaaacccgagttggaggatgatgatgagtttattttgttcatcatgttttgttttcgtatatttttgaccaaataagctatttattagacatcttattcttaaacccatttgat

SEQ ID NO: 4360 - DNA, 1409 bp, Artificial Sequence
  P4785 (opLexA::G290, G290 is from A. thaliana)
agttagggttttagattcccttattctcagacttagggtttgggttcgtcatgagtaagaaggatataaaacgttgcaggctatcctgaaaagtaatgcttagacgaactaaagatacacttctcgatggaaaacccgtgatctctttacctccgaagtccatcgagttgaggagagtggactttaccaaggaagaacgtgatttctactcaaaactagagtgcgactctcgtgaccaattcaaggaatatgcagaagctggaacggtgaagcaaaattatgtaaatattttgttgatgctgctgcgtcttcgtcaagcttgtggccaccctcttctagtatccagtttgtcatggtcatcctcagctgaaatggttaagaagcttccatatgagaagctaacctttcttctgcatcgcttagaagcttcactggcaatttgtggtatctgcaatgttgcacctaaagatgctgttgtttcactctgtggtcacgttttctgtaatcagtgcatttgcgaatgtcttactcgcgataataatcaatgcccactgtcatactgcaaagtcggacttgaaatttcatcattattttccagagaaacactggaaaatgctatgcttgacttgcataaacttgatgccccatgtgatcgtaccacttcagatcctgttgggagtggtgagccttgtgaaaatttaccatgtggttcatccaaaatcaaggctgctctagatatcttgcaatcactgagcagaccacagagtcccgcgacagtaatgaatgatgtgaatcagagctccgaaaatggagagaataatcagcagcttgacaagtcattcagtttacctgcaactccagcgaagagtagtgtgggtggtgtggttaatgtagctggagaaaaagccattgtgtttacccaatggacaaagatgctggacctccttgaagctggtcttaagagttcaggtattcagtatagaaggtttgatggaaaaatgacagtaccagctcgagatgcagcagtacaagattttaatactctccctgatgtttctgtaatgataatgtctctcaaagctgctagtcttgggctaaatatggtggcagcttgtcatgttatcatgctggacttatggtggaacccgactacagaagatcaggcaattgacagagcacaccgtattggacagacacgaccagtaaaggtggtgcgcttcacagtaaaagatacagttgaagatcgcatattggccctccagcaaaagaagagaaagatggtggcttctgcattcggagaacatgaaaacggtagtcgagaatcgcatctctctgtggaggatttgaattatctgttcatggcatgagagctcgatccaattgaagctcttctacaaactcaggtacgc

SEQ ID NO: 4361 - DNA, 1125 bp, Artificial Sequence
  P4877 (opLexA::G237, G237 is from A. thaliana)
agagaaatggcgaagacgaaatatggagagagacataggaaagggttatggtcacctgaagaagacgagaagctaaggagcttcatcctctcttatggccattcttgctggaccactgttcccatcaaagctggtctctctttcatcttcttctttattagtttttagtttctcaaactgagtcaactttgataattgttgttgggatttaatttgatagggttacaaaggaatgggaagagctgcagattaagatggattaattacctaagaccagggttaaagagggatatgattagtgcagaagaagaagagactatcttgacgtttcattcttccttgggtaacaagtaagtgtatctctaagacctaaccctattgttttagcagatgctagttatagagagactaatgatttaggtgtaattaggtggtcgcaaatagctaaattcttaccgggaagaacagacaatgagataaagaactattggcactctcatttgaaaaagaaatggctcaagtctcagagcttacaagatgcaaaatctatttcccctccttcgtcttcatcatcatcacttgttgcttgtggaaaaagaaatccggaaaccttgatctcgaatcacgtgttctccttccagagacttctagagaacaaatcttcatctccctcacaagaaagcaacggaaataacagccatcaatgttcttctgctcctgagattccaaggcttttcttctctgaatggctttcttcttcatatccccacaccgattattcctctgagtttaccgactctaagcacagtcaagctccaaatgtcgaagagactctctcagcttatgaagaaatgggtgatgttgatcagttccattacaacgaaatgatgatcaacaacagcaactggactcttaacgacattgtgtttggttccaaatgtaagaagcaggagcatcatatttatagagaggcttcagattgtaattcttctgctgaattcttttctccatcaacaacgacgtaaattgcgtttattgtaatgtaaatcaaatttctaaggcaaaaccggaaaaaaaatgttttgttttttgttttgtcttaaatgctttgacaccaataaggca

SEQ ID NO: 4362 - DNA, 1089 bp, Artificial Sequence
  P4888 (opLexA::G721, G721 is from A. thaliana)
acacattattcgagagaaatggaatcagccaatcactctctttcctccatatataaaatctagccaatattcacaaataataactacttccttcgttcttttccttaccaaaagatccacctcgaacctctctcctccgtcttcctccgcagccgccgtcactatcaccgcagctagaatgagagaagataatccaaattggttccttagatgggaagaagagcttccatctccagaagaactcatccctatctctcaaaccttaatcactcctcatctagctctcgctttccaaatcggaagtcctaatcatcatctcggatcaaagagaaccaccgcgatttatcaccagaagcttcaatcctccaccactccaacaactccaactccaactcctccaccgatgatgatgaattctgatttcggcggtggcgattccacggatcttggttcaggatcaataggaggagagccagcaagaacgttgaaacggccgcgtctagtgtggacgcctcagctacacaaacgtttcgtggatgcggttggacacttagggatcaaaaacgcagttccaaagactataatgcagcttatgagcgttgaaggattgactagagagaacgttgcgagtcatcttcagaaatatcgtctttaccttaggagaatgcaaggcgggaacggtaacggaatcactggaggacacgtcatcgtctctgattcggctactgatcggctatttgctagctcaccggttccagctcatttcttgagcccggattacttgatgccgccattagagcattcgtatatggggaaacatgtgattacgcagcaaaaccaagtggttcgtaatctgaggtatgaagattcggaatatggtcatggtagtatgaagatgcttaagctcttccctgccggaaattaatgaaatatttgaattcttaacttcatttttatggaagtaataatgtttaaggtatgtggattatctctgtaatttgcatttgtcgtcaggatcaataatctattgttagtgtatattatttgttacgcgaacaatttaacctttgtatgatgttatcatttgaa

SEQ ID NO: 4363 - DNA, 866 bp, Artificial Sequence
  P4896 (opLexA::G563, G563 is from A. thaliana)
ccagatagataaaaattcgttccaattccagtgagctccggaaatggcgtccttcaagttgatgtcttcttccaattccgacttgtctcgccgtaattcttcttctgcttcatcttccccttctataagatcatcgcaccatctccgaccaaatcctcacgccgatcactccagaatcagtttcgcttacggcggaggagtcaacgattacactttcgcgtctgattcaaagcccttcgagatggcgattgatgttgatcggagtatcggagatcggaacagcgttaacaacggaaagagtgttgacgatgtttggaaagagattgtatctggagagcaaaagacgatcatgatgaaggaagaagaaccagaagatataatgacacttgaggatttcttagcgaaagcagaaatggacgagggagcttcagatgaaatcgatgtgaagattccaacggagagactcaacaacgacggtagctatacatttgattttccgatgcagcgacacagttcgttccagatggttgaaggatcaatgggtggaggagtaacgagaggaaagagagggagagtgatgatggaggcaatggataaagctgcagctcagagacagaagaggatgatcaagaaccgtgaatccgctgctaggtctcgagagaggaaacaggcttatcaggttgagttagagactttggctgccaagttagaggaggagaatgagcagcttttgaaggagattgaagagagcactaaagagagatacaagaagctcatggaggttctgattccggtcgatgagaaaccaaggccaccgtcgaggcccttaagcaggagccattccttggaatggtgaagtgtggttg

SEQ ID NO: 4364 - DNA, 1002 bp, Artificial Sequence
  P4914 (opLexA::G1324, G1324 is from A. thaliana)
agtatggaaaattcgatgaagaagaagaagagcttcaaagaaagtgaagatgaagaactaagaagagggccttggactttggaggaagacacacttctcacaaattacatcctccataacggtgagggtcgttggaatcacgtcgccaaatgtgctgggctaaagagaactgggaaaagttgtagattgagatggttgaattacttgaaacccgacataagacgagggaatcttactcctcaagaacagcttttgatccttgagcttcactctaaatggggtaataggtggtccaagattgcacagtacttgccaggaagaacggataacgagatcaagaactattggagaacaagagttcaaaaacaagctcgtcaactcaacatcgaatctaacagcgacaagttctttgacgctgttcgtagtttttgggtccctagattgatcgagaagatggaacaaaactcatccactactactacttattgttgtccccaaaacaacaacaacaactctcttcttcttccttctcaatctcacgactctttaagtatgcaaaaagatatagattactcgggtttcagcaacatagacggttcttcttcaacttctacttgcatgtctcatctaacaacagttccacactttatggatcaaagcaacaccaatatcatcgatggctcgatgtgtttccatgaaggcaatgttcaagaattcggaggatatgttcctggcatggaggattacatggtaaactcggacatctcaatggaatgtcacgtggcggatggttattcagcgtacgaggatgttacacaagatcccatgtggaatgtggatgacatttggcagtttagggagtaattaagtcgtcaagagatgagatggtagagcctaccactacggttctattatatggactaatatacttcttttgcttaactaagcaaaaagtttcgaaccttttacccatattatctcgggttggagactagaacatgt

SEQ ID NO: 4365 - DNA, 1215 bp, Artificial Sequence
  P4918 (opLexA::G1437, G1437 is from A. thaliana)
aatctcacaatctttacaagagtttttaaaatctctaaccttcatggactttctcaaagtttcagacaagacaacaattccatatagaagtgattctttgtttagtttgaatcagcaacaatacaaagagtcttcttttggattcagagacatggagattcatccgcatcctactccatatgcaggaaatggacttttgggttgttattactattaccctttcacaaacgcacaattgaaggagcttgagagacaagcaatgatctacaagtacaagatcgcatctattcctgttcctttcgatctacttgtttcttcaccatcctctgcctctccttgtaacaataaaaacatcgccggagatttagagccgggaagatgccggagaacagacggaaagaaatggagatgcgcgaaagaagtcgtctctaatcacaaatactgtgagaaacacttacacagaggtcgtcctcgttcaagaaagcatgtggaacctccttattctcgccctaacaacaatggtggttctgtgaaaaacagagatctcaaaaagcttcctcaaaagttatctagtagttccatcaaagacaaaacacttgagccaatggaggtttcatcatcaatctcaaactatagagactccagaggaagtgagaaatttactgtattggcaacaacagagcaagagaacaagtatctgaatttcatagatgtatggtccgatggagtaagatcatctgaaaaacagagtacaacttcaacacctgtttcttcttccaatggcaatctctctctttactcgcttgatctctcaatgggaggaaacaacttaatgggccaagacgaaatgggcctgatacaaatgggcttaggtgtaatcgggtcgggtagtgaggatcatcacgggtatggtccttatggtgtgacttcttcactagaggagatgtcaagctggcttgctccgatgtctaccacacctggtggaccattagcggagatactgaggccgagtacgaatttggcgatctctggtgatatcgaatcgtatagcttgatggagactcccactccaagctcgtccccgtctagagtgatgaagaagatgactagttcagtgtccgacgaaagcagccaggtttaggagttatggagtttggtaataacgactttttgtttgagttttggcctttcttcaatcttgtgcctgtaaactag

SEQ ID NO: 4366 - DNA, 1241 bp, Artificial Sequence
  P4942 (opLexA::G522, G522 is from A. thaliana)
gtgtcctatacacatatctataattccacaggttgaagaaaagaaataatggaatcggtggatcaatcatgtagtgttcctccgggattcagattccatccaacagatgaagagctcgttggttactatttaaggaaaaaagttgcatcgcaaaagatcgatcttgatgtcataagagatattgatctctacagaatcgaaccatgggatttacaagagagctgccgaatcggatatgaggaaagaaatgaatggtatttcttcagccacaaagataagaaatatccaacaggaacaagaacaaacagagcgaccatggctgggttttggaaagccacgggccgagacaaggctgtttacgacaagtcaaaactgattggtatgagaaaaacacttgtgttctacaaaggaagagcccctaatggccaaaaaaccgattggatcatgcatgaataccggctagagtcagatgagaatgcacctcctcaggaagaagggtgggtggtttgtagagcgttcaagaaaaagccaatgaccgggcaagccaagaacacagaaacttggagctcaagttacttttacgacgaattaccgagtggagtacgctcagttacggagcctcttaactacgtatctaagcagaaacaaaacgtttttgcacaagatttaatgttcaagcaagaactagaaggatcagatatcggtttaaacttcatccactgcgatcaattcattcaacttccgcagcttgaaagcccttcactccctcttaccaaaagaccagtgagcttgacgtcaattacatcattggagaagaataaaaatatctacaaaagacatttaatagaagaggatgtgagcttcaatgcgctaataagtagtggaaataaagataagaagaagaagaaaacatcagtgatgacgacggattggagagcactcgataaatttgttgcttctcaacttatgagccaagaagatggagtttcgggttttggaggtcatcatgaagaagataacaataaaatcggtcattacaataacgaagagagcaataacaagggatcagtagagactgcttcttccacgttattgagtgatagagaagaagagaacagattcatcagtggattattgtgttccaacttggactatgacttatatagggatttacatgtttgataaaagataacactataatatggtgcgtaacgtttgctatataggtaccgtagaattta

SEQ ID NO: 4367 - DNA, 1018 bp, Artificial Sequence
  P4946 (opLexA::G1460, G1460 is from A. thaliana)
cttcactcaaaccctaatcccgggaacccgggaattttgatcattttgtttcttttcgatctgtttctattttaaaaagatgatgaaagatccgactgggtatagatttagtccgacgggagaggaagtgataaaccattacctaaagaacaaaattctgggtaagacttggctcgttgatgaagccattagcgagatcaacatcttgaatcacaaacccagcaaggatttgcctaagttagctaggatccaatcggaagatcttgagtggtactttttctctccgattgagtacacgaacccgaataagatgaaaatgaagaggacgacaggttctgggttttggaaacctagtggtgttgatcggaaaattagggataaaagaggaaatggtgttgtgatagggattaagaagacgcttgtgtaccatgaaggtaagagtcctcatggagttagaactccttgggttatgcacgagtatcacatcacttgcttgcctcatcataagaggaaatatgttgtctgccaagtaaagtataagggtgaagctgcagaaatttcatatgagccaagtccctctttggtatccgattcgcataccgtcatagcgattaacggagaaccggaacctgagcttcaggttgagcagccaggtaaagaaaatctcttgggtatgtctgtagatgatttgatagaaccaatgaaccaacaagaggagccacaaggtcctcacttagctccgaatgatgatgagtttatacgtggattgagacatgttgatcgagagccggttgaatatttgtttgccaatgaagaaaacatggatggtttgtctattatgaatgacttgacaatcccaatgatcgcccaacaagaggatctcattctctctgagtgggagggatttatcgcagccacctttttcagcgacaacaacaataacaataaccttaacgtgcatcaactaacgtctttcttaccgggatgattatcagaatgcattttgggttacaacgga

SEQ ID NO: 4368 - DNA, 1148 bp, Artificial Sequence
  P4952 (opLexA::G1917, G1917 is from A. thaliana)
cttcactccaacgtgaaacctgcaaactgaacttatctcttcatattttctttagcttctcttaattttacacttagggttttcaaaccagtagagagagagagaagtgtgtaagagcgatgatgcagactccgtacactacttcaacgcaggggcaatattgtcattcttgtggaatgttccaccaccatagccaaagctgctgctacaacaacaacaacaactccaacgccggttcttactcgatggtcttctccatgcaaaacggtggcgttttcgagcagaacggtgaggactatcatcactcttcctccctcgttgactgcactctctctcttggaactccttctacgaggctttgtgaggaagatgagaaacgtagacgctctacttcatctggtgcttcttcttgcatctccaacttttgggacttgattcacaccaaaaacaacaactccaaaacggcaccgtacaataacgttccttctttctccgctaacaagccaagtcgcggttgttccggtggtggtggtggcggaggaggcggtggcggaggtgactctcttctcgctagacgctgtgccaactgtgacactacttctactccactatggaggaatggtcctagaggccctaagtccctatgcaacgcatgcggcattcgtttcaagaaggaagagagaagaactactgcggctacaggaaacaccgtcgtcggagctgcaccggttcaaaccgaccagtacgggcatcacaactctggctacaataattaccatgctgccactaataacaacaataataatggtactccgtgggctcatcaccactcgacgcagagggttccgtgtaattatccggcaaatgagatcaggttcatggatgattacggcagtggagtagcaaacaacgttgaatccgacggtgctcacggcggtgttccgttcctttcttggaggcttaatgtagcggatagggcaagtcttgtccatgactttaccagatgaaaggagaatagaaaacgacgttagattctcttaaaatttccatgtggtttaattatgtctaattaaaaaaaaaccaagaaaatatttctgaaaaaaatagaagtgtatatcgagagacgatgttgatgtttattgatagtg

SEQ ID NO: 4369 - DNA, 982 bp, Artificial Sequence
  P4955 (opLexA::G159, G159 is from A. thaliana)
cgcttttctttttctgttcaaaacatctcgaaaatggcgagaaagaatcttggtcgtagaaaaatagagttggtaaaaatgaccaacgaatcaaaccttcaagttacgttttcaaaaagaagatctggtcttttcaaaaaaggcagtgaactttgcaccttatgtgacgcggaaattgcgataatcgtgttttcaccctcgggaaaagcatactcttttggtcatccaaatgttaacaagttacttgaccactctttagggcgtgttataagacacaacaacacaaactttgctgaaagccgcacaaagctccgtattcaaatgctcaatgagtctttaactgaggtgatggctgaaaaagaaaaagaacaagagaccaagcagtcaatagtccaaaatgaaagagagaacaaggacgctgagaagtggtggaggaactctccaacagaactcaacttagctcaatcaacttccatgaaatgtgatcttgaagctttgaagaaggaagttgatgaaaaagtcgctcaacttcatcatagaaacctaaacttctatgttggaagttctagcaatgttgctgctccagcagctgttagtggtggtaatatctccacaaaccatggtttctttgatcaaaacggaaactctacttctgctccaacactgccgtttggatttaatgttatgaatcgcacaccagctgggtacaacagttaccaactccaaaaccaggaggttaaacaagtccatcctcagtattgggctcgttactattagtctatctctctcgttgtgtgactttttaagtctccaatagtttgttctgctttttgttttgtttttgtttgttgttgttgttgttgtcgggcttttaattaagtctcgagtcaactagtttcttgtttcttttcgttatactttgtcttgtagctttatatcattttcttgtggaatatgagtaagctatatgaagtttcatatt

SEQ ID NO: 4370 - DNA, 1055 bp, Artificial Sequence; identical to SEQ ID NO: 415
  P5056 (opLexA::G19, G19 is from A. thaliana)

SEQ ID NO: 4371 - DNA, 977 bp, Artificial Sequence; identical to SEQ ID NO: 1051
  P5060 (opLexA::G399, G399 is from A. thaliana)

SEQ ID NO: 4372 - DNA, 1360 bp, Artificial Sequence
  P5061 (opLexA::G428, G428 is from A. thaliana)
ttacttttgtgtttcttcatattcttcagaagcaagcacaaggctagggatcgaagaagcggcgatcactgatcgtatctcactacgatcacattaatggatagaatgtgtggtttccgctcgacggaagactattcggagaaagcgacgttgatgatgccgtccgattatcagtctttgatttgttcaaccaccggagacaatcaaagactgtttggatccgacgaactcgctaccgctttgtcctcggagttgcttccgcgtattcgaaaagctgaggataatttctctcttagtgtcatcaaatccaaaatcgcttctcatcctttgtatcctcgcttactccaaacctacatcgattgccaaaaggtgggagcgcctatggaaatagcgtgtatattggaagagattcagcgagagaaccatgtgtacaagagagatgttgctccattatcttgctttggagctgatcctgagcttgatgaattcatggaaacctactgtgatatattggttaaatacaaaaccgatcttgcgaggccgttcgacgaggctacaactttcataaacaagattgaaatgcagcttcagaacttgtgcactggtccagcgtctgctacagctctttcagatgatggtgcggtttcatctgacgaggaactgagagaagatgatgacatagcagcggatgacagccaacaaagaagcaatgaccgcgatctgaaggaccagctactacgcaaatttggtagccatatcagttcattgaaactcgagttctctaaaaagaagaagaaagggaagctaccaagagaagcaagacaagcgttgctcgattggtggaatgttcataataaatggccttaccctactgaaggcgacaaaatagctctggctgaagaaacaggtttggatcaaaaacaaatcaacaattggtttataaaccaaaggaaacgccattggaagccttcggagaacatgccgtttgatatgatggacgattctaatgaaacattctttaccgaggaatgaaaagagagacatgggattgtgcattgtataatttttacactgttttcccaagaaaagaaaacagtaaaaagcttttggtaaatgggacatcatcgcgaatgaatggaaccagttagccaaaacggtcaagggcgtggcgtaacgagacattgtattggaaatagtggcaatattatgtcactaatcttccaatggtccaaaatgatagatttcttatttgtattgaaccttacttagatagctgatgtgtcaactaaataatttattttcatccttatactacttgtatcaatgtctctaattgatcaattgttgcttgctattcaaa

SEQ ID NO: 4373 - DNA, 935 bp, Artificial Sequence
  P5065 (opLexA::G452, G452 is from A. thaliana)
tccgcaagaacaagaacaagaagaagaagaacaagacaagaagaacaaagtacccaagaaaacacacagggaaggaaacacaaagattgatattgatccaaaagcaatggcgtacgagaaagtcaacgagcttaaccttaaggacacagagctatgtcttggattacccggaagaacagagaagatcaaagaagaacaagaggtttcttgcgttaaaattaacaacaagcgtctatttgaggaaactcgtgatgaagaagaatctacacctcctaccaaaactcaaatcgttggttggccaccagtgagatcttcccgtaagaacaacaacagtgtgagctacgtgaaagtgagtatggacggagctccttaccttcgcaagatcgatctcaagacatacaaaaactaccccgagcttctcaaagcgttagagaatatgttcaaagtcatgattggtgaatattgtgagagagaaggatacaaaggatctggatttgtaccaacatacgaagataaagatggtgactggatgttggttggtgatgttccatgggacatgttctcttcttcttgtaagagactcagaatcatgaagggatccgacgctcctgctctagactcttccttatgatccagagaagctgagaatcttttgtctaaaaaggagatgatgactatgatcgatgaatgaaaaaccctttttggtttgattcggatcggagtttgactaaagttgaccgtgaaagacgaaacttcggggttttgtccgacgagagatccatctctagtgatgttctttttgtttttgtatttagatttgaagtttgatgtaaagatacatgagattttatgtataatacggacacatacacaatctatagatgtataatgtattaagtagttatgtcctataagatcatcagttttctgttaaa

SEQ ID NO: 4374 - DNA, 1224 bp, Artificial Sequence
  P5067 (opLexA::G463, G463 is from A. thaliana)
gtctctttctgtttgtttgttttcttgtttccttctctctctctctttctttctttgtcttcctttcccaggttgtttttttttgctctctctgccttcttgactttcaaaagactctttctttcttttggattgattttggattctagggctctctttcttttagtgggtttttgttgttgttgttgtggtctctctgatgattactgaacttgagatggggaaaggtgagagtgagcttgagcttggtctagggctgagtcttggcggtggaacggcggccaagattggtaaatcaggtggtggtggcgcgtggggagagcgtggaaggcttttgacggctaaggattttccttctgttggttctaaacgtgctgctgattctgcttctcatgctggttcatctcctcctcgttcaagtcaagttgttggatggcctcctatagggtcacacaggatgaacagtttggttaataaccaagctacaaagtcagcaagagaagaagaagaagctggtaagaagaaagtgaaagatgatgaacctaaagatgtgacaaagaaagtgaatgggaaagtacaagttggatttattaaggtgaacatggatggagttgctataggaagaaaagtggatttgaatgctcattcttcttacgagaatttggcgcaaacattggaagatatgttctttcgcactaatccgggtactgtcgggttaaccagtcagttcactaaaccgttgaggcttttagatggatcgtctgagtttgtacttacttatgaagataaggaaggagattggatgcttgttggtgatgttccatggagaatgttcatcaactcggtgaaaaggctacgtgtgatgaaaacctctgaagctaatggactcgctgcacgaaatcaagaaccaaacgagagacagcgaaagcagccggtttagatctcttttcgacgttacggtgttacaggttttatattttggggttttgcaagtctgagatacttctgaagcaagcataagctagattgatcttatatccagtttgtgtattttcttggttcttataatggtttttactggttttctttagtttttttttttgctgtcttttaattttcggttgcgatttcactatatactatggatggaagagaatgctctttatatcttttactacactgtaaatatttgaagcttatctaatatcgtttttaagggttaaa

SEQ ID NO: 4375 - DNA, 1034 bp, Artificial Sequence
  P5072 (opLexA::G482, G482 is from A. thaliana)
acacttaacaattcacaccttctctttttactcttcctaaaaccctaaatttcctcgcttcagtcttcccactcaagtcaaccaccaattgaattcgatttcgaatcattgatggaaatgatttgaaaaaagagtaaagtttatttttttattccttgtaattttcagaaatgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaacaaagattggtgaagtggatctctctctgtatatagatacataaatacatgtatacacatgcctatttttacgacccatataaggtatctatcatgtgatagaacgaacattggtgttggtgatgtaaaatcagatgtgcattaagggtttagattttgaggctgtgtaaaagaagatcaagtgtgctttgttggacaataggattcactaacgaatctgcttcattggatcttgtatgtaactaaagccattgtattgaatgcaaatgttttcatttgggatgctttaaa

SEQ ID NO: 4376 - DNA, 1162 bp, Artificial Sequence
  P5076 (opLexA::G525, G525 is from A. thaliana)
cttctctcttctcaaaaacccttccctcttcgtctccaaacaacaacaaacacaacaacaacaaaaatcttacaagaagatcatttttagaaaccctattaggataaaatggattacgaggcatcaagaatcgtcgaaatggtagaagatgaagaacatatagatctaccaccaggattcagatttcaccctactgatgaagaactcataactcactacctcaaaccaaaggttttcaacactttcttctctgctactgccattggtgaagttgatctcaacaagattgagccttgggacttaccatggaaggctaagatgggagaaaaagaatggtatttcttctgtgtgagagaccggaaatacccgaccggtttaaggacaaaccgggcgacagaagccggttattggaaagccacaggaaaagacaaagagatattcaagggaaaatcacttgtgggtatgaagaaaactttggttttctataaaggaagagctcctaaaggagttaaaaccaattgggttatgcatgaatatcgtttagaaggcaaatattgtattgaaaatcttccccaaacagctaagaacgaatgggttatatgtcgtgttttccaaaaacgtgccgatggtacaaaggttccaatgtcaatgcttgatccacacattaaccgaatggaaccagccggtttaccttcgttaatggattgttctcaacgagactccttcaccggttcgtcgtctcacgtgacctgcttctccgaccaagaaaccgaagacaaaagacttgtccacgagtccaaagacggttttggttctctgttttactcggatcctctgtttttacaagacaattattcgctaatgaagctgttgcttgacggtcaagaaactcaattctccggcaaacctttcgacggtcgtgattcgtccggtacagaagaattggattgcgtttggaatttctgagttgtataagttatgttgtagacttgtagtagtcatgtgttcgtgtgtgtgaatgaatattcttgttacatttttttgtaaaaaaggagaaaaaaatatgctagaaagtcaattgcttttgttatgtagcattagtgttttttatgtactcaatagacttcctaattaaataaaaatcttaatttatttgccaaaa

SEQ ID NO: 4377 - DNA, 1223 bp, Artificial Sequence
  P5085 (opLexA::G591, G591 is from A. thaliana)
gtaaatctctctttgaaggttcctaactcgttaatcgtaactcacagtgactcgttcgagtcaaagtctctgtctttagctcaaaccatggctagtaacaaccctcacgacaacctttctgaccaaactccttctgatgatttcttcgagcaaatcctcggccttcctaacttctcagcctcttctgccgccggtttatctggagttgacggaggattaggtggtggagcaccgcctatgatgctgcagttgggttccggagaagaaggaagtcacatgggtggcttaggaggaagtggaccaactgggtttcacaatcagatgtttcctttggggttaagtcttgatcaagggaaaggacctgggtttcttagacctgaaggaggacatggaagtgggaaaagattctcagatgatgttgttgataatcgatgttcttctatgaaacctgttttccacgggcagcctatgcaacagccacctccatcggccccacatcagcctacttcaatccgtcccagggttcgagctaggcgtggtcaggctactgatccacatagcatcgctgagcggctacgtagagaaagaatagcagaacggatcagggcgctgcaggaacttgtacctactgtgaacaagaccgatagagctgctatgatcgatgagattgtcgattatgtaaagtttctcaggctccaagtcaaggttttgagcatgaaccgacttggtggagccggtgcggttgctccacttgttactgatatgcctctttcatcatcagttgaggatgaaacgggtgagggtggaaggactccgcaaccagcgtgggagaaatggtctaacgatgggactgaacgtcaagtggctaaactgatggaagagaacgttggagccgcgatgcagcttcttcaatcaaaggctctttgtatgatgccaatctcattggcaatggcaatttaccattctcaacctccggatacatcttcagtggtcaagcctgagaacaatcctccacagtaggatttctgcaataaagagtttgtacagctaatccaactgtccaacatgggtttttcttctgctctaatgactctggtttcttctctcctctctcaccgacttgaaaggtaaaaaagtgaaaaaggctttgtagatggaatcaatgtaggatttgcagtagagggcaaaaaaatgtcatatagctcaattgatcaagtcttaaa

SEQ ID NO: 4378 - DNA, 855 bp, Artificial Sequence; identical to SEQ ID NO: 1181
  P5091 (opLexA::G649, G649 is from A. thaliana)

SEQ ID NO: 4379 - DNA, 987 bp, Artificial Sequence
  P5094 (opLexA::G663, G663 is from A. thaliana)
gggaagccacaataaccccctattcctcggccttttttaaaaaagttttagaataatccgataaaatacttttatattaatttttctttggtccatggagggttcgtccaaagggttgaggaaaggtgcatggactgctgaagaagatagtctcttgaggctatgtattgataagtatggagaaggcaaatggcatcaagttcctttgagagctgggctaaatcgatgcagaaagagttgtagactaagatggttgaactatttgaagccaagtatcaagagaggaagacttagcaatgatgaagttgatcttcttcttcgccttcataagcttctaggaaataggtggtccttgattgctggtcgattgcctggtcggaccgctaatgatgtcaaaaattactggaacacccatctgagtaaaaaacatgagtcttcgtgttgtaagtctaaaatgaaaaagaaaaacattatttcccctcctacaacaccggtccaaaaaatcggtgtttttaagcctcgacctcgatccttctctgttaacaatggttgcagccatctcaatggtctgccagaagttgatttaattccttcatgccttggactcaagaaaaataatgtttgtgaaaatagtatcacatgtaacaaagatgatgagaaagatgattttgtgaataatctaatgaatggagataatatgtggttggagaatttactgggggaaaaccaagaagctgatgcgattgttcctgaagcgacgacagctgaacatggggccactttggcgtttgacgttgagcaactttggagtctgtttgatggagagactgttgaacttgattagtgtttctcaccgtttgtttaagattgtgggtggcttttctttcgtattttagtaatgtatttttctgtatgaagtaaagaatttcagcattttaagaaaaatggttatgtttctacgtaataaaaaaaaacgttatttataaa

SEQ ID NO: 4380 - DNA, 649 bp, Artificial Sequence
  P5099 (opLexA::G682, G682 is from A. thaliana)
tcgacccacgcgtccgctctctcagagtactctcttagtttctttcttcttcttctttgtaatacggtgccgtttgacatggataaccatcgcaggactaagcaacccaagaccaactccatcgttacttcttcttctgaaggtaagctgaaaacttaaacaccttcgttttctcatttttccatgtttttttatacttatctatatataatgagaaatctgaattttggtgatgacaaggaacagaagtgagtagtcttgagtgggaagttgtgaacatgagtcaagaagaagaagatttggtctctcgaatgcataagcttgtcggtgacaggtttgatcttttaactaataatgaatactatttcgtaggaaaataatttaattgtaacaccatagtaaaagctgaattttgtgtgttattatttgatgaaaggtgggaactgatagctgggaggatcccaggaagaaccgctggagaaattgagaggttttgggtcatgaaaaattgaaaagtgatcaatatatctctatagtttcactgattgtttcgattatattccgttgtattttaaatttaccaactctgttataagaagaaaactttcttaaatcccaaaccatttaactaaaaaaaaaaaaaaagggc

SEQ ID NO: 4381 - DNA, 1423 bp, Artificial Sequence; identical to SEQ ID NO: 1233
  P5105 (opLexA::G749, G749 is from A. thaliana)

SEQ ID NO: 4382 - DNA, 1420 bp, Artificial Sequence; identical to SEQ ID NO: 1253
  P5111 (opLexA::G793, G793 is from A. thaliana)

SEQ ID NO: 4383 - DNA, 786 bp, Artificial Sequence
  P5130 (opLexA::G35, G35 is from A. thaliana)
ggattctaaaagataagagaaacagtaagtcggttaattttggattaagtaacgcacaagccaaagccttctcctgatcgaatcataaaccaaacaaatctttcttttaaaagaagcggacacaaaccctaaccaccaaccctctccgtcgtcaaatttcccggcgaaagatgaaacgaattgttcgaatttcattcacagacatggaagcaaccgattcttcaagcagcgaagacgagtcaccaccgtcatcacgccgtcgaggtaagaagctagtcaaggaaatcgtaatcgatcattctgatcccccggaggtcggaaaaactcggttcaaaatcaggattccggcgagtttacttgctgcgaggaatacgacggcgaataagaagaagttccgtggcgtgaggcagagaccatgggggaagtgggcggctgagattagatgtggtagagttaaaggaagacctgaacgaatttggcttggaacttttgaaacagctgaagaagctgctcttgcttatgataacgctgcgattcagttgattggacctgatgcgccgactaattttggccgtcctgatgttgattctgcggtggtgaaaaagcaagattctgatgctagtggtggtgcttctgaagaagttgtttgattttcttgtttataactaactttgcaaggttacttttgtttatcatcatcttttgtaaatttgatcatcttgctctttgctttttaacttctcttgtacatgtttgaattataaaagttctaatttttcaatcaaa

SEQ ID NO: 4384 - DNA, 1034 bp, Artificial Sequence; identical to SEQ ID NO: 417
  P5142 (opLexA::G190, G190 is from A. thaliana)

SEQ ID NO: 4385 - DNA, 1745 bp, Artificial Sequence
  P5145 (opLexA::G261, G261 is from A. thaliana)
attttgggcttctgattttgatcgaaacttactgatagtaagttctttgagtcctccttaactgtagtttctgtgtactgaagttattgaattgaaagtttttatcttttttggttattgaaactttcatagtttgatcaaaagagtctcttgctctgtttttggctctgtttttgtgagtgtgattgtaagctttgttgtgagtagattgaatcaaggagtgtgagagttgttaaaagtgttttcagagatggatgagaataatcatggagtttcatcaagctcacttccacctttcctcaccaaaacatatgagatggttgatgattcttcatccgattctatcgtctcttggagtcagagcaataagagtttcatcgtttggaatccgccggagttttctagagatcttcttccgagattcttcaagcacaataacttctctagctttatccgccagcttaacacatatgtaagtgttttcatgctttgtttaaaagtattgactaaatcaatcatcttcttagtggaatttgtttttgtgtgtagggttttagaaaagctgatcctgagcaatgggaatttgcggaatgatgattttgtgagaggtcaacctcatcttatgaagaacattcatagacgcaaaccagttcatagccactctttaccgaatcttcaagctcagttaaacccgttgacggattcagaacgagtgagaatgaataatcagattgagagattgacaaaagagaaagaaggattgcttgaagagttacataaacaagacgaggaacgagaagtgtttgagatgcaagtgaaagaacttaaagaacgattacaacacatggagaagcgtcagaaaacaatggtttcgtttgtttctcaagtattggaaaagccagggcttgctttgaacctatcgccgtgtgttcccgaaacaaacgagaggaaaagaaggttccctaggatcgagttctttcccgatgaaccgatgttggaagagaacaaaacttgtgttgttgtgagagaggaaggttctacaagcccttcttcacacacaagagagcatcaagtggaacagttagagtcatcgatagcgatttgggagaatcttgtatcggattcttgtgagagtatgttacaatcaagaagtatgatgacacttgatgtggatgaatcatctacttttccagagagccctcctctttcttgcatacagttaagtgtcgattcacgtctcaaatctcctccttctccaaggatcatcgatatgaactgtgagcccgatggttcgaaagaacagaacactgttgctgctcctcctcctcctccagtagcaggagcgaatgatggcttctggcagcagtttttctcagagaatcctggctcaaccgagcaacgggaagttcaattagagaggaaagacgataaagataaagccggagtacgtactgagaaatgttggtggaattcgagaaatgttaatgcaattacagaacagcttggacatctgacttcttcagagagaagttgatatgtcaaagattaaatttctagtctgttttagttacttgtaaaatagggtttctcagttttattgttttcgattacagtacttaggtatggttcagctgtttatttatcacttgtatgatctttcacagttcattgtagcagacttcaatggtaatgataagctagagcttatggatagtattcataaaatgagattgaccttcaacaaa

SEQ ID NO: 4386 - DNA, 1766 bp, Artificial Sequence; identical to SEQ ID NO: 859
  P5248 (opLexA::G285, G285 is from A. thaliana)

SEQ ID NO: 4387 - DNA, 2956 bp, Artificial Sequence; identical to SEQ ID NO: 865
  P5249 (opLexA::G286, G286 is from A. thaliana)

SEQ ID NO: 4388 - DNA, 1550 bp, Artificial Sequence
  P5256 (opLexA::G326, G326 is from A. thaliana)
caattaatgacatcttcttcttctcctttcactgcaaaaccgaaagcttgagactttgagattatgtctatgtcatcttcttcttcttccatcgatcacttcatcacctttcgtcatcttgatcttattctccactgtataaaatcagcgagattttaagggattgtgaaggtaccatcttaaacacaaaatgggtacttctactacagagagtgtggtggcgtgtgaattttgcggcgagagaacggcggttctgttttgtagagccgatacggcgaagctttgtttgccttgtgaccagcacgtgcactcggcgaaccttctctcgaggaagcatgttcgttctcagatctgtgataactgtagcaaagagccggtgtccgtacgttgcttcacagataatctcgtattgtgtcaggagtgtgattgggatgttcacggaagctgttcctcctccgcgacgcatgaacgctccgccgtggaagggttttcaggttgtccttcggttttggagcttgctgctgtgtggggaatcgatttaaagggtaagaagaaagaagatgacgaagacgaattgactaagaattttgggatggggttggattcgtggggttctggatctaacatcgttcaagaactgattgttccttatgatgtgtcttgcaaaaagcaaagctttagctttgggaggtctaagcaggtagtgtttgaacagcttgagttactgaagagaggcttcgttgaaggcgaaggagagattatggttccggagggaatcaatggcggaggaagcatttctcagccatctccgacgacgtcgtttacttctttgcttatgtctcaaagtctttgtggtaatggtatgcaatggaatgctactaatcatagcactggccagaacactcagatatgggattttaacttgggacagtcgaggaaccctgatgaacctagtccagtcgaaactaaaggctctactttcacattcaacaacgttactcatctcaagaacgatacccgaaccaccaatatgaatgctttcaaagagagttaccaggaggattccgtccactcaacttctaccaagggacaggaaacatctaagagcaacaatattcctgctgccattcactcgcataaaagttctaacgactcctgtggcttgcattgcacggaacatattgctattactagtaatagagccacaagattggtggcggtaacgaatgctgatctagagcagatggcacagaacagagataatgctatgcagcggtacaaggaaaagaagaaaacgcggagatatgataagaccataagatatgaaacgaggaaggcgagagccgagaccaggttgcgtgttaagggcagatttgtgaaagctacagatccttagatgtctctccacgttaggttttacatttgagatcctaagttaggaactttttttgttttttctactttcaactaccttgtaaatgtaaatgatcgatcttcagctgcataatgtgtggccagatttttgtaatttttacgtttaaccttctaaa

SEQ ID NO: 4389 - DNA, 1031 bp, Artificial Sequence
  P5262 (opLexA::G368, G368 is from A. thaliana)
ttgcgtttccacatttgtttaaacataactctctctctctctctctctctctctctctctcagtacctcttattcttatgctcttcttcaccaatcctatctcttctatctgtctttattttctctacatgtgaattgacccatttctggtaaacacatagagtaccacttttcttatttagattcttcttcctcttcatagcttccaagtcaactacttcagcttctgtcggctgtctcttcccagatctcgttaagaccaaaacttggaataaatgacggaatctgatgatgcctcacgagaaacaccagccagcagaggaggagaagcctcgtcaaatcaagatctgtccaaaccagaatcaaaccatgtttcactcgatctcaagctcaacgatactttcaacgatgacacaaagagcacaaagtgtgaagcaaacccaagagtcttctcttgcaactactgcagacgcaagttctatagctctcaagctcttggaggtcaccagaacgcacacaagcgagaaagaacaatggccaaacgagcaatgcacatgggaagaatgtttggtcaccatcacaggccttacacatacacttcttcttcccttgggatgcaagctcactccggtttacttcatcacaccttatctcagcctcagcctcttgtttctaggtttcatcatcaagggtattttggtaacaccgtgccgttgttctttgactatgacgatggtggtagcgacttcttctggcccggcagcttccgtcaggtggttgaggaagctgaggctccggtggttgtggtggctagtactgagtcaggccttgatttgaactcggttgcggcaaatggaggtgtagataataatagctcaaagcctgatcttaccttaagactctaaaaggattaaggagattatatctttattgttatttttctattgttagacattcagaagataagttggagacagttgatagaaattgatgaaaaactttgttgttatattaaatgaggttgttcatta

SEQ ID NO: 4390 - DNA, 1488 bp, Artificial Sequence
  P5265 (opLexA::G440, G440 is from A. thaliana)
aaatcactgtttcataacacgtttttctctctcacccaccaaaaaaaaatcttttgttcttgttaccaaaaaatctcgtgataaatctcttcaaactttgttttattttcttcttgattctctcgaaatctctctcaacaaacccagaaactttccttgattcgcaagcttttcttccttttatattcttcattttgatgcgaatatagagagagtccataaaagaaacagtaatggacgaatatattgatttccgaccattgaagtacacagagcacaagacttcaatgactaaatacaccaaaaagtcatcggaaaaactttccggtggtaagtcattgaaaaaggttagtatttgttatactgatcctgacgcaacagattcatcaagtgacgaagacgaagaagatttcttgtttcctcgccggagagtcaaaagattcgttaacgagatcactgttgagcctagctgtaacaacgtcgtcaccggagtttcgatgaaagatagaaagagactctcttcttcctccgatgaaactcaatctccggcgtcgagtcgtcaacgtcctaataacaaagtttcagtctccggtcagataaagaagttccgtggtgttagacaacggccatgggggaaatgggcggcggagattagagatccggagcaacgtcggaggatttggctcgggacttttgagacggcggaggaagctgccgtggtttatgataacgccgctataagactccgtggaccggacgctttaactaatttctccataccgcctcaagaagaggaagaagaagaagaaccggaaccggttattgaggagaaaccggttattatgacgacgccaacaccaacaacatcgagttctgaatcaactgaagaagatttacaacatctctcatctcctacttcggttctcaatcaccggtcagaagagattcaacaagtacaacaaccgtttaaatcagctaaacccgaaccgggggtttcaaatgcaccatggtggcataccgggtttaataccggtttaggtgaatcagacgattcatttcctttggatactccgtttcttgacaactatttcaatgaatcaccaccagagatgtcaatatttgaccaaccaatggatcaaattttctgtgaaaatgatgatatcttcaatgatatgttgttcttgggtggtgaaactatgaacattgaagatgagttaacaagttctagtatcaaagatatgggttcaacgtttagtgattttgatgattcattgatatcagatctattagttgcttaatatgatgatgagagtgaagaagaaaccatcaagcaaatatctatggtgtgactgaaaaattttggtgttacttttttttctttcataagttcatgagcttttttgtttcttttttttaataatttatttagttttgtcaggagcttgtaaaacagttttggagaaatagtggaaaaatagtttaattaaa

SEQ ID NO: 4391 - DNA, 976 bp, Artificial Sequence
  P5266 (opLexA::G449, G449 is from A. thaliana)
agcttctctatatctctcctctctttcaaggataataaccaaaagcttttctttttatcttctcctgcaattcttgaagaaatggatgagtttgttaacctcaaggaaacagagctgaggctgggattaccgggaacagataatgtatgtgaagcaaaagagagagtttcttgctgtaataacaacaataagagagtactatcaactgatactgagaaggagattgaatcatcatcaaggaaaactgaaacatcccctcctcgaaaggctcagattgttggatggccaccagttagatcttacaggaagaacaacattcagagtaagaagaatgaatctgagcatgagggtcaaggaatctatgtgaaagtaagtatggatggtgcaccatacttgaggaaaatagatctgagttgttacaaaggatactcagagttgcttaaagctttagaagtgatgttcaaattctctgtgggagagtactttgagagagatggatataaaggttcagactttgtgcctacttatgaagacaaagatggtgattggatgctcattggtgatgttccatgggagatgttcatatgtacgtgcaagagactaaggatcatgaaaggatcagaagccaaaggtttaggctgtggtgtatgagatatatcttcaagaaatctaacagagacacaaaagaacttgaagaaaaatagagtttcttttggttcagagaaatctctgtctgtgcttgggttgtcgggtttctcgggcaagatctatgttcattggattgaatccaattcatagcctttatttacctcatcggtaaaattcaaatgtaaacatgcttaatggtcttaagcatatgaaactggaacctaattacattttgtttcagaaacagggcaaaaggttgtccttaaatctttggttatgtgtattacattaattaaagtgttatgaagattgaagagttgtttttaaa

SEQ ID NO: 4392 - DNA, 1200 bp, Artificial Sequence
  P5272 (opLexA::G501, G501 is from A. thaliana)
aaaaatccagatccagctgaaattgaattttcaaccaacgaagaagagatttttccaagagcaacagacaagaagaagagaatgaagtcggagctaaatttaccagctgggttccgattccatccaacggacgaggagcttgtgaaattctacttgtgccggaaatgtgcttccgagcagatctcggctccggttatcgccgagattgatctctacaagttcaatccttgggagcttccagagatgtctctgtacggagagaaagagtggtacttcttctcacctagagatcggaaatacccaaacggttcgcgtcctaaccgggcagcaggaaccggttattggaaagctaccggagcagataaaccgattggtaaaccgaagacgttgggtatcaagaaagcactcgtcttctacgcagggaaagctccaaaagggattaagaccaattggataatgcatgagtatcgtctcgctaatgttgatagatcagcttctgttaacaaaaagaacaacctacgacttgatgattgggttttatgtcgaatatacaacaagaaaggaaccatggagaagtatttccccgcggatgagaagccgaggaccacgacaatggctgaacagtcatcatcaccttttgatacatcagactcgacttacccgacattgcaagaggatgattccagcagctcaggtggtcacggtcacgtggtgtcaccggatgttttggaggttcagagcgagcctaaatggggagagcttgaggatgctttggaagcttttgatacttcaatgtttggtagttccatggagttgttgcagcctgacgcttttgtccctcagttcttgtatcagtctgattatttcacttccttccaggatccgcctgagcagaaaccattcttgaattggagttttgctccacaggggtaaaaacggaagagaccaaaaaaggtgtttgctagtagtactgtgatgtgccagagagaagagtctcatctcaactcatccctggctcttagtagtaaaagaagattgtagaatgttaatagcttttagcatcaatgtctcattagcaggcacattcttgttctttcatgagaagtttatatgaaaactaaaaatttatattcaaattcttcaagatgttgcacttatgtagatactgatattaaataacaacctaacctttatgagaaa

SEQ ID NO: 4393 - DNA, 1038 bp, Artificial Sequence; identical to SEQ ID NO: 1107
  P5274 (opLexA::G508, G508 is from A. thaliana)

SEQ ID NO: 4394 - DNA, 1798 bp, Artificial Sequence
  P5507 (opLexA::G513, G513 is from A. thaliana)
atcgtgtcaaattttagggttttttcttttcgtacttcatcaaattctggaatctggttttttcttagttttcttctatatacctttgaatcgcatctttgatccaaattcattttagatatcaccttgaagtcgaatttgtgattttttcttttcctctcgaattctcaaagtctcacgcaactatgaaagaagacatggaagtactatcgctcgcttcactaccggttgggttcagatttagtccaacggacgaagagttagtccggtactatctccggctcaagatcaacggtcacgataacgacgttagagtaattcgtgagatcgatatctgcaaatgggagccttgggatttgcctgatttttctgtggtgaagacaacagactcagagtggctcttcttttgtcctttggaccggaaatatccgagtggaagtcgaatgaatagagctactgtggctggatactggaaggcgacgggaaaagaccgtaagatcaaatcaggaaagactaagattataggtgttaagaggactctagtgttttatacaggtcgtgctcctaaagggacacgaacttgttggattatgcatgagtatcgtgctactgagaaggatcttgatggaacaaagtctggccagaatccgtttgttgtttgtaagttgtttaagaagcaagatattgtgaacggagctgctgaaccagaagagtcaaagtcatgtgaagttgaaccagcggtatcgtctccaactgttgtggacgaggttgaaatgtctgaggtatctcctgttttccctaaaacagaagagactaatccttgtgacgtcgcagagtcttctcttgtaatccccagcgaatgtcgtagtggatactctgtccctgaggttacaaccaccgggcttgacgatatcgattggctctcgtttatggagtttgattccccgaagctgttctctccgttgcactctcaggtgcaatctgagctcggttcctctttcaatggcttacaatctgagtctagtgaattgttcaaaaaccacaatgaggattacattcagactcagtacggtacaaatgatgcggatgaatatatgtccaagttcttggattcttttcttgacattccctatgagccagaacagatcccatatgagccacagaatcttagctcatgcaacaagatcaatgatgaatctaagagaggaattaagattagagctcgacgagcacaagccccgggttgtgctgagcagtttgtaatgcagggcgatgcctcaagaaggctgcgtcttcaggttaaccttaacagccacaagtcagaaactgacagtacacaacttcaatttatcaagaaagaggttaaggacacaacaacggaaactatgacgaaaggatgtggaaatttcacaagatcaaagagcaggactagtttcatattcaagaaaattgcagccatgggatgttcatacagagggcttttcagagtcggtgtggtagcggttgtgtgtgtgatgtcggtctgcagtctagtcgcataaatccgctgaatgtgatgtttgttccgatcaattcatatagtaagaataaagaaagtggtttttacgggtggagagagcgcggatttgtgtgtataacaggggttttggcctggttctgcatctgttgttattgttgttgtttttgtcggcttaagcttaaccatggtcggtttaggagtgtagtagacttgtagttaacatgtacgacgactcataatattcagatggtaatgtttggaaatttttttattcctaaa

SEQ ID NO: 4395 - DNA, 981 bp, Artificial Sequence
  P5513 (opLexA::G529, G529 is from A. thaliana)
gcaaagatgtcttctgattcgtcccgggaagagaatgtgtacttggccaagttagccgagcaagctgagcgttacgaggaaatggttgagttcatggagaaagttgcaaagaccgtggagaccgaggaacttactgttgaagagaggaatctcttgtctgttgcttacaagaacgtgattggtgctaggagagcttcttggaggattatctcttccattgagcagaaggaagatagcaggggcaacagtgatcatgtttcgattatcaaggattacagaggcaagattgaaactgagctcagcaagatttgtgatggcattttgaaccttcttgaggctcatctcattcctgctgcttctttggctgagtccaaagttttttacctgaagatgaagggagattatcatcggtaccttgctgaattcaagactggtgctgagaggaaagaagctgctgagagcactcttgttgcctacaagtctgctcaggatattgctcttgctgatctggctcccactcacccaatcagactggggcttgctcttaacttctctgttttctactatgagattctcaactcatctgatcgtgcgtgtagtctcgcaaagcaggcttttgatgaggcaatctcggagctagacacattgggagaggaatcatacaaggacagtacattgatcatgcagcttctccgtgacaatctcaccctctggacttctgacctcaatgacgaagctggtgatgatatcaaggaagccccgaaagaggtgcagaaagttgatgaacaagcccaaccaccaccttcgcagtgataaaatcagatccatggaatgatttgcagacaaaaagatatatggcttggttctgtgtttttaaacagaaaaaaaccttgtagtttccttaaacatgggctgtagtttccttaaacatggatttgtagtagtaattgtagctgcatgatttggttatcgatggttaaa

SEQ ID NO: 4396 - DNA, 885 bp, Artificial Sequence; identical to SEQ ID NO: 1239
  P5541 (opLexA::G763, G763 is from A. thaliana)

SEQ ID NO: 4397 - DNA, 1136 bp, Artificial Sequence
  P5557 (opLexA::G881, G881 is from A. thaliana)
gtgaccgaagaaagcaaattgagactacgcaccaactagtcctttggtttgtatcttaagataaaggtttcttttatggacggttcttcgtttctcgacatctctctcgatctcaacaccaatcctttctccgcaaaacttccgaagaaggaggtctcagttttggcttctactcacttaaagaggaaatggttggagcaagacgagagcgcaagtgagttacgagaggagctaaacagagttaattcagagaacaagaagctaacagagatgttagctagagtctgtgagagctacaacgaactacataatcatttggagaagcttcagagtcgccagagccctgaaatcgagcagaccgatataccgataaagaaaagaaaacaagacccggatgagttcttaggctttcctattggactcagtagtggaaaaactgagaacagctccagcaacgaagatcatcatcatcatcatcagcaacatgagcagaaaaatcagcttctttcatgtaaaagaccagtcactgatagcttcaacaaagcaaaagtttcgactgtctacgtgcctactgaaacatcggacacaagcttgacagttaaagatggatttcaatggaggaaatacggacaaaaggttacaagagacaacccgtcacctagagcttactttagatgctcgtttgcaccgtcttgtccagtaaaaaagaaggtacaacgcagcgcagaggatccatctttacttgtagcgacatacgaagggacgcataaccacttgggtccaaatgcttctgaaggggatgctacaagccagggtgggtcaagcacagtgactttggatctggttaatggctgtcatagactagcgttggagaaaaacgaaagggataatacgatgcaagaggttctgattcaacaaatggcgtcatcgttaacaaaagattcgaaatttacagctgctcttgctgctgctatatctgggaggttaatggagcaatctagaacatgaacgtttttagtgaatgtattgtttttgtttgtttagaatgattcttcgttttcgaattgtgtctttcgattaggagataaaagatgtatataaatattataagtagatgaagaaatcgtataagtaaa

SEQ ID NO: 4398 - DNA, 2310 bp, Artificial Sequence; identical to SEQ ID NO: 1307
  P5565 (opLexA::G941, G941 is from A. thaliana)

SEQ ID NO: 4399 - DNA, 960 bp, Artificial Sequence
  P5689 (opLexA::G1335, G1335 is from A. thaliana)
tttttttttaaaagatttagagagaaaagtgagttattaagagattccaatcaaaatgagcggagacaacggcggtggtgagaggcgcaaaggctccgtcaagtggtttgatacccagaagggtttcggcttcatcactcctgacgacggtggcgacgatctcttcgttcaccagtcctccatcagatctgagggtttccgtagcctcgctgccgaagaagccgtagagttcgaggttgagatcgacaacaacaaccgtcccaaggccatcgatgtttctggacccgacggcgctcccgtccaaggaaacagcggtggtggttcatctggcggacgcggcggtttcggtggaggaagaggaggtggacgcggatctggaggtggatacggcggtggcggtggtggatacggaggaagaggaggtggtggtcgaggaggcagcgactgctacaagtgtggtgagcccggtcacatggcgagagactgttctgaaggcggtggaggttacggaggaggcggcggtggctacggaggtggaggcggatacggcggaggaggtggtggttacggaggtggtggccgtggaggtggtggcggcgggggaagctgctacagctgtggcgagtcgggacatttcgccagggattgcaccagcggtggacgttaaaaccaacgccggttacgcggtggagaagagtgagttggttatctcacaagtgatcggttctttctcccgccgccttctatctctctattatccactttttgcttattatgatggatctctatctttgttagttggttttttcttgatggtttcggattaggactcttcttttggttttgctacttatggttggttttatttatggtacttgtgatatgggtgaaatgctctacttgttgctctgtttcaagtgttcataatatgcgaacaaatattctgggttttgtttcaaa

SEQ ID NO: 4400 - DNA, 1230 bp, Artificial Sequence; identical to SEQ ID NO: 139
  P5692 (opLexA::G1349, G1349 is from A. thaliana)

SEQ ID NO: 4401 - DNA, 1179 bp, Artificial Sequence; identical to SEQ ID NO: 307
  P5702 (opLexA::G1669, G1669 is from A. thaliana)

SEQ ID NO: 4402 - DNA, 765 bp, Artificial Sequence
  P5703 (opLexA::G991, G991 is from A. thaliana)
gaaaaatggaagaagaaaagagattggagctaaggctagctcctccttgtcaccaattcacttccaacaacaacatcaatggatctaaacaaaaaagctcgaccaaagaaacatcattcctttccaataacagggttgaggtagctccagtggtgggatggccgccggtgagatcatcccggagaaacctaacggcacaactaaaggaggagatgaagaagaaggagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagatgtttgtatctactgtaaagaggttgcatgttttaaagacctcccacgccttctcactctcacctagaaaacatggcaaggaatagagagaggttggccaaaatcatcagttcgatggtttgtttttaatgtaatttttgtggaaactaatggggtttggctttgatttactggttttctttttcacttatgtactaggtttttgcttgctatgttatttcttgttttggttgtaaatatgctgttcgtttaagaaatcgggggttagtatgttatcgtgtgtataaaaatagtgtaagcacgtaagttgattacaaa

SEQ ID NO: 4403 - DNA, 2990 bp, Artificial Sequence
  P5706 (opLexA::G619, G619 is from A. thaliana)
atttttttccaatctgcaaattttagtctatgtctgttccttgtgctccctcttctcagtacctgcaaatggaggaagaagaatccttctctgaaacccttgttctcatttgattcctccttcctctctcttcttctctctctgtctctgattcgttattccacacttatgactcatctttcccgtcaatagctaagtttgcctcttctttgtgaaatttagctgaaaaaggagaggaattccgaattctgtcacttcaaagctcgaattttgcaaactttcctttgatgggttttacttgttttgttgtaatctgattaaaaatagaaactttttgttttcttcttgtctccttttgctcttaaaagagaagctttttcaatggaatttgacttgaatactgagattgcggaggtggaagaggaggagaatgatgatgtaggagtaggagtaggaggaggaacaagaattgacaagggtaggcttggaatttcaccatcttcttcttcttcatgctcttccggatcatcatcgtcatcatcttctacaggctctgcatcttccatttactctgagctttggcatgcttgtgctggtcctctcacttgtcttcccaagaaaggcaatgtagttgtctatttccctcaaggtcatttggagcaagatgctatggtttcatattcgtctcctcttgaaatccccaaatttgaccttaatccccaaatcgtctgcagggtggttaatgtccagttgcttgctaataaggacaccgatgaggtctacactcaagtcactctgcttccacttcaagagttttcgatgctaaatggggaggggaaagaggtcaaggagttaggaggggaggaagagaggaacggaagctcatccgtcaagcggacacctcatatgttctgtaaaaccttaacagcgtctgacacaagcacacatggaggcttctctgtacctagaagagccgctgaagattgttttgctcctcttgactacaaacaacagaggccatctcaagagctcattgcaaaggacctccatggagtagagtggaagtttcgccatatctatagaggtcaaccaaggaggcatctactcaccactggttggagtatctttgtcagtcaaaagaatctcgtctctggtgatgcggttctctttctgagagacgaaggaggagagctgagattaggaatcagaagagcagcacggccaagaaatggacttcctgactcaatcattgagaagaattcatgttcaaacattctgtctcttgtggctaatgctgtatctacaaaaagcatgtttcatgtgttctacagtccacgagcgacgcatgcagagtttgtgattccttatgagaagtatatcacaagcatcaggagtcctgtttgcataggcacaagatttagaatgcgatttgaaatggacgattctcctgagagaagatgcgctggtgtagtgactggagtctgtgacttggacccgtataggtggccaaactctaaatggaggtgcttgttggtgcgatgggatgagtcttttgtgagtgatcatcaagaaagagtttcaccttgggagattgatccctcggtttctctcccacacttgagcattcagtcatctccaaggcctaaaaggccatgggcaggtttactggatactaccccacccggaaaccccataacaaaaaggggtggttttttggactttgaggagtcggttagaccctctaaggtcttgcaaggtcaagaaaatataggttctgcatcaccctcacaggggtttgatgttatgaaccgccggatactggattttgcgatgcagtctcatgcaaatccagtccttgtgtcgagtagagtcaaggatcgatttggtgagtttgtagatgctactggcgtgaacccagcttgttcaggtgttatggacctggataggtttccaagggtcttgcaaggtcaagaaatttgctcgcttaaatcattcccgcaatttgctggtttcagtccagctgctgctcctaatccctttgcttaccaagccaacaagtcaagttactatccgctagctttgcatgggattaggagcactcatgttccgtatcagaatccatacaatgcgggaaaccaatcctcgggtcccccttcacgtgcaataaactttggtgaagagactagaaagtttgatgcacaaaatgaaggtggcctaccaaataatgttacagctgatttgccattcaagattgatatgatgggaaaacagaaaggcagtgagttgaatatgaatgcttcatcaggatgtaaacttttcggattctccttaccagtggagacacctgcatctaagccgcaaagctcgagcaaaagaatctgtacaaaggttcacaagcaaggaagccaagtggggagagctattgatttgtcgcgacttaacgggtatgatgatctccttatggagcttgaacggctgttcaacatggaagggcttctcagggatcctgaaaaaggatggaggatcttatatactgatagtgagaacgatatgatggtcgttggcgatgatccatggcatgatttctgcaatgtggtgtggaagatacacttatacacgaaagaggaagtggagaatgcgaatgacgataacaagagttgtttagagcaagctgctctcatgatggaagcatcaaagtcatcttctgtgagccagcctgattcttctcctacaatcactagggtttgatacccataaagaagcttatttcctatgttttaaagtgtgttttgctcacaaaagaacttcaactttatctttgtctttgaatccatttatgtgtttgtttgtgtttcttctggtctccatggatgtctcatgtgtaccgttttactcgagagatatgtgagtttatgggatgtgtaaagcatgccattggattttaaggttttcaaaattacaatatatatattagttttgaagttaaaaaa

SEQ ID NO: 4404 - DNA, 1057 bp, Artificial Sequence
  P5826 (opLexA::G921, G921 is from A. thaliana)
ccaagatcgactcttacttcgaatctctctcaactttcttcctcagcttacgggaacttccacacatatacatccacaagaacccatatcgaagattcatcctacatatatttacatggatcagtactcatcctctttggtcgatacttcattagatctcactattggcgttactcgtatgcgagttgaagaagatccaccgacaagtgctttggtggaagaattaaaccgagttagtgctgagaacaagaagctctcggagatgctaactttgatgtgtgacaactacaacgtcttgaggaagcaacttatggaatatgttaacaagagcaacataaccgagagggatcaaatcagccctcccaagaaacgcaaatccccggcgagagaggacgcattcagctgcgcggttattggcggagtgtcggagagtagctcaacggatcaagatgagtatttgtgtaagaagcagagagaagagactgtcgtgaaggagaaagtctcaagggtctattacaagaccgaagcttctgacactaccctcgttgtgaaagatgggtatcaatggaggaaatatggacagaaagtgactagagacaatccatctccaagagcttacttcaaatgtgcttgtgctccaagctgttctgtcaaaaagaaggttcagagaagtgtggaggatcagtccgtgttagttgcaacttatgagggtgaacacaaccatccaatgccatcgcagatcgattcaaacaatggcttaaaccgccacatctctcatggtggttcagcttcaacacccgttgcagcaaacagaagaagtagcttgactgtgccggtgactaccgtagatatgattgaatcgaagaaagtgacgagcccaacgtcaagaatcgattttccccaagttcagaaacttttggtggagcaaatggcttcttccttaaccaaagatcctaactttacagcagctttagcagcagctgttaccggaaaattgtatcaacagaatcataccgagaaatagtttagcttcaaattccgttagagtttttagatt

SEQ ID NO: 4405 - DNA, 1378 bp, Artificial Sequence
  P5839 (opLexA::G222, G222 is from A. thaliana)
ctcttcaagcttatagaacctccaagaaccataaaactctctctgcaacaatctatactttcttcattacttttataaaaaatgggaagacattcttgttgttttaagcagaagctaagaaaaggcctttggtctcctgaagaagatgagaaacttctcaattacatcactagacatggtcatggctgttggagttctgtccctaaactcgcaggtttggtctctatgtgctcttatattatatatagcttaaagaggtttatatagcatcgtttataatgtttttatatgcgttggtggatatatatgatcaaataggtttgcaaagatgtggaaagagttgtagacttaggtggataaattatttgagaccagatttaaagagaggagctttctctcaagacgaagaaagcttgatcattgagctccatgctgcattaggcaacaggttcattaatttgcaacacatttatatagttttgaatttataatgtatattgtgtatatatatatatatgttaaaaaaaaaatctttggttcatattgaatatgtagatggtctcaaatcgcaacgcggttaccgggaagaacagacaacgagatcaaaaacttttggaactcatgtcttaagaagaagctgagaagaaaaggcattgacccaacaacacataaacccttaataacaaacgagcttcaatctcttaacgtcatagatcagaaactgacgtcatcagaagtagtaaagtcaacgggttcgataaacaacctacatgatcagtcaatggtcgtctcatcgcaacaaggtccatggtggttcccggcgaatacaactacgactaatcaaaactctgcgttttgctttagttcaagtaatactacaacggtttcagaccagatcgtatctttaatctcttcaatgtctacgtcatcatctccgacaccaatgacttcaaacttcagtcctgctccaaacaactgggaacaactcaactactgcaacacagtaccaagtcagagcaacagtatctacagtgccttctttggtaatcaatacacagaagctagccaaaccatgaacaataataatccactagtagatcaacatcatcatcatcaagacatgaagtcatgggcatcagagattcttcattacacagaacacaaccaaagctcagaaactgttatagaagcagaagtgaagccagacattgccaactactactggagatcagcatcatcatcgtcgtcaccaaaccaagaagctgcaacattactacacgatgctaacgtggaagtgtacggtaaaaatctacaaaagcttaataacatggtgtttgatcagagcctttagattattaacatgtgttatagagagttt

SEQ ID NO: 4406 - DNA, 3304 bp, Artificial Sequence
  P5842 (opLexA::G217, G217 is from A. thaliana)
gttccaaccctaatctagggttactctctctctcgcttccttctgttcttcgttcttaccgagttccacgagcattagcttcagagaccttgaattggagtgcggttggatcaaaaacagttgagcgaagatgaggattatgattaagggaggtgtttggaagaacaccgaagatgagattctcaaagccgccgtgatgaagtatggtaagaaccaatgggctcggatctcgtctcttctcgttcgtaagtctgctaaacagtgtaaagctcgctggtacgagtggctcgatccatctatcaaaaaggtaagtcgtgttcgcgttttccttctcttaactagtagtgttcgaaaaaaaactatggatctggcgaacatttttttgtttggggatttggccttttaggtagtttgttagcttgttactaggtgctttagttgtatatatgtattgatttgcatctggaaattcatagaaagtgtaggcagtaatgctaggagttttggagtattcgaaggttttcttatgtttttgaattacaactgagtttaattttgtgatgttaatgtagactgaatggaccagagaagaagatgagaagcttctacatcttgctaaacttctgcctactcaatggagaactattgctcctattgtgggtcgtacaccatctcaatgtcttgagaggtatgagaagctccttgatgcagcatgcactaaggatgaaaattatgatgcagcggatgatccacgaaaattacgtcctggtgagattgatccgaacccagaagcaaagcctgctcgtcctgatccggtagacatggacgaagatgagaaagaaatgctttctgaagcaagagctagattggctaacacgaggggaaagaaggctaaaagaaaagctagagaaaaacaacttgaggaagctagaaggcttgcttctctgcaaaaaagaagagaactaaaagcagctgggattgatggaaggcataggaaaagaaagagaaagggaatcgactataatgcagaaattccttttgaaaagagggcacctgcgggattttatgatactgcggatgaagatcgtcctgctgatcaagtaaaatttccaactaccattgaagaacttgaaggaaaaagaagagctgatgtagaagcacatttacgcaaacaagatgttgcaaggaataaaattgctcagagacaggatgctccagcagctatattgcaagcaaacaagctgaatgatccggaagttgttaggaagaggtcaaagctgatgttaccaccaccgcagatttcagaccacgagctagaagaaattgctaagatgggctatgccagtgaccttcttgccgagaatgaggagctaacagaaggcagtgctgctactcgtgcacttttggcaaattactcacaaacaccaaggcaaggaatgacacccatgaggacacctcaaagaactcctgctggtaaaggtgatgctattatgatggaagcagaaaacctggccagattaagagactctcagacacctttgctaggaggagaaaatcctgagttgcacccttctgacttcactggggtcactccgagaaagaaggagattcaaacgcctaatccaatgttgaccccttcaatgactcctggtggtgctggtcttactccaagaattggcttgacgccatcaagggatgggtcttctttttctatgacacccaaagggactcccttcagggatgaacttcacattaacgaagacatggacatgcacgaaagtgcaaaacttgagaggcagagacgagaggaagctagaaggagtttacgctctggtttgactgggcttcctcagccaaagaacgagtaccaaatagttgcacaacctcctcctgaggaaagtgaagagccagaagagaaaattgaggaagacatgtcagacaggatagcgagggaaaaggcggaggaagaagcaagacaacaggcattgcttaagaagagatccaaggtcttgcagagagatcttcctagacccccagctgcttcattggcagtaattaggaactcgttgctttcagctgatggagacaaaagttctgttgttcctcctactccgattgaggttgcagataaaatggtaagagaggagcttctacagttgctggagcatgataatgcaaagtatccgcttgatgacaaagctgagaagaagaaaggagccaagaaccgtaccaaccgttctgcttctcaagttcttgcaattgacgattttgatgaaaatgagctccaagaggtatgtagatgaaaatatctatccaatttcagtttacttttgttttgttttttggttgattaattcgttggccagcttctggaatccttagttctctcttggtttaggctagattgtttgattgataatttttgcatgaatgttaatccctccttaattatcaacatctgtaattaatttggtatacactagggagttttgaatgaaggttgttgcttatgatttttggtaggctgacaaaatgataaaggaggaggggaagtttctgtgtgtgtcaatgggacatgagaacaagacacttgatgattttgtagaagctcacaacacatgcgtgaatgatctcatgtatttccccactcgaagcgcttacgagctctcaagtgttgctgggaacgcggacaaagttgcagcttttcaggaggagatggagaatgtgagaaaaaagatggaggaggatgagaagaaggcagaacacatgaaggccaagtacaaaacttatacaaagggtcatgaggtaacatatagtccacattgccttaaatgttaattctgaaactatattttgtttggtgtcaatgtttaacggatttgtacatttgacagaggagggcagagaccgtgtggacccaaatagaggcgacattgaagcaggctgagattggtggaacagaagtagagtgctttaaagcattgaagaggcaagaagagatggctgcatcttttaggaaaaagaatttgcaagaggaagtgataaagcaaaaggaaacagagagtaaactgcagactcgctatgggaatatgttggcaatggttgaaaaagcagaggagataatggtcggtttccgagcacaggcattgaagaaacaagaggatgttgaagattctcacaaactgaaagaagctaagctagccactggagaggaagaggacatagccatagccatggaagcttctgcataaaaacttgagttttgtattgcttacaagttttaaggagacgtagcttgactttg

SEQ ID NO: 4407 - DNA, 1148 bp, Artificial Sequence
  P5843 (opLexA::G239, G239 is from A. thaliana)
gcacattgcttaatcacttcaaatctaatccacaaaaccattcacaccatctcatcttctttctctctatctcttttcctttcctcatttaaagtttctttataagaaatggaagattacgagcgaataaactcaaactctccaacacatgaagaagattctgatgtacggaaaggtccatggaccgaggaagaagatgcaatcctagtcaacttcgtctctatccatggcgatgctcgttggaaccacatcgctcgttcctctggtatcatcaaaacatcaatctctaaatatacatatacacaaaggctttatatatagataaacttatatatattttactcatatatgtgcagggctaaagcgaactggtaagagttgtagattaagatggcttaattacttacgtccagatgttagaagaggcaacatcactctcgaagaacaatttatgatcctcaaactccattctctttggggcaataggtacacactatatatctcaaatgttaatattttgctattctatatgttactagttaagtatgttattaatatatgtcttttttttcaattgaatatataaggtggtcgaagattgcgcaatatctaccgggaagaacagataatgaaataaagaattattggagaactcgagtccaaaagcaagccaaacacctaagatgcgatgttaacagtaatcttttcaaggagactatgagaaatgtttggatgccgagattagtggaacgaatcaacgcccaatcattacccaccacgtgtgaacaagtggagtcaatgatcaccgacccaagtcaaccagttaacgaaccgagtccggtcgagccgggtttcgttcaattcagccagaatcatcatcagcaattcgtaccggctacggaattgtcagcaacgtcttcgaattctccggctgagacgttttcggacgttcgaggtggggtggtgaacgggtcaggttatgatccgtcgggtcaaacgggtttcggagagttcaacgattggggctgtgttggtggggacaacatgtggactgacgaggagagtttttggttcttgcaggaccagttctgccccgatacgacatcgtattcgtataattaaggaaatatacgattactatacgtaac

SEQ ID NO: 4408 - DNA, 1293 bp, Artificial Sequence
  P5883 (opLexA::G1480, G1480 is from A. thaliana)
acgtgtcaacttttcattcgatctagatggatacccatggaccccacatggatagactcattgacacgctcatgtgaagccaatagtaacaccaaccacaaaagaaagagagagagagagacactgaaacatagagagaagaaaaagaagaggtttagagagagaaaaatggcgtcaaagctctgcgattcgtgcaaatcagcgacggcggcgttatactgccgaccagacgcagcgtttctatgcttaagctgcgattcaaaagtccacgcggcgaacaaactcgcgtcacgacacgcgcgcgtgtggatgtgtgaagtgtgcgagcaagcaccggcacacgtcacgtgcaaagcagacgcggccgcgttatgcgtcacgtgcgaccgtgatatccactcggctaatccgttagctcgccgtcacgaacgcgttcccgttactccgttttacgattccgtctctagtgacggttccgttaaacacaccgccgttaatttccttgacgactgttacttctccgatatagatggtaacggaagccgtgaagaagaggaggaagaagctgcttcgtggctgttacttcccaatccaaagactacaacgacggcgacggcggggatcgttgctgttacttcagctgaggaagttccgggagatagtccggagatgaacactggtcaacagtatttgttctcggatccggatccgtatctggatctggattatggaaatgttgatccgaaggtggaatcgttagagcagaatagctccggtactgatggtgttgttccggtggagaatcggacggttaggattccgacggtgaacgagaattgctttgaaatggattttaccggaggatctaaaggctttacttatggtggtggttacaattgcatcagtcacagcgtgtcatcatcgtcgatggaagtgggagtggtgccagatggtggttcggtggctgatgtatcgtatccttacggtggtcctgcaaccagtggagctgatccggggacacagcgggctgttccgctgacttcagctgagagagaagcgagggtaatgaggtacagagagaagaggaagaacaggaagtttgagaagactataaggtatgcttcaaggaaagcgtatgcggaaatgagaccgagaatcaagggacggtttgcgaagcggacggatacaaatgagagcaatgatgtggttggtcatggtggtatctttagtgggttcggacttgtacctacattttagatattgagagagggagagactctaaaatggaagaga

SEQ ID NO: 4409 - DNA, 853 bp, Artificial Sequence
  P5884 (opLexA::G1811, G1811 is from A. thaliana)
tatctctctctcatcactatttgccatctctttctctctccctctctttcaaatgtcaataaaccaatactcaagcgatttccactaccattctctcatgtggcaacaacagcagcaacaacaacaacaccaaaacgacgtcgtggaagaaaaagaagctcttttcgagaaacccttaaccccaagtgacgtcggaaaactcaaccgcctcgtcatcccaaaacagcacgccgagagatacttcccactagcggccgccgccgcagacgccgtggagaaaggacttctcctctgctttgaggacgaggaaggtaaaccatggagattcagatactcgtactggaacagtagccagagttatgtcttgaccaaaggctggagcagatacgtcaaggagaagcaccttgacgccggagacgtcgttctcttccatcgacaccgttcagacggcggaagattcttcattggctggagaagacgcggtgactcttcttcctcctccgactcttatcgccatgttcaatccaatgcctcgctccaatattatcctcatgcaggggctcaagcggtggagagccaaagaggcaactcgaagacattaagactgttcggagtgaacatggagtgccagctagattcggactggtccgagccatccacacctgacggttctaacacatatacaaccaatcacgaccagtttcatttctaccctcaacaacaacactatcctcctccgtactacatggacataagtttcacaggagatatgaaccggacgagctagaagcccacaaggattaaaaaaaagcttcacatctggtcctgttatgttgtcatagatgttgattcc

SEQ ID NO: 4410 - DNA, 1245 bp, Artificial Sequence
  P5885 (opLexA::G2318, G2318 is from A. thaliana)
aggtaaagaatctgacccattcacatatgcgtttcaaaaacactatcatgtccaccacacgattaaaccaaagagaagagagagagagagagaaacagagaagaaaagattgaagcaatcgaatggagagtgtggtggcaacatggagcagagaagaagagaaagcattcgagaacgcaattgcgttgcattgtgtagaggaagagataacagaggatcaatggaacaaaatgtcgtcaatggtaccaagcaaagccttagaagaagtaaagaaacattaccaaatccttttagaagatgtcaaagcaatcgagaatggtcaagttcctttacctcgttatcatcaccgcaaaggtctcatcgtagatgaagcagcagcagcagctacttctcctgccaacagagactctcattcctctggatcatctgagaagaaaccaaatcctggcacctccgggataagtagctccaatggaggaagaagtggtggctcgagagctgagcaagagagaagaaaagggattccatggactgaagaagagcatcggtttcttcttcttctccttcatctccatcatctatccattgatattatttagacttaaaagagtgaaaaaagatttggaagattctttacctttattgaatactctgttttgtttggaaggttgtttcttttgggtttggacaagtttgggaaaggagattggagaagcatttcaaggaactttgtgatctcaagaactccaacacaagttgcaagtcatgctcaaaaatacttcatcaggcttaactcgatgaaccgagatagaaggcggtctagcattcacgacatcaccactgtgaacaatcaagctcctgcggttacaggaggaggacaacaaccgcaagtggttaaacatagaccagctcagccacaaccacagccacaaccgcaaccacaacaacatcatcccccaacaatggctggattagggatgtatggtggtgcgccagtgggacaaccgatcatcgcaccacctgatcatatgggttcagctgttggaacacctgtgatgcttccacctccaatgggaactcatcatcatcaccatcaccatcatcttggagttgctccttatgctgtaccggcttatccggtaccgccattaccgcagcaacatccagctccgtcgacaatgcactgactgaaaacaatacagttggtattaaaactgacatatattgtactgaaaacttgtgtac

SEQ ID NO: 4411 - DNA, 2332 bp, Artificial Sequence
  P5886 (opLexA::G1855, G1855 is from A. thaliana)
ttgtttctgtctcagtctctatcttagataaagattcagtctttgcactcaagaatggcgaaagagaacagtggtcatcatcaccaaacagaagcaagaagaaagaaactaactttgattcttggtgtaagtggactctgcattttgttctatgttttaggtgcatggcaagccaataccgtcccatcttctatctcgaagctcggatgcgagacgcaatcaaacccttcttcgtcctcttcctcttcctcatcttcagagtcagctgaactagatttcaaaagccataatcagattgagttaaaggaaacaaaccaaaccattaagtactttgaaccatgtgaattatctctcagtgagtacactccttgtgaagaccgacaaagaggaagaagattcgataggaacatgatgaaatatagagaaagacattgtcctgtaaaagatgagcttctttattgtttgattcctcctccaccaaactacaagattccatttaaatggccacaaagtagagactatgcttggtatgacaatatccctcacaaggaacttagtgttgagaaagcagttcaaaactggattcaagttgaaggtgaccgctttagattccctggtggtggtactatgtttcctcgtggagctgatgcttatatcgatgatattgctaggcttattcctcttactgatggtggaatcagaacagctattgacactggatgtggtgtaagtgtttcattgtaagagtatacgtatacacttctttttgatcattgtttgattcaatatctgttttttatattaggttgcaagttttggtgcttacctcttgaagagagacattatggctgtgtcttttgctccaagagacactcatgaagctcaggtacagtttgctttagaacgcggagttcctgcgataatcgggattatgggatcaagaagacttccttatccagctagagcttttgatcttgctcattgttctcgttgtttgatcccttggtttaaaaatggtaatgatttgactctgtttctgttcatagctgaggaagaaacataacactgaaatcttttgtagatggtttgtaccttatggaggtcgaccgggttttaagaccgggcggttactggatcctctcgggaccaccgattaactggaaacagtactggagagggtgggagagaacagaggaggatttgaagaaagagcaagattcaatagaagatgtagcaaagagtctttgctggaagaaagtaactgaaaaaggtgacttatcaatttggcaaaagcctctcaatcacattgagtgtaaaaagctcaaacaaaacaataagtcacctccgatatgcagctcagataacgcggattccgcttggtaatactaatttacatctcgaaaatgtagtcttaactttgtgaaagaacaatgtcaaaacttggttttctctgttttaggtacaaagacttggaaacttgtataacaccattaccagaaacaaacaatccagatgattcagcaggcggtgcactcgaggattggccagaccgagcattcgcggtacctccaagaatcatcagaggaactataccagaaatgaacgcggagaaatttagagaagacaacgaggtttggaaagagagaatagcacattacaagaagatagtccctgagctttcacatggaagattcaggaacattatggacatgaacgcttttctcggcggattcgctgcttccatgctgaaatatccctcatgggtcatgaacgttgtcccggtcgatgcagagaaacaaacgttaggtgtgatctacgaacgtggattgatagggacgtatcaagattggtgtgaaggattctcaacgtatccaagaacttatgatatgattcatgcaggaggattgttcagcttatacgaacataggtaaagtttcatggtcttccaactcaaaactatatccgtgaaacgcgactaatggaatgttctttgtgtatgttttaaggtgtgatttgacgttgatattgttggagatggatcgaattttgagaccagaaggaacagttgtgttgagagataatgtggagacgttgaataaggtagagaagatagtgaagggaatgaagtggaagagtcaaattgttgatcatgagaaaggtccttttaatcctgagaagattcttgttgctgttaaaacttattggactggtcaaccttctgacaagaacaacaacaacaacaacaacaacaacaactagtgttccaactctctaggaactcttcactcttttgttgttgttgtgttttttttactttacgcagattctgatt

SEQ ID NO: 4412 - DNA, 1408 bp, Artificial Sequence
  P6000 (opLexA::G562, G562 is from A. thaliana)
agattcttgtagaaagagtcattgttctcttgagtgggaaaccttgaaaccattcctatgggaaatagcagcgaggaaccaaagcctcctaccaaatcagataaaccatcttcacccccggtggatcaaacaaatgttcatgtctaccctgattgggcagctatgcaggcatattatggtccaagagtagcaatgcctccttattacaattcagctatggctgcatctggtcatcctcctcctccttacatgtggaatcctcagcatatgatgtcaccatctggagcaccctatgctgctgtttatcctcatggaggaggagtttacgctcatcccggtattcccatgggatcactgcctcaaggtcaaaaggatccacctttaacaactccggggacgcttttgagcatcgacactcctactaaatctacagggaacacagacaatggattgatgaagaagctgaaagagtttgatgggcttgctatgtctctaggaaatgggaatcctgaaaatggtgcagatgaacataaacgatcacggaacagctcagaaactgatggttctactgatggaagtgatgggaatacaactggggcagatgaaccgaaacttaaaagaagtcgagagggaactccaacaaaagatgggaaacaattggttcaagctagctcatttcattctgtttctccgtcaagtggtgataccggcgtaaaactcattcaaggatctggagctatactctctcctggtgtaagtgcaaattccaaccccttcatgtcacaatctttagccatggttcctcctgaaacttggcttcagaacgagagagaactgaaacgggagcgaaggaaacagtctaatagagaatctgctagaaggtcaagattaaggaaacaggccgagacagaagaacttgctaggaaagtggaagccttgacagccgaaaacatggcattaagatctgaactaaaccaacttaatgagaaatctgataaactaagaggagcaaatgcaaccttgttggacaaactgaaatgctcggaacccgaaaagagagtccccgcaaatatgttgtctagagttaagaactcaggagctggagataagaacaagaaccaaggagacaatgattctaactctacaagcaaattccatcaactgctcgatacgaagcctcgagctaaagcagtagctgcaggctgaatcgatggtaattcatgtcgatttctacttaatttgtcgacataaacaaagaaaataagtgctactaatttcagaaaaacttgatagatagatagtatagtagagagagagagagagagagaggtgtgatgattattgatctataaattttcggagagagagagggagaaagagaaacttttcctccagatgaaaatttgtg

SEQ ID NO: 4413 - DNA, 1226 bp, Artificial Sequence; identical to SEQ ID NO: 1159
  P6001 (opLexA::G598, G598 is from A. thaliana)

SEQ ID NO: 4414 - DNA, 914 bp, Artificial Sequence
  P6002 (opLexA::G658, G658 is from A. thaliana)
cctccaaatacacgtagagagatacatatatacatatagagatcaacaaagatgggaagatcaccatgctgcgagaaagctcacatgaacaaaggagcttggactaaagaagaagatcagcttcttgttgattacatccgtaaacacggtgaaggttgctggcgatctctccctcgcgccgctggattacaaagatgtggtaagagttgtagattgagatggatgaattatctaagaccagatctcaaaagaggcaattttactgaagaagaagatgaactcatcatcaagctccatagcttgctcggtaacaaatggtctttaatagctgggagattaccaggaagaacagataacgagatcaagaactattggaacactcatatcaagaggaagcttctcagccgtgggattgatccaaactctcaccgtctgatcaacgaatccgtcgtgtctccgtcgtctcttcaaaacgatgtcgttgagactatacatcttgatttctctggaccggttaaaccggaaccggtgcgtgaagagattggtatggttaataattgtgagagtagtggaacgacgtcggagaaggattatgggaacgaggaagattgggtgttgaatttggaactctctgttggaccgagttatcggtacgagtcgactcggaaagtgagtgttgttgactcggctgagtcgactcgacggtggggttccgagttgtttggagctcatgagagtgatgcggtgtgtttgtgttgtcggattgggttgtttcgtaatgagtcgtgtcggaattgtcgggtttctgatgttagaactcattagagagtcaatcgagaattctttaggaatctttttatatatttagatcgtcaattgtgttttttttttgttcacatttgttatgtaacatc

SEQ ID NO: 4415 - DNA, 1655 bp, Artificial Sequence
  P6019 (opLexA::G1439, G1439 is from A. thaliana)
ctctgaagtgattatttagcactactttttctttgtctccttctgaatccattttttatggatcttggagttcgtgtttctggtcatgaaaccgtttcttctccgggtcaaactgaactcggatctggtttcagtaacaagcaagaaagatccggtttcgatggtgaagattgctggagaagttcaaagctctcacgaacatcaactgatggattctcttcttcccctgcctctgctaaaacgctgtcgtttcatcaaggcatccctttactgagatctaccactattaatgatcctcgtaaaggacaagaacacatgcttagcttctcttctgcttcaggcaaatcagatgtctcaccttatcttcagtactgtagaaactcaggatatggtttaggaggaatgatgaacacaagcaacatgcatggaaacttgttgacaggagtaaaaggacctttttcattgactcagtgggcagagctagagcaacaggcgttgatctataagtatatcacagccaatgtccctgttccatctagtttacttctctctctcaagaaatcttttttcccttatggttccttgcctcctaattcttttggatggggctcttttcatctgggcttttccggtggtaacatggatcccgagccagggagatgtcgccggacagatggaaagaaatggcggtgctcgagggacgctgttcccgatcaaaagtactgtgaacgacatattaacagaggccgccatcgttcaagaaagcctgtggaaggccaaaatggccacaatactaatgctgccgccgctgcttctgctgctgccgcttctaccgctgctgctgtgtccaaagcggcagcggggacttcagctgttgcgatgcgtggatcagataataacaatagccttgccgctgctgttggaacacaacatcataccaataatcaatctacagattctttggctaacagagttcaaaattctcgaggggcttcggtttttcctgccacgatgaacttacagtcgaaggaaactcatccgaaacaaagcaataatccctttgaattcggactcatctcttctgattcgttacttaatccgtcgcataaacaagcctcgtatgcaacctcttccaaaggctttggatcgtatcttgacttcggcaaccaagccaagcacgcggggaatcacaacaatgtcgattcttggcccgaagagctgaaatcggattggactcagctctcaatgtcaatccctatggctccatcttcccctgttcaagataaacttgcactctcacctttaaggttatcgcgtgagtttgaccccgcgatccacatgggattaggcgtcaacaccgagtttcttgaccccgggaaaaagacgaataactggataccaatctcctggggtaataacaactccatgggaggtccactcggcgaggtactaaacagcacgaccaatagtcccaagtttggttcctctccaacaggcgtcttgcaaaagtcgacatttggttctctttctaacagcagctcggcaagcagcaccatcattggcgataacaacaataagaacggtgatggaaaagatccgcttggcccgaccacgctgatgaatacttctgctactgctccttctctgtgaaactg

SEQ ID NO: 4416 - DNA, 1460 bp, Artificial Sequence
  P6038 (opLexA::G8, G8 is from A. thaliana)
taatcgttgttgctgtagaagacgatctctaacaactgattccttcatcatcaccttcgctagatttgtaattttcagagcttgagatgttggatcttaacctcaacgctgattctcccgagtcgactcagtacggtggtgactcatacttagatcggcagacatcagacaactccgccgggaatcgagtggaagagtccggtacatcgacgtcgtcagttatcaatgccgatggagacgaagactcttgctctactcgagctttcactctcagtttcgatattttaaaagtcggaagtagtagcggcggagacgaaagccccgccgcttcagcttccgttactaaagagttttttccggtgagtggagactgtggacatctacgagatgttgaaggatcatcaagctctagaaactggatagatctttcttttgaccgtattggtgacggagaaacgaaattggtaactccggttccgactccggctccggttccggctcaggttaaaaagagtcggagaggaccaaggtctagaagttcacagtatagaggagttactttttatagaagaactggtcgatgggagtcacatatttgggattgtgggaaacaagtttatttaggtggtttcgacactgctcatgctgcagctagagcttatgatcgagctgctattaaatttagaggtgttgatgctgatatcaactttactcttggtgattatgaggaagatatgaaacaggtacaaaacttgagtaaggaagagtttgtgcatatactgcgtagacagagcacggggttttcgcgggggagttcgaagtatcgaggggttacgttacacaaatgtggtagatgggaagctaggatggggcagtttcttggtaaaaaggcttatgacaaggctgcaatcaacactaatggtagagaagcagtcacgaacttcgagatgagttcataccaaaatgagattaactctgagagcaataactctgagattgacctcaacttgggaatctctttatcgaccggtaatgcgccaaagcaaaatgggaggctctttcacttcccttctaatacttatgaaactcagcgtggagttagcttgaggatagataacgaatacatgggaaagccggtgaatacacctcttccttatggatcctcggatcatcgcctttactggaacggagcatgcccgagttataataatcccgccgagggaagagcaacagaaaagagaagtgaagctgaagggatgatgagtaactggggatggcagagaccggggcaaacaagcgccgtgagaccgcagccaccgggaccacaaccaccaccattgttctcagttgcagcagcatcatcaggattctcacatttccggccacaacctcccaatgacaatgcaacacgtggttacttttatccacacccttaacttgtaaggggacatatgagagtt

SEQ ID NO: 4417 - DNA, 1808 bp, Artificial Sequence
  P6042 (opLexA::G722, G722 is from A. thaliana)
aatctttgacggcgatgactatggagcaagaaattgaagtcttggaccagtttccggttgggatgagagttcttgctgttgacgatgaccagacttgtctccgtattctccagactttgcttcagcgctgccaatatcacgttacaacaacgaatcaggcacagaccgcattggagttgttgagggagaacaagaataagtttgatcttgttattagcgatgtcgacatgccagacatggatggtttcaagctgcttgagcttgttggtcttgaaatggacttacctgtcataatgttatctgcgcatagcgatccaaagtatgtgatgaaaggagtcaagcacggtgcctgtgattatctgcttaaaccggttcgaattgaggagcttaagaacatatggcaacatgttgtgagaaagagcaaacttaagaagaataagagcaatgtgagtaatggttcaggaaactgtgataaagcaaacagaaaacgtaaagaacagtatgaagaggaggaagaggaagaaagagggaatgataatgatgatccaacggcgcagaagaagcctcgtgttctttggacgcatgagctgcacaataaattcctagcagctgttgatcatttaggcgttgagagagctgttccaaaaaagattctagatctgatgaatgttgacaaactcactagagagaatgttgcaagccaccttcagaaattccgcgttgctctgaagaaggtgtctgatgacgccattcaacaagctaacagggcggctattgactcacattttatgcaaatgaattctcagaaaggacttggtggcttctaccaccaccaccgcggaatacctgttggatccggtcagttccatggtggaaccacaatgatgaggcattactcttcaaataggaatcttggtcgtctgaattcccttggagcaggaatgttccaaccagtctcatcatcgtttcctcgtaaccataatgatggaggaaacatacttcagggtttgccgctagaagagcttcagatcaacaacaacatcaacagggcttttccaagctttacttcacaacaaaactctccaatggtagctcccagtaatctgttacttctcgagggtaacccgcagtcatcatctttaccctcaaacccgggtttttctcctcatttcgagatcagcaagcgtctagaacattggtcaaacgctgcattgtcaaccaacattccacagagtgatgttcattcaaaacctgacaccttggaatggaatgcgttctgcgactcagctagtccgctagtaaacccaaacctggatacaaatccggcatctctctgcagaaacacgggttttggatccacaaatgctgcacaaacagacttcttttatccattacagatgaatcagcagcctgcaaacaactcaggtccagtgacagaagctcaactgtttagaagtagcaatccaaacgaaggtttactcatgggacaacagaagcttcagagtggtttgatggcttctgatgctggttccttagatgatatagtcaattccttaatgacacaggaacagagccaatctgatttctcggaaggtgattgggatttggatggtttagctcactcggaacatgcatacgagaaactccattttcccttttctttgtcagcttgagaaacctgttttattcagacacaatcaattattattatcttttggttctgtctcttctctcttctctgtaatgaaagtgtaagctattgtttaccgctcccccactggtttgagcaacttaggaagatccaaatc

SEQ ID NO: 4418 - DNA, 2847 bp, Artificial Sequence
  P6044 (opLexA::G415, G415 is from A. thaliana)
gcgggtaactagaagtagtggatctggtttgaagcagacaaatgtagataatggaggagagattagtccaactgttgacagagtatctgaacaaggcaaatcatcagaggcagggagtcacatgccaactgatgcaaacggaaatggacatttgcatcatgagattatggatcatggaaaggggaatgaagaacagaaaccaacccctcaaaccgtgaagaaggattctaataccaataccaaattttcagggtctcatcgtgagcttgtcatcggtcttccttgccgtggacaatttgaaatccacaaccggtccagggcatctacgagttcgaagaggttaggaggaggtggagaaaggaatgtgttgtttgcaagtcacaagagagctcagagatctaaggaagatgctggaccatcttcggttgttgctaattccacacctgtaggtcgaccaaagaaaaagaataagactatgaacaaaggacaagttagagaagatgatgagtacacaagaatcaaaaagaaacttcgatactttctaaaccggattaactatgagcaaagcctaattgacgcctattcgttagaaggctggaaaggttcaaggtttgtctcttgatgacatttgttttccctcttattcatgcattatttgagagttataggtatcctctgtgagatatatttctgatctcactcagtcttgttgattatgtgttctttgtagcctggaaaagataaggccagagaaagagcttgaacgagccacaaaggaaattttgcggcgcaagcttaaaattagagatctttttcagcaccttgacacactctgtgctgaaggaagccttccagagtctttatttgatactgatggagagatttctagcgaggatgtaagagaatattgttctgaactcaacctttgttcccttgtttatcctgatagaaccagtttgtgtctctagaagtattgataatacgagcagttgtttaatcgcagatcttctgtgcaaaatgtggttcaaaggacttgtctgttgataatgatatcatactatgcgatgggttttgcgatcgaggctttcaccaatactgtcttgaaccacctctgcggaaagaagatagtaatattctctgcctacgtacttggtagtgttttaagcagttcttgctggtatctacagctgtcttttttgttggttttaatttttgtagttcctccggatgatgagggttggctatgccccggatgtgattgcaaagatgacagcttggacttgcttaatgattctttagggacaaaattttcggtcagcgacagttgggaggtatataactatatatgttgaggtttttattgttaaagaggagaaaacacttaaaaacacacctgccttgaacttttgtgtagaaaatatttcctgaggcagcagcagcgctggttggtggaggtcaaaatcttgactgtgatcttccttcagatgattctgatgatgaagagtatgatccagattgtttgaatgataatgaaaatgatgaagatggcagtgatgacaatgaagaatctgagaacgaagatggtagttctgatgaaactgaattcacatctgcatctgacgaaatgattgagtcatttaaagaagggaaagatataatgaaagatgtaatggcccttccatctgatgattctgaggatgatgactatgatcctgatgccccgacttgtgatgatgataaagaaagttcaaattctgattgtacatcagacactgaagatcttgaaacttccttcaaaggagatgagactaatcagcaagctgaagatacaccacttgaggatcctggcagacagacgtctcagctccaaggtgatgcaattttagagtcagatgttgggcttgatgatggtcctgccggtgtatccagaaggaggaatgttgaaaggctggattacaaaaagttgtatgatgtgagtgatctctctttttcttgataatcgatttctatctggctttggaaaaacctctgaatggtatttttcttctatgtgcaggaggaatatgacaatgttccgacttcgtcaagtgatgatgacgattgggataaaactgcaagaatgggaaaagaagattccgagtcggaagatgaaggggacactgtacctctgaaacagtcttcaaatgcagaagatcatacttctaagaaacttatacggaagtcgaaaagggcagataaaaaggataccttagaaatgccacaagaaggtcctggagaaaatggtggttctggtgaaattgaaaaaagcagctcttcagcatgtaaacagacagatcccaaaactcaggtaaaaagatatagctgtcttgaggctttaaggtgccaatcttacattattatgagggagggagcaatggattgaaaggatccctcttttatgcagagactgtacatatcttttcaagagaatcaatatccagacaaagccacgaaggagagcttagccaaagagctacaaatgacagttaagcaagtaagaagtttctcctagtaaattgtttgtttagttctcccttttagtcgacctagtttcatctctgctaagaactgattatgttctgtaggttaataactggtttaagcataggcgttggtcgataaacagcaaacctttagtttcagaggaaaatgtcgagaagttaaaaacaggcaaggaaggtgaatgtgagacatctgttgctggaagtagcaaacaaactatggaaaccgagtcagttgcagagaaaccaaccaatactggatcacggaaaagaagaagaaagtagactttagattcaatcatgaagg

SEQ ID NO: 4419 - DNA, 1826 bp, Artificial Sequence
  P6050 (opLexA::G1442, G1442 is from A. thaliana)
tgaggggatattacagagttcaggaaataaaaaatatagaaatttgtgttttgtgtttaatgggaacaagagcagaacgcaaggaagattttgttggtgggtttggatttggtgttgtagaaaattcgcataaagacgttatggtgctacctcatcatcactattatccatcatattcatcaccttcctcttcttctttgtgttactgttctgctggtgttagcgatcccatgttctctgtttctagcaatcaggcttacacttcttctcacagtggtatgttcacacccgccggttctggttctgctgctgtgactgtagcagatccttttttctccttgagctcttcaggtttcaagttctcacctttttgttgacttctgagctatgaaaaaattgaattttgttgttatgtgttggttttgatgtgattttggtggataaaatccaggggaaatgagaagaagtatgaacgaagatgctggtgcagctttcagcgaagctcaatggcatgagcttgagaggcagaggaatatatacaagtacatgatggcttctgttcctgttcctccagagcttctcacaccctttcccaagaaccaccaatcaaacactaacccggatggtaagatctccctagcctctcacttaaacgtttcccatttttgtcaatttgtcttggtttcatgtgttcttgatctcttgttatcatgtttgatgcaactaaaagccattatgatggtattagaatgtcaagttttttaccagtgttacctcttagtggatacatataggagtggaatgtttagtatttatgctgattacaagaatctgccgttgtctatgtggatgacagtaactgtggcagtggcgacaggaggctcattgcagctggggattgcttcaagcgcaagcaataacacggctgatctggagccatggaggtgcaagagaacagatgggaagaaatggaggtgctctagaaacgtgattcctgatcagaaatactgtgagagacacacacacaagagccgtcctcgttcaagaaagcatgtggaatcatctcaccaatcatctcaccacaatgacattcgtacggctaagaatgatactagccagcttgtgagaacttatcctcagttttacggacaacctataagccagatccctgtgctttctactcttccgtctgcctcctctccatatgatcaccacaggtgcttttacttacattcttgtagtcaaagtattcaaatccttcccctttgaaatcatttgaaagactgaaacttagtggttgatatgtgaagaggactgaggtggtttacgaaagaagatgatgccattggaaccttaaacccggagactcaagaagctgtccagctgaaagttggatcaagcagagagctcaaacggggattcgattatgatctgaatttcaggcagaaagagccaatagtagaccagagctttggagcattgcagggtctattaagtctaaaccagacaccacaacataaccaagaaacaagacagtttgttgtagaaggaaagcaagatgaagcgatgggaagctctctgacactctcaatggctggaggaggcatggaggaaacagagggaacaaaccagcatcagtgggttagccatgaaggtccatcatggctctattcaacaacaccaggtggaccattggctgaagcactgtgtctcggtgtctccaacaacccaagttctagtactactactagtagctgcagcagaagctcaagctaaacaaatggcgctcgagttccggtttagtgattagaaaccatcgttgttag

SEQ ID NO: 4420 - DNA, 1895 bp, Artificial Sequence
  P6053 (opLexA::G645, G645 is from A. thaliana)
ctttgccactttaatatcttgcacgcatccaatatacctcaccacaccacatcacaacaacgaagaagaagaagaagaagaagagcttcaagaagacaaatacactattttttatcgtctgcaatgcccttaccctttgaagagtttcaagggaaggggatttcttgtttctcttctttctcgtcttccttcccccaaccaccgtcgtctccgcttttgagccaccgcaaagcaagaggcggcgaagaagaagaggaagaagttcccgcggcggagcctacctctgttctggactccctcataagcccaacctcttcctccacggtgtcttcctctcacggcggaaacagcgccgtcggaggcggcggcgacgccaccaccgatgagcaatgcggagccattgggttgggtgattgggaggagcaagttcctcatgaccacgaacagagcattctcggactcatcatgggagattccacagatccctctcttgaactcaacagcattctccaaacatctcccaccttccacgactctgactactcatcacccggtttcggagtcgtcgacaccggcttcggtttagaccaccactctgttccgccgtcacatgtttccggtcttctgatcaaccaaagtcaaacccactacacacagaatcctgcggctatcttctacggccaccaccaccatacacctccgccggcaaagcggctcaaccctggtcccgtggggataacagagcagctggttaaggcagcagaggtcatagagagcgacacgtgtctagctcaggggatattggcgcggctcaatcaacagctctcttctcccgtcgggaagccattagaaagagcagctttttacttcaaagaagctctcaataatctccttcacaacgtctcccaaaccctaaacccttattccctcatcttcaagatcgctgcttacaaatccttctcagagatctctcccgttcttcagttcgccaactttacctccaaccaagccctcttagagtccttccatggcttccaccgtctccacatcatcgacttcgatatcggctacggtggccaatgggcttccctcatgcaagagcttgttctccgcgacaacgccgctcctctctccctcaagatcaccgttttcgcttctccggcgaaccacgaccagctcgaacttggcttcactcaagacaacctcaagcacttcgcctctgagatcaacatctcccttgacatccaagttttgagcttagacctcctcggctccatctcgtggcctaactcgtcggagaaagaagctgtcgccgttaacatctccgccgcgtccttctcgcacctccctttggtcctccgtttcgtgaagcatctatctccgacgatcatcgtctgctccgacagaggatgcgagaggacggatctgcccttctctcaacagctcgcccactcgctgcactcacacaccgctctcttcgaatccctcgacgccgtcaacgccaacctcgacgcaatgcagaagatcgagaggtttcttatacagccggagatagagaagctggtgttggatcgtagccgtccgatagaaaggccgatgatgacgtggcaagcgatgtttctacagatgggtttctcaccggtgacgcacagtaacttcacggagtctcaagccgagtgtttagtccaacggacgccagtgagaggctttcacgtcgagaagaaacataactcacttctcctatgttggcaaaggacagaactcgtcggagtttcagcatggagatgtcgctcctcctgatttccaccggagtttcaattattaaaaaaatattttccttaattcaatttatcttaaatgacaaatttttagtttctgattttattttgctcagt

SEQ ID NO: 4421 - DNA, 1019 bp, Artificial Sequence; identical to SEQ ID NO: 537
  P6056 (opLexA::G2130, G2130 is from A. thaliana)

SEQ ID NO: 4422 - DNA, 1431 bp, Artificial Sequence
  P6061 (opLexA::G1806, G1806 is from A. thaliana)
ccatcatcttcttcttctaagaatcaacaacaatgcagagcagcttcaaaaccgttcctttcactcctgatttctactctcagtcttcttacttcttcagaggagatagttgtcttgaggagtttcatcaaccagtcaatggttttcaccatgaagaagctatcgatttaagtccaaatgtcactattgcttcagctaacttacactacacgacgtttgatacggttatggattgtggtggtggtggtggtggtggcttgagggagagacttgaaggaggagaagaggagtgtttggacacagggcaactagtgtaccagaaagggacaagattagtaggaggaggagtaggagaagtgaacagcagttggtgtgattcggtttcagctatggctgataacagtcaacatactgacacttccacagatattgatactgatgacaagactcagttgaatggaggtcatcaagggatgctattggctacaaattgttcagatcaatccaatgtgaaatctagtgatcaaaggacacttcgtcgacttgctcagaaccgggaggctgctaggaaaagtcggttgaggaaaaaggcatatgttcagcaacttgagaatagtcgaatcaggcttgcacagctagaggaagagctcaaaagagctcgccaacagggatctttggttgaaagaggagtttcagcggatcacacgcatttggcagccggaaatggtgtcttttcatttgaattggaatatacacgttggaaggaagaacatcaaagaatgatcaacgacttaagatcgggtgtgaattcgcagttaggtgacaacgatctacgcgttctagtggatgctgtgatgagtcactatgatgaaatattcaggctaaagggaattggtactaaagttgacgtctttcatatgctctcaggcatgtggaagacacctgccgagagatttttcatgtggttaggtggatttagatcatcagagttacttaagatattggggaaccatgtggatccattgacggaccagcagttgataggcatttgcaaccttcagcaatcgtctcaacaagcagaggatgcattgtcacaaggcatggaagctctacaacaatcacttctcgagacgctttcttctgcttcaatgggtccaaactcttcagcaaatgttgcagattatatgggtcatatggctatggctatgggcaaacttggcactcttgaaaacttccttcgccaggctgatttattgaggcaacaaactctgcaacagcttcacagaattctcaccacacgacaagctgctcgcgcctttttggtcatccacgattatatttctcggcttagagcacttagctctctatggttagccagacctagagactaaataaaaagcctgcatgagtcatgatgaccaaaggaaaagg

SEQ ID NO: 4423 - DNA, 1818 bp, Artificial Sequence
  P6062 (opLexA::G1246, G1246 is from A. thaliana)
ttgaatcggcaagggaagaagctatgatcatgtacggaggaggaggagcagggaaggacggtggatccaccaatcacttatcagacggaggagtgatattgaagaaaggtccatggacggcggcggaagatgagatacttgctgcgtacgttagagagaacggtgaagggaattggaacgccgttcagaaaaacacaggtttggctcgttgcggcaaaagctgccgtcttcgatgggccaatcacctccgaccaaatctgaaaaaaggctctttcaccggtgacgaagaacgtctcatcattcagcttcatgctcagcttggtaacaaatgggctcgcatggctgctcagttaccgggaagaacagacaacgagattaagaactattggaacacgagattgaaacgacttcttcgccaaggacttcctctttatcctccagatattatccctaaccatcaactccatccacatccacatcatcaacaacaacagcaacataaccatcatcatcatcatcatcaacaacaacaacaacatcaacaaatgtattttcaaccacaatcttcacaacgaaacacaccatcatcttcccctcttccatctccaacaccagcaaacgcaaagtcctcatcatccttcacttttcataccacgactgctaacctcctccatccacttagccctcacactccaaacacaccatctcaactctcttccacaccgcctccaccaccactttcctctcctttatgttcccctcgcaacaaccaatacccgacccttcccctctttgccctcccgcgttcccaaatcaacaacaacaacaacggaaatttcactttccctagacctccacctctccttcaaccgccttcatcactcttcgcaaaacgttacaacaatgctaacactcctcttaattgcatcaaccgcgtctcaaccgcaccattttcccctgtttcaagagactcctacacttcctttcttacattgccttacccttccccaaccgctcaaaccgctacttaccacaatactaataacccttactcttcctctccttccttctctttaaacccttcttcttcttcttaccctacatcaacttcttccccaagctttcttcactcccattacactccttcttccacctcatttcataccaacccagtttactccatgaaacaagagcagctcccttcaaaccaaattccccaaatagatggcttcaataacgtcaacaacttcacagacaacgagagacagaatcataaccttaacagttccggtgctcatagaagaagtagtagctgcagcctcttagaggatgtcttcgaagaggccgaagctttagcctctggaggcagaggccgacctccaaaacgaagacaactcacagcttctcttccgaaccacaacaacaacaccaacaacaacgacaacttcttctcggttagtttcggacattatgattcttctgacaacttatgttccttgcaagatttgaaatcaaaggaagaagagtctcttcaaatgaacacaatgcaggaggacatagctaagcttcttgattggggaagtgatagtggagagatctctaatggacaatcatctgttgtcactgacgacaatcttgttcttgatgttcatcaattagcttcactattcccggctgattctacagccgtcgtagccgcaacaaacgaccaacacaacaagaataataacaataattgttcctgggatgacatgcagggaataaggtagaaactatgtctgaaaagaatctacggccaagatcaagaactaacaaagc

SEQ ID NO: 4424 - DNA, 812 bp, Artificial Sequence
  P6063 (opLexA::G2344, G2344 is from A. thaliana)
ttattctaagtagcttgacttgtttagtttaaatatgaggttaatgattttgtggggatttgatagttctggttcttgagtttatttaaaataggtttaccaggatcatgtactgactctgttctttggaacttttcagaattctgcttcggacattaagctcatgagtcatgacttcttcaatccatgagctttctgataacattggaagtcatgagaagcaagaacagagagattctcatttccaaccaccaatcccttctgcaagaaattatgaatcaattgttacaagtttagtctactcagacccggggactacaaattccatggcacctggacaatatccatatccagatccttactacagaagcatatttgcaccgcctccacaaccgtataccggggtacatctacagttgatgggagtgcagcaacaaggcgttcctttaccatctgatgcagtcgaggaacctgtttttgttaacgcaaagcaataccacggtatactaaggcgcagacaatcaagagcaagacttgagtctcagaataaagtcatcaagtcacgtaagccgtatttgcatgaatctcggcatttgcatgcgataagacgaccaagaggatgtggcgggcggtttctaaatgccaagaaggaggatgagcatcacgaagacagtagtcatgaagaaaaatccaaccttagcgctggtaaatccgccatggctgcttctagtggtacatcttgagaaggtcctacaagtagctttgttgtattttggctctgtttggtctcagatcatctatgtcttttagtg

SEQ ID NO: 4425 - DNA, 1722 bp, Artificial Sequence
  P6076 (opLexA::G720, G720 is from A. thaliana)
cggcggtgttggccgcaaaaacgatgcaaaaccagctatggtcattaccgctaacgatttatcaaaatgggaaaattttcctaaaggacttaaggttcttcttctcctcaacggctgtgacagcgacggagatggctcctcagccgccgagactcgatcagagctcgaatcaatggactatatcgttactacattcaccgatgaaactgaagcactctctgcggttgtcaagaacccggagagcttccacattgccatcgtcgaggtgaatatgagcgctgagagtgagagtttcaagtttcttgaggctgccaaagacgttcttcctactataatgatttcaaccgatcattgcatcactactacaatgaaatgcatagcgcttggtgcagttgagttcctacaaaaaccgctctcaccggagaaattaaagaacatttggcagcatgttgttcataaggcattcaatgatggtggaagtaatgtttcgatatcacttaagccagtgaaagaatccgttgtctcgatgcttcatcttgagaccgacatgacaatcgaggagaaagatccagcgccatcaacaccgcaattgaaacaagattcacggttactagacggtgattgccaagagaacataaatttctcgatggaaaatgtaaattcctcgaccgagaaagataacatggaagatcatcaagacatcggtgaatctaaatcagtcgacactacaaaccgcaaattagatgacgacaaagtggttgtcaaagaagagagaggagacagtgaaaaagaagaagaaggtgaaaccggagatctcataagcgagaagacagattcagttgatattcataagaaagaagatgagactaaaccgattaataaatcatccgggatcaagaacgtgtctggtaacaaaactagtcgaaagaaggtggattggacaccagagctgcacaagaagtttgtgcaagcagttgagcaactcggcgttgatcaagcgataccctcgcggattcttgagttgatgaaagtaggcaccttaacaagacacaatgtagctagtcaccttcagaaatttcggcagcataggaagaatattcttccaaaggatgatcataaccatagatggatacaatctagagagaaccatagaccaaatcaacgtaattataacgtttttcaacagcaacaccgtcccgtgatggcttatcccgtttggggtcttcccggtgtttatccgccaggagcgattccacctttgtggccaccgccgctgcagtccattggtcaaccacctccgtggcattggaaaccaccttatccaacggtgagcggtaatgcatggggttgtccggttggaccgcctgtgaccggatcatatattactccttcgaatactaccgccggcggatttcaatatcccaacggagctgaaaccggcttcaaaataatgccggcgagtcagccggacgaggaaatgttagatcaagtggttaaagaagcgataagcaaaccgtggctgccgctaccgctcgggctaaaaccgccgtccgcggagagcgttttggctgagctaacgcgtcaaggcatctcagccgtcccttcttcttcttgtctaatcaacggctctcatcgtctccgctgacgtgtccatgatgaaacagaacccgcagatatgatgacgtcatgcgtggcgtacttgtccgtgtctgacgatccgaa

SEQ ID NO: 4426 - DNA, 1220 bp, Artificial Sequence
  misc_feature (961)..(961): n is a, c, g, or t
  P6149 (opLexA::G36, G36 is from A. thaliana)
aaaaaatgctataattcttcctttttcttgttctttcagagattttgatttctattcaatcgactaagagggtgtgtttttaatccctctctgttttaattttgtttcctagtctttaaagatccatggcagccatagatatgttcaatagcaacacagatccttttcaagaagagctcatgaaagcacttcaaccttataccaccaacactgattcttcttctcctacgtattcaaacacagtcttcggtttcaatcaaaccacatctctcggtctaaaccagctcacaccttaccaaatccaccaaatccaaaaccagcttaaccagagacgtaacataatctctccaaatctagccccaaagcctgtcccaatgaagaacatgaccgctcagaaactctatagaggagttagacaaaggcactggggaaaatgggtagctgagatccgtttacccaagaaccggacccgactctggcttggaactttcgacacagctgaagaagcagccatggcttatgacctagctgcttacaagctaagaggcgagttcgcgagacttaatttcccacagttcagacacgaggatggatactacggaggaggtagctgtttcaatcctcttcattcctctgtcgacgcaaagctccaagagatttgtcagagcttgagaaaaacagaggatattgacctcccctgttctgaaacagagcttttcccgccaaaaacagagtatcaagaaagtgaatatgggttcttgagatctgatgagaattcgttttcagatgagtctcatgtggaatcttcttcgccggaatctggtattactacgttcttggacttttcggattctggatttgatgagattgggagtttcgggctggagaagtttccttctgtggagattgattgggatgcgattagcaaattgtccgaatcttaaacaaagcaaagagaagnctttttcttttaggagtttgtctttcaatttcagtgtcttatattaatctctctgcaactgaaatttttaacagttgcggagagaatcgtctctagggtttgtttctcttcctccatgttttggtctgactggtttatgtcttttttttttttttgaactttcaaaaacctttgtcattgaccaatcggagaagtttccatgtattctctcatctttaaatttctaatgaagaatgtaaattattagtcttttgctaaa

SEQ ID NO: 4427 - DNA, 1461 bp, Artificial Sequence
  P6160 (opLexA::G1072, G1072 is from A. thaliana)
gacactatgtttttttttcttcttcttgtttggatcatataaatctgattttttcccggaaaataccgttgagaacttctccggcgtgagctgaccaggagaaatctgttcttgtgtttagttcaattctcggctgaggaacgttgactgttgactgatagagcaacttcagtgtgttgagactaaacataaagcttcagttaaggataggatttgagaatggaaacaagcgacagaattagccctggtggtggtataggagcagaagttccatcagcgtatcatatggctccgagaccttcagatagccctgctaaccagtttatggggttgtctctccctcccatggaagccccaatgccttcttcaggggaagcctcagggaagaagaggagaggcagacctcgtaaatatgaagctaatggtgctcctttgccttcttcatcagttcctcttgtgaagaaacgagtaagaggcaagctcaatggttttgatatgaagaagatgcataagaccattgggttccattcttctggtgaaaggtttggtgttggtggtggtgttggtggtggtgttggatcaaatttcacgccgcatgtaatcacagtgaacactggtgaggatattactatgagaatcatctccttttcacaacaaggaccacgagctatttgtatcttatcagcaaatggagtgatatcaaacgttactcttcgccaacccgattcttgcggtggtactctcacctacgagggtcggtttgagatactgtctctgtctggttcattcatggaaacagagaatcaaggttcaaaaggtcggtctggtggcatgagtgtatctttggccggtcctgatggtcgtgttgtcggtggcggtgtcgctggcctgctcattgccgccactcctattcaggttgttgttggcagttttataacgagtgatcaacaagatcatcagaaaccgaggaagcaaagagtcgagcatgcccctgcagcagtcatgtcagtgcctcctcctccttctcctcctcctccggcggcttctgttttctcaccgacaaacccggacagagagcagccgccatcttcattcggtatctccagctggaccaacggacaggacatgccgagaaactcagccactgacatcaacatatctttaccagtcgactgagtttgagtttccagatggaagattaggtttcagattaactctctactgtctgtacaatggttaggaggattgttgaagctgaatgttactgtacgcttttctttattttagaacacaacttgagcttcttctacttttagggtaactttctctgatgacttgcctcttgttacttactatattgctagtactgaggtttaatccttttaatggcggattaatctgtgttgttcccttttagttgttttctttattgatattttacactatttagtatcccccaaa

SEQ ID NO: 4428 - DNA, 2008 bp, Artificial Sequence
  P6165 (opLexA::G830, G830 is from A. thaliana)
ccgggtcctcagtatcgggtcagatctagatccggatccggagacgctgagaatgaaacacttcagaactgagcgagtccgtgcgactccgaagctcttcacctacgttctcgtcggtttcatcgctctactcggcttgacttgcctctactacggctcttcgttcgctcccggatccagaaagtccgatgagttcgatggatctaataaccgcgttcgcaccggaatcggatccttgaggaatcgagatattgtgcttgcagtgagccgtttcgaagttcctaaaagtgttccgatatgtgattcgagacactcggagttgataccgtgtttggatcggaaccttcattaccagttgaaattgaaactcaatttatcgttaatggagcactatgagcatcattgtcctccatcagaacggcgtttcaattgccttgttccgcctcctgttggttataagatcccgttaaggtggcctgtgagtagagacgaggtgtggaaggcgaatatcccgcacacacaccttgctcaagagaagtctgatcagaattggatggttgttaatggtgataagatcaattttcctggtggaggaacacatttccacaacggagctgacaaatacattgtttccctggctcagatgctgaaattccctggtgacaaactcaacaatgggggaagcattcggaatgttcttgacgttggttgtggggtagctagcttcggagcctatcttctttcacatgacatcatagccatgtctcttgcccctaatgatgtccaccagaaccagatccagtttgctctagaacgagggattccatcaacacttggtgttcttgggacaaagcggcttccatacccaagcagatcatttgaacttgctcactgctctagatgtcggatagattggcttcaaagagatgggatcttgttactggaacttgataggttgctcagacctggtggctactttgtatactcgtcgcctgaagcttatgcacacgacccagagaacagaaagattgggaatgcaatgcatgatctctttaagagaatgtgttggaaggtcgtggccaaacgagaccaatctgttatatggggaaaaccgatatccaacagctgttacttgaagagggatccgggtgtcctgcctccgctttgtccttctggagatgacccagatgcaacttggaatgtctcaatgaaggcttgcatatcaccttactcagtgaggatgcacaaagaaagatggagtggactcgttccctggccacggaggctgacagctcctccaccacgtcttgaagaaattggtgtcactcctgagcaattccgtgaagatacggaaacatggcggcttagagtgatagaatactggaaactgctgaaaccaatggtgcaaaagaactccataagaaacgtgatggacatgagctcaaaccttggcggtttcgcagctgctctaaacgataaagatgtatgggtaatgaatgtcatgcccgttcaatcctctccaagaatgaagatcatttacgaccgtggccttatcggagccactcatgattggtgtgaagcctttgacacatacccacgaacgtttgatcttatccacgcatggaacaccttcacagaaacccaagcacgtggatgcagctttgttgatctgcttatcaagatggatcggatactacgcccagaaggatttgtcataattcgtgacacaactgacaatattagctatatcaagaagtatctgacattattgaaatgggataaatggtccacagagacaactccaaaaggtgatcctctgtcgaccaaagacgagatagttttgatcgccagaaagaaactttggagcttgcccgccatttcagtgtcctgaaatctaacagtcaacaggcgaatgaatgagatttacagcatcagaggcgcgtagctgaggaaaatactcagcaatggagaagtgtaaattacacgacattcatacatagttgttaac

SEQ ID NO: 4429 - DNA, 1732 bp, Artificial Sequence
  P6168 (opLexA::G1637, G1637 is from A. thaliana)
agcgagatcttgtgattctaattcttgtgataccgaaaacattggtggcgagagagagatggtgaaggagacggtgacggtggcgaaaacgtgctcacactgtggccataatggccataacgcacggacttgtctcaacggcgttaataaggcaagtgttaaactgttcggcgttaatatatcgtctgatccgattaggccgcctgaggtaacggcgttaaggaagagtcttagtttgggaaaccttgatgctcttctcgctaacgatgaaagtaacggtagcggtgatcctatcgccgccgttgatgataccggttatcattccgatggtcagattcattccaagaagggtaaaactgctcatgagaagaaaaaggggaagccatggacggaagaagaacatcgtaatttcttaatcggtttaaacaaactcggaaaaggagattggagaggcattgcaaagagtttcgtgtcgacaagaacaccaacacaagtcgcaagtcatgctcagaaatattttattaggttaaacgttaacgacaagagaaaaagacgtgctagtctctttgacatctctctcgaagatcagaaggagaaagagaggaactctcaagatgcttcaacaaagactccacctaaacaaccaataaccggaattcaacaaccggtagtacaaggtcatactcaaaccgagatttcgaacaggtttcagaatttatcaatggagtatatgccaatctaccaacccataccaccttactacaactttccacctattatgtaccatccaaattatccaatgtactatgccaaccctcaagtaccggttaggtttgttcatccttctggtatacctgttccaagacatataccgattggtttgcctctgtctcaaccgagtgaagcttctaatatgacaaataaagacggtttggatcttcatatcggtttgcctccacaagctactggagcttctgacttgactggtcatggcgttattcatgtgaaatgaaatctcattttttgtgtgtttatttaagcatgatataggtatattgcttcttttttttggtgttgagttttatttgaatatatagctccatattcaaaagttttgccaatcggattatgtatcatttttatttcttcccagattagattaaataagaatatagatatatttggatttatatttagctgcttctttatcaaccaaaaacaaaacaaaaaaaatcttagttttggtgaagtttattgagtaaaatcaacattcattgggagaaaattaaaaaaatggtgttgattaactagtaaaatcctttgatcaatttcctagaagctcgtctggttctatcagtgaggtttggtttgtcaggatctccgagttctaaggtggcacccaagaaaccggtctgagttccatcgctatcattgtcgatgtctccttcgatcgtcaatccttcaatcttagccgcaatagattcttctctcatcccaacatccacatcttcaaaatttggatcgatgttataagtgccacaaagaataaagtatcaacatgtaacagttacataaaatatttcccaacttcacaaccgccaaatgcagacatgatctctctaccatttgcaatccaatttgatcatgttggattattgcggatgagttcgtggttaacaacatgcatgttttttctttcactttaaaaccgggcatggtttgatcaaacaca

SEQ ID NO: 4430 - DNA, 1167 bp, Artificial Sequence
  misc_feature (1139)..(1139): n is a, c, g, or t
  P6173 (opLexA::G1211, G1211 is from A. thaliana)
cctagatttctgcaactgaattcctaattcgaaaaagaatggagggttcgtcgtcgacgatagcaaggaagacatgggaactagagaacagcattctaacagtagactcacctgattcaacctccgacaacatcttctactacgacgatacttcacagactaggttccagcaagagaaaccgtgggagaatgatcctcactactttaaacgagtcaagatctcagcgctcgctcttcttaagatggtggttcacgctcgctctggtggtacaattgaaataatgggtcttatgcaaggtaagaccgatggtgatactatcattgttatggatgcttttgctttaccagtggaaggtactgagacaagggttaatgctcaggatgatgcttatgagtacatggttgagtattcacagaccaacaagctcgcggggcggctggagaatgttgttggatggtatcactctcaccctggatatggatgctggctctccggtattgatgtttctacgcagacgcttaaccaacagcatcaggagccatttttagctgttgttattgatcccacaaggactgtttcagctggtaaggttgagattggtgctttcagaacatactctaaaggatataagcctccagatgaacctgtttctgagtatcaaactattcctttaaataagattgaggactttggtgttcactgcaaacagtactattcattagatgtcacttatttcaagtcatctcttgattctcaccttctggatctactatggaacaagtactgggtgaacactctttcttcttctccactgctgggtaatggagactatgttgctggacaaatatcagacttagctgagaagcttgagcaagccgagagtcatctggttcagtctcgctttggaggagttgtgccatcatcccttcataagaaaaaagaagatgagtctcaactaactaagataactcgggatagcgcaaagataactgtggaacaggtccatggactaatgtcgcaggtcataaaagatgaattattcaactcaatgcgtcagtccaacaacaaatctcccactgactcgtcggatccagaccctatgattacatattgaagttgctcttcttttggtttctanttttggattgacccatcatttgttgtcc

SEQ ID NO: 4431 - DNA, 913 bp, Artificial Sequence
  P6181 (opLexA::G344, G344 is from A. thaliana)
tcaaatatggattcgcttcgctcctcctttatttaaaatacttgtagtgctttcatacggctagagacaaaaatggagtgtgtagaagcatttctcggtgatttttccgtcgacgatcttctcgacctctctaacgccgacacttctttagagtcgtcttcgtcacaaagaaaagaagacgaacaagaacgtgagaaatttaagagcttttctgaccaaagtacccgtctttcaccgccagaggatctcttatcttttcccggcgacgctccggttggtgatttggaggacttagagtggttatccaacttcgtggaggattctttctcagaatcgtatatttcgagtgatttcccggtgaatccagtcgcgtcggtggaggttcggagacagtgcgttcctgttaaacctagaagcaaacgccgccgcaccaacggccgtatctggtctatggagtctccatctcctctgctatccaccgctgttgccagaaggaagaagagagggagacagaaggtggatgcatcgtacggtggcgtagtccagcagcagcagctgaggcggtgctgcagccattgtggagtccagaagacgcctcaatggagaatgggtccattaggtgcgaagacactgtgtaatgcttgtggggtccggtttaagtcgggtcgacttttacccgaatatagacccgcttgtagcccaacattcaccaacgagattcactctaactctcaccggaaagtgttggagctacggctcatgaaagtggcggatccggctcgggtttaagccatttttttctatcttgaaattttatcaatgccatgtgcattgtgtaatcttgtaaacagagaatcagagagagatccgtagactgttttcacattcatgaagttaagctataattagagac

SEQ ID NO: 4432 - DNA, 2612 bp, Artificial Sequence
  P6184 (opLexA::G1657, G1657 is from A. thaliana)
ccatggtgtgtgtcagtgtgtgcacatatttttataagatatcttcacatacacaaaaacatttattgtacagtgcacaagtgatcgaatatttgattctttttcataatcagagatctgatctaaatggagtatgaccgtacgttgaacttgattccatacggactacaaggagtaagagaggaggaagaaatcgaagaagacgatgaagagagcatgacgttgtcgtcagtaccagaaaacgaaacgtcggagtgttcttcgcctccggcgacgtatcctccaatccctcctcggcctaaaacaccgagagagccgatggagtttctatgcagatcatggagtctttctacttctgagatctctttagctttatcatctcagaaatctgataaacaactcaacaaaaaccctaatatttctcagttggccgatgtcacttctctggctccggtagcaccaccaccgccgctacaagtaagccgtctcttgctttcatcttctctttattgtatattaagttcgtatggttgatatgatcgtacgttaccatcaaataaaggaaattaattttgatagtactattagaaactcactaaagatcttggatgcatgcaaatgaagtcttttttttttttgggatcaaaatattatacacttgtaattgattttaatagttgaattttcacgtttataaatttgcatacaataagttgtcgttttcagtagttgccacaaagatacaataagtgaaacagttagacgttattttccaataatgttgtaaatacttttttttttttagtgtaaagtaattttcattatattctcatgtgtaacgaaattattactttatgctaacaatttgttaggtgttttaagtttatgggccaagaatatatttatagaaccaaaataataatattaagacccaatctgtaaaaagcccaaaatgtttaaattgtttctttcttcaacagacgggaaagctagcgagtgcggttcacgcgcggagaacgggaacgatcggaaaatggttccaccaccgagaattcgtcggcgggaaggtctccgccgtaaagaagagagatagagttcgcgtggagaaagctcatctgcattccgccgtgtccattgcgtctctggcgacggcaatcgccgcagtgaccgcttcaggcaatcaagacggcttcgctggatcaaagatgagctcagcccttgcctcggcgtcggagttgttagcttctcactgcctcgaattggcggagcttgccggcgccgatcacgatcgcgtcgtctctgctgtccgatcagctgttgatgttcgtggacctggcgatttgttgactctaactgctgcagctgcaacaggtacattgattgtttgacttcaattctcaatccttgattgtttcgctctattgaatttgactagtccattgtagttttgagttgatcattcgattatgattctcggtttttcgataatgtagcattgagaggagaagcagctttgagggtaagactaccaaaggaagctaagaacagtgcagctataagcccctgtgagagagttttaccagagactcatagttgctcttctgagctcgatcgcactagcacgaccgatgaactcatatctgcaaaaggagttgaagaatcaactggagagctaatgcagtgcacacgaaacggtaatgtttcagtaagagcttctttactaattgttgtgaatgatgatgatattataattcaagaatcaattggaaacaaaaaaatttcacttaccacgagattgatgaattgactcatggactttccaggtgttctgcggtggaagcatgtaaaagtgtacatcaacaaaaaatctcaggttaaacatcgaatactcattgaagctaacaaagttatatgctggttgaattctagagttgaattttgctcggtttctcttttgcaggtcatagtagaaatcaaaagcaaacacgttgtaggagcattctccatgaaaagcaaaggttagtgagctactcttctttctttcaatgtctatggtgttcatttgtataagcagagtgatcttgggactttgtccaatgctttacaataatccagtggttgaatcactacaggcattgtaaatgatgtatgcgagacagtctcaggcctgcaaaatggaaaagacacggaaaacacagaagaagagctctatttcggaatcggtacagggaaaggtctgacaaagttcaagtgcaagagcaaggctgataagcagacatgggtggatagcatccggaatcttctccatcgagtaactgctgttgaggtcgacacttctcttgaaactataaacattaacgatagcacataaatcatgatgtcttgtgttaacggtgttagtgttggttattttcattacaagccaatgatatgtattgtttcaagaacatatacatatctgcaagtaggtgtagtgtttttcatcttcgtcacttgtttttatttcagtcaaattgtaaacattgttttgtggaaataatgaagaagattataataaggcttgatgaatctcaccggagaaatgtccatgtgtttctccatggcttcttccc

SEQ ID NO: 4433 - DNA, 1527 bp, Artificial Sequence
  P6196 (opLexA::G2154, G2154 is from A. thaliana)
atccctaactctctctctctagaaattcttatttttgtgcgtatctctctaaaaaggaatggatcctaacgaaagccaccatcaccaccaacaacaacagctccatcacctccaccaacagcaacagcaacagcagcagcagcaacgactcacttctccttacttccaccaccaactacagcaccatcaccaccttccaaccaccgtagcaaccaccgcttctaccggaaacgccgttccatcttccaacaatgggcttttccctccgcagcctcagccacagcaccagcctaatgatgggtcatcttctctcgcggtgtaccctcattcagttccgtcctcggctgtgacggcgccgatggagccggtaaagaggaagaggggtcgaccaagaaagtatgtgacgccggaacaagccctagcggctaagaaattggcgtcttctgcgagtagttcgtctgctaaacagaggcgagagcttgctgctgttaccggtggtacggtatcgactaattccgggtcatccaagaaatctcagcttggttctgtcgggaaaactggacaatgttttactccgcatattgttaatatagctcctggcgaggatgtggtccagaaaattatgatgttcgcaaaccaaagcaagcatgaactatgcgttctttctgcatcaggcactatctctaatgcatccttgcgccaaccggctccatcaggaggcaacttaccatatgagggtcaatacgagattctctcactatctggatcctatatccgaactgaacaaggtggtaaatccggcggccttagcgtttctttatctgcttcagatggtcagatcatcggtggagcgattggtagccatctcacagctgctggcccggttcaggtgattcttggtacgtttcagcttgatagaaagaaggatgccgccgggagtggtgggaaaggggatgcttcaaacagtggaagtcggttaacttctcctgtaagctctggacagttgcttggcatgggtttccctcctggtatggaatctacgggaagaaatccaatgaggggaaacgacgagcaacatgatcatcatcatcatcaagccggtttgggtggacctcatcatttcatgatgcaagcgccgcaggggatacacatgacacattccaggccatctgaatggcgcggaggaggcaacagcggtcatgatggcagaggcggtggcgggtatgatttgtcaggaaggataggacatgagtcgtcggagaatggagattacgagcagcaaataccggattagcagagcttccaggagaagtgtgtagagtttagatcccaagtagagaaacagaaggcgagcaaagaatctgaactgagagaggacttattagacagagactcgtctgaagggtctttaatcatagaaagaagttgctgagtgattgcttttgttcttcttcttggtacggtgtattatattaactccacaaccttttttttatactttcagtaacgattctccttcactttcaa

SEQ ID NO: 4434 - DNA, 728 bp, Artificial Sequence
  P6197 (opLexA::G350, G350 is from A. thaliana)
ttcaagataatggcacttgaaactcttacttctccaagattatcttctccgatgccgactctgtttcaagattcagcactagggtttcatggaagcaaaggcaaacgatctaagcgatcaagatctgaattcgaccgtcagagtctcacggaggatgaatatatcgctttatgtctcatgcttcttgctcgcgacggagatagaaaccgtgaccttgacctgccttcttcttcgtcttcacctcctctgcttcctcctcttcctactccgatctacaagtgtagcgtctgtgacaaggcgttttcgtcttaccaggctcttggtggacacaaggcaagtcaccggaaaagcttttcgcttactcaatctgccggaggagatgagctgtcgacatcgtcggcgataaccacgtctggtatatccggtggcgggggaggaagtgtgaagtcgcacgtttgctctatctgtcataaatcgttcgccaccggtcaagctctcggcggccacaaacggtgccactacgaaggaaagaacggaggcggtgtgagtagtagcgtgtcgaattctgaagatgtggggtctacaagccacgtcagcagtggccaccgtgggtttgacctcaacataccgccgataccggaattctcgatggtcaacggagacgaagaggtgatgagtcctatgccggcgaagaaactccggtttgacttcccggagaaaccctaaac

SEQ ID NO: 4435 - DNA, 1511 bp, Artificial Sequence; identical to SEQ ID NO: 533
  P6199 (opLexA::G2121, G2121 is from A. thaliana)

SEQ ID NO: 4436 - DNA, 948 bp, Artificial Sequence
  P6206 (opLexA::G2452, G2452 is from A. thaliana)
ttgccttggtcactcaagactctcttcttcactctctgttttttgtcctcttctaaaatttagagaaaaaaacgaaagttttcaccaaaaacagaggaggagctatgtcatcgtcgacgatgtacagaggagttaatatgttttcaccggcaaacacaaactggatttttcaagaagtcagagaagccacgtggacggcggaggagaacaaacggttcgagaaagctctcgcttatctggacgacaaagacaatcttgagagctggtccaagatcgcagatttgattcccggcaaaacagtagctgacgtcattaaacgatacaaggagctagaggatgatgtcagcgacatcgaagccggacttatccccattccgggatacggcggcgacgcctcctccgctgcaaacagtgactatttctttggtctagaaaactccagctacggttatgattacgtcgttggaggaaagaggagttcgccggcgatgactgattgttttaggtctccgatgccggaaaaggagaggaagaaaggagttccgtggaccgaggacgaacacctacgatttctgatgggtttgaagaaatatggaaaaggagattggagaaacatagcaaaaagctttgtgacgactcgaacgccgacgcaagtcgcttcacacgctcagaaatattttcttcgacaactcacagatggtaaagacaaaagacgatcaagtattcacgatatcaccactgttaacatccctgacgcagacgcatccgcaaccgccacgaccgctgacgtagcactctctcctactccagccaattcttttgacgttttccttcagccaaatcctcattacagtttcgcgtctgcgtctgcgtctagctattataatgcgtttccgcagtggagttaaatcacttagaaattatctagagtttgtggtctcctataga

SEQ ID NO: 4437 - DNA, 819 bp, Artificial Sequence
  P6207 (opLexA::G1305, G1305 is from A. thaliana)
cgatgatgatgacaaaagttacatgtccccataagattctctaaaattaaaagtggggtgtgatggggaatagaagagcaccatgctgtgacaaaagccaagtgaagagagggccatggagtgatgaagaaagtgaaagactcagatcttttatcctcaaaaatggtcatcaaaattggcgatctcttcccaaactcgctggattgatgagatgcggaaagagttgtcgtctaagatggataaactatctgagaccaggtctcaaacgaggcaacttcaccaaggaggaggaagataccattatccaccttcaccaagcttatggaaacaagtggtctaagatcgcatccaacttcccgggaaggacagacaacgagatcaagaatgtatggaacactcatctcaagaagcggttggtgaagaggagcatttcatcatcatcatccgatgttaccaatcattcagtgtcttctacctcttcttcctcttcctcaatctcgtcagtcttgcaggacgttattattaagagtgagaggcctaaccaggaagaggagtttggggaaatcttggtggagcaaatggcatgtggatttgaggtggatgcaccacaatcactagaatgtctctttgacgatagccaggttcctcctcctatatctaaaccagactcactacaaacccatgggaagtcatcagatcacgaattttggagccgactgattgaaccagggttcgatgattacaatgagtggctcattttcttggataaccaaacttgctagtgctagaacacacaaggagttgacccatcatgtctta

SEQ ID NO: 4438 - DNA, 950 bp, Artificial Sequence
  P6209 (opLexA::G1925, G1925 is from A. thaliana)
aatggaagaaaatcttcctccggggttcagatttcatcctacagacgaggagctcataacgcattatctatgtcggaaagtctccgatataggattcaccggtaaagctgtcgtcgacgttgatctcaacaagtgtgaaccttgggatttgccagccaaggcttcaatgggagagaaagagtggtatttcttcagccaaagggatcggaaatatccaaccggtttaagaacaaaccgggcaacagaagctggttactggaaaaccaccgggaaagataaagaaatataccgaagtggagtgttggttgggatgaagaaaaccctagttttctacaaaggaagagctcccaaaggtgagaaaagcaattgggttatgcatgagtacaggcttgagagcaaacaacctttcaaccccacgaataaggaggaatgggtagtgtgtagggttttcgaaaagagcacggcagcaaagaaagcacaagaacaacaacctcaatcttctcaaccatcttttggatctccatgcgatgcaaactcatcaatggcaaatgagtttgaagatattgatgagcttccgaatctgaattcaaactcatcaaccatcgattacaataatcatatccatcaatattcgcaacgcaatgtttactcagaagacaacacaacaagtacggctggtctcaacatgaacatgaacatggctagtactaatcttcagtcttggacaacaagtctccttggtccgcctttatctccaatcaactctttgttgctcaaggctttccaaatcaggaactcttatagtttcccaaaagagatgatccccagtttcaatcattcttctcttcaacaaggagtctccaatatgatccaaaatgcttcaagttcgtctcaagtgcaaccccaaccgcaagaggaagcgtttaatatggactccatatggtgaagcc

SEQ ID NO: 4439 - DNA, 969 bp, Artificial Sequence
  P6211 (opLexA::G2299, G2299 is from A. thaliana)
gccaaaattttaccaacatttttctcttctcatatcaaagtttctctctcatttcttcatcacacttcactgccctgttttttttcctcattttgaatagttctcaaacttatatatttttccccctgaagcctagctatttctttttatttgcattaatctcgggatccgaatcgaaaaaagcaatcagaataatagacttgtacgatacttgtgcctaagctaacacaatggcagaggaatactacagcctccgctcggagagagtaactcagcttcttgtccctaactcggagtctgactcagtgagtgacaaaagcaaagctgagcaaagcgagaagaagactaaacgtgggagagactccggtaaacaccctgtttatcgcggagtaaggatgaggaactggggaaaatgggtgtcggagattcgtgagccgaggaagaaatcacgtatttggctgggaactttcccgacgccggagatggcggcgcgtgcacacgacgtggcggctctgagcattaaaggaacggccgctatactaaacttccctgaactcgctgactcattccctcgacccgtttcattaagccctcgagacattcagacagcagctcttaaagcagctcacatggaaccgacgacgtcgttttcatcttccacgtcttcgtcgtcgtctttgtcttctacgtcttcgctcgagtctcttgtgttggtgatggacctctcgaggactgagtcggaggagctcggtgagattgtggagcttccaagtctcggggcgagttacgacgtcgactcggctaaccttgggaacgagtttgtcttctatgactcagttgactactgtttatatccgccgccgtggggacagtcgtccgaagataactatggtcacggaattagccctaattttggccatggcttgtcatgggatctctaacagtttattttgtatcattaccataatg

SEQ ID NO: 4440 - DNA, 1168 bp, Artificial Sequence
  P6213 (opLexA::G2293, G2293 is from A. thaliana)
atacacaacccctcttcttctccaccttctctccattttctctttctctcatatctctctgtctacttctactcctctttctccatctgcaactcatatatttccaaaaagtgatcaagatcaacaaaatatccgaatcttgatccgacctttctttcttagcttaacttcttgtaaatatatataactatagtctatactctatagagcatatatataaacatgaagcgaggtctagatatggcgagaagctacaatgatcatgaaagtagtcaagaaaccggacccgaatcaccaaattcttcaacctttaacggcatgaaagctcttatctcttctcattcgcctaaaagaagcaggagatccgtagagaagagagtagtgaacgtaccgatgaaagaaatggaaggatctcggcacaaaggggacacaactccgccctcagattcatgggcttggcgtaagtacggccaaaagcccattaagggatctccataccctagaggttattaccgttgtagtagcacaaaaggttgtccggcgaggaagcaagtcgagagaagcagagatgatccaacgatgattctcatcacttacacttctgagcataaccatccttggcctctcacttcttccacaagaaacgggcctaaacctaaacccgagcccaaacccgaacctgagcctgaggtagagccagaggcggaggaggaggataataagtttatggttcttggaagggggattgaaacgacgccatcatgtgtcgacgagttcgcatggtttacggagatggagacaacatcttcgacgattcttgagagcccgattttctcgtcggagaaaaagacggctgtctcgggggctgatgacgtggcggtgttctttccgatgggagaagaggatgagtctttgttcgccgatctcggcgagttgccggagtgttctgtggtgtttcgtcaccggagtagcgtagtggggtcacaagttgagatcttttgacacgtggtgatattttattggatattattgtcgctcacatgggaagcgttgtacgcacggcgtttttgttttagtttctcaacggtaatcaataaatcatcatataagactctttatacttgttattgataaaaaaaaggtatgattcgattttgtaattcctttt

SEQ ID NO: 4441 - DNA, 2690 bp, Artificial Sequence
  P6406 (opLexA::G727, G727 is from A. thaliana)
agatggtaaatccgggtcacggaagaggacccgattcgggtactgctgctggtgggtcaaactccgacccgtttcctgcgaatcttcgagttcttgtcgttgatgatgatccaacttgtctcatgatcttagagaggatgcttatgacttgtctctacagaggtaaaattcaatcaaaatttcgttttaatattaatctaaaattttattaatttacaaaggtttcatggtgaaattatgacccaatttgtgaaaatttattgtaattttggtggttaactatggattttaattacggtggttgactctgccaaaaatagtaaacagagcttatggaattgactagaagttttcattgactgttgaatgaatcactgttagattcagatatatatacatcgcttagttctctgttctgttctaatattgtgatctgcttaaagattctccttttgaggtttattttcaatagatcttttagttctcaagaaaagtgtgattcaaatttcttaaattttgttcaaaggttttaagagttagtttgagattctggtatttattttgatccagttctgttttcgattattttcaaaattttgttttttgatgctttttgactctgattctgttattacagtaactaaatgtaacagagcagagagcgcattgtctctgcttcggaagaacaaagaatggttttgatattgtcattagtgatgttcatatgcctgacatggatggtttcaagctccttgaacacgttggtttagagatggatttacctgttatcagtacgtatcttaatcgctaaaaacttattattaactctaattcgttttcttgagatctgaatgttttgaaacctttggttatagtgatgtctgcggatgattcgaagagcgttgtgttgaaaggagtgactcacggtgcagttgattacctcatcaaaccggtacgtattgaggctttgaagaatatatggcaacatgtggtgcggaagaagcgtaacgagtggaatgtttctgaacattctggaggaagtattgaagatactggcggtgacagggacaggcagcagcagcatagggaggatgctgataacaactcgtcttcagttaatgaagggaacgggaggagctcgaggaagcggaaggaagaggaagtagatgatcaaggggatgataaggaagactcatcgagtttaaagaaaccacgcgtggtttggtctgttgaattgcatcagcagtttgttgctgctgtgaatcagctaggcgttgacagtgagttaaaaacttgcttgcttatgcatttgtgtgtgtcgatgtttgttttcttgtctaatctttaccgtattggggcattcaatgcagaagctgttcctaagaagatcttagagatgatgaatgtacccggctaacgcgagaaaacgtagccagtcacctccaggtatatatgtgatcgaatagtattacattttttcattgttgatgtgttctaacagtggtaacattgtggaattccagaagtatcggatatatctgagacggcttggaggagtatcgcaacaccaaggaaatatgaaccattcgtttatgactggtcaagatcagagttttggacctctttcttcgttgaatggatttgatcttcaatctttagctgttactggtcagctccctcctcagagccttgcacagcttcaagcagctggtcttggccggcctacactcgctaaaccagggatgtcggtttctccccttgtagatcagagaagcatcttcaactttgaaaacccaaaaataagatttggagacggacatggtcagacgatgaacaatggaaatttgcttcatggtgtcccaacgggtagtcacatgcgtctgcgtcctggacagaatgttcagagcagcggaatgatgttgccagtagcagaccagctacctcgaggaggaccatcgatgctaccatccctcgggcaacagccgatattgtcaagcagcgtttcaagaagaagcgatctcactggtgcgctggcggttagaaacagtatccccgagaccaacagcagagtgttaccaactactcactcggtcttcaataacttccccgcggatctacctcgcagcagcttcccgttggcaagtgccccagggatttcagttccagtatcagtttcttaccaagaagaggtcaacagctcggatgcaaaaggaggttcatcagctgctactgctggatttggtaacccaagctacgacatatttaacgattttccgcagcaccaacagcacaacaagaacatcagcaataaactaaacgattgggatctgcggaatatgggattggtcttcagttccaatcaggacgcagcaactgcaaccgcaaccgcagcattttccacttcggaagcatactcttcgtcttctacgcagagaaaaagacgggaaacggacgcaacagttgtgggtgagcatgggcagaacctgcagtcaccgagccggaatctgtatcatctgaaccacgtttttatggacggtggttcagtcagagtgaagtcagaaagagtggcggagacagtgacttgtcctccagcaaatacattgtttcacgagcagtataatcaagaagatctgatgagcgcatttctcaaacaggtttgattattactcgaatacagtgcactctaaaac

SEQ ID NO: 4442 - DNA, 1106 bp, Artificial Sequence
  P6412 (opLexA::G1757, G1757 is from A. thaliana)
cattatacatctttctcatcatagtttgtatcaatttcctagagtaaactacctaaaggaaaaaaaaaatctattttgggaatcatatactaaaaatggaaggaagagatatgttaagttgggagcaaaagacattgctaagcgagcttatcaatggatttgatgcggccaaaaagcttcaggcacgacttagagaagctccgtcgccgtcgtcatcattttcatcaccggcgacggctgttgctgagactaacgagattctggtgaagcagatagtttcttcctacgagagatctcttcttctgctaaactggtcatcctcaccgagcgtacaacttattccgacgccggttactgtagtcccggtggcaaatcccggcagtgttccagaatctccggcatcgataaacggaagtccgagaagtgaagagtttgccgatggaggaggttctagcgagagtcatcatcgccaagattacattttcaattcaaagaaaagaaagatgttaccaaagtggtcagaaaaagtgagaataagcccagagagaggcttagaaggacctcaagatgatgtctttagctggagaaaatatggtcaaaaagacattttaggcgccaaattcccaaggagttattacagatgcacacatcgtagcacacaaaactgttgggcaacgaaacaagtccagagatcagacggggatgctacggttttcgaagtgacgtacagaggaacacacacttgttcgcaggcgatcacaagaacaccaccattagcctcgccggagaagcgacaagacaccagagtcaaaccagccattacccaaaagccaaaggatattctcgagagtcttaaatccaacttaaccgttcgaaccgatgggcttgatgatggtaaagacgttttctcgttccctgatacgccgccgttttacaattacggaactatcaacggcgagttcggccacgtggagagttctccgatcttcgacgttgttgactggttcaatccaacggtcgagattgacacaactttccccgcgtttttacacgagtcgatttattattaattaaaatttgtaacagagaaatagatagtaactagt

SEQ ID NO: 4443 - DNA, 2236 bp, Artificial Sequence
  P6415 (opLexA::G1807, G1807 is from A. thaliana)
cctagttattggagagtggtgagaattagaaactgcattatccgatctaaaatgggtgatacagagaagtgtaacagtgatatgatccagagacttcattcatctttcggcactacttcttcttccattcccaaaaatcccatttctcagctcgatttaaaccctaatttcatccgctcatcagctcctcaattctccaagcctttcagtgacagtggcaaacgaatcggtgttcctccgtcgcaccccaacttaatcccaccgacttctccgttttctcagatcccgaccacccgacaacccggttcgcataattttaacccgggaggagctaatcattcacggtcaatgtcacagcccaactctttcttctcttttgactccttacctccgttaagcccttctccgtttcgagatcacgatgtttcaatggaggatagagattccggcgtgtttaacagcaaccattcgttgcctccatcgccgttcacgaggtgtaattcgacctcttctagctccttgagagtcggtgagagtttacctccgagaaagtctcatagacgctccaacagtgatatccccagtgggtttaattcgatgcctttgatccctccgagaccattggagaggtctttttctggtggggagtgtgctgattggtcaaagtctaatccttttgtgaagaaggaatcgagctgcgaaagggaaggtgtcggagagagagaagctatggatgatctcttctcagcatatatgaatcttgaaaacattgatgtgttgaactcctctgaagctgatgatagcaagaacggtaatgagaatagggatgatatggagagcagcagagcaagcgggaccaagactaacggtagtgatacggaaggagagagcagcagtgtcaatgagagtgccaataataatatgaattcttctggtgaaaagagagagagcgtgaagagaagagcggctggaggagatattgctcctaccaccagacattacaggagtgtttcagtggacagttgtttcatggagaagttgtcttttggtgatgaatctctaaagccgcctccttctcctggatctatgtcaaggaaagtttcccctaccaattcggttgatgggaactcgggtgctgcttttagcatcgagttcaataacggtgagtttactgcagcggaaatgaagaagatcatggcaaatgataaactagcagagatggccatgtctgaccctaaacgtgtcaaaaggtacaaatattgaatcttgactaacattaccggtttataatcaaatattctgatgtttaaggaatgatcctcttttcagaatcttagcgaaccgtcaatccgcagcacggtcaaaggagaggaagatgcggtacatagtagaattggaacacaaagtgcagactcttcagaccgaggctaccacattgtctgctcagctcacacttttgcaggtgcgttgtttacaatgttataaaagcgcctagattggtcaatttttgttttgttctaacgatcttagttactgcattatccagcgcgatatgatggggttgacaaatcagaacaatgagcttaagttccggcttcaagcaatggagcaacaagcgcgtcttcgcgatggtatacatttctcttcacattgtatcaaatttacgatattattaacatgactttaacaaaaaatggaaccagatcctatatgctttaaaaaaatctccatttttgcgcttaacgaatgtgaaatgacgatttttttcccccgctttgcagctctgaacgaagcactgaatggagaagtccagcgactgaaactggcaatcggtgagagcagtcagaacgaatcagagagatcaaagatgcaatcactcaacgctgagatgttccagcaactcaacatcagccagttaagacagcagccacaacagatgcagcaacagtctcatcagcagaaccaccagaatggaaccatggcaacaaaatctgaatcaaatgaatagagcagagaagttgttgcggtggatcaaagggttggagtttttcaacaagttacatatcaaatcaaacattatatttcatttatgtgcagagtcagttgaatttacatatatatcatataagtccaagaaatttaattttacaatatgttgttatcttagaaagaaaaaattcaatttatagtagatataggtatgaactatgaacacaagttatatgtaatgggattg

SEQ ID NO: 4444 - DNA, 2514 bp, Artificial Sequence
  P6416 (opLexA::G1804, G1804 is from A. thaliana)
cggaacacaaagccaccggtttttagacacacagatttcattttcaggttaacacttttcttgttttataatttttcaagatcttggattagaagactgttaaataaatctatctctttatttataagtttaggtcttcgttttctggtccttacttatctgcgtattaccaaatattaaactttgtggtaaagtgatacttagtaatagacggatataatgatgacccaagctaatgattaatttattttactaatcatcaggttaagctctagattatcttttgtttaaaaccgtattaataaatgattaaagaggaaaaaaatcttgtgttgataagttcgctttaagaagaaaacgagtgggttaagatattttcctcttttggtaacgaaaactttattggaagagtaaattattagtttatttattgctaattttagtatcgtttgtcgctgtcacgatgtggaccgttcttctttattttcacgtggaccgacttaattaccttctttcattcttgttatttcaatattttttacgtcatttaaactccactttaccaaaataatttatttcattctttgagagcatcaattatcaaataattcaattgtcttttttcgtgatagttgaataagggacaactattaagtgagtttcgtgaatagctgaacagggacaagtaactgaagtttggtcaaaataatacgatgaatttaatatataagagacaaaattgttattgtcgtttaggtggtatccatatttcaatatagtttgtgtgaatacagatataaaaatggttattgttgtgtatatgatgcagttgttaaatggtaactagagaaacgaagttgacgtcagagcgagaagtagagtcgtccatggcgcaagcgagacataatggaggaggtggtggtgagaatcatccgtttacttctttgggaagacaatcctctatctactcattgacccttgacgagttccaacatgctttatgtgagaacggcaagaactttgggtccatgaacatggacgagtttcttgtctctatttggaacgcagaggagaataataacaatcaacaacaagcagcagcagctgcaggttcacattctgttccggctaatcacaatggtttcaacaacaacaataacaatggaggcgagggtggtgttggtgtctttagtggtggttctagaggcaacgaagatgctaacaataagagagggatagcgaacgagtctagtcttcctcgacaaggctctttgacacttccagctccgctttgtaggaagactgttgatgaggtttggtctgagatacatagaggtggtggtagcggtaatggaggagacagcaatggacgtagtagtagtagtaatggacagaacaatgctcagaacggcggtgagactgcggctagacaaccgacttttggagagatgacacttgaggatttcttggtgaaggctggtgtggttagagaacatcccactaatcctaaacctaatccaaacccgaaccaaaaccaaaacccgtctagtgtaatacccgcagctgcacagcaacagctttatggtgtgtttcaaggaaccggtgatccttcattcccgggtcaagctatgggtgtgggtgacccatcaggttatgctaaaaggacaggaggaggagggtatcagcaggcgccaccagttcaggcaggtgtttgctatggaggtggcgttgggtttggagcgggtggacagcaaatgggaatggttggaccgttaagcccggtgtcttcagatggattaggacatggacaagtggataacataggaggtcagtatggagtagatatgggagggctaaggggaaggaaaagagtagtggatggtccagtggagaaagtagtggagagaagacagaggaggatgatcaagaaccgcgagtctgctgctagatctagagcaagaaaacaagtaaatagagaccttcttcattccttttatgatgtttcttgttgaaaaaaatctaatgtttgttgttgttgttttgggaaggcatatacagtggaattggaagctgaacttaaccagttgaaagaagagaatgcgcagctaaaacatgcattggtatatatttactcatctcgttaaagagtttattctttttgtgaaagtgagtttgtaacaatttagcctttgttatgttttcatcaaggcggagttggagaggaagaggaagcaacaggtaaagacacctattgagtttgcattactaagatggttgcagtattttggtcagaagaaaactacaaaatggaattgttggtttatggttgcagtattttgagagtttgaagtcaagggcacaaccgaaattgccgaaatcgaacgggagattgcggacattgatgaggaacccgagttgtccactctaaacaaacaataggaagatggagaagaagtcggagacagaacgagggaaaaactgatgattttctacgttgttgttttgtctttgagg

SEQ ID NO: 4445 - DNA, 1604 bp, Artificial Sequence
  P6417 (opLexA::G599, G599 is from A. thaliana)
agaacagcttcgttgtcacttgtcattctataaatcgcatccccattgacaacctttcacttccatcaaaactctctctctatatctctctctctatatatctctctctatatctctctctctcttcactctctctttctttcaaaatggaaaaactcatggttccgacatggagacccgacccggtttaccgtccaccggaaacaccactcgaaccgatggagtttttagctcgttcatggagcgtctctgctctcgaagtctccaaggctctaacaccacccaaccctcagattctcctctccaaaaccgaagaagaagaagaagaagaacccatctcctctgtcgtagacggcgacggcgacacggaagacaccggacttgtcaccggaaacccattctccttcgcttgttcagaaacttctcaaatggtcatggatcgtatcttgtctcactctcaagaagtatcaccaagaacatctggtcggctatctcacagtagtggtccacttaatggttctttgaccgacagtcctcctgtgtctcctcccgaatccgacgacattaagcaattttgcagagcgaacaaaaattcattgaacagtgtaaattctcagttccgttcaacggcggcaactccgggacctataaccgctacagctacacagtccaagacggtgggacggtggcttaaggaccggagagagaaaaagaaagaggagactcgggctcataacgctcagattcacgctgctgtctctgtcgccggcgttgctgcagctgttgctgctattgcagcagccaccgctgcgtcttctagctgtggtaaggatgagcagatggctaaaactgacatggccgttgcttctgctgcgacccttgtggctgctcagtgtgtggaagctgctgaagttatgggagctgagagagagtatttggcttctgttgttagctccgccgtcaatgttcgttctgccggagatattatgactctcaccgccggagcagctacagctttaagaggagtgcaaacattgaaggcaagggcaatgaaggaagtgtggaacatagcatcagtgataccaatggataaaggactcacttctacaggaggaagcagcaataatgttaatggtagcaatggaagctcaagcagtagtcacagtggtgaacttgtacaacaggagaatttcttgggaacttgtagtagagaatggctcgctagaggttgtgaactcctcaaacgcactcgcaaaggtgatctccactggaagatagtatctgtttacatcaacaaaatgaatcaggttatgttgaagatgaagagcaggcatgttggaggaaccttcaccaagaagaaaaagaacattgtgcttgatgtgatcaagaatgtcccggcctggcctggacgacatttgctagagggaggagatgatctaagatacttcggtttgaagacggttatgcgaggtgatgttgaattcgaggtcaagagccaaagggaatatgaaatgtggacacaaggtgtctcaaggcttcttgttcttgctgctgagaggaagtttaggatgtgaataaacgttcaatggctgcttggtttaagt

SEQ ID NO: 4446 - DNA, 2898 bp, Artificial Sequence
  P6421 (opLexA::G1089, G1089 is from A. thaliana)
aagagagcttcttaaggaagaagaagatgggttgtgctcaatcaaagatcgagaacgaagaagcagttactcgttgcaaagaacgaaaacaattgatgaaagacgccgtcactgctcgtaacgctttcgccgccgctcactcagcttacgctatggctcttaaaaacaccggagctgctctttccgattactctcacggcgagtttttagtctctaatcactcgtcttcctccgcagctgcagcaatcgcttctacttcttctcttcccactgctatatctcctcctcttccttcttccaccgctccggtttctaattcaaccgcttcttcttcctccgctgcggttcctcagccgattcctgatactcttcctcctcctcctcctccaccaccgcttcctcttcaacgtgctgctactatgccggagatgaacggtagatccggtggtggtcatgctggtagtggactcaacggaattgaagaagatggagccctagataacgatgatgatgacgatgatgatgatgatgactctgaaatggagaatcgtgatcgtttgattaggaaatcgagaagccgtggaggtagtactagaggaaataggacgacgattgaagatcatcatcttcaggaggagaaagctccgccacctccccctttggcgaattcacggccaattccgccgccacgtcagcatcagcatcaacatcagcaacagcaacaacaacctttctacgattacttcttccctaatgttgagaatatgcctggaactactttagaagatactcctccacaaccacaaccacaaccaacaaggcctgtgcctcctcaaccacattcaccagtcgttactgaggatgacgaagatgaggaggaggaagaggaggaagaggaggaggaagaggagacggtgattgaacggaaaccactggtggaggaaagaccgaagagagtagaggaagtgacgattgaattggaaaaagttactaatttgagagggatgaagaagagtaaagggatagggattcccggagagaggagaggaatgcgaatgccggtgactgcgacgcatttggcgaatgtattcattgagcttgatgataatttcttgaaagcttctgaaagtgctcatgatgtttctaagatgcttgaagctactaggctccattaccattctaattttgcagataaccgaggtaattttgattcgataaatgtctgagagaaacaaaatgattggtttagctaagattgatgtgttgttgttgtaacaggacatattgatcactctgctagagtgatgcgtgtaattacatggaatagatcatttagaggaataccaaatgctgatgatgggaaagatgatgttgatttggaagagaatgaaactcatgctactgttcttgacaaattgctagcatgggaaaagaagctctatgacgaagtcaaggtaactatatcaaaacttgtctcttttttatgcttgtgcttgtttagtgaagctgaaagattttaactttttgaggaaagattcttgcaaccatgtttagtctttttgggtaatcttctctcctgagaaaagcccctttgattgttttgggtagttttatgagcaaaaatgatatatttttctcttgagagtctaattttgggatacacttcttgttggatataggctggcgaactcatgaaaatcgagtaccagaaaaaggttgctcatttaaatcgggtgaagaaacgaggtggccactcggattcattagagagagctaaagcagcagtaagtcatttgcatacaagatatatagttgatatgcaatccatggactccacagtttcagaaatcaatcgtcttagggatgaacaactatacctaaagctcgttcaccttgttgaggcgtaagtttcgcttcttggtagatattttttcctatgatgttttagacaaattgattttgagttcttatgcaaatttttttgcaggatggggaagatgtgggaaatgatgcaaatacatcatcaaagacaagctgagatctcaaaggtgttgagatctctagatgtttcacaagcggtgaaagaaacaaatgatcatcatcacgaacgcaccatccagctcttggcagtggttcaagaatggcacacgcagttttgcaggatgatagatcatcagaaagaatacataaaagcacttggcggatggctaaagctaaatctcatccctatcgaaagcacactcaaggagaaagtatcttcgcctcctcgagttcccaatcccgcaatccaaaaactcctccacgcttggtatgaccgtttagacaaaatccccgacgaaatggctaaaagtgccataatcaatttcgcagcggttgtaagcacgataatgcagcagcaagaagacgagataagtctcagaaacaaatgcgaagagacaagaaaagaattgggaagaaaaattagacagtttgaggattggtaccacaaatacatccagaagagaggaccggaggggatgaatccggatgaagcggataacgatcataatgatgaggtcgctgtgaggcaattcaatgtagaacaaattaagaagaggttggaagaagaagaagaagcttaccatagacaaagccatcaagttagagagaagtcactggctagtcttcgaactcgcctccccgagctttttcaggcaatgtccgaggttgcgtattcatgttcggatatgtatagagctataacgtatgcgagtaagcggcaaagccaaagcgaacggcatcagaaacctagccagggacagagttcgtaagaactaatgtaagatcagagtaatgtcttcttcttctttgatcttgaatatttaagcacacacatacatacaacgtatagctaaattg

SEQ ID NO: 4447 - DNA, 1200 bp, Artificial Sequence
  P6429 (opLexA::G659, G659 is from A. thaliana)
gtgaatctcatcaggaactgagtgatataaagttatatatatagaggagagagggagtgagagggagtgagagagagagaatggggaagggaagagcaccttgttgtgacaagaccaaagtgaagagaggtccatggagcccagaagaagacattaaactcatctctttcattcaaaagtttggtcatgagaactggagatctctccccaaacaatctggtatgtcattgcttttgtcatcacaatcaaagcaaaagcctcttcaattgttttttcttttctttatgattctgaatgtatatatatgcaaaaatgaagggctattgaggtgtgggaagagttgtcgtctaaggtggattaactatcttaggccagatctgaagcgtggcaacttcacttcagaggaggaagaaacaatcattaagcttcaccacaactatgggaacaagtggtcgaaaatcgcttctcaacttccaggtagaacagataacgagatcaagaatgtgtggcacactcatctaaagaaaagactggctcagagctcaggaactgcagatgaaccggcctcgccttgttcgagtgattctgtttctcgtgggaaagatgataagtcatctcacgtagaagattctttgaacagagagactaatcataggaatgagttgtctacatctatgtcttctgggggttccaaccaacaagatgatccaaagatagacgaactcaggtttgagtatatagaagaagcttatagcgagtttaacgacattattattcaagaggtagacaaacccgatctgctggagataccatttgattcagatcctgacatttggagtttcttagatacttcaaactcatttcaacaatccactgcaaatgagaacagctcaggctcaagagcaacaacagaagaagagtctgatgaggatgaggttaagaaatggttcaagcacctagaaagcgaactcgggttagaagaagacgataatcaacaacaatacaaagaagaagaatcatcatcatcatcactcttgaagaactacgagctcatgatacattgataaaagatatttattttggatatcaatatgacaatatgtatgatggaaaggtagagagatagtagagaaaatgtatttcctatagttttttaattggcattatttttagtagcctgtagataaaacagagctggtc

SEQ ID NO: 4448 - DNA, 934 bp, Artificial Sequence
  P6430 (opLexA::G665, G665 is from A. thaliana)
tctctctttctctatctcgctgtccctccttctctttctcattcattgcaatgggcagaagatgctcacactgtggaaacgtaggacataactcaagaacatgttcttcttaccaaacaagagtagttaggctctttggtgttcatctagacaccacaagctcttctccgccgcctcctcctcctccctcgattttggccgctgcaataaagaaaagtttcagcatggattgcttgccggcatgttcctcctcttcctcttcctttgctggttatctctccgatggtctcgcccataaaacacctgaccgcaaaaaaggggttccatggacggcggaagagcaccggacgtttctaattggattagaaaagcttggaaaaggagattggagaggaatctctagaaacttcgtcgtcacaaaatccccgacacaagtggcaagtcatgctcaaaaatactttctccggcaaactaccactctccatcacaagagacgccgcaccagcctctttgatatggtttcggccggcaatgttgaagaaaatagtactactaagaggatatgtaatgatcatattgggtcgagctcaaaggttgtttggaaacaaggattactcaatcctcgtcttggatatccagatccgaaagtatcagtatccggctcgggtaactccggtggactcgatcttgagctgaagcttgcgtccattcaatctcctgaatcgaatattagacctattagcgttacgtgaatctatataacacgttatgatcagtttcattagaataattcaaatgtttacatatataatatcttatcgatcctatctaatttgattttgatttaacgttagttactttgataatttcgtcgatattgtttttttggttttttcattgtgagattttttgtcttggaagttggatccataca

SEQ ID NO: 4449 - DNA, 1209 bp, Artificial Sequence
  P6431 (opLexA::G666, G666 is from A. thaliana)
gtgtactaagggtagtgtgactcattaccacctaaagtagtttcaattttcttctatttttcttggcaaagagttatagtgggaaacaaagggagtggttaataaagaattaattagttaattaagggagttcaagatcataatggtgaggcctccttgttgtgacaaaggaggagtgaagaaagggccatggactcctgaagaagatatcattttagtcacttacatccaagaacatggtcctggtaattggagagctgttcctaccaatactgggctgcttagatgcagtaagagttgtagacttagatggacaaactatttaaggccaggaatcaaaagaggcaatttcacagaacatgaagaaaagatgattgttcatctccaagccctcttaggaaatagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaaggctctctctgaggctttatctcctgccgttgcaccaatcattacatctacagtgacaacaacgtcttcctctgctgaatcaagacgctctacttcctcagctagcgggtttcttaggacgcaagaaacatctacaacttatgcctcaagcaccgaaaatatcgcgaaattgctcaaagggtgggtgaaaaactcgccgaagactcaaaactccgcggatcaaatcgcttctacagaggtaaaagaagtgatcaagagtgatgatgggaaggagtgtgcaggggcatttcagtcattttctgagtttgatcactcatatcaacaggctggtgtttcacctgatcatgagaccaaaccagacataactggatgctgcagtaaccaaagtcaatggtctttgtttgagaagtggttgtttgaggattctggtggacagattggtgatattctattggatgaaaacactaatttcttctgaagagtttgctttaatcacatggttctaattttaggatcctcatctctattttttttttgggttttccaaattaactcgcttagattatcgtgaga

SEQ ID NO: 4450 - DNA, 870 bp, Artificial Sequence
  P6433 (opLexA::G679, G679 is from A. thaliana)
ctaatctgtacggttcttatttcgaaagggtaaaaaccaaaagcgacgcaaagggcaaaatcggaaaaagtgttttatttatggccgccgttagtagttcgtcggagaccggagactgcggcgttacgggaaagagagatgagatcatgttgttcggagttagagtcgtggttgatccgatgagaaagtgtgtgagtttgaacaatctctctgattatgaaaagtcttctccggaggatgagatccctaagatagtcaccgccggagctggagatggtgaagataagaacgaaacggatgcgacggtgattgtcgctgacggttacgcctccgccaatgacgctgtccagatttcgtcttcttccggcgggaggaaacgaggggttccatggacagagaacgagcataagaggttcttgattgggttgcagaaagtaggaaaaggagattggaaaggaatatcaagaaactttgtgaagagtaggactcctactcaagtagctagtcatgctcagaaatacttcctccgacgaaccaacctcaaccgtcgccgaagaagatctagcctttttgatatcactactgagacggttacagaaatggccatggagcaagatcctactcaggagaactcaccactacctgaaaccaacatcagctctggacagcaagcgatgcaagtttttactgacgtggccgacaaaaactgagaatgcaccagagacatttcatctcaacgatccatatctggttccagtaaccttccaagcaaagccaacattcaatctaaacacagatgctgctccactttctctcaacctttgtctggcatcctcatttaatcttaacgagcaacccaactcaagacac

SEQ ID NO: 4451 - DNA, 1304 bp, Artificial Sequence
  P6434 (opLexA::G927, G927 is from A. thaliana)
ggaatctgaagctcttctctactctctactctatcactccatctgtgaacatatctttcttattcttctaggcactatctatttttcactttttgtaattggaatttggagatggctatgcaaactgtgagagaaggtctcttctctgctccacagacttcttggtggactgcttttggatctcagccgttggctccggagagtctcgccggcgattctgactcattcgccggagttaaggtcggatctgtcggagagacaagacaacgtgtggataaacagagcaactctgcaacgcacttagctttctcacttggtgatgtaaagagtccaagacttgtgccaaagcctcatggagctactttctcaatgcaatcaccttgcttggaacttggattttctcagccaccgatctatacaaagtatccctatggagaacaacaatactatggagttgtttcagcctatggatctcagagcagggtaatgcttcctctaaacatggaaacggaagatagtaccatctatgtgaactcaaagcaataccatggaatcataaggagacgccaatcccgcgcaaaggctgctgctgttcttgatcagaagaaattgagtagtagatgccgcaagccatatatgcatcattcgcgccatctccatgcattgcggcgtcctagaggatccggtgggagattcttgaacactaaaagtcagaacttggaaaatagcggaaccaatgcaaagaaaggtgatggaagtatgcagattcagtctcagcctaagcctcagcaaagtaactctcagaattctgaagttgttcatccggaaaacgggaccatgaacttatcgaacggattaaatgtgtcgggatcagaagttactagcatgaactacttcctaagttctcccgttcattctcttggtggcatggtaatgcctagcaagtggatagcagcagcagcagcaatggataatggctgctgcaatttcaaaacctgatcctttaccgtttcacagtcaaacggagagagataaagaactcttgccttggtataaaggattttcctttttgccaatccgctttggctgtgaacaggcaaatcatctttggctcattctctattaaggtaacttcgccgtgaggtgaaaaaagctttgatatatttatcttcagtgtaaaagtagttaaaactggtgaagaacaatgatgtgtttggtcactaaacccacttgttccaactagtagtgtgtgttttaagaaaactctgttatctgattttgtagctctctctggctttgtgtgt

SEQ ID NO: 4452 - DNA, 971 bp, Artificial Sequence
  P6435 (opLexA::G1048, G1048 is from A. thaliana)
cggttagtagaccatggcggaggaatttggaagcatagatttactcggagatgaagatttcttcttcgatttcgatccttcaatcgtaattgattctcttccggcggaggattttcttcagtcttcaccggattcatggatcggagaaatcgagaatcaattgatgaacgatgagaatcatcaagaggagagttttgtggaattggatcagcaatcggtttcagatttcatagcggatctactcgttgattatccaactagcgattctggctccgttgatttggcggctgataaagttctaaccgtcgattctcccgccgccgctgatgattccgggaaggagaattcggatttggttgttgagaagaagtctaatgattctggtagcgagattcatgatgatgatgacgaagaaggagacgatgatgctgtggctaaaaaacgaagaaggagagtaagaaatagagatgcggcggttagatcgagagagaggaagaaggaatatgtacaagatttagagaagaagagtaagtatctcgaaagagaatgcttgagactaggacgtatgcttgagtgcttcgttgctgaaaaccagtctctacgttactgtttgcaaaagggtaatggcaataatactaccatgatgtcgaagcaggagtctgctgtgctcttgttggaatccctgctgttgggttccctgctttggcttctgggagtaaacttcatttgcctattcccttatatgtcccacacaaagtgttgcctcctacgtccagaaccagaaaagctggttctaaacgggctcgggagtagtagcaaaccgtcttataccggcgttagtcggagatgtaagggttcgaggcctaggatgaaataccaaatcttaacccttgcggcgtgacaacgccttttttaactgcttcttttgcgcattttgagttgtagatgagtgtcttttagttttctcgccg

SEQ ID NO: 4453 - DNA, 1433 bp, Artificial Sequence
  P6436 (opLexA::G1057, G1057 is from A. thaliana)
cccaaatattaccagtcgttaggaagcaatcacgagttgttttaggaattagtgaacgtgataatggctagcaatgagatggaaaaatcgagtaaagagaaggaacctaaaacacctcctccttcttctactgcccctccctcttcacaggaaccttcatcggctgtgagtgctggcatggctactccagattggtctggttttcaggcatattctcctatgccgccgcctcatggttatgtggcatctagtccccaacctcacccttatatgtggggagttcagcatatgatgcctccttatggaactccgcctcatccttatgttgcaatgtatcccccaggtggcatgtacgcacatccttcaatgcctccgggttcttatccctatagcccttatgctatgccttctccaaatggaatgactgaagtttctggcaatactacaggcggcactgatggtgatgctaaacaatctgaagtgaaggaaaaattgcccatcaaaagatcaagaggaagcttgggaagtttgaacatgattacaggaaagaacaatgaacctgggaaaaactcaggagcatcagctaatggagcttactccaaaagtggggagagtgcttctgatggttcaagtgaaggaagtgatgggaactctcaaaatgattcgggatctggactagatggaaaggatgctgaagcagcatcagagaatggtggttctgccaatggtccgcaaaatggaagtgctggtacacctattctaccggtgagccagaccgtaccaatcatgccaatgacagctgcaggtgttcctggcccaccaacaaatttaaatattgggatggattactggggtgctccaacttcagctggtatccctggaatgcatgggaaagtatctacaccagttcctggagttgttgctccaggctcgcgagatggtggccattcacaaccctggttacaggacgatagagaacttaagcgacagagacggaagcagtccaatagggagtctgctcgaagatcaaggttgcgtaaacaggccgaatgtgatgagctggcccaacgcgctgaggtgttgaacgaagaaaacacaaatctcagagcagaaatcaacaagctcaaaagccaatgcgaagagcttaccaccgagaacacctctctcaaggaccaactttcattattccctccacttgaaggcataagcatggacaatgaccaccaagaaccagacaccaatcaaacaggtgccgcagagagaaaggttgattcatacaaagactcaacgtgagaagacatagagcaaaaccaattcctaacacaggtataaaaaagtagcagcagcagcaacaacaacactcggcggttctttgctaacagatggtttgtaggattttaggcatcagagatcgattggttccgaatagtttg

SEQ ID NO: 4454 - DNA, 684 bp, Artificial Sequence
  P6439 (opLexA::G7, G7 is from A. thaliana)
gaatcataaacgagccagaatattatcccccgggttacaacttgtctaccaccgcaatttcaaacatggtgtctatgctgactaatgttgtctctggtgagaccgaaccctcggcatctgcgacatggacgatgggtcataagagagaaagagaagagttttctttgcctcctcaaccattgattaccggttcagctgtgactaaagaatgtgaaagctcaatgtccttggagaggccaaaaaaatatagaggagtaaggcaacgaccatggggaaaatgggcggcggagattcgagacccacacaaggcgacacgtgtatggcttgggacattcgagacagccgaggccgccgcaagagcctatgatgcggcagcacttcgctttagaggaagcaaagcaaagcttaatttccccgaaaatgttggaactcagacgattcaacgaaattctcatttcttgcaaaactcaatgcaaccttctctaacatacatcgatcaatgtccaactctattatcttactctcgatgtatggagcaacaacaaccattagtaggcatgttgcagccaacagaagaggaaaatcactttttcgaaaaaccatggaccgaatatgatcaatacaattactcctcttttggttaactaacatatcgtcaacgctttgtatttctacttattcgat

SEQ ID NO: 4455 - DNA, 1025 bp, Artificial Sequence; identical to SEQ ID NO: 883
  P6441 (opLexA::G29, G29 is from A. thaliana)

SEQ ID NO: 4456 - DNA, 1495 bp, Artificial Sequence
  P6445 (opLexA::G426, G426 is from A. thaliana)
ggtgataattgaaacatatgaaacaatcgtcgtcatagaagcagcagagattcaccttctttctttatctttccctctcagaaacaggaaacaaaattcaaaaagaacaaaaaaaaaaggtcaaaccaaaaacgatggcgtttcatcacaatcatctctctcaagacctctccttcaatcatttcaccgaccaacaccaacctccacctccgcaaccgcctcctcctcctccgcaacagcaacaacatttccaagaagcaccgcctcctaattggttaaacacagcgcttcttcgttcctcagataacaacaataacttcctcaacctccacacagccaccgctaacaccacaaccgcaagcagctccgattctccttcctccgccgccgccgccgccgctgctaaccagtggctatctcgctcctcctctttcctccaacgaaacaacaacaacaacgcttccatagtcggagatgggatcgatgatgtcaccggaggagcagacactatgattcagggagagatgaaaaccggcggtggagaaaacaaaaacgacggcggaggagctacggcggcggatggagtagtgagctggcagaatgcgagacacaaggcggagatcctttcgcatcctctttacgagcagcttttgtcggcgcacgttgcttgtttgagaatcgcgactccggttgatcagcttccgagaatcgatgctcagcttgctcagtctcaacacgtcgtcgctaaatactcagctttaggcgccgccgctcaaggtctcgtcggcgacgataaagaacttgaccagttcatgacacattatgtgttgctactgtgttcatttaaagagcaattgcaacaacatgtgcgtgttcatgcaatggaagctgtgatggcttgttgggagattgagcagtctcttcaaagcttaacaggagtgtctcctggagaagggatgggagcaacaatgtctgacgatgaagatgaacaagtagagagtgatgctaatatgttcgatgggggattagatgtgttgggttttggtcctttgattcctactgagagtgagaggtcgttgatggaaagagttagacaagaacttaaacatgaactcaaacagggttacaaggagaagatagtagacataagagaggagatattaaggaagagaagagctgggaagttaccaggagataccacctctgttctcaaagcttggtggcaatctcattccaaatggccttaccctactgaggaagataaggcgaggttggtgcaagagacaggtttgcagctaaaacagataaacaattggttcatcaatcagagaaagaggaactggcatagcaatccatcttcttccactgtattgaagaacaaacgcaaaagcaatgcaggtgacaatagcggaagagagcggttcgcgtagaaacaacaaacatatgatgtgaattggggaggtggaagatgggatttgaaagcagggttttaggg

SEQ ID NO: 4457 - DNA, 2232 bp, Artificial Sequence
  P6449 (opLexA::G1518, G1518 is from A. thaliana)
cacaatcgaagaaatcttttgaaagcaaaatggaagagatttcgacggatccggttgttccagcggtgaaacctgacccgagaacatcttcagttggtgaaggtgctaatcgtcatgaaaatgacgacggaggaagcggcggttctgagattggagcaccggatctggataaagacttgctttgtccgatttgtatgcagattattaaagatgctttcctcacggcttgtggtcatagtttctgctatatgtgtatcatcacacatcttaggaacaagagtgattgtccctgttgtagccaacacctcaccaataatcagctttaccctaatttcttgctcgataagctattgaagaaaacttcagctcggcatgtgtcaaaaactgcatcgcccttggatcagtttcgggaagcactacaaaggggttgtgatgtgtcaattaaggaggttgataatcttctgacacttcttgcggaaaggaagagaaaaatggaacaggaagaagctgagaggaacatgcagatacttttggactttttgcattgtctaaggaagcaaaaagttgatgaactaaatgaggtgcaaactgatctccagtatattaaagaagatataaatgccgttgagagacatagaatagatttataccgagctagggacagatattctgtaaagttgcggatgctcggagatgatccaagcacaagaaatgcatggccacatgagaagaaccagattggtttcaactccaattctctcagcataagaggaggaaattttgtaggcaattatcaaaacaaaaaggtagaggggaaggcacaaggaagctctcatgggctaccaaagaaggatgcgctgagtgggtcagattcgcaaagtttgaatcagtcaactgtctcaatggctagaaagaaacggattcatgctcagttcaatgatttacaagaatgttacctccaaaagcggcgtcagttggcagaccaaccaaatagtaaacaagaaaatgataagagtgtagtacggagggaaggctatagcaacggccttgcagattttcaatctgtgttgactaccttcactcgctacagtcgtctaagagttatagcagaaatccggcatggggatatatttcattcagccaacattgtatcaagcatagagtttgatcgtgatgatgagctgtttgccactgctggtgtttctagatgtataaaggtttttgacttctcttcggttgtaaatgaaccagcagatatgcagtgtccgattgtggagatgtcaactcggtctaaacttagttgcttgagttggaataagcatgaaaaaaatcacatagcaagcagtgattatgaaggaatagtaacagtgtgggatgtaactactaggcagagtcttatggagtatgaagagcacgaaaaacgtgcctggagtgttgacttttcacgaacagaaccatcaatgcttgtatctggtagtgacgactgcaaggttaaagtttggtgcacgaggcaggaagcaagtgtgattaatattgatatgaaagcaaacatatgttgtgtcaagtacaatcctggctcaagcaactacattgcggtcggatcagctgatcatcacatccattattacgatctaagaaacataagccaaccacttcatgtcttcagtggacacaagaaagcagtttcctatgttaaatttttgtccaacaacgagctcgcttctgcgtccacagatagcacactacgcttatgggatgtcaaagacaacttgccagttcgaacattcagaggacatactaacgagaagaactttgtgggtctcacagtgaacagcgagtatctcgcctgtggaagcgagacaaacgaagtatatgtatatcacaaggaaatcacgagacccgtgacatcgcacagatttggatcgccagacatggacgatgcagaggaagaggcaggttcctactttattagtgcggtttgctggaagagtgatagtcccacgatgttgactgcgaatagtcaaggaaccatcaaagttctggtactcgctgcgtgattctagtagacattacaaaagatcttatagcttcgtgaatcaataaaaacaaatttgccgtctatgttctttagtgggagttacatatagagagagaacaatttattaaaagtagggttcatcatttggaaagcaactttgtattattatgcttgccttggaacactcctcaaga

SEQ ID NO: 4458 - DNA, 4203 bp, Artificial Sequence
  P6452 (opLexA::G288, G288 is from A. thaliana)
ccagaaactttgtgattccacggtagttagttccaatctcaatgtctacggcggcagcggctcgtccggtggctggaactggcttacgggagaagacggcagcgtcactggtcaattccttccgattagcgtcggtgactcaacgtttacgttaccacattcaagacggagctaaggttgatcctaaggagtttcaaatctgttgcatctctttcgctaagtaatttcctctctctctctctctcgccattacttatagatattaacatgcgcgcacaaaaatcaaagcttttctaaatgatattctttaatctctgggttttgattttttggctgtgtttttgaattgatgatatgcttaatttctctgttcagaggcattgattttgctatagcgaataatgatattcctaagaaggttgaggagtttccgtggttactcaaacaggttatttctcaattaaaatatggatttttttttttttctggattaatggaggccattgttagtgaactgatgatagtgcttgtgttatgtgacgtagttgtgcagacatggaactgatgtgtacactaagacggcgcttatggtgctgatgatctctgttaaggtaattaagagagtaatctgcagactgcttctgttctgtgaataagcactttttttttgtttagaaaagagaagccttttgtttagatttcatgtcggttggaatgtttgaggtcaaaaggttttcactttgtcaccatctatgatgactcatttggttttgacatataatacttttgatttttgttaaatgtcacagcatgcttgtcatttgggatggttttcggatagcgagagtcaagaacttatcgctctagctgatgaggtttgttttcttccgaatcatggtataaaaccaaaagcaggttatttggatgatgaggatacaaatgttttctttcttattcagataaggacttgttttgggagttctggaagcactagccctggtatcaaaagtcctggcagtacattttcgcagatcatggagaggtaggttttgctttcactgtgtggctttgttgattgacatagattttactctagcagtttattaggagcgtgaatatttccaaacttttatcacaagttagttaagcagtaccaaaaacttcttcaatagaatggtattcactggatacaaatctaagcattggttgaaatttatttctttctgatcccaggttctatccatttgtaaagcttgggcatgttcttgtttcttttgaagtgaaggtgagcctttcttctgttctaaacatctatttctgatattatcatctaagtgtgcttttttggctttccttgcatgacaggctggctatacaatgctggcgcatgatttttatatctcaaagaatatgccacattcactccaagagaaaattgtatgtgtggctcatctgttagtcattcgatatctcagtctggatctctctataataaattctacctttatctgtgcaattaggtggaaaatgtgaatataaccattgcttgcattctatctaacagtccttcatatacatttttgaatctatttcatcttgtagatgtgcccactctctgcaccttttggttagcaaatgatttcttacaccagattcttgtttgctcttcagcggttatttgttgcccagacagacaacatagacacgtctgcctgtatttcaaatcctccagaagtcaggtatgcgaattgtttttgctatttttcctcaccgacacgaaatgtgatccaatttaaccttcctggctttcatatgaaaattgcagcttcttgctaaatggaaagggggttgagaagagagtcaatatcgcaatggtttgtgcagtttgacttttaattggattttgtttctctgcactggttatgtgcatgtttatgtcaatttttttctttccaggatacagggcctcaactccctacaaatgttactgcacagctgaaatatggaactaatcttctccaagtgatggggaattttaaaggtttctattcaattatatatatcttttttgttgtccatgtctatttaattaatatcttattaagatgcttgattgttcaaaggaaattacatcatcataattgcttttacgggactggtagtgccacctgaaaaaccggttcttaaagattaccttcagtccggagtcattgaagcaagtccaggtaattaaagagcataagataggagagaggaacatttttcttgaatgctctatactattccagtttgaatcattcaatgattgcaagcacatacctgtaagattttttttccaatctaatcgctctgtacttttttttacctgtctatagattcagacatcattgaggggccatcacgagtatctctcagttgccctataaggtaccaattctacttttttacgtactactgtgttatcttatggttgtttttttggtcagtgatttagtctttaataaaacagtcgcaagcggatcaagctaccagtcaagggccagttatgtaaacatcttcaggtgatgcaatcaaatatcaagcgatattctctttttttccatccttttaaattggcatacagtgttttaatgtgggtgttaccttatttttctcgtaatatttgttagtgatgtgatactttctgctgcagtgttttgatttctcaaactacgttcacataaatatgaggaacccaacctggcgctgcccgcattgcaatcaacctgtttgctaccctgacattcgtttagatcaaaacatggccaaggcaattagctatctatgttgtaatttgatttctgctacatttttgcgttgcagcttaatactgataactcgtctcatatcatatccttagatattaaaagatgtggaacacaatgctgctgatgtaatcatcgatgctggtggtacatggaaggttacaaaaaatactggcgagaccccggaacctgtgcgtgagatcattcatgatctagaagacccgatgagcttattaaactctggtcctgttgttttcgatcttacgggggatgatgatgctgaactggaagtttttggtgacaacaaggttgaggaccggaagccctgtatgtctgatgctcagggtcaatctaataataacaacacaaataaacatccttcaaacgatgattactcttcgatatttgatatctctgatgtgatcgcacttgacccggagattttatctgctttgggaaacactgcgccacaaccgcatcaagcttcgaatactggaactggtcaacaatattcaaacttatcccaaataccaatgtccatagatccaatgccggtacctgtaccattctcgcagacaccatctccaagagatagaccagcaactacttccactgtcttcaccataccgaatccctctccacaatactctcaggttcatgcttcacctgttacacccaccggaacatatcttggtagaaccactagtccgagatggaaccagacttatcaatctcaagcgccaccaatgacaactccatatacggtttgtgatttcgtttgagagacttgtttctttcttcagtattcgtatgttgacaatatgtgttccttgcagagccggaaggtctcagttccagtaacgagccagtcgccagcgaatgtatcctcttttgttcagtctcagcatgtccctagagtactcagccagcctaataattatggcgtcagaggtttaaccagtagccatgcaagcacttcaaggcagcacccaagtggtcccactgttcaatctgtttctcgattaagtgacctagtggatgtagacttgacggttcctgatacatccaactggcgcccgaggatgcgaggaagtcttgtgcccggttctcattccactgctcttgaccacatgatcatccgacctagccaacagtctcaaacttccactaggctgaatagttcacagccggttcagacaccatcggttcaaacgtctcaagctcagtcaccttttacaacggctgcctatagaaccgagacagttttaggaaaccgaaaccatccggtgcccgctcctcctggcattgttaggcctactggaccgacatcttgatggagaacttgagaggctagaacaaggggaagttggtacttaggagttaggacacaacacttaac

SEQ ID NO: 4459 - DNA, 4152 bp, Artificial Sequence
  P6453 (opLexA::G1080, G1080 is from A. thaliana)
cgtaactccaaagctctcaaaggacatctctttaggtatcaccgtttctccatcttactgttgtttcttctacttgtgtgaaaaatctcaccttttctaggttttcttctactctaatggtccaatttcatttgggtttctttacctttctataaaaatctctcttttttgtcaaattcgtgcacttttcaggttttgattttcgattactctaagaaaacttcttaatttgttcaatcagttttgtgttttgtctgcggtatgactttggttatgctctccttatattctctctcgccctattttgggattccgattacgaaaaagttgccttcttatgtgattctgattgtttgtcatctatccgatggttctgtgaaagttttactctttccataaggattttgcttgaggaactttaaacggcggaacaggttactaagttaagagaataggttagattgtgttaggatttcaaagtggaaatttgttctttaattgttgatagatagttgctttgagggttttttttatttggtatgtatgattgatttgtgttgtgttgggagcaacataagcttgatttgtatttgttgccttggatttaatttatgtatcttcgttgtgtttgcttgggatttctttgtttttttctatatacggaggcatgagatttgagtttgagatttgagagaatgatcatgtctcgctaaatagcaaatatcctgcaatgcgtaattttcatttgttttatatatcatgatgcaatttggtaataaagggcactgttcttctctcatattcaacatgaatacaatgatactctcactcacacctttgcattagataacttagtggaacagatgactcgctattacttaattctctcttctagttatgttttggttatttctgatcgggtcttgccaggggtcagtgcattgatccctagaatacagtgtcttgagaggctttaatactttttttttttttgaagtggttttgtgattgttgtgtttgtttttgttagagttaaggatcactagaatataatcagaaccactattttactgaaatcaataactgaaatagaaccccaaaatacagaacacagttccctcggtctaaaccaagcctatgtcgcaggatggatctatccatcgtcctgcttcctatttattagaatctccaaaaccacttaacagaaaatttcctagtcggaatagttagtgagtcctaattaacatatgatcactccccactaattaaagtttctttttctgaatttgaagctattctagtagttctgcaggttgtaaatctaactcatgttactcttttttttgcatgtaagcttggacaatgggtgcatcaacatccagaatagatgaagataaagccttacagttatgtcgagaaagaaaaaaattcgtccaacaagcactcgatggaagatgtttgttagctgctgctcacgtttcatacgttcagtctcttaagagtaccggaactgccctcaggaaattttctgagactgaagttccagttgaatcttccttgtacacgtccactagtgcaacaccagaacaacctcttgctttaatcgagaaatctgtttctcatttgtcatactctcctccacctgcttcacattcccaccatgacacgtattctcctcctccgtcgcctcctagtaccagtccgttccaggtcaatcatatgaaattcaaagggttttcttcaaaaaaagtggaagagaaaccaccagtatctattattgccactgttacctcatccagtatcccaccaagcaggtctatagaaaagatggaatcaaccccatttgaggaatcttcttccatgccacctgaagcaccttgggattattttggtctttctcatccaattgacaaccagttttcttcttctcatgttgggaatggtcatgtgtcgagatctgttaaggaggaagatggaactccagaggaggaagatgatggtgaggacttttcttttcaagaaagggaagagtccagagattcggatgatgatgagtttgatgaacccacaagtgatactcttgttagaagctttgaaaacttcaatagagtgcgccgtgatcacagtactttgcctcaaagagagggagtggaaagcgactcctcagacgctgagaaaagtaaaactcctgagttatcaccaccagtgacgcctttagtagctactccagtgaacaaaacaccaaacaagggagatcacaccgagaacaagcttcctcccagggacttcttgtcaagtatgaaagagatagagttgctctttgttaaagcttcagagactggaaaagaggttcctaggatgcttgaagccaataaactacatttccgtccaatagttccatcaaaagaaagtaataatttttatctctgaaggttttacttgcacgtatatgtatgcgtaaattccaccttagttaatctaatgtgtctctgcatctaaattgcttactgattgtgattcatatctgaagaaaaacactctttaaatcacttatctctgctttttgcaggtggctccggtgcatcatcactgttcaaaacctgtctctcttgtggggaagatccaaaagatgtaccggaaggtaatcaagcttatctaaattttgggtcaactgttgtagattgtatggagtgtttacagtctaagttgtttgtgcagagcctgctcagaactctgtgaaatacttgacctggcataggactgaatcttcacgatcctcatcttctcggaatcctctcggaggaatgaattctgatgatgtggaagagctcaatagtaatctctttgaaaacatttgcatgattgctggaagccatgcctcaacgctagacagattgtatgcatgggagcggaagctctatgatgaagttaaggtacttatagtgcattgaatagttttttaagaaaatcaagaaattgcagtaaaagtatgtgatttgttttcttcacttttttatcggtttcaggggagtcagactgtgcggagagagtatgacgaaaagtgcagaattttgagagaacttgaatcagaaggtaaaggttcacaaagaatagacaagacacgtgcagttgtgaaagaccttcactccagaatcagagtggcgattcataggatcgactcaatatcaagacggattgaagaactccgtgacaatgagctccagcctcaacttgaagaactcattgaagggtatgtgttaagtcactctctccagtatactcaattcgtttgatttcaaatttgacctgaaccattatatatatcatttcttggatgtgaataggttgagtcgtatgtgggaagtaatgttggaatgccacaaggttcagtttcagttaatcaaagcgtgttacagaggcggaaacattaaactcaacatgcaatcagagttgcacagacaagtaacatctcaccttgaagatgagctctgcgcattggcctcaagctttacaaaatggatcacaggccagaaatcgtatattcaagcgataaacgagtggctggtgaaatgtgtcgccttaccacaacgatccaaacgaaaaaggcgtgcaccacaaccgtctttgagaaactatgggccccccatttatgcaacctgtggaatctggctagaaaagctcgaagtcttacctaccaaagaggtttcaggctccattaaagcacttgcttctgatgttgccaggttcttgccacgtcaggagaagaatcgcaccaagaaacatcgatctggtgagaacaaaaacgatttgacagctcacatgttgcaagatgagacattggaggattgtggtccgggatttgatcggtttaggacaagcttggaaggatttgttggacaactcaaccagtttgcagaatcatcagtgaaaatgtatgaggaacttaaagaaggaatccacggagctaaaaacaactacgagcagttgaagaaggcgtactcttcacaaggaaaatgaatttttttggtttcttagaaaaatggagttttgtcaggttagaattttggagggaaaattgggtttaggcatttgtaaatgcaaaagggattacataaaaagattgcttcaagcatgaatttggcagataattgg

SEQ ID NO: 4460 - DNA, 2516 bp, Artificial Sequence
  P6455 (opLexA::G2006, G2006 is from A. thaliana)
acaagatacatacaccaacttggtcaaagtcacttcctttttataacacctctctttagatcctagtctcactcttcttgtctcatcacccacacatgtaaccatcatcatgggaagatcaccatgttgtgaaaaggctcacatgaacaaaggagcatggactaaagaagaagatcaacgtcttattgattatatacgtaatcatggtgaaggctcttggcgttctcttcctaaatccgttggtaaatttctccaaagttttgattttttttctttcaaatttttatgtttcttgatctgatgattttatcttttctttagggttgttgcgttgtggaaaaagttgtagattaagatggattaattaccttcgtcctgatcttaaacgtggaaatttcactgatggtgaagagcaaatcattgtcaaacttcatagtttatttggcaacaagtaatttcctttctcttaattatgatttatgaacaaaccagttttactgtaaaaaagtaaaaccaatggttaaaccgtgaaagactaaaaaaaatgaagaatcgggttttggtcattagtccgaaccggttcactggtttaatcagattttaaaccgggtgttgtgagtctttttaataccggtttttggtgataactcaaatcggatagctattcgattcacagtcaaactggttcaaccggtttgaaaacactggagaaaactaatcaaatggttttctcttcagtttataaaaatgaataaatgtacaatttggtttatatacaagcagatccagtattgagaagatagcattctatgcgttttgaatggaaaagaaggttttgtaggcttctctctctcttctctcatttgcatcttttagagagagaaagcatctgatcttctttttccggcaacaatagcttctttagtgtttgttggccagttctctgtccagaatcttatggcttttccagcatggatgtctggcttttgtccggcgatgtttagggcaacgtttgattgtcgtggttcttctgacactgttcggttctttacgacgatggtcggtttgcgtttggcttccattggcttctttagcggcggtaggctagctaaggtctagagtttcaccgcctatcttcggtgtttcgtctaccttttggccggattgattccggtttagatttatgttttcttctctcgatttctttatattcagtttgattgagctcttttgcgtttcattgttagatctggcatataattccttgaacctcctttgtttaaagggattaatttgttttccacgcttatcgatttcattttttgagaacaaattaagatgcggattaaggttttttatgcttatgggttgaaactattgcaattgtggctgtttctctaactgatctatggagacgagtgcttttttgttcttttttaaggtgttgctgaaagctccatcggcttactctacgtcgatgttctttagatttcaggaatcaattgcctttgggagatctttcctttccaaatttgctaatgaagtttggtggattctctaattaaaaatcaatggacttctcttgaagctccggcggtttccggtggttttagagttccctgagttgctaaccagaacggtggtgaatggcgacaactaaggcttcttcagtcaacgtgtttcaactttgtttgttaacatcacacgtggctttgtggtggaagggaatctttaatttacttcctctaaaggttttgtttcctggtttgggctttctttatgggcctctgcttataagttagacttgttggttttttatgtaatatggatgactatattttagttgatccaatgttgtaaggtttaatatgtgtcaagatttgtaagtggaaggttccacagttgtatctttacaacataaggttttaaataaagtgcaacacttatgagaaaaaaataataaaaatacaagcagatccaatttgacaaaaccaaataaataaccggtttaatatacccaaatgaccaagttttaaaccaatgttccttacatttcgaatgtctttttttcagatggtctttgattgctgggaaattaccgggaagaaccgataatgagattaaaaattattggaacactcatataaaaaggaagcttcttaaccgtggtattgacccaaaaactcacggttcgatcatcgagcctaaaacgacatcgtttcatccccgaaatgaagatttgaagtccacgtttcccggttctgttaaactaaagatggagacttcttgtgaaaactgtgcttctacgagcggtacgactacggacgaggatttacggttaagtgttgattgtgattacagatatgatcatctggacaaggagctaaacttggacctaacactcgggtacagtccgactcgatttgtcggggtcggatcttgttactagctcgtgtgacgtttgtgtttgtaaattgggatcacatatgaaccttgtatgaattgctaaacgggcg

SEQ ID NO: 4461 - DNA, 1460 bp, Artificial Sequence
  P6460 (opLexA::G631, G631 is from A. thaliana)
cggaggcttctcattagatctctattagtgggtttaggtcaagttcttgaaatggataaggagaaatctcctgcaccaccacctagtggaggtcttcctccaccatcgggtcgttactctgcgttttcacctaatggaagtagctttgcaatgaaagctgaatcatcttttcctcctttgactccaagtggaagcaatagctcagatgctaaccgattcagccatgatattagccgaatgccggataatccacctaagaacctaggccatcgccgagctcattcagagattcttactcttcctgatgacttaagctttgatagtgatcttggtgtggttggtgctgctgatggaccttctttctctgatgatactgacgaggacttactctatatgtatcttgatatggaaaaattcaattcttctgctacatcgacttctcaaatgggtgagccatcagaaccgacttggaggaatgaattagcctcgacttctaaccttcagagtacacccggtagctctagtgaaagaccgagaattagacaccaacacagccaatcgatggatggttcaacaactatcaagcctgagatgcttatgtcagggaatgaagatgtgtctggagttgactctaagaaagccatctctgctgctaaactttctgagcttgctctcattgatccaaaacgcgccaagaggatatgggcaaacaggcagtctgctgcgaggtcaaaagaaaggaagatgagatacattgcagagctcgagagaaaagtacagactttacaaacagaggccacatctctctcagcccagttgactctcttacagagagatacaaatggcctgggtgttgaaaacaatgagcttaaactgcgagtacaaactatggagcaacaggtccacctacaggatgctttaaatgatgcactaaaggaggaagtccagcatcttaaggtattgacggggcaaggtccatcaaatggtacatcaatgaactacggttcttttggatcaaaccagcaattctatcccaataatcagtcgatgcacactatcttagccgcacaacagttacagcagctccagatccagtcacagaaacagcaacaacaacaacagcaacaccagcaacaacaacagcagcagcagcagcaatttcactttcaacagcagcaactgtaccagcttcagcagcagcaacggcttcaacaacaggaacaacaaagcggggcttcagagctaagaagacccatgccttctcctggtcagaaagagagtgtgacatcgcctgatcgtgaaactcccttgacaaaagactgagtctagactgtgctaatgtccaatttagtaagttactcttggaaaatcttctttttcatcgcaggctcatggatttgggatttactgcattatagagttaaaaacaagacagcttagaagttgcggatttagaagtg

SEQ ID NO: 4462 - DNA, 1270 bp, Artificial Sequence; identical to SEQ ID NO: 487
  P6463 (opLexA::G2059, G2059 is from A. thaliana)

SEQ ID NO: 4463 - DNA, 601 bp, Artificial Sequence
  P6466 (opLexA::G1881, G1881 is from A. thaliana)
taactttgaaagtgagactaatcgtttgagtaaaaaacatgcgaattttgtgtgatgcttgtgagagcgccgccgctatcgtcttttgcgccgccgacgaagctgccctctgttgctcctgcgacgaaaaagttcataagtgcaacaagctggctagtcggcatcttcgtgtaggcttagctgatccgagtaatgcaccaagctgtgacatatgcgaaaatgcacccgcattcttttactgtgagatagatggtagttccctttgtctacaatgtgatatggtggtacatgttggtgggaagagaacacataggcggtttctattactgagacagagaattgagtttccaggcgataagcctaatcatgctgaccaactgggactacggtgtcaaaaggcttcctctggtcgtggtcaagaatcaaatgggaatggtgatcatgatcataatatgatcgatcttaactccaatcctcaaagagtacacgagcctggatcacataaccaagaggagggtattgatgtaaataacgcaaacaatcacgagcatgaatagtgatcgcagatacacaagatcaagtaagaacctatgcaagaaca

SEQ ID NO: 4464 - DNA, 671 bp, Artificial Sequence
  P6468 (opLexA::G362, G362 is from A. thaliana)
ccatcgataaacacatacgttcacacatatatgtctataaatccgacaatgtctcgtactggcgaaagttcttcaggttcgtcctccgacaagacgataaagctattcggcttcgaactcatcagcggcagtcgtacgccggaaatcacgacggcggaaagcgtgagctcgtccacaaacacgacgtcgttaacagtgatgaaaagacacgagtgccaatactgcggtaaagagtttgcaaattctcaagccttaggaggtcaccaaaacgctcacaagaaggagaggttgaagaagaagaggcttcagcttcaagctcggcgagccagcatcggctattatctcaccaaccaccaacaacccataacgacgtcatttcagagacaatacaaaacgccgtcgtattgtgcattctcctccatgcacgtgaataatgatcagatgggtgtgtacaacgaagattggtcgtcgaggtcgtcgcagattaacttcggtaataatgacacgtgccaagatcttaatgaacaaagcggtgagatgggtaagctgtacggtgttcgaccgaacatgattcagttccagagagatctgagttctcgttctgatcagatgagaagtattaactcgctggatcttcatctaggttttgccggagatgcggcataacaaat

SEQ ID NO: 4465 - DNA, 639 bp, Artificial Sequence; identical to SEQ ID NO: 1117
  P6470 (opLexA::G527, G527 is from A. thaliana)

SEQ ID NO: 4466 - DNA, 1431 bp, Artificial Sequence
  P6473 (opLexA::G1531, G1531 is from A. thaliana)
cctctaaacgtcttcagccaaggtatatatatttctccatttcgttaatcttaattatggttgtgtgtttttttttcttcttctgatttctcatattgatatctcactgatctgttgaaatttgggggataatattgttaacgggtgaccaatacagtactacagttacatgaaccaatatagttttgtaacggacccaaattcttgcaattttgttgaatacccttttgttctcatatattaaataaaaaatttgatttattttcgttcattctaaggtttgagaggtttaggccttggcgatgattgggccgtcatgtttatcgtatagagagtaggcctgttcagaaatctttgccatcaattacttactttatgtactcgtcgttggtctggaatttgagtctaagctcattaataagaggattgacaaataaacaaacgttttgatacgtatagttcaattttgattttctaatcatccaagtatccaactattttctatttggttttcttatgaatttgtttattgcataatttcttgatgaatgttgttttttggttaatgttgaaataatttagcttgagagaagcctaaagaaaatctaaaatgtgtgagtcaagcaacaaagtcagagtatcgccatacccgcttcggtcttcgaggaccgacaaacacaaggcgtcagagtcgcctattgagacaggttgggaggatgtgcggtgtgtaatctgcatggaaccacctcacaatgctgttcttttgacatgctcttcttcttctagtggatgtcatccttacatgtgcgatacgagtgttcgtcactccaattgtttcaagcagttccgcagaaaaaccataaaaaagcgcctataccccaagaccttacattgtcctctctgtagaggtgaagtatccgagacgacaaaggtgacgagcactgcaagaagatttatgaatgctaaaccgaggtcttgctccgtagaggattgcaaattctctgggacgttttctcagcttactaagcacttgaaaactgagcatcgcggtattgtgccaccaaaggtcgatccactgagacaacagagatgggaaatgatggagagacattctgaatacgttgaactcatgactgcagctgggatttcgcgtatggctgaggtgatgcaacaacagcttccccaggatcagaatcatcctcatgtgtttcaagtgaccgttaatggaaccatatggaatctaattgatccgagtcagggaaggaatggattaggcatcaccaactatagcgcaatgcagtttgtaccattaagcataaatcacagtagaactctgtgaagaattctaacttgtttagtgaaaacccaagtttaaagttttgatgatctcaatatcttactttcattagttgggatccataatgtttagaa

SEQ ID NO: 4467 - DNA, 1561 bp, Artificial Sequence
  P6474 (opLexA::G1838, G1838 is from A. thaliana)
cagattttcaactaggaaaaaagttacaatcttttttgatggctcctccaatgacgaattgcttaacgttttctctgtcaccaatggagatgttgaaatcaactgatcagtctcacttctcttcttcttacgacgattcttctactccttatctcatcgataacttctatgctttcaaagaagaagctgagatagaagctgctgctgcttcaatggcggattcaacaaccttatctacttttttcgatcattctcagactcagattccaaagctggaagatttcctcggtgattcctttgtccgttactctgataaccaaacagagacccaagactcttcttctctcactccattctacgatccacgtcaccgcaccgttgccgaaggagttacagggttcttctctgatcatcatcagccagatttcaagacgataaactcgggaccagaaatcttcgatgactcaacaacttccaacatcggtggtactcatctctccagtcacgtggtggagtcatcaacgacggcgaagttagggtttaacggtgattgcaccaccaccggaggagttttgtctctaggggttaacaacacatcagatcaacctttgagctgtaacaatggcgagagaggtggaaacagtaacaagaagaaaacagtttctaagaaggaaacatcagatgattcaaagaagaagattgtcgaaacattgggacaaagaacttcaatttatcgtggagtcacccgacatagatggactggaagatacgaagcgcatctatgggataacagctgtaggagggaaggtcaagccagaaaaggacgtcaagtgtacttaggtggatatgacaaggaagatagagcagctagagcctatgacttggcagctttaaaatactggggttctactgctactacaaattttccggtctcgagttattcaaaagaacttgaggaaatgaatcacatgaccaagcaagagtttattgcatctcttaggaggaaaagtagcggtttttcgagaggagcttcaatatatagaggtgtcacaaggcatcatcaacaaggtcgctggcaagcaagaatcggccgtgtcgcaggaaacaaagatctttacctcggaacctttgcaaccgaagaggaagcagcagaggcttatgacattgcagccataaagttcagaggaatcaacgcagtaactaactttgagatgaacaggtatgacattgaagctgtcatgaatagttctttacctgtaggaggagcagctgcgaaacgccacaaactcaaactcgctcttgaatctccttcttcatcatcctctgaccataacctccaacaacaacagttgcttccgtcctcttctccctcggatcaaaaccctaactcaatcccatgtggcattccatttgagccttcagttctctattaccaccagaacttctttcagcattatcctttggtctctgactctacaattcaagctcctatgaaccaagctgagtttttcttgtggcctaaccagtcttactaaatcatttggttcgttcttgcttagac

SEQ ID NO: 4468 - DNA, 1157 bp, Artificial Sequence
  P6478 (opLexA::G2426, G2426 is from A. thaliana)
cttcagctagattaagactaataacttgtgtgggaaaacaatgggcagatcgccatgttgtgataaggccgggttgaagaaagggccttggactccagaagaggatcagaaacttttggcttatattgaagaacatggccatggaagctggcgttctttgcctgagaaagccggtctccaaaggtgtggaaagagttgcagactcagatggactaactacctaagacctgacatcaagagaggcaaattcactgtacaagaagaacaaaccatcattcaactccacgctctcctcggaaacaggtggtcagcgattgcaactcatttaccaaagaggacagacaacgagatcaagaactactggaacacacacttgaagaaacgtctgatcaaaatggggatagatccagtgactcacaagcacaaaaacgagactctttcgtcttccacaggacaatcaaagaacgcagccacgcttagtcatatggctcaatgggagagtgcaagactcgaagctgaagcaaggctagctagagaatcaaagcttctccatttacagcattaccaaaacaataacaaccttaacaaatcagcagctcctcaacaacattgcttcactcaaaaaacatcaacaaactggactaaaccaaaccaaggaaacggagaccaacagcttgaatctccgacatcgacggtgacattctctgagaatcttctgatgcctttaggaatccctacggatagcagcagaaatagaaacaataacaacaatgagtcctcggcgatgattgaattggccgtatcttcgtcaacctcctccgatgtgagtctggtcaaagaacatgaacacgactggattaggcagatcaactgtggtagtggaggaataggagaaggattcacgagtctattgatcggtgattcggtcggccggggtttacccaccgggaaaaacgaagcgacggcgggcgtggggaatgagagtgagtataactactatgaggataacaagaattactggaatagcattctcaacttggttgattcttcaccgtccgattccgcgacgatgttctgatctaagggtcttcaaccaaacatttttaattctcagattgttttttaaatgtcgatagctttccaatactttttatctt

SEQ ID NO: 4469 - DNA, 2034 bp, Artificial Sequence
  P6493 (opLexA::G586, G586 is from A. thaliana)
catgactagtcataacctttaaatcacttctgctttttttctgtttctcttttgatttattcaaagacaacaaagttttgtttttgacaaaaaatctgatctttgtttgttcgtttgtttgttacatggggatgaagaaacaatggcaaccggagaaaacagaacggtgccggacaatctaaagaaacagctcgcagtttcagttcgaaacattcaatggagttatggaatcttctggtctgtctctgcttctcaaccaggagtgttggagtggggagatggatattacaatggagacataaagacaaggaagacgattcaagcagcagaagtcaaaattgaccagttaggtcttgagagaagtgagcagcttagagagctttatgaatctctctccctcgctgaatcctcagcttccggtagctctcaggtcactagacgagcttccgccgccgctctctcaccggaggacctcaccgacaccgagtggtactacttagtatgcatgtctttcgtcttcaacatcggtgaaggaatccccggaggagcgttatccaatggagaaccaatatggctttgtaacgctgaaaccgccgatagcaaagtcttcactcgttctcttctagctaaaagtgcttcgcttcagacagtggtttgcttcccgtttcttggaggagtccttgagattggcacgaccgaacatattaaagaggacatgaacgtgatacaaagtgttaagacgttgttccttgaagctcctccatatactacaatatcgacaagatcagactatcaagaaatttttgatcccttaagtgacgataaatacactccggtgtttataaccgaagcttttccaacaacttctactagcgggtttgagtatgaacctgaggatcatgattcgttcatcaacgatggtggtgcgtctcaggtacaaagctggcagtttgtgggtgaagaaatcagtaactgcattcaccaatcgttaaattcaagcgattgcgtttcccaaacgtttgttggaacaaccgggagacttgcttgcgatccaaggaagagtaggattcaacggttaggtcagattcaagaacagagtaaccatgtaaatatggacgacgatgttcattaccaaggcgtgatatcgacgattttcaaaacaacgcatcagctaatactcggaccgcagtttcagaacttcgataagcggtctagcttcacaaggtggaagcgatcatcatctgtgaaaacattgggagagaaatcgcagaagatgataaagaagatactcttcgaggttcctttgatgaacaagaaagaagagttgttaccggacacaccagaggaaaccgggaaccatgccttgtccgagaagaaacgccgcgagaaattgaatgaacggtttatgacattgagatcaatcattccctcaattagtaagattgataaagtgtcgattcttgatgatacaattgagtatcttcaagatttacagaaacgggttcaagagttggaatcttgtagagaatctgctgatacagagacacggataacgatgatgaagaggaagaaaccggatgatgaggaggaaagagcatcagcgaattgtatgaacagcaaaaggaaggggagtgatgtgaatgtaggagaagatgaaccagctgatatcggttatgctggtctaacggataacttaaggatcagttcattaggtaacgaggtggttattgagcttagatgcgcttggagagaagggatattgcttgagataatggatgtgattagtgatctcaacttggattctcactcggttcagtcgtcaaccggagacggtttactctgcttaactgtcaattgcaagcataaagggacaaaaatagcaacaacaggaatgatccaagaggcacttcaaagggttgcatggatatgttaaggattcaaggtttagatttgacaaaattagctttttctctggtttggtttcccaattttcggtaatcagtgattctaaccgagtttttgtgattttggaaa

SEQ ID NO: 4470 - DNA, 1115 bp, Artificial Sequence
  P6494 (opLexA::G699, G699 is from A. thaliana)
tcatgaagagactaagcagctcagattcaatgtgtggtctaatctccacttctacagatgaacagagtccaagagggtacggaagtaattaccaatctatgcttgaaggttacgatgaagatgctacactaatcgaggaatattccggcaaccaccaccacatgggtctatcggagaagaagagaagattaaaagttgaccaagtcaaagctcttgagaagaatttcgaacttgagaataaactcgaacctgagaggaaaactaaattagcacaagagcttggacttcaacctcgtcaagtagctgtttggtttcagaaccgtcgtgcacggtggaaaacaaaacagcttgaaaaagattacggtgttcttaagggtcaatacgattctctccgccacaatttcgattctctccgccgtgacaatgattcccttctccaagagattagtaaaatcaaagctaaggtaaacggtgaagaagataacaacaacaacaaagctattacggagggtgttaaggaagaggaagttcacaagacggattcgattccttcgtctcctctgcagtttctagaacattcctctggttttaactaccggcgaagcttcactgacctccgtgaccttctaccgaattccaccgttgtcgaggctggatcttccgatagttgcgattcaagcgccgttcttaacgacgaaacaagttctgataacggaagattgacgccgcctgtgacggttactggcgggagtttcttacagtttgtgaaaacagagcaaacagaggatcacgaggattttctaagcggtgaagaagcttgtggtttcttctccgatgaacagccgccgtcacttcattggtactctgcttcagatcattggacttgagaattgtttatcaaattggtgctctgtttagtctcaatgggaaaacagagaagagggcaaaggtggaataattgataaataaggattaaggatgaaggggattattaaattaaatccgcgggagaagttaattttgggtttaagattgtaatggctcttcatgtaattaacgatgtcgagaggggctttcacagaaataggaatcaatggggacactctgatatgaaa

SEQ ID NO: 4471 - DNA, 1298 bp, Artificial Sequence
  P6495 (opLexA::G751, G751 is from A. thaliana)
tcttgccaaaataaaaaataaaaaaggagtttgttgtgaagccaatgaacgagatcgtgacaaacacatgcctaaaacaacagtcgaatcctccttctcctgctactcctgtggaaaggaaggcaagaccggagaaagaccaggctttgaactgtccaagatgcaactccttaaacaccaagttctgttactacaacaactacagcctgacgcagcccaggtacttttgtaaagactgcaggaggtattggaccgcaggtggttccctcaggaacatccccgtcggtggcggcgtccgcaagaacaagagatcttcttccaattcctcttcctcttcaccctcttcgtcttcttcttcaaagaaacctctttttgccaacaacaacacgcctacgcctcctcttcctcatcttaaccctaagattggtgaagcagccgctactaaagttcaagacttgacgttttctcaagggtttgggaacgcccacgaggttaaagatctcaacttggcgttttctcaagggtttgggatcggtcacaatcatcacagtagtatcccagagtttctgcaagtagtacccagcagcagtatgaagaacaacccactggtctcaacttcctcgtctttggagcttttagggatctctagttcctctgcttcctctaactcacgccctgctttcatgtcttatccaaatgttcatgattcatcggtctacacagcatccgggtttggtctgagttacccacagtttcaagagttcatgagaccagctttgggattctctcttgatggtggggatcctctacgtcaagaagaggggtccagtggcactaataatggaaggccgttgctgccatttgagagcctcctcaaacttccagtttcatcatcaagcaccaatagtggtgggaatggcaatctgaaagagaataatgatgagcatagtgatcatgaacatgagaaagaagaaggagaagctgaccaatctgttgggttttggagtggcatgttaagtgctggtgcttctgctgctgcatctggtggttcatggcaataattttagtcatggaccccatcccatgagagtttttagaagaaatgattacatttttcacccatgttttaaaaagatgagagggttaactatataatctgggtgcttactattttagtccttttcctttggtttccttctccttttctaaaaattattattaactttgttgggttggggatggatactgtatgtatttagactctcttttaaatcaatctcagttgttagttacctaaa

SEQ ID NO: 4472 - DNA, 1174 bp, Artificial Sequence
  P6496 (opLexA::G764, G764 is from A. thaliana)
cgatatctttacaaccattaaacaaaaaatttggccactacaagttgaaaaagttttgattatatctaatcgctgaaatggattacaaggtatcaagaagtggggagatagtagaaggagaagtagaagattcagaaaagattgatttaccacctggtttcagatttcacccaactgatgaagaacttataacacactatctaagaccaaaggttgtaaactcttttttctctgctatagctattggtgaagttgatctcaacaaagtcgagccttgggacttgccttggaaggctaagcttggggaaaaagagtggtacttcttttgcgtaagagaccgaaaatacccgactggtttaagaacgaatcgtgctactaaagccggttattggaaagctacagggaaagataaagagatcttcaaagggaaatctcttgttggtatgaagaaaacattggttttctacaaaggaagagctcctaaaggagtaaaaacaaattgggtcatgcatgagtatcgattagaaggcaaattcgctatcgataatctctctaaaaccgctaagaacgaatgtgttattagtcgtgtttttcatacacggactgatggtacgaaggagcatatgtccgttggtttacctccgctgatggattcttctccatatctaaagagtagaggacaagactctttagccgggaccacccttggtgggttgttgtctcacgttacctacttctccgaccaaacaaccgatgacaagagtcttgtggccgattttaaaactaccatgtttggttccggatcgactaactttttaccaaacataggttctctactagacttcgatcctctgtttctacaaaacaattcttcagtactgaagatgttgcttgacaatgaagaaacccaatttaagaagaatcttcacaattcaggttcatcagagagtgaactaacagcgagttcttggcaaggtcacaattcttatggttccactggtccagtgaatcttgattgcgtttggaaattctgaatttggaaaatcgaaaatttggatgttaactagggggtatatagggtttttaaaaacagtgtatatatgcgttatgtgttagctttagattctaggatatacaaagatgacactaatagattcttataacattttgtaaa

SEQ ID NO: 4473 - DNA, 831 bp, Artificial Sequence
  P6812 (opLexA::G481, G481 is from A. thaliana)
agcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 4474 - DNA, 2269 bp, Artificial Sequence; identical to SEQ ID NO: 793
  P6817 (opLexA::G273, G273 is from A. thaliana)

SEQ ID NO: 4475 - DNA, 903 bp, Artificial Sequence
  P6819 (opLexA::G345, G345 is from A. thaliana)
gtatgtgttaaagagtgaatggagctgtggacagaagctagagccttaaaggcaagtctaagaggagaatctactatatctctcaaacatcaccaagtgattgtgtcggaagatttaagccgaacttcttccttgccggaagatttctccgttgagtgtttcctcgatttctcagaaggtcaaaaagaagaagaagaagaagttgtctctgtttcttcttcacaagagcaagaagaacaagaacatgattgtgtctttagttcacaaccttgcatctttgatcaacttccttctttgccggatgaagatgtggaagagcttgaatgggtatctcgtgttgtggatgattgttcatcaccagaagtttcacttctcttaacacaaacacataaaaccaaaccaagcttctcaagaattccggttaaaccaagaaccaaacggtctcggaacagtttaaccggtagtcgtgtttggccactcgtttcaaccaatcatcaacatgcagcaacagagcagttgaggaagaagaaacaagaaactgtccttgtgtttcaacgaagatgcagccattgtggcacaaacaacacaccacagtggagaaccggtccggtcggtccaaaaaccttatgtaatgcatgtggagtccggtttaagtctggtaggctctgcccggaatacagaccggcggatagtccgacgttctcgaatgagattcactcaaatcttcataggaaggttctggaattaagaaagagtaaagagttgggtgaagaaacaggtgaagctagtactaaatcagacccagtcaaatttggcagcaagtggtagataagacttaggtaaaacctactttttgtaacattatctgtagtgttgtaatttaacaacttgcttcttaacaaa

SEQ ID NO: 4476 - DNA, 776 bp, Artificial Sequence
  P6820 (opLexA::G365, G365 is from A. thaliana)
tacatggaaccgtccatcaaaggagatcaagaaatgttaaaaatcaagaaacaaggtcatcaagatcttgagttggggttgacccttttgtcacgtggaaccgcgacctcatcagagctcaatctcatcgattctttcaaaaccagctcatcatcgacttctcatcatcagcaccagcaagaacaattggcagatccgagagtgttctcgtgtaattattgtcaaagaaagttctatagttcacaagcgctaggcggtcaccaaaacgctcataaacgtgagcgcaccttagccaaacgtggacagtattacaagatgactctctcctccttgccttcttcagcgtttgcgtttggccacggttcagtcagcagattcgcaagcatggcatcgttaccattacatggctcggtgaataacaggtcaacgttagggattcaagctcattcaacgatccataagcccagcttcttaggaagacaaacgacgagtttaagtcatgttttcaaacagagcattcaccagaaaccgaccataggaaagatgttgccggagaaatttcaccttgaagtcgccggaaataataacagtaacatggttgctgctaagttggagagaattggacatttcaagagcaaccaagaagatcataatcagtttaagaaaattgacttgactcttaagctatgagctctgccatcttctttttagtcttcattataactttttttattctcatctttgtttgatataatgattgacggcagggtgtgtta

SEQ ID NO: 4477 - DNA, 3319 bp, Artificial Sequence
  P6828 (opLexA::G886, G886 is from A. thaliana)
cgaagcaaacgtctagagttccgacgttatgggttgcggaggatcaaaagtagataatcaaccaatagtgattctctgtagagaacgaaaggagctgcttaaagcggcgtcgtatcatcgttctgctctcgctgtcgctcacctaacttacttccagtctctctccgacgtcggtgaagctattcaacgtttcgttgacgacgaagtcgtagctggtttttcttcttcttcttcgccggattctccagttcttacacttccgtccgacgaagggaaaccgacgaaacacaagaggatttctccttcttcaaccacctcaatttctcattccgtcatcgaagaagaagacactgatgatgattcgcatttgcatctaagctccggatccgaatccgaatcagaagttggatctaaggatcatatccaaattactagcactccagaacaagagcggtcaacggaatcatttccttccggttatcatccaacaaactatgctccaccggtttacccacctggttatccacccggttacccattcagttacccgaccggttattcatcgggtaattatcaaccgggttacccgaattacacaggtgagaatccatacggaaatcgaggaatgtattacatgaagaaatctgcgccacaatcacgaccgttcattttccaaccggagaatcatcgagtggaggagaacgcgcaatggccgtcggattctggatttagaaacacaggagtgcaacggagatcgccgtctccgttacctcctccgtcaccacctacggtttcaacttgggattttttgaatgtgtttgatacttatgattacagcaacgcccgttctcgtgcttcgggatattatccgatgggaatggcgtcaatctcaagcagtcctgattcgaaggaagttagagaaagagaagggattcctgagctagaagaagtaacagagcaagaagttatcaagcaagtgtatagacgtcccaagagaccaggattggagaaggttaaagaacacagagacgagcacaagcacaacgtttttcctgagaggaacattaacaaaagggaagttccaatgccagaacaagtcactgagagctcattggattcagagacaatttcgtctttttcaggaagtgatgtagaatcggagtttcactatgttaatggtggtgaaggaaagagtagcagcatcagttcaatcagtcatggggctgggacaaagagctcgagagaagtagaagaacagtatgggaggaaaaaaggagtgagctttgagttggaggaaacaacgagcacttcgtcttttgatgttgaatcttccaagataagtagcttatccagtttgtcgattcatgccactagggatctcagagaagttgttaaggagatcaagagtgagttcgagattgcttcttcttgtgggaaggaggttgctttgttacttgaagtcggcaagttgccttatcagcataaaaacaatggcgttaaaggtactgtgtcttaactcgtatgttttgctagccatgatcatgcattagtttacagctagaataaaactatctgcttttgtaacccatgcgtttaaattttgcaatgttatgtcatggttacaaagtaatgctgataaacttaagtttaatggttatttgatgaattgtaatatgaacagaaatgttgaaaactctaaattccaatataatgggaaagtatcttaaattattgtggtttagactgatttgcttggtgttgaactatgaaccatgtattctgtccgcactgctttttagatgaaggtcttttttactgttttgtttggtggggttttaaatgaaaagttttgcttttcagttatcttatccaggatcatgtatctggtagcaccatccacacggtcatcgcactctcagcccagactatcaatacgtttaacatctagaactcgaaaaatggcgaaatcatacaatggacaagatgttaatggaggcttcaatggaaacctctcatcaaccttagagaaactgtatgcgtgggaaaagaaactgtacaaggaagtcaaggtattaatatttttaatatttgatgcagctttgtgtttctgaatcactaatgggaatctatatcacatatagattcttgcgtgatgttaaattgtgatttgcgtgtgatggcaggacgaagaaaagcttcgtgctatctatgaagagaagtgcaggagactaaaaaaaatggatagtcatggagcagaatctatcaagatcgatgctactcgggcagccattaggaagcttctgaccaaaatcgatgtttgtataagatcagttgattcgatttccagcagaatccataaacttagagatgaagagttgcagccacagttgatacagttaattcacgggtaaatcatctctctatattttgacatctttttacagattaagctgaaaaaactgatattttgtgttttgaaggttgataagaatgtggaggtcaatgctgaggtgccaccagaaacagtttcaggcgatcagggagagcaaggttcgatctctaaaggcgaacacaaccttacaaaatgactctggctctacagcaattcttgatcttgagatagagcttagagaatggtgcatcagcttcaacaactgggtcaacacccagaaatcatacgtccagttcctaagcggatggctcacgaaatgccttcactatgaacccgaggcaaccgatgacggaatcgctcctttctctcctagccagatcggtgcaccgcccatctttatcatttgcaaagattggcaagaagcaatgtgtagaatatctggagagaatgtgaccaatgcaatgcaaggttttgcttcaagcctacacgagctatgggagaagcaagaagaagagcaaagggtaaaagcgcaatctgagcagcgagatgcagagtcagagagaagtgtggtttcgaaaggtcggtcagagagcgggatatcagctttggatgatttgaaagtggatttagattcaatgaggaagaggctagtcgaggagagaggtaagggtaaagaaaccattaagcttgtgaacaacgcgtcttcgagcagcttaaaagctggtttagttcccattttcggggcactgagaaaattcacatcagaagttgtgaaagctcatgaaattgttaggcttcaacatcctcagacctcttcttgagtagagagtgtggacttaccacatttttgcaccgttttgaagttttgttacttgcaaattagacataggtctatatagaaggaaattgttgtatagatgagttctg

SEQ ID NO: 4478 - DNA, 1165 bp, Artificial Sequence
  P6837 (opLexA::G625, G625 is from A. thaliana)
gtcctctccactatttttctcaatttctttaatctctctctttctctctctacttcctcttcctcttcttcttcttcttcttcttcatctatggaccctttagcttcccaacatcaacacaaccatctggaagataataaccaaaccctaacccataataatcctcaatccgattccaccaccgactcatcaacttcctccgctcaacgcaaacgcaaaggcaaaggtggtccggacaactccaagttccgttaccgtggcgttcgacaaagaagctggggcaaatgggtcgccgagatccgagagccacgtaagcgcactcgcaagtggcttggtactttcgcaaccgccgaagacgccgcacgtgcctacgaccgggctgccgtttacctatacgggtcacgtgctcagctcaacttaaccccttcgtctccttcctccgtctcttcctcttcctcctccgtctccgccgcttcttctccttccacctcctcttcctccactcaaaccctaagacctctcctccctcgccccgccgccgccaccgtaggaggaggagccaactttggtccgtacggtatcccttttaacaacaacatcttccttaatggtgggacctctatgttatgccctagttatggttttttccctcaacaacaacaacaacaaaatcagatggtccagatgggacaattccaacaccaacagtatcagaatcttcattctaatactaacaataacaagatttctgacatcgagctcactgatgttccggtaactaattcgacttcgtttcatcatgaggtggcgttagggcaggaacaaggaggaagtgggtgtaataataatagttcgatggaggatttgaactctctagctggttcggtgggttcgagtctatcaataactcatccaccgccgttggttgatccggtatgttctatgggtctggatccgggttatatggttggagatggatcttcgaccatttggccttttggaggagaagaagaatatagtcataattgggggagtatttgggattttattgatcccatcttgggggaattctattaatttgtttttgtggaagatcatattatatacgatgagcatccctaaggtcggtcaagagcattggagattcattgttgagaggaatcaa

SEQ ID NO: 4479 - DNA, 891 bp, Artificial Sequence; identical to SEQ ID NO: 695
  P6841 (opLexA::G255, G255 is from A. thaliana)

SEQ ID NO: 4480 - DNA, 827 bp, Artificial Sequence
  P6849 (opLexA::G32, G32 is from A. thaliana)
cataaaggtatagtatcattattagaaagatgaacacaacatcatcaaagagcaagaagaagcaagacgatcaggttggtacaaggtttcttggggtgagaagaaggccttggggaagatacgcagctgagattagagacccaactacgaaggagcgtcactggcttggcactttcgatacggcggaagaagctgccttggcctacgatagagctgctcggtccatgcgtggcacacgtgccagaaccaactttgtttactcagacatgcctccttcctcatccgtcacctccattgtttctcctgacgatcctcctcctcctccacctcctcctgctcctcctagcaatgatcctgtcgattacatgatgatgtttaaccaatactcatccactgactcgccaatgcttcagcctcattgtgatcaagtggacagttacatgtttggtggctctcaatcttcgaattcttattgctattctaatgacagtagtaatgagctgcctcctctcccgagcgacttgtcgaattcgtgttatagccaaccacagtggacctggaccggtgacgactactcgtctgagtacgtacatagtccaatgttcagcagaatgcctccggtttctgactctttccctcaaggtttcaactactttggctcctaattctttctcatcgtccatatttaataccttcctcatttgtaccttttccttcttcttcttttttgggtttatctatgtttcgccgtccttgatctctgcctatgtgatcaaagtgactgtttgtcattagtttttcaataacaagttatcatttgtatcttg

SEQ ID NO: 4481 - DNA, 2026 bp, Artificial Sequence; identical to SEQ ID NO: 25
  P6854 (opLexA::G1062, G1062 is from A. thaliana)

SEQ ID NO: 4482 - DNA, 458 bp, Artificial Sequence
  P6857 (opLexA::G1394, G1394 is from A. thaliana)
gtcctaagtatacatgtcttttttgtcttttgtctgaatctttctcgtcggaaacacagatctcagttccttacagaagaatctccgactcgtttctttgccggcattctcagatttccggatactagccatgagcagtgatggttccgccggaaaggcggttgttgaagccaaaggattgaaccctggattgatagtgctgcttgttattggaggtctgcttgtgacatttctcatagccaattacgttatgtacatgtatgctcagaagaatctacctccaaggaagaagaagcctctttccaaaaagaagctcaagcgtgagaagctgaagcagggagtccctgtgcccggcgaatagattccagcttcttcaacagtctgtgtttttaacctgtaatcacaatgtcattgagacttttgtatgggagagtagcaaacgtcccttgttctggaaa

SEQ ID NO: 4483 - DNA, 829 bp, Artificial Sequence
  P6858 (opLexA::G1379, G1379 is from A. thaliana)
ctctgcctctctctctctctcaaaacccatctcgaaagtctttctctttcgagggtttagatcctccatggaaggcggcggagttgctgacgtggctgtccccggtacgaggaagagagacagaccttacaaaggaattaggatgaggaagtggggaaagtgggtggcggagattcgtgagcctaacaagcgctctaggttatggcttggctcttactctactcccgaggcggcggcgcgagcttacgacacggcggttttctatcttagaggacctacggcgaggcttaacttccctgagcttcttcctggggagaaattctccgacgaggatatgtcggctgcgaccatcaggaagaaagccacggaggtcggtgctcaggttgatgctttgggcacggcggtgcaaaataaccgccaccgtgtttttggtcagaatcgagatagtgatgtggataataagaattttcatcggaattatcaaaacggtgaacgagaagaagaagaagaagatgaggatgacaagagattgaggagtggcggccggttattggatcgggttgacttgaataaattacccgacccggaaagctccgatgaagaatgggaaagcaaacattaaaaatatatagtttggagcggtggctgttgctaacgtacgccaacggcttgcttctacgaatcattagcgccgtttatgatttttttttttttttttttcattatctgaaaatttagggctttttagttattaatttttgttttgtttttttcctttcttgcgagttttgcggtttatggaattttaggctattgcttaacgaaaaaa

SEQ ID NO: 4484 - DNA, 2143 bp, Artificial Sequence
  P6861 (opLexA::G1774, G1774 is from A. thaliana)
ctatacaaggatcgtgattacaagagaggacttattctatagcaaaaccctagattttctagcagtttgtttcgtctccttcctcctaaattaacctcaaattcgttttagggtttcttcagccgccggtaatggacttttcagatgatgacatgattgataacaaatcaggggaggagaattacagctatggtggtggtaacgaatccgatgactacaacgatgtggtagacacaattattccatcggagaaaagttacgtgattctcaaggaagaagacattctcaagcttcaaagagacgatatcgaacgagtttcatcgattctttctctaagccaagtggaagtgattgttctgcttcttcactataactggtgtgttagtaaagtcgaagacgaatggtttacggacgaagaaagaatccgtaaagccgttggtttattgaaggagcctgtcgttgacttcaatggtggagaaaaagacaaaaaatgtagaaaagtgaatatccaatgtggaatttgctttgaatcatacactcgagaggaaattgcaagggtttcttgtggtcatccttattgcaagacttgctgggctggttacatcactacaaaaatcgaagacggtccgggatgtttaagggttaaatgtcctgagccttcttgttccgctgctgttggtaaagatatgatcgaggatgttactgagacaaaagttaacgagaagtattctagatatattcttaggtcttatgtagaagatgggaagaagattaaatggtgtccatcaccgggatgcggatacgcggttgaattcggtggaagtgaaagtagtagttacgatgtttcttgtttgtgttcgtataggttttgctggaattgcagtgaagatgctcacagtcctgtggattgtgacacggtttcaaaatggatattcaagaaccaggatgagtcggagaacaagaattggatgcttgcgaattcaaagccttgtcctgaatgcaagcgtcctatcgagaagaacgatggatgtaaccatatgacatgttcagctccgtgtggacatgagttttgttggatttgtcttaaagcatatcgtcgtcacagcggtgcttgcaataggtttgttgtggagcaggcagaaagtaagagagcattgcttcagagtgaaatcaaaagatacacgcattattatgtaagatgggcagaaaatcaatcgtcgaggctaaaggctatgagagatctggagaagttgcaatcggtgcagcttaaggagcttagtgacaatcagtgcacgtctgaaactcagcttcaattcaccgtagatgcatggcttcaggtcagtaaaagtatttaaataactctttgattatactaacattacgaaactgtatatatatagcaagcaccgtagaaattagtaaaaacgatttcatgattcaactaaagttgtaatttatcaaaagtcgaacttagagtttcatcggtaaatcaccatgatgcgaataaccaatgaatttccaattttgacgtttgataaattagaacattgttgttgaacatttattgacatgtgattgattttactgtggtagatcatcgaatgtaggagagtcttgaaatggacatatgcatatggatactaccttcaagatctccccaagcggaaattttttgagtatttgcaaggttagttttcgttaaggaaacacttaaatatgtacgttgtgatcataatttgtccattgtagctaattaaatttttgttgtcaggggaggctgaatcaggtttggagaggcttcatcattgtgcagagaatgagttgaaacaatttttcattaaaagtgaagatccatccgatactttcaatgctttccggatgaaattaactggtttgactacagtaaccaaaacctacttcgaaaatctggtgaaagctttggagaatggtctggttgatgtgacacataatgaattccccccagataatgagaccaaatcaacacaagaaaaatacgaagaatatcaagattacgaagacgattttctcgaaacacaaaggctatatgatgaagctcttttaagtggctgctactacgattgagatctctctcagcctcaatttaatcccttcgttttgctag

SEQ ID NO: 4485 - DNA, 1338 bp, Artificial Sequence
  P6866 (opLexA::G1389, G1389 is from A. thaliana)
aaagcaagtgggcaacaaaaacggcacgcaagtttttcttccaagttaaaacaactcttggaatgtcattttgaaaggtaaaaaaataatgggacttaaaggatatagcgtcggagaaggaggaggagagatagttgaggttcaaggcggtcacataatccgagccactggacgcaaagaccgtcatagcaaagtgttcacatcaaagggtccacgtgaccggcgcgtgagactctcagctcacacggcgattcaattctacgatgtgcaagaccggttaggttatgaccggcctagcaaagccgttgattggctcatcaagaaagccaaaaccgctattgataagcttgaactcggggagactactactactactactcgtcaagaaccggtgaatactaaaccggaatctcccactttggttttccaaagagagaacaatgaccaaacgcagttcgtggcggccaatcttgatcctgaagacgcaatgaaaacgtttttcccggcgacgacaacaacaaacggtggtggtggtacaaacatcaatttccaaaactaccctcatcaggatgacaacaacatggtctcaagaacaacaacaccaccaccaaaccttagccaagatcttggtctctctcttcacccatttcaagggaacaacaacacagtcgtagttcccgagaccaacaatttcaccacgactcatttcgacacgttcgggagaatctctggatggaatcatcacgacttaactatgacgtcatcatcctcatcagaacatcaacaacaagaacaagaagaaaggagtaatggtggtttcatggtgaatcatcatcctcaccatcatcatcatcaaccgtcgatgatgacattgcttaatagtcagcaacaacaagtgtttcttggtggccaacaacaacaacaacaaaggggtacccttcagtccagtttattccctcattcgtttcgttcttgggatcatcatcaaacgacgtcggatcatcatcatcatcagaatcaagcttcttcgatgtttgcttcatcatcacagtatggttctcatgggatgatgatgatgcaaggccttagtttccccaacactacaagactactccacggagaagaagctactcaaccaaactcttcttcttctcctccaaactcacacctctaaactaaggtttgcttcttctttttaatgtatttatatattttaagtataataggttattaatcaagaaaccagacaataattaaatctttcataattaaattaccacatgtatttctttcagacaaccatggaggttcaaattcatgatgacatgcattgaacaa

SEQ ID NO: 4486 - DNA, 1863 bp, Artificial Sequence
  P6867 (opLexA::G910, G910 is from A. thaliana)
gtcaccaatctctgatctttttagttctcttatcggtaaaaacttattcttctctttttgttcgatctgtgatctctaataaactaatttgatattttttttgatgtaacagggaggaatcttttatatgttatgtataataataattgagaatatggaaagagtatgtgagttttgtaaagcgtatagagcagtggtttattgtatagctgatacagcaaatctttgtttaacatgtgatgcaaaggttcattcagctaattcactctcgggacggcatttacgtacggttttatgtgattcttgtaagaatcagccttgtgttgttcgatgttttgaccataaaatgtttctttgccatggatgtaatgataagtttcatggtggtggctcttctgagcatcgtagaagggatttgaggtgttatacgggttgtcctcctgctaaagatttcgcggttatgtggggttttcgagttatggatgacgatgatgatgtttcgttagagcaatcttttcgaatggttaaacctaaggtttgatgcttgttttgtatacatatttacagtttcttataaccggtgtaagatctcgggtcgaaagtagactaatacacccgaggcttgtagaaagccgtctacaatggccaaaagagaaccacaacgatctgtggccttaaaccatagggcgagtctttcacctacttgaacaaaccactggaccatacgctctttagtttttttttgtatatctttttatagctttgtagatgaatagatctctttatagctgatgtaccgatgattttgatggtttcaggtgcaaagagaaggtggttttatcttggaacagattcttgaattggagaaggttcagctcagggaagagaatggtagttcttccttgacagaacgaggtgatccatctccattggagcttcctaagaaacccgaagaacagttaatcgatcttccgcagaccggaaaagagctggttgttgatttttcacacttgtcctcatcttccacacttggtgattccttttgggaatgcaaaagtccatacaataagaacaatcaggtttggtttaaatatcacacagtacatagtcttagtgggaaccattagttacatgagattagctctgtttctgcagttgtggcatcaaaatatacaagacattggagtatgtgaagatacaatctgcagtgacgatgacttccaaatacctgacattgatctcactttccggaactttgaagagcaatttggagctgatcctgagccaattgcagatagtaacaacgtgttctttgtttcttcccttgacaaatcacatgaggtttgaaatctttcatccactactatagagtctagttcagtaaccactatatatgttttattgttatataacctaagatctctctacctttgatgtgtgttcagatgaagacattttcttcttcattcaataatcccatatttgcacctaaaccagcttcatcaactatctcattctcaagcagtgaaaccgataacccttatagtcactcagaggaagtaatctcattttgtccctccctctctaacaatacacgtcaaaaggtcatcacaaggctcaaggagaagaagagagcaagagtgtaagtcttaaacaccgatgatcctaattcacattaaatagtatatcttaaacttttcataatgtaactagcattttcttaattcagggaggagaaaaaagcttaatatggtcccaagaaaatggcagagtaacacaatttcttgcaatgcctttgtacataagacactaatctacctcttcatctattttacatggctcagtttcttgcatgtaactgtg

SEQ ID NO: 4487 - DNA, 690 bp, Artificial Sequence
  P6872 (opLexA::G167, G167 is from A. thaliana)
aatagttaaagaaaatatggggaggaaaaaactaaaattgaagagaatagagtccctaaaagagagaagtagcaaattttcaaaacgtaaaaaaggtctttttaaaaaggcagaagaagtagcattgttatgcgactcggatataatgttaattgttgtttctcccaccgagaagcctacagtttttaacactcgttctagatcattccatacaatccttgagaggttttgcatgctttcattacaagaacgggaagagaggagagcttacacaataaagacgctgaaaaaattggtgaacgagaacaataccgaaatatccactgaaaatgatcaattttcgcctgaaaataatcaactttcgcctgaaaatgatcaatttttgtctgaaatggatcaattttcgtctaaaaatcaatatttatctgaaagtgatgaagtgattcaggatgataataaggtcaccaaactgagagaactcaaggaattgtatgctgagaagatggtaattttgaggaactgggaaagcccgaataaagttacagatttgcaaggacttaatatcatggaagaatatttagtcaattctctcaaccatatcaaaaaaaccataaagattaagatccaagaagagcaacaaaactcttatttcatttagagatggagagtttatttgtacttagccgactg

SEQ ID NO: 4488 - DNA, 1437 bp, Artificial Sequence
  P6873 (opLexA::G962, G962 is from A. thaliana)
tctctactcaacaccactcaatttcatctctctttttcccttccattgttagtataaaaaccaagcaaacccttaatcacttttcatcatcatatatcaccttaatccacatgcatacacatatctagtctttttgatatatggcaattgtatcctccacaacaagcatcattcccatgagtaaccaagtcaacaataacgaaaaaggtatagaagacaatgatcatagaggcggccaagagagtcatgtccaaaatgaagatgaagctgatgatcatgatcatgacatggtcatgcccggatttagattccatcctaccgaagaagaactcatagagttttaccttcgccgaaaagttgaaggcaaacgctttaatgtagaactcatcactttcctcgatctttatcgctatgatccttgggaacttcctgctatggcggcgataggagagaaagagtggtacttctatgtgccaagagatcggaaatatagaaatggagatagaccgaaccgagtaacgacttcaggatattggaaagccaccggagctgataggatgatcagatcggagacttctcggcctatcggattaaagaaaaccctagttttctactctggtaaagcccctaaaggcactcgtactagttggatcatgaacgagtatcgtcttccgcaccatgaaaccgagaagtaccaaaaggctgaaatatcattgtgccgagtgtacaaaaggccaggagtagaagatcatccatcggtaccacgttctctctccacaagacatcataaccataactcatcgacatcatcccgtttagccttaagacaacaacaacaccattcatcctcctctaatcattccgacaacaaccttaacaacaacaacaacatcaacaatctcgagaagctctccaccgaatattccggcgacggcagcacaacaacaacgaccacaaacagtaactctgacgttaccattgctctagccaatcaaaacatatatcgtccaatgccttacgacacaagcaacaacacattgatagtctctacgagaaatcatcaagacgatgatgaaactgccattgttgacgatcttcaaagactagttaactaccaaatatcagatggaggtaacatcaatcaccaatactttcaaattgctcaacagtttcatcatactcaacaacaaaatgctaacgcaaacgcattacaattggtggctgcggcgactacagcgacaacgctaatgcctcaaactcaagcggcgttagctatgaacatgattcctgcaggaacgattccaaacaatgctttgtgggatatgtggaatccaatagtaccagatggaaacagagatcactatactaatattccttttaagtaatttaattagatcatgattattatccatgacaataattaatgctgctttgcgc

SEQ ID NO: 4489 - DNA, 828 bp, Artificial Sequence
  P6875 (opLexA::G2519, G2519 is from A. thaliana)
gatcaatataggaactccagaagagaatcttgatcaattaagtatcatgtctcacatcgctgttgaaaggaatcgaagaaggcaaatgaacgagcatcttaaatcccttcgttctttgactccttgtttctacatcaaaaggggagatcaagcttcgatcatcggaggagtgatagagttcatcaaagagttgcagcaattggttcaagttcttgagtccaagaaacgtcgaaagaccctaaaccgaccatctttcccttatgatcaccagacaatcgagccatccagtttaggagccgccactacccgagtaccgtttagtcgaatcgaaaatgtgatgaccacaagtactttcaaggaagtaggagcatgctgtaactcccctcatgctaacgtagaagcaaagatttcaggttctaatgttgtattgagagttgtctctaggcgaatcgtggggcagctcgtaaagatcatctctgtcttagagaagctatcttttcaagttcttcacctcaatattagtagcatggaggagactgtcttatactttttcgttgttaagataggattggagtgtcacttaagcttggaggagctaactcttgaagttcagaaaagctttgtgtctgatgaagtgatcgtctctaccaattaaaaacaaaattctacatgtactagagcgtgtatcgttttttgggattaataatcatataatcgttacatgagccttgatactttgctagaaataagctcctctaaacaaaaccttctttttaaaaaaacacacttatgttttacttagtttgttgttgtatccgaagttgatca

SEQ ID NO: 4490 - DNA, 1546 bp, Artificial Sequence
  P6877 (opLexA::G2105, G2105 is from A. thaliana)
acactctctgacttgaactcttctcttctaccgaatcaaaccaaatggaggatcatcaaaaccatccacagtacggtatagaacaaccatcttctcaattctcctctgatctcttcggcttcaacctcgtttcagcgccggaccagcaccatcgtcttcatttcaccgaccatgagataagtttattgccacgtggaatacaagggcttacggtggctggaaacaacagtaacactattacaacgatccagagtggtggctgtgttggtgggtttagtggctttacggacggcggaggaacagggaggtggccgaggcaagagacgttgatgttgttggaggtcagatctcgtcttgatcacaagttcaaagaagctaatcaaaagggtcctctctgggatgaagtttctaggattatgtcggaggaacatggatacactaggagtggcaagaagtgtagagagaagttcgagaatctctacaagtactataaaaaaacaaaagaaggcaaatccggtcggcgacaagatggtaaaaactatagatttttccggcagcttgaagcgatatacggcgaatccaaagactcggtttcttgctataacaacacgcagttcataatgaccaatgctcttcatagtaatttccgcgcttctaacattcataacatcgtccctcatcatcagaatcccttgatgaccaataccaatactcaaagtcaaagccttagcatttctaacaatttcaactcctcctccgatttggatctaacttcttcctctgaaggaaacgaaactactaaaagagaggggatgcattggaaggaaaagatcaaggaattcattggtgttcatatggagaggttgatagagaagcaagatttttggcttgagaagttgatgaagattgtggaagacaaagaacatcaaaggatgctgagagaagaggaatggagaaggattgaagcggaaaggatcgataaggaacgttcgttttggacaaaagagagggagaggattgaagctcgggatgttgcggtgattaatgccttgcagtacttgacgggaagggcattgataaggccggattcttcgtctcctacagagaggattaatgggaatggaagcgataaaatgatggctgataatgaatttgctgatgaaggaaataagggcaagatggataaaaaacaaatgaataagaaaaggaaggagaaatggtcaagccacggagggaatcatccaagaaccaaagagaatatgatgatatacaacaatcaagaaactaagattaatgatttttgtcgagatgatgaccaatgccatcatgaaggttactcaccttcaaactccaagaacgcaggaactccgagctgcagcaatgccatggcagctagtacaaagtgctttccattgcttgaaggagaaggagatcagaacttgtgggagggttatggtttgaagcaaaggaaagaaaataatcatcagtaagctacatttttcattctcaaaatgaagaataagagaacttagaaacgatgtcgtgg

SEQ ID NO: 4491 - DNA, 806 bp, Artificial Sequence
  P6884 (opLexA::G2139, G2139 is from A. thaliana)
cctacaagaaatcaaacactagttctggtttctgcaaacatgtcatctacgaagcaagcaaagggaagaaaaacaaaggggaagcaaaagatcgagatgaagaaggtggagaactatggagataggatgattacgttctcaaaacgtaaaaccggaatttttaagaaaatgaacgagctcgtagcaatgtgtgacgttgaagtggctttcttgattttctctcaacccaagaagccctatacattcgcacatccgtctatgaagaaagtggctgaccggttaaagaacccttcgagacaagaaccattagagagagacgataccagacccctcgtcgaagcttataagaaacgaaggctccacgacctcgtaaaaaaaatggaggcgctcgaagaggagcttgcgatggatctagagaagttgaaactgttgaaggaatcgagaaatgaaaagaagttagataaaatgtggtggaactttccttcggaaggtttgagcgcgaaggagctgcagcaaaggtaccaagcgatgctcgagttacgtgataacttatgcgacaatatggctcacttacgattgggaaaagactgtggtggttcatcttctgttcgtgtgggacgtcgagtttctggtggtgttcgtctgttcgatcgtgaagcatgatcatacatattcatacttgatgatttaaatttctttgtatttgaactgctgattttaatactgcatgtatccatttgacgaagctcaatcgtctcgagtatatctctattatctaacagtattgagaaaaaaggagtttcagt

SEQ ID NO: 4492 - DNA, 875 bp, Artificial Sequence
  P6885 (opLexA::G157, G157 is from A. thaliana)
gggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttcttcaaa

SEQ ID NO: 4493 - DNA, 719 bp, Artificial Sequence
  P6892 (opLexA::G179, G179 is from A. thaliana)
tctttctctccctcccctccttggcttttttcaagttcccaccataaacgcagagggagttaagaaatggaggataggaggtgtgatgtgttgtttccatgttcatcatcggttgatcctcgcttgacagagtttcatggggtcgacaactctgctcagccgacaacatcatccgaagagaagccaaggagtaagaagaagaagaaagagagagaagcgaggtacgcgttccagacaagaagccaggttgatatactggatgatggatacaggtggaggaagtacggccaaaaagcagtcaagaacaatccattccccaggagctattataagtgcacagaagaaggatgcagagtgaagaagcaagtgcagaggcaatggggagacgaaggagtggtggtgacgacataccaaggtgttcatacacatgccgttgataaaccctctgataatttccaccacatcttgacacaaatgcacatcttccctcccttttgcttgaaggaatgattagaggaattggattgtaatatttactttcccaaaaacgttgggctcacaccatcagacctttacttttaaactagcagcaactcacatatctcaaaaatactaatccttatctttgtctttatgggacctttgaatccatctgctttggtgtcttagtctcggctgccctgtaatcgaaagtatattcatcatcaaattaccaaaca

SEQ ID NO: 4494 - DNA, 1159 bp, Artificial Sequence
  P6893 (opLexA::G1642, G1642 is from A. thaliana)
agcgatagagatctagagagagagagaggatgggtcatcactcatgctgcaacaagcaaaaggtgaagagagggctttggtcacctgaagaagacgaaaagctcatcaactacatcaattcatatggccatggatgttggagctctgttcctaaacatgcaggtttgcagagatgtggaaagagttgtagattaagatggataaattatctaagacctgatcttaaacgtggaagcttctctcctcaagaagctgctcttatcattgagcttcacagcattcttggtaacagatgggctcaaattgctaaacatctacctggaagaacagataacgaggtcaagaatttctggaactcgagcattaaaaagaagctcatgtctcaccatcatcacggtcatcatcatcatcatctctcttccatggcgagtttgctcacaaaccttccttatcacaatggattcaaccctactacagtcgacgatgaaagttcaagattcatgtccaatatcatcacaaacactaaccctaatttcatcactccaagccatctctctcttccttctcctcatgttatgaccccattgatgttcccaacctctagagaaggagatttcaagtttctaaccacaaacaacccaaaccaatctcatcaccatgataataaccattacaacaacctcgacattttgtcacccacaccaactataaacaatcatcatcaaccttcactttcttcttgtcctcatgataataatctccaatggccagcgttaccagatttcccagcgagtaccatttctggtttccaagaaacccttcaagattatgatgatgctaataaactcaacgtgtttgtgacaccattcaacgataatgccaaaaagttattatgtggagaagttctcgaaggcaaagtactatcttcctcctcaccaatttcacaagatcacggcctttttcttcccaccacgtacaactttcaaatgacttctacgagtgatcatcaacatcatcatcgagtggactcatacatcaatcacatgatcataccatcatcatcctcatcgtcgccaatctcttgtggacagtacgtcataacttaagcaaaccctattcatactcaatcaacatgggattccttgacatggtacgtaat

SEQ ID NO: 4495 - DNA, 2004 bp, Artificial Sequence
  P6895 (opLexA::G1777, G1777 is from A. thaliana)
gtactttatcacctccgtcgttctataatactctcttccgtcaatcatatcatttgtcgacaatttcattctgatcagtttaaaaattgatccatggatgataatttaagcggcgaggaagaagattactattactcctccgatcaggaatctctcaacgggattgataatgatgaatccgtttcgatacctgtttcttcccgatcaaatactgtcaaggttattacgaaggaatcacttttggctgcacagagggaggatttgcggagagtgatggaattgttatcggttaaggagcaccatgctcggactcttcttatacattaccgatgggatgtggagaagttgtttgctgttcttgttgagaaagggaaagatagcttgttttctggtgctggtgttacacttcttgaaaaccaaagttgtgattcttccgtttctggttcttcttcgatgatgagttgtgatatctgcgtagaggatgtaccgggttatcagctgacaaggatggactgtggccatagcttttgcaataactgttggactgggcattttactgtaaagataaatgaaggtcagagcaaaaggattatatgcatggctcataagtgtaatgctatttgtgatgaagatgttgtcagggctctagttagtaaaagccaaccagatttagctgagaagtttgatcgttttcttcttgagtcgtatatcgaagataacaaaatggtgaagtggtgtccgagtactcctcattgtgggaatgccatacgtgttgaggatgacgagctctgtgaggttgaatgctcttgtggtttgcagttctgtttcagttgttcatctcaagctcactccccttgctcttgtgtgatgtgggaactatggagaaagaagtgctttgatgagtccgagactgttaattggataactgttcacacaaagccgtgtcccaaatgtcacaagcctgttgaaaagaatggtggatgcaatctcgtgacttgtctttgtcgacaatctttttgttggttgtgtggtgaagctactggaagggaccacacttgggctagaatctcgggtcatagttgtggtcggttccaagaagataaagagaaacaaatggagagagcgaaaagggatctcaagcggtatatgcattatcataaccgatacaaagcacatatcgactcctccaagctagaggctaagcttagtaataatattagtaaaaaggtgtctatttcagaaaagagggagttacaacttaaagacttcagctgggctaccaatggactccatcggttatttagatcaagacgagttctttcatattcataccctttcgcattttacatgtttggagatgagctgtttaaagatgagatgagctctgaggaaagagaaataaaacaaaatctgtttgaggatcagcagcagcagcttgaggctaatgttgagaaactttctaagttcttggaggaaccttttgatcaatttgctgatgataaggtcatgcagataaggattcaagtcatcaatttgtcagttgcggtcgatacactctgcgaaaatatgtatgaatgcattgagaatgacttgttgggttctctgcaacttggcatccacaacattactccatacagatcaaacggcatagaacgagcatctgatttttatagttcccagaattccaaggaagctgttggtcagtcttcggattgtggatggacgtccaggctcgatcaagctttggagtcagggaagtcggaagacacaagttgctcttccgggaagcgtgctagaatagacgaaagttacagaaacagccaaaccaccttactagatttaaacttgccagcggaagccattgagcggaaatgaacacttatccttcttcacctcccaataacaccctttttgtccaaataaagtgtgttacccggatatttatagctctaaacccaatcccctctgcttaatttgtcagtgaccttacctaaccctcttcag

SEQ ID NO: 4496 - DNA, 1011 bp, Artificial Sequence
  P6896 (opLexA::G2084, G2084 is from A. thaliana)
gcgcatccatcttcaccgtttcatacgaaactctttacgaggagtctctctttacttttctctctctctcaaagaaagaaagaaaagcctcttttaattttctccggccagagtgtgtgggatgcacaaggaaagagggaaaatgccggtttctagcaacagaaatagagtatcgccatacccgcttcgctcttgcaggaacaagaaacaaaaagaagtcgaggcgtcgtcgtcacctgttgagttagagagtgttagtgaatgggaggatgtgaggtgtgtgatttgtatggagcctcctcacaatgctgtcctcttgcaatgctcttctttctccaaaggatgtcgtgcttacatgtgtgatacaagcgctcgtcactccaattgtttcaagcagtaccgcagaagcaacagctcaagccgttgtagtggcaagactctacattgtccctactgcagaggagaggttcaggggactatgaagtcgacttgtgctcggagattcatgaatgctagaccgaggtgttgtactgttgacaagtgcgatttctcagggacctatgcgcagctgaaaaatcacttgaaaactgagcatcctggttttacaccgccaaagttagacccttgggagcaacacatgtgggagcagttggagagagaggcggagtacattgaaatgctcaacgctcgtcagagatgggatgcagaacagagattgttggcgacttctctccatcagcttccatatcgtcatcccatgattgatctcaactttgatgcgttggtgcataatctgtttcttggtgcgtccatggagagccgtgcaagcaccgacaattacccggctcacataccccgtctggagttccatgcccccatgtatcccagatggacgccatgaagattctgagtgccagagtctatgaggaattcttccaaaagttttgatgtctcttgatttttatcataatgtaatgttcttgtagcgacatcagttcttgttctaggcat

SEQ ID NO: 4497 - DNA, 840 bp, Artificial Sequence
  P6901 (opLexA::G280, G280 is from A. thaliana)
aatccctcctcacacagattccttccttcatcacctcacacactctctacgcttgacatggccttcgatctccaccatggctcagcttcagatacgcattcatcagaacttccgtcgttttctctcccaccttatcctcagatgataatggaagcgattgagtccttgaacgataagaacggctgcaacaaaacgacgattgctaagcacatcgagtcgactcaacaaactctaccgccgtcacacatgacgctgctcagctaccatctcaaccagatgaagaaaaccggtcagctaatcatggtgaagaacaattatatgaaaccagatccagatgctcctcctaagcgtggtcgtggccgtcctccgaagcagaagactcaggccgaatctgacgccgctgctgctgctgttgttgctgccaccgtcgtctctacagatccgcctagatctcgtggccgtccaccgaagccgaaagatccatcggagcctccccaggagaaggtcattaccggatctggaaggccacgaggacgaccaccgaagagaccgagaacagattcggagacggttgctgcgccggaaccggcagctcaggcgacaggtgagcgtaggggacgtgggagacctccgaaggtgaagccgacggtggttgctccggttgggtgctgaattaatcggtacttatgcaatttcggaatctttagttactgaaaaatggaatctcttagagagtaagagagtgctttaatttagcttaattagatttatttggatttctttcagtatttggattgtaaactttagaatttgtgtgtgtgttgttgcttagtcctgaga

SEQ ID NO: 4498 - DNA, 1362 bp, Artificial Sequence
  P6903 (opLexA::G2011, G2011 is from A. thaliana)
cacaccccaatttctcactctctctctcactaaaacccgtaaattttctactatatcaaatgagcccaaaaaaagatgctgtttctaaaccaactccaatttcagtacccgtttcgagacgatccgatatacccgggtctctctacgtcgacactgacatgggtttctctgggtcaccacttcccatgccactagacatcttacaagggaatccaattccaccttttttatccaagacttttgatttggttgatgacccgactcttgacccggtcatctcttggggactgaccggagctagcttcgtagtttgggatcctctagagtttgccagaatcatacttccaaggaatttcaaacacaacaatttctccagcttcgtcagacagcttaacacttatggatttcgaaagattgatactgacaagtgggaattcgctaacgaggctttccttagaggcaagaagcatcttctgaagaacattcatcgtcgtcgatcaccacaatccaaccaaacttgctgcagtagcactagccaaagccaagggtcacctactgaggttggaggagagattgagaagctgaggaaagagcggcgtgcattgatggaggaaatggttgagcttcagcagcaaagcagaggcacagctcgacatgtggacactgtaaaccagaggctgaaagctgcagagcaacgtcagaagcaattgctctctttcttggctaagttgtttcagaaccggggtttcttggaacgcctgaagaacttcaaaggaaaagaaaaaggaggagctcttggattggaaaaggcgagaaagaagttcatcaagcaccaccagcagcctcaagattctccaacaggaggggaggtggtgaagtatgaagctgatgattgggagagattgctaatgtatgacgaagagactgagaacaccaagggtttaggagggatgacttcaagcgatccaaaaggcaagaacttgatgtatccatcagaagaagagatgagcaaaccagattacttgatgtccttcccatctcctgaaggacttattaaacaagaagagacgacatggagcatgggtttcgatactacaataccgagtttcagcaacaccgatgcatggggaaacacaatggactataatgatgtctcagagtttggttttgctgcagaaacaacaagtgatggtttgcctgatgtctgctgggaacaatttgctgcaggaatcacagagactggattcaactggccaactggtgatgatgatgataatacgccaatgaatgatccttaggatcttttcatatatagtttagaccaaaaacccgtttcttatcgggtgaactattaattcatta

SEQ ID NO: 4499 - DNA, 621 bp, Artificial Sequence
  P6906 (opLexA::G2510, G2510 is from A. thaliana)
ataacaaactctttaatgtcaccacagagaatgaagctatcatcaccaccagttaccaacaacgaaccaaccgccaccgcttctgccgttaaatcttgcggcggaggaggtaaagaaaccagctcatcgaccacgaggcatccagtgtaccacggagttcgcaaacgccgatggggaaaatgggtttctgagatcagagagccccggaaaaagtctcggatttggctcggatcttttccggtgccggagatggctgctaaggcctacgacgtggcagcgttttgtctaaaaggtagaaaagctcagctgaatttccctgaagaaatcgaggatctacctcgaccgtccacgtgtactcccagagatatccaagtcgcagcggccaaagcagccaacgccgtgaagatcatcaaaatgggagatgatgacgtggcaggaatagacgacggagatgatttctgggaaggcattgagctgcctgagcttatgatgagtggaggtgggtggtcgccggagccttttgttgccggagatgatgccacgtggcttgtcgacggagacttgtatcagtatcagttcatggcgtgtctgtgagtgttgctgtcgattgtgtcgtattcg

SEQ ID NO: 4500 - DNA, 1080 bp, Artificial Sequence; identical to SEQ ID NO: 669
  P7007 (opLexA::G245, G245 is from A. thaliana)

SEQ ID NO: 4501 - DNA, 1073 bp, Artificial Sequence
  P7015 (opLexA::G664, G664 is from A. thaliana)
caatccctcaatataaaataacaagtagaattgatctgcctatatataagattttgagacgaaataagatctaaaccacaagaaagaaagtaaacataaaagtatgggaaggtcaccgtgctgtgagaaagctcacacaaacaaaggagcatggacgaaagaagaggacgagaggctcgtcgcctacattaaagctcatggagaaggctgctggagatctctccccaaagccgccggacttcttcgctgtggcaagagctgccgtctccggtggatcaactatctccggcctgaccttaagcgtggaaacttcaccgaggaagaagacgaactcatcatcaagctccatagccttcttggcaacaaatggtcgcttattgccgggagattaccgggaagaacagataacgagataaagaactattggaacacgcatatacgaagaaagcttataaacagagggattgatccaacgagtcatagaccaatccaagaatcatcagcttctcaagattctaaacctacacaactagaaccagttacgagtaataccattaatatctcattcacttctgctccaaaggtcgaaacgttccatgaaagtataagctttccgggaaaatcagagaaaatctcaatgcttacgttcaaagaagaaaaagatgagtgcccagttcaagaaaagttcccagatttgaatcttgagctcagaatcagtcttcctgatgatgttgatcgtcttcaagggcatggaaagtcaacaacgccacgttgtttcaagtgcagcttagggatgataaacggcatggagtgcagatgcggaagaatgagatgcgatgtagtcggaggtagcagcaaggggagtgacatgagcaatggatttgattttttagggttggcaaagaaagagaccacttctcttttgggctttcgaagcttggagatgaaataatattgtcaaattttaggcgtaactgtacaaaacttttgcctagataatttgaaagtatatcttcaacttgtatgagaaatttaactggtgaattataatatatagaatttgttttttaaaa

SEQ ID NO: 4502 - DNA, 756 bp, Artificial Sequence
  P7021 (opLexA::G279, G279 is from A. thaliana)
cacaaacacgtagttattctctctttactctctctatttctctctcttcaaaccctacgaagatcttcttcttcttcttcaagaatcgatcatgaaaggagctaaatctaaggctgaaaccaggagcacaaagctctctgtgactaagaagcctgctaagggagccaaaggtgctgctaaagatccaaacaaacctaagaggccttccagtgccttcttcgttttcatggaagatttccgtgtgacgtacaaggaggagcaccctaagaacaagtctgttgctgctgttggcaaagctggtggtgaaaagtggaaatccttgtctgactctgagaaggctccttatgtggctaaggctgacaagcgcaaggttgagtatgagaagaacatgaaagcctacaacaagaaattggaggaaggccctaaggaagatgaggaatctgacaagtcagtttcagaggttaacgatgaggatgatgctgaggatggcagtgaagaggaggaagacgatgattaagaagttgaagttgtggtagcgtaatatagaaggctgcaaggaatctctcggatgtttttatctcctctcttaaaatgttaattcgggtggttaaagtggtttttttttttttctttttctttttcttactgatgtttcgttttagtaaactattacctatctcccactgattctacgggtaatggaaaaagtgaatgtagaatgtttagatggtgaaatgagagatttgtagctctaaa

SEQ ID NO: 4503 - DNA, 1238 bp, Artificial Sequence
  P7027 (opLexA::G467, G467 is from A. thaliana)
gttgcttcaagagttttggatagtgtagcagagagattttaactaatgggtttataaaattttgttcttttgcgtgaacaagttgtcaacttctagacagattttctttttgaagtgttttcttgtcgaaattcttcttcttttggtcaaagaacgcaagattcttctgtagttcctctaaaaaaaatcctaatggagggttattcaagaaacggtgaaatctctccgaagctgcttgacttgatgattccacaagagagaagaaattggtttcacgatgagaaaaactctgttttcaaaacagaggagaagaagcttgagctaaagcttggaccacctggtgaagaagatgatgatgaatcgatgataagacacatgaagaaagaaccaaaagacaaatctatcctctctctcgctggcaaatacttctctccttcttccaccaaaaccacatcccataaaagaactgctcctggtccagttgtgggatggcctccggttcgatccttcaggaagaatttagctagtggaagttcttcaaagcttggaaatgactcaaccacctccaatggtgttaccctcaagaaccaaaagtgtgatgctgctgctaagacaacagaaccaaagagacaaggaggcatgtttgtgaagatcaacatgtatggtgttcccattggtcgtaaagttgatctcagtgctcataatagctatgagcagttatctttcacagttgacaagctcttcagaggtcttcttgcagctcaaagagactttccatcatccatagaagatgaaaaaccaatcactggattattagatgggaatggagaatatactcttacatatgaagacaatgaaggagacaagatgcttgtaggagatgttccatggcaaatgtttgtgtcttcggtgaagaggctgcgtgtgattaaaacttctgagatttcttcagcattaacatatggaaatggtaagcaagagaaaatgagaagatgaagaaaaagatcttttacagcttttaaagaagtagagagatgttattaattgcattttgcctttaaactttgatgagtttttggtcttggaaaagtttctgatataagtctgatgtacattctggtttgttacatcttcttttggcttttgagatatcatagagttttgttggaactcaaagaccaaacagtgcaatgatgattttggggtcttgagtaaatttacaaacccttttaggcaaa

SEQ ID NO: 4504 - DNA, 1394 bp, Artificial Sequence; identical to SEQ ID NO: 1157
  P7033 (opLexA::G596, G596 is from A. thaliana)

SEQ ID NO: 4505 - DNA, 487 bp, Artificial Sequence
  P7039 (opLexA::G997, G997 is from A. thaliana)
tacaaaccaaccttctcaattcctctcttttcatccacattttcactagctaatggcttctagttcaatgagcacctcatcatggacagctagagaggacaagcaattcgaaatggcgttggcgaaattcgacaaggacactcctgaccgttggcaaaaaattgcaagggcagttggtgggaaatcaactgaagaagtaaagcgacactatgaattgctccttagggatgtgaatgacattgagtcaggacgctatccacaacctaggtaccgtaacactaattgaagccattaataaaatgcctttctatcaagaagaggacatttgagagaatctataaagaactaagaatttcgatgtatttcttatattctatttgctttctttttttgtttttttttttaatttctgtttggttttcagatatataataatctctctcaatatccatcctattctaatccaatcaatttaagttcatataaa

SEQ ID NO: 4506 - DNA, 1338 bp, Artificial Sequence
  P7040 (opLexA::G1008, G1008 is from A. thaliana)
gcctttttgactcttctttctctcttctactttttttcaggctctctctctatatctctatcttcttctccggttaactaaaagagaaatgaaaagccgagtgagaaaatccaagtacacggttcaccggaaaatcacatccacaccgttcgacggtttcccgaagattgtcaaaatcatagtcactgacccatgcgctactgattcttccagcgatgaggaaaacgacaacaaatctgttgctccgagggtgaaacgttatgtggatgagatcaggttctgtgacgaagatgacgaacctaaaccggcgaggaaagcgaagaaaaagtccccggcggctgcggcggagaacggtggagatttggtaaagtctgtggtgaagtatagaggagtgagacaacgaccttggggaaaatttgcggcggagattcgtgatccttcgagtcgtactagactctggcttgggacttttgcgacggcggaggaagctgctataggttacgatagagccgcgattcgaatcaaaggtcataacgctcagacgaattttctcactcctcctcctagtccgacgactgaggtgttaccggaaactccggtgattgaccttgaaactgtctctggttgtgattcggcgagggaatcgcaaatcagtctgtgttctccgacttctgttctccggtttagtcacaacgacgaaacagagtacagaacagagccaacggaagaacaaaatccgtttttcttgcctgatttgtttcgctccggagattatttttgggattccgaaattacccctgaccctttgtttctcgacgaattccaccagtccttgttaccaaacatcaacaacaacaacacagtgtgtgataaggatacgaatctgtctgatagttttccgttgggagtgatcggagatttcagctcatgggatgttgatgagtttttccaagatcatttgttggataagtaatttgatgagttcttccccagaatttttctgggtttctctttttggttgtgtgagtgagatgagtggtttgatgacaacgacggggatgaatcttagccgtccgttttccatttcgtggacggctccgatcagcggaagaagcgcaacggagtttttatttatctgtttgagaattttataatttaatttgcgagtaaatatagtaattagtgttaagattgtgagagtttaagttaattagggaggggttttgaatattggggattttgggaggtttttgtttggtttctctccaagtctgtcactatgcaaggaagcagtataaagaccgtatatatattttattattaatattgataaaagta

SEQ ID NO: 4507 - DNA, 1011 bp, Artificial Sequence; identical to SEQ ID NO: 299
  P7056 (opLexA::G166, G166 is from A. thaliana)

SEQ ID NO: 4508 - DNA, 1190 bp, Artificial Sequence
  P7059 (opLexA::G168, G168 is from A. thaliana)
acaaccacacaaaacaaaaaacaaattcatggggatgaagaaggtaaagctatctttgatagctaatgaaatatcaagggaaacatccttcatgaagaggaaaaatgggataatgaagaaactctacgagttgtcaactctatgtggtgtccaagcttgtactctcatctacagtccattcattccggttccagagtttctggagatgtcgccgacagcccgaacaaggaagatgatgaatcaagaaacgtatctaatggagaggattaccaaagcaaaagagcaactacagaacctggttggtgcgaaccaagagttacaggttagacgatttatgtttgattgtgttgaaggcaaaatgtcgcagtatcgttatgatgcaaaagaccttcaagatttgttatcttgtataaatctatatctcgatcagcttaacggaaggatcgagatccttaaagaacacggtgactcgttgccttccgtctctccttttcctactagaattggtgttgaagaaactggtgatgagtcgtcttccgactctcctattcttgctacaactggggttgtagatactcctaatgctacaaatcctcgtgttcttgtggccgatacgactcattttcttgatgcgaatgcaactgcggtaactgctccctttggattttctaatcatattcaatataagaatatgaatatgagtcaagatctgcatcgaccgtttcaacaccttgttcctactaacttttgtgatttttttcaaaatcagaatatgaatcaggttcaataccaggctcctcctaatgatatgtttaatcagattcaacgagagttctacaacattaatttgaatcagaaatcaaatcagtatatgaatcaacaacaaccattcatgaatccgatggtggaacaacatatgagtcatgttggagggcgtgagagcattcctttcatggacggaaactactacaactacaatcaactaccagtcgttgatcatggttccacaagttacatgccttccaccaccggtgtttatgatccttacttcaacaataatctctaatcaaaagagggagattttctaatctaagtgttcagttgtttgtatttgtgttttcttcatttcaaaagacaaaaactaattttgtttattaataattgttgtaatggttaaagtgtctctcttt

SEQ ID NO: 4509 - DNA, 4715 bp, Artificial Sequence
  P7061 (opLexA::G1146, G1146 is from A. thaliana)
tggagaaaaagagtttttgaaaatccaaacaacaaaaaatgccgattaggcaaatgaaagatagctctgagactcacttagttatcaaaacccaacctttaaagcaccacaatccaaaaaccgttcaaaacggtaaaatccctcctccttctccttctccggtgacggtgactactccggcgacggttactcagagtcaagcttcttcaccttcaccaccgtcaaagaatcgtagccggaggagaaaccgtggtggaagaaaatctgatcaaggagatgtttgtatgagacctagctctcgtcctcgtaaaccgccaccgccaagtcaaaccacttcctccgccgtctccgtcgccaccgccggtgagattgtcgctgtgaatcatcagatgcagatgggtgttcgtaaaaactcaaactttgctccaagacctggatttggaacacttggaactaaatgcattgttaaagctaaccactttctcgctgatttgcctaccaaggatttgaatcagtatgatgtaagtttttattagaaaaagttaagattttttttgccttttttttagtttttgctgtaatgagaaacaaagcttgaacctttagatggtttcctgaaaaaaggtttgaaatttaatgaaggagagagagttagattttaatgttgttcttattgcttatttgggtccattgacatttggttaatgttttgcaggttacaattactcctgaagtgtcatcaaagagtgttaacagagctataattgctgagttagttagactttacaaagagtctgatctcgggaggagacttccggcttacgatggccggaaaagtctttacactgctggagaacttccttttacttggaaggagttcagtgttaagattgttgatgaagatgacggtatcatcaatggccctaagtaagtgtctaaggttctttaggtgattgattttgttatgtgtagttttatattgaaattgacacattttgctttgtagaagggagagatcatataaggtggcaatcaagtttgttgcacgggcaaatatgcatcacttaggcgagtttctagctggtaaacgggcagattgtccgcaagaggcggtgcagattcttgatattgtactcagggagttgtcggttaagaggttttgtcccgttggaagatctttcttttcgcctgatattaaaacaccgcagcgactcggtgaagggttagagtcatggtgtgggttttaccagagtattagaccaactcaaatgggtttatcactaaatatcggtaaagatttgacttaagagattgttacagttttggttttattttataagtcagcccaatcttaatgttattctccttactttgtagatatggcttcagctgcattcatcgagcctcttccagtgatagagtttgtagcacagcttcttggaaaggatgtcttgtcgaagccattgtcggattctgatcgcgtcaaggtacacaagtctcttcatcttattatatcttgtctcaagtccttgattgtttcctcaagaatgttttttttcttgggaatttttaacagattaagaagggtcttagaggagtgaaagtagaggttactcacagagcgaatgtaagaaggaaataccgtgttgcgggtttaacaactcaaccaacaagagagctaatgtgagtattttctttttacttactctttgattactaaggcttgtttcattgagattaatttctggtttatattcttaggtttccagtagatgagaactgtactatgaagtcagttattgagtatttccaagagatgtatggattcacgatccagcacacgcatttgccatgtctccaagttggaaaccaaaagaaggcaagctatttgccgatggaggtaaaccgtaaactgctggtttgtttgtttcaagacttcacatttcagctcttggctattttcgctgattcaatttccaatgtaggcatgcaaaattgtcgagggacaacggtacacgaaaaggttgaatgagaagcagattactgctctcttgaaagttacatgccaaaggccgagggacagagaaaacgatattttgcgggtatttttttagtcatgtatcttatatggttctttgtgagttagaacttagaagtgaggattaatcttgttgtcaaaaatgttttatagactgtccaacacaacgcatatgatcaagatccatatgcaaaggagtttggcatgaacataagcgaaaagttagcttctgttgaagctcgtattcttccagctccatgggtaaaaaacctaaacagatctctgaatgctcatactatgagaatactgttatgttaattcgtctctctttgcttgctacagcttaagtatcacgagaacgggaaagaaaaagattgtctcccgcaagttggtcagtggaatatgatgaacaagaaaatgatcaacgggatgactgtgagcagatgggcctgtgttaacttctcacgcagcgttcaagaaaacgttgctcgtggattttgtaatgaacttggtcagatgtgtgaagtctcaggcatggtaataatattcatctttttttcttttcttgttgcattgtttgaattctcttttaactcgatgtgattcttatcagaaagctttgcttcgtttatcattgtaggagtttaatccagaacccgtgataccaatatatagtgcgaggcccgatcaagtcgagaaagctctaaagcatgtttatcacacttcaatgaacaaaaccaaaggcaaagagttagagcttctgctggcaatattacctgataacaacggttcactttatggtattatttcgacatccataaacttaacccttttgccttctttagtaatggttttgatgaaaacgaaatgtttcttgtaatctcaggtgatcttaagagaatctgtgaaaccgagcttggtttgatatctcaatgttgtctcacaaaacatgtgttcaagattagcaaacagtatctggcaaatgtatcccttaaaatcaacgtaaaggtgaatagtttttactgctgtatcgaagattttcgattgtttttagtattatgaatctcagatctttctatgtttggtttcagatgggaggaaggaacacagttctagtagacgccataagctgtagaataccactggttagcgatataccgacaatcatttttggcgcagacgtgactcacccagagaacggggaagagtcaagcccttcaatcgctgctgtaaggattatacacttttatcaagtagtggagcatcgaaattcattatactcagtttttttcttttgttttctttaggttgttgcttctcaagactggcctgaagtgacaaaatatgcgggtttagtttgtgctcaagctcacaggcaagaacttatacaagatttgtataaaacatggcaagatcctgttcgcggtactgttagtggcggtatgatcaggtaataactcgcaatatttcggtttttgtagtttgattttatcggtgtatctcaaggtttttttgcttgctttctacagggaccttcttatctcatttagaaaagcaacagggcaaaaaccgcttcgaattatcttttatcggtaagtctctctttgctcatttaagtaaaagaattatatctaaaacccacaattagttctcatggttgttttattcgcgcagtgatggagtaagcgaagggcaattctatcaagttttactctatgagttggatgcaattcgaaaggtaaaaacttttgtgcatagcatgaaatgaatccgccacaaagttagcaaaacattttacataatcggaaacgggtttgtgtttgtttaggcttgtgcatcgcttgaaccgaattatcagccaccggtgacattcatagttgtacagaagcgtcaccacactcgtttgtttgctaataatcaccgagacaaaaacagtactgaccgaagcggaaatatcttaccaggttagttattaaaaacggttgaaagaagatcataacagaaataattaactaactaactaactgcttctttgccaccttttgtttcaggtactgtagttgacactaaaatatgtcatccaactgaattcgacttctacctttgtagccatgcgggtattcaggtacgaaacaactatcgaaatatccgttaatatgaccttttccgtaactatacagataaaatgacactgtttgtgtttgttgtatgatctagggaacaagcaggcctgcacattaccatgttctttgggacgagaacaatttcacagcagatggtattcaatctctgactaacaatctctgttatacctatgcgcggtgcactcggtcggtctctataggtaaataacaacatttcttcttcttcttcgtgtacccgcaaatatgacgaaaatcagcaaactcatatgttcttttattttctgatgttgtacagttcctccagcgtattatgctcatcttgcagcatttcgagcacgtttctacctggaaccggagataatgcaagacaacggatcaccgggtaaaaagaacacgaaaacaacaactgtcggagacgtaggtgtgaagcctttaccagccttgaaggagaatgtgaagagagtaatgttctactgctaaaaatccaaacattccttaatcagttttaataagtagtttggttgtttgcttgt

SEQ ID NO: 4510 - DNA, 864 bp, Artificial Sequence
  P7065 (opLexA::G165, G165 is from A. thaliana)
cttcaaaacatctaaaaaatggtgaaaaaaactcttggtcgtagaaaggtagagatagtgaaaatgactaaggaatcaaaccttcaagtcacattttccaagagaaaagctggtctttttaagaaggctagtgaattttgcacattatgtgatgcaaaaattgcgatgatcgtgttttcaccagctggaaaagtattttcttttggtcatccaaatgttgatgttctgcttgaccactttcgagggtgtgttgtaggacacaacaacacaaaccttgatgaaagctacacaaagcttcatgttcaaatgctcaacaaatcctacactgaggtaaatgtcaattgttggcaatatctaatatttgtttctctcttatttttcgattttgatattgaatattatataaatgtttcacaattcatggatattcttaacaaattcattattcgtggatttattcgtaggtgaaggcggaagtagaaaaagaacaaaagaataagcagtcgcgggctcaaaatgaaagagaaaacgaaaacgctgaggagtggtggagtaagtctccattagaactcaacttaagtcaatcaacctgtatgatacgtgttcttaaagatttgaagaagatagttgatgaaaaagcaattcaattaatccatcaaacaaacccaaacttctatgttggaagttctagcaatgctgctgctccagcaactgttagtggtggtaatatctccacaaaccaggggttctttgatcaaaacggaatgacgactaatcctactcaaacacttctgtttggatttgatattatgaatcgcacaccaggagtttaaataagtctatcctcattatgggtcttggtac

SEQ ID NO: 4511 - DNA, 1913 bp, Artificial Sequence; identical to SEQ ID NO: 1247
  P7068 (opLexA::G789, G789 is from A. thaliana)

SEQ ID NO: 4512 - DNA, 662 bp, Artificial Sequence
  P7074 (opLexA::G2094, G2094 is from A. thaliana)
cactagttcacgaatcacgatctgcggttcctgaagctggtaatgctagatcccaccgagaaagtaatcgattcagaatcaatggaaagcaaactcacatcagtagatgcgatcgaagaacacagcagcagtagcagtaatgaagctatcagcaacgagaagaagagttgtgccatttgtggtaccagcaaaacccctctttggcgaggcggtcctgccggtcccaagtcgctttgtaacgcatgcgggatcagaaacagaaagaaaagaagaacactgatctcaaatagatcagaagataagaagaagaagagtcataacagaaacccgaagtttggtgactcgttgaagcagcgattaatggaattggggagagaagtgatgatgcagcgatcaacggctgagaatcaacggcggaataagcttggcgaagaagagcaagccgccgtgttactcatggctctctcttatgcttcttccgtttatgcttaacgaattttctggatcttaagttttaaggtgaaataataattaattttgtaggatgtgtaacgaattaatgtgtaatttttgtatgcgtttttttggtgttgtttgaattaactaaattttgaaatttttgtatcttgtttatgtgatctctggtgaagaatgaatgaatg

SEQ ID NO: 4513 - DNA, 1495 bp, Artificial Sequence
  P7078 (opLexA::G2316, G2316 is from A. thaliana)
ttactttcaagtcgatctcgtaatcccctaaatctcctaataaaaaaatctagtatttataaaagtgggatggagagtagagaggattcattcatatcaaaagagaagaaatcaactatgaaaaaagaaaaacaagcgattgcatcacaaagaaatagaagaagagtaattaaaaatagaggaaacgggaagcgattgattgcatcattatcacaacgaaagagaagaagaatacctagaggaagaggaaacgagaaggcagtgtttgcaccatcatcactaccaaacgatgttgtagaggaaatcttcttacgacttccggtgaaagcaataatccaactaaagtctctctcaaaacaatggagatcgacgatcgagtctcgcagttttgaagagagacacttgaagatcgtcgagcgatcacgcgtggattttccacaggtcatggtcatgtctgaagaatattccttgaaaggaagtaaaggtaatcagcctcgtccagatacagacattggttttagtacaatctgtttggaatcggcttctattctgtcctccactcttatcactttccctcaaggatttcaacaccggatctatgcttctgaaagctgtgacggacttttctgcatccattccctaaaaacacaagccatatatgtagttaacccggccactcggtggtttcgacaacttcctccggctaggtttcagattttgatgcaaaagttataccccactcaagacacttggattgacataaaaccagtagtctgttatacagcattcgtgaaggccaatgattacaaattagtgtggttgtataattctgatgcctcgaatccaaacctgggagttacaaagtgcgaggtttttgattttagggcaaacgcttggaggtacttgacttgcactccaagctatcggatattccctgaccaagtaccagcagctacaaacgggtctatttattggttcacggaaccatataatggcgaaataaaagtggtagctctcgatattcacactgaaacgtttcgtgtgctacctaagattaatccggccattgctagttcagatcctgaccatatcgacatgtgcactttggataatggtttgtgcatgtcgaaaagagaatcggatacgttggtccaagagatatggaggttaaaatcatcagaagactcatgggagaaggtttataccatagatttgctttcttgttcttcttcttctttatctgagttccgcgatggatttaattggacacgaaaagatttggttgagccatccacaccagtggcgatatgcaaggacaagaagattctgctctcacatcgctatgcccgcaatatgatcaaatacgatccccaaataaaatctatcagtttaatttaccaacctcctttgtgtagaagatatgcttcttattttcagagtttgatctctcatatataaaatgctttgatgtatttggaagcatgtaatgtaagaa

SEQ ID NO: 4514 - DNA, 1364 bp, Artificial Sequence
  P7082 (opLexA::G219, G219 is from A. thaliana)
aaaagaagcagaatcattcccatttataacaaacctaaacctctcttttcttcttctctttacctttttcattccaaaatctctctctctctctctctttctctggctcgggaagaagatgtcacgtagttgctcacagtgtggaaacaacggccacaactctcgcacatgtccgacggacataactaccaccggtgacaacaacgacaaaggcggcggggagaaagccatcatgctttttggcgtccgcgtcacggaagcttcatcatcttgttttagaaaaagtgttagtatgaacaatctctctcaattcgatcaaactcctgatcccaacccaaccgatgacggtggttacgcttcagacgacgtcgttcacgcctccggtagaaaccgtgaacgcaaacgaggaactccatggacagaggaagaacatagattgtttcttactggattgcataaagttggaaaaggtgattggagaggaatctctagaaactttgttaaaactcgaacacctactcaggtagcgagtcatgctcagaaatattttctccggcggactaatcagaatcgtcgtcgtcgtagatcaagcctcttcgatatcactcccgattcgtttataggatcatcaaaagaagagaatcagttacagactccattggagctaatccgtccagttccgattcctattccgattccaccgtcgcggaagatggctgatttgaatcttaacaagaaaaaaactccagcgacaacggagatgtttccgctgtcgctgaatttgcagaggccgtcttcgtcgacatcgtcatcgtccaatgaacagaaggcacgtggctcacgtgcctcctcggggttcgaggcgatgtcgagtaatggagatagtataatgggagtggcttgatgaagaagataatgttttaattaatttatattgtataagataagatctggatgatgattaatttgaaatttgagaattaggctaattagatactttgatcagaatcaagtgagtttttaagtttgaattagtgtgtacatgtttttttgctctttttgggggaaacgacttgtcgtttttgttgttgtatgatgtaaaacaacaggtagtctctgtgttgttttggtcaagacttgatcagattcagaagtgaagacgacttcaagcttaagatagtttagatgtgtcttttgaaaagtttaaacagaatggttattgggttaaggttaagtgtatctcatatgctttttctatcttttttttggtaagacttttccagtaatttgccgttttcttcggggtgtgtgttgttgataatgtcacattcatgaaccaaacacagttatataactttagtaaa

SEQ ID NO: 4515 - DNA, 828 bp, Artificial Sequence
  P7084 (opLexA::G732, G732 is from A. thaliana)
aaaaaaaccaaacataaaacataaaactctgtcctttttttgtcttcttgtaacttttcttgttaaaaatcaatggcgtcatctagcagcacataccggagctcaagctcttccgacggtggtaataataacccgtcggactccgtcgtcaccgtcgacgaacgaaaacgtaaaagaatgttatcgaacagagaatctgcacgtaggtcaaggatgcgtaaacagaaacacgttgatgatctaacggctcagatcaatcagctatcaaacgacaaccgtcagatcttgaacagcctcaccgtaacatctcagctttacatgaagatccaagccgagaactctgttctcaccgctcagatggaggagcttagcaccagactccaatctctcaacgagatcgttgatcttgttcaatccaacggtgcaggatttggtgttgaccagatcgacggctgtggttttgatgatcgtacggttgggatcgacggatattacgatgatatgaatatgatgagtaatgttaatcattggggtggttcggtttacactaaccaacccattatggctaatgatatcaatatgtattgattaataaaattaattaaaataattagatgccccttttttgtctttttattttaaaatttagcccattttggtgtttttgggttggtgtgatgatgtaattatagtacatgcatctttgattggttggaaggataaatataaactttatatatatattggggcatatatatatgagttgtactttgcatgtattggtgtgtgttttgttataattatatgattatatatgtttatgttaaa

SEQ ID NO: 4516 - DNA, 1119 bp, Artificial Sequence
  P7085 (opLexA::G897, G897 is from A. thaliana)
aaacagtagagagagatatagagagcatcaatggcgtcgtcgtcaagactttgcgattcgtgcaaatcgacggcagcaactctattctgccgcgcagacgccgcgtttctctgcggcgactgcgacggtaagatccacacagctaacaaactcgcatcacgtcacgaacgagtttggctatgtgaagtatgcgaacaagcaccagcacacgtcacgtgcaaagctgacgccgctgcgttatgcgtcacgtgcgaccgtgatatccactcagctaatccactctctcgccgccacgagcgcgtaccaatcactcctttctacgacgctgtaggtccagcaaaatccgcttcctcctccgtcaatttcgtagatgaagatggcggtgacgtcactgcttcgtggcttttagctaaagaaggaatcgaaatcactaatttgttctccgatcttgattatccgaagattgaggtaacgtcggaggagaatagctccggtaacgacggagttgttcctgtgcagaataagttgtttcttaacgaagattacttcaatttcgatctctctgcttccaaaatttctcaacaaggattcaatttcatcaaccaaactgtttcgacgagaacgatagatgtaccgttggtgcctgaaagtggaggagtgacggcggagatgacgaacacggagacgccagctgtgcagttatcaccggcggagagggaagcaagggttttgaggtatagagagaagaggaagaatcggaaatttgagaagacgattaggtatgcgtcgcgtaaagcttacgctgagatgaggccgagaatcaaaggacgttttgctaagagaacagattcgagagagaatgatggtggagacgtcggagtttatggcggattcggtgttgttccgagtttctgatattttccggtgaaagaaacatggtagtagtatatcggttaatagcagattaaggataattaaaactaaaatgtttcctgatttaatcaggggctaagttattgttagaagattgttgttttttgaattaattctcacaattgtatcctaaattatatagtttacttaatgttgaactaataaattttgatttacaatctcaaa

SEQ ID NO: 4517 - DNA, 1468 bp, Artificial Sequence
  P7086 (opLexA::G265, G265 is from A. thaliana)
ctttggtcttggaagccaaatcaaacctttccttcaatcctcaaattttcgaaaattttctcttttgctttacgttctctcaattcttatttgtaagaaagtttgttcctttaatcaatcaaatcaaagagacttttgaagattgtttcccaatttgcgtcaatcgggatcgagtcaaatctgaaatcttctccactcatcatctgactataagacttaatcaagggactttttgttcgggtttggttttaaacgtcttggattcgaagtggttaaggtatggatgaaaataatggaggttcaagctcacttccacctttccttactaaaacatatgaaatggttgatgattcttcttctgactcggtcgttgcttggagcgaaaacaacaaaagcttcatcgtcaagaatccagcagagttttcaagagaccttcttccgagattcttcaagcataagaatttctcaagtttcatccgtcagcttaatacatatggttttcgaaaagtagatcctgagaaatgggaattcttgaatgatgattttgttagaggtcgaccttaccttatgaagaacattcatagacgaaaaccggttcatagccactcgttagtgaatctacaagcgcaaaatcctttgacggaatcagaaagacggagcatggaggatcagatagaaagactgaaaaatgagaaagaaggccttcttgcggagttacagaaccaagagcaagaacggaaagagtttgagctgcaagtaacgacattgaaagatcggttacaacatatggaacaacatcagaaatcaatagtggcatatgtttcacaggttttgggaaaaccaggactttcactaaacctcgaaaaccatgagagaagaaaaagaagatttcaagagaactctcttcctccaagcagttcacacatagaacaggtcgaaaagttagaatcttcgctaacgttttgggagaatcttgtatcggaatcatgcgagaagagcggtttgcagtcatcaagcatggatcatgatgcagctgagtcaagtctaagtattggcgatacacgacccaaatcatcgaagattgatatgaactcagagccgcccgttaccgttactgcgcctgctccaaaaacaggcgttaacgatgacttttgggaacaatgtttgacagagaaccctggatcaaccgagcaacaagaagttcagtcagagagaagagatgtcggtaatgataataatggtaataagattggaaatcaaaggacgtattggtggaattcagggaatgtaaataacattacagagaaagcttcttgacatgaatgaggtttttgtaaaatagttttcttttggttccactgagattattgtatgtgttcattatttattactctgtttctgtaaaaacaaatctctctattgtttgaggcaggagtgacataaatgcatatgcagaattggtttcaaa

SEQ ID NO: 4518 - DNA, 2330 bp, Artificial Sequence; identical to SEQ ID NO: 797
  P7087 (opLexA::G274, G274 is from A. thaliana)

SEQ ID NO: 4519 - DNA, 1118 bp, Artificial Sequence
  P7088 (opLexA::G865, G865 is from A. thaliana)
atccccacttgttgttcatcaccaagccaagctccatgtcctagtcactccacagattccctatcatcatcaattcgtttcaaacttagttcctttcaaagtcttgtacatatatacacacacacctattattctcttggtgtgtttgtgtgttacatatacgtgtgagtacatactttgttgtaaaagtggatcggaggtatggaaagggaccggttccaccggaaacatcggcggcggcggatgataattcgtcttggaacgagactgatgtcaccgccatggtctccgctctcagccgtgtcatagagaatccgacagacccgccggtcaaacaagagcttgataaatcggatcaacatcaaccagaccaagatcaaccaagaagaagacactatagaggcgtaaggcagagaccatggggtaaatgggcggcagaaatccgcgatccaaagaaagcagcccgtgtctggctcgggactttcgagacggcagaggaagctgctttagcctatgaccgagctgccctcaaattcaaaggcaccaaggctaaactgaacttccctgaacgggtccaaggccctactaccaccacaaccatttctcatgcaccaagaggagttagtgaatccatgaactcacctcctcctcgacctggtccaccttcaactactactacttcgtggccaatgacttataaccaggacatacttcaatacgctcagttgcttacgagtaacaatgaggttgatttatcatactacacgtcgactctcttcagtcaacctttttcaacgccttcttcatcttcttcttcctcccaacagacgcagcaacagcagctacaacaacaacaacagcagcgtgaagaagaagagaagaattatggttacaattattataactacccaagagaataatctaattattattgttggtcgaatcagttttataaatagctatcatagtttcatttttggtttccgtaacctttgttgcatggaaaatatgaatgaacgagggacatgtgtaacaatttgtttgtgtttcgtaaatgttagttgtatttggatttgctgaagtttgattttctgagcataaatcatttgacggtcaaa

SEQ ID NO: 4520 - DNA, 1337 bp, Artificial Sequence
  P7092 (opLexA::G1076, G1076 is from A. thaliana)
attttagtcttcctataacttcttctcaatcctctctcatatcttttttcttagtttaaatttcaataaaatagaaaaaaacatatacaaatctacagagaagagaagctttattttaatcttgtgtgtgtgtgtgtgttttatataatttttattttttttcaaattaaaatctcttctttgcttttgatgtgggcatggctggtcttgatctaggcacagcttttcgttacgttaatcaccagctccatcgtcccgatctccaccttcaccacaattcctcctccgatgacgtcactcccggagccgggatgggtcatttcaccgtcgacgacgaagacaacaacaacaaccatcaaggtcttgacttagcctctggtggaggatcaggaagctctggaggaggaggaggtcacggcgggggaggagacgtcgttggtcgtcgtccacgtggcagaccaccgggatccaagaacaaaccgaaacctccggtaattatcacgcgcgagagcgcaaacactctaagagctcacattcttgaagtaacaaacggctgcgatgttttcgactgcgttgcgacttatgctcgtcggagacagcgagggatctgcgttctgagcggtagcggaacggtcacgaacgtcagcatacgtcagccatctgcggctggagcggttgtgacgctacaaggaacgttcgagattctttctctctccggatcgtttcttcctcctccggcacctcccggagcaacgagtttgacaattttcttagccggaggacaaggtcaggtggttggaggaagcgttgtgggtgagcttacggcggctggaccggtgattgtgattgcagcttcgtttactaatgttgcttatgagagacttcctttagaagaagatgagcagcagcaacagcttggaggaggatctaacggcggaggtaatttgtttccggaggtggcagctggaggaggaggaggacttccgttctttaatttaccgatgaatatgcaaccaaatgtgcaacttccggtggaaggttggccggggaattccggtggaagaggtcctttctgatgtgtatatattgataatcattatatatataccggcggagaagcttttccggcgaagaatttgcgagagtgaagaaaggttagaaaagcttttaatggactaatgaatttcaaattatcatcgtgatttcggacattgtcttgttcatcatgttaagcttaggtttattttttgtcgtttgtagaattttatgtttgaatccttttttttttctgtgaaactctattgtgttcgtctgcgaaggaaaaaaaaattctcaaa

SEQ ID NO: 4521 - DNA, 829 bp, Artificial Sequence
  P7093 (opLexA::G1090, G1090 is from A. thaliana)
aaactaattcgcacagttctatatacactcacaaacacacacacacacaatatagtgctactaaaataaccttgtattaattatggaaaacacttacgttggccaacgagattaccgcttcaacgttaaccagttgtcctacagaggcattcgtcggaggaaatggggcaaatgggtatcggagatccgagaacccggtaagaaaacaaggatttggcttggaagctacgagacggccgagatggctgcagcggcctacgatgctgcggctcttcacctccgaggacgtgggaccaatctcaactttccggaactcgtcgacagttttcctcggccggaaagctctagttcggagcacattcaagcggctgcacaagatgcagcacttatgtttaaaccaggtaggttgagtgaaccagctctcgagtctggtcaaggactttctcgagtaggattgtctccggatcagattcaagcgattaatgagtctccattagactcgccgaggatggggtggatgcaggatttggaagttgctgactacgaagaattatacggacaattttttggtcagcacgatagggatgagttttttgaaatgcagcaatttcagtccatatggaattctaataattgatatacgttcgcttaattgcttaaccatttgattttttttttaataatgtcatatcatcaaccaaggtttttcgattatattcagtaaagtataataaattttcgacccttactgtttttcttgggttcaatttgtaatctcttaacaatgatgatgtcataaataccaatatgattaattcaaattttcaaa

SEQ ID NO: 4522 - DNA, 1379 bp, Artificial Sequence
  P7094 (opLexA::G2484, G2484 is from A. thaliana)
tttagggtttgtagctcctttctctttttttcttttctcaatttcccccaaattaaaaaaaaactctctctttcagagatttacaaatttcatttctccaaatccgaaaccccaaagtgaatatttttccttctgggtttcttttgtttgcctggaaacatttgtctcagattttgattttgaccggagtactcatattctccggcgatttctccggcgacatcgtttgtgaaatggagggaattactcatccaatacctcgtactgttgaagaggtctttagcgacttcagaggtcgacgagctggtcttattaaagctctcactaatgatatggtgaagttttaccaaacgtgtgatcctgagaaggagaatttgtgtctctatggacttccaaatgagacatgggaggttaatctacccgttgaggaagttcctcctgagcttcctgaaccagctttaggcatcaatttcgctagagacggaatgcaagaaaaggactgggtatctttggtcgcagttcacagtgattcatggctgctttctgttgcattttactttggtgcacgtttcggatttggcaagaatgagaggaagaggctgttccagatgattaatgagctgccaaccattttcgaagttgtgagcggcaatgcaaagcagtccaaggatctatctgttaacaacaataatagcaaaagcaaacctagtggcgtcaagtctcgccaatccgaatctctctcaaaggttgcaaagatgtcatctccaccgccaaaagaagaagaagaagaagaagatgagagtgaagatgagagtgaagacgatgaacaaggtgcggtttgtggtgcttgtggagacaactacggtacagatgagttctggatttgctgcgacgcgtgtgagaaatggttccatggaaaatgtgtgaagataacacctgcaaaagcagaacacatcaagcattacaaatgcccaacttgcagtaacaagagagctagaccttgaagttaaataaccaaattatgaaaaggtaaagcgagttaggagaaaattatgaaagaagaaggtgaagtttccagtttataagaaatgccagtaaaagggacttagaagatgtaagcaggtaaaaaaaaaaattgtattgcttagtctttattgttggattgagactatctacagttggtgatgtcttttcttttctttttttggatttttgttgttgttaatgttaattctactactaatttgtttggtctgtttaagatattttagttctgattagtaattttttttttttttttttttttttctgattagtaatttgctaaaattgtaaaaactattatgtcgttatgtagtctttttattcatctttttaaa

SEQ ID NO: 4523 - DNA, 2197 bp, Artificial Sequence
  P7103 (opLexA::G2555, G2555 is from A. thaliana)
aaagacaacaatcggagaacaatctggtctgctgctaaaatttaataaattgttttgtctaattgtctccacccataaaaaagcgcgaattcaattcaccgactaaagacattctccggtggagaccccgatgcaatccactcatataagcggcggaagtagcggtggtggtggtggaggaggaggagaggtgagtcgaagtggattatctcggatccgttcagctccagctacttggattgaaaccctactcgaagaagatgaagaagaaggtttaaaacctaacctttgtttaacagagctgcttactggtaataataactctggaggagtgataacgagtcgtgacgactcgttcgagttcctgagttctgttgagcaaggattgtataatcatcatcaaggtggtggctttcaccgtcagaatagttctccggctgattttcttagtgggtctggttctgggactgatgggtatttctctaattttggtattccggcgaattatgactatttgtcgaccaacgttgatatttctccgactaaacggtctagagatatggaaacacagttttcttctcagctggtaagactctgtttccattaaattcagataaaaatgcgaactttaatggaaagataaacttttttttgttgcttactttaatgtcaagttgtgtgaatttgtggtcaaaatggtgaggttaggttctattttggggattgatacggttttagtttaattgggtgtttgaattcttcagttgtggagacaataaagatgtaaaagagttgtcttgtctaatttgacaacttgcatttgtttgaaacaaattcccctgcaagttgcagttgttttttctttgtttccctgtggctgtgaaagtgaatgttgcataaagtttgtattagtagatgggcaaacaaaaagagccttcattggttagatatgtatcgatcttgtaactttagaagtttctgaatcatgacttttgtgaaatgaaacatgttttcatgtgtgcatatggtttgtgagttaactaataactcttcccttttggtttgtgagtagaaagaagagcaaatgagtggtgggatatcaggaatgatggatatgaacatggacaagatttttgaggattcagttccttgtagggttcgtgctaaacgtggttgtgctactcatcctcgtagcattgctgaacgggtaattacttaaaagtttgtgctagatgctttgcagtactaattctgtttctgcctcattcttgttttgtcattaagcttttctctgttcattttgttaggtgagaagaacgcgaataagtgatcggattaggaggctgcaagagcttgttcctaacatggataaggtaaattctttttacaaggcagattggttttaagttttctttgaagtttttaaaaagaattaccaaatgggtccaagattagatatgcttaaagcttaaggttagagcattattgtgaaggcattattggttcttaaggtaggagctagtgcttagccgtaaagtaaaggaatttggatgttaactgttgatgattgtgaaggcattattggaacttcaaaactacttactccttaatccataaactatggttgtgcagtcttttagaagattcaatgcatgatagtccgggagagttataacgcgaagattcgtttttttttgtattttctttgttgcagcaaaccaacactgcagacatgttggaagaagctgtggagtatgtgaaggctcttcaaagccagatccaggtttatctacagatactaattgattagaaacacaaatttatgtttaataaaatatgttaggattttggatttttttgatcattttatttggttttgatgatggattcaggaattgacagagcagcagaagagatgcaaatgcaaacctaaagaagaacaataatgtatcctttaggatttgatatatctgtattttatttttgtactatctaaaaatggtgatgatctgttcgaaaattcgaaacatgatcttatatattgaactagaaaaaatagatatatatgaattttagctgtaaaatttttgtacaataaggagaaaaagatttagaagagtcaataaaaagatgatgtttacaagtcgagaatatatattttgttagttttgtttatcaatttatgctcaaggtttca

SEQ ID NO: 4524 - DNA, 892 bp, Artificial Sequence
  P7110 (opLexA::G792, G792 is from A. thaliana)
tttccacacattgtctctacctttccctttttcagatttgaccctttgttttcaaaagaaacgatttttagtagccgccggggaatcaggagaatggtgtctccggagaatacgaactggcttagtgattaccctttgattgaaggtgctttctctgatcagaaccccactttcccttggcagatagatggctcagctactgtcagtgttgaagtggatggcttcctttgtgatgcagatgtgatcaaagaaccaagttcaaggaagaggatcaaaactgaatcttgcactggttctaactcgaaagcttgtagggagaaacaaagacgtgatagactaaatgacaagtttacggagttgagttccgtattggaacctgggagaactccaaaaacagacaaggttgctattatcaatgatgcaattcgcatggtgaatcaagcaagagatgaagcgcagaaactaaaggacttgaactcaagcctccaggagaaaatcaaggagttgaaggatgagaagaacgagctgcgtgatgagaaacagaagcttaaggtcgagaaggagagaatcgatcagcaactgaaagctattaagacacagcctcagcctcaaccttgtttcttaccaaatccgcaaacactctctcaagctcaagctcctggaagcaagcttgtccctttcacaacttatcccggctttgcaatgtggcaattcatgcctcctgctgctgttgatacctcacaggaccatgtccttcgtcctccagttgcttaaagctgctgcttctctctactactattaacggttctgtaagattacttcttacgcgcttttttctgatgtaatgattctcacattctgtgattggtgacatagtccactgcaacttaaa

SEQ ID NO: 4525 - DNA, 923 bp, Artificial Sequence
  P7112 (opLexA::G1134, G1134 is from A. thaliana)
gtagtgtctattgaaaccagagaaaagccaaaggggatgcaaccaacatccgtcggtagtagcggcggtggtgacgacggaggaggcagaggaggaggaggagggctaagtagaagtggactatctcggatccgttcagctccagcgacttggcttgaagctttacttgaggaagatgaagaagagtctttgaaacctaatcttggtctcaccgatttgcttaccgggaactcgaacgatttaccgacaagtcgcggctcgttcgagttcccgattcctgttgagcaagggttgtatcaacaaggtgggtttcaccgacagaatagtactccggcggattttcttagtggttctgatggatttatccaaagctttgggattcaggcgaattacgattacttatcggggaatatcgatgtttctccgggaagtaagcggtctagagaaatggaagcactcttctcttctcctgagtttacttctcaaatgaaaggagagcaaagcagcggtcaagttcctaccggagtatcaagcatgtcggatatgaacatggagaaccttatggaggactctgttgcttttagggttcgggctaaacgtggttgcgcaactcatccccgcagcattgccgagagggtacgaaggacgcggattagtgatcggataaggaagctacaagagcttgtacctaacatggacaagcaaaccaacactgcagacatgttagaagaagcagtagaatacgtgaaagttcttcaaaggcagatccaggagttaacagaagaacagaagaggtgcacatgcatacctaaggaagaacaataaggtttgctcctgatttgttttatatttgcttaacggcaatgatctgatcgaaaaattcgaaagatgatcttagcttgaatttagatggatgtcatgtt

SEQ ID NO: 4526 - DNA, 799 bp, Artificial Sequence
  P7118 (opLexA::G1646, G1646 is from A. thaliana)
gatcttttgatccaatcacaaggcaaagatccaatggacaataacaacaacaacaacaaccagcaaccaccaccaacctccgtctatccacctggctccgccgtcacaaccgtaatccctcctccaccatctggatctgcatcaatagtcaccggaggaggagcgacataccaccacctcctccagcaacaacagcaacagcttcaaatgttctggacataccagagacaagagatcgaacaggtaaacgatttcaaaaaccatcagctccctctagctcgtatcaaaaaaatcatgaaagctgatgaagatgtgcgtatgatctccgccgaagcaccgattctcttcgcgaaagcttgtgagcttttcattctcgaacttacgattagatcttggcttcacgctgaagagaacaaacgtcgtacgcttcagaaaaacgatatcgctgctgcgattactagaaccgatatcttcgatttccttgttgatattgttcctagggaagagatcaaggaagaggaagatgcagcatcggctcttggtggaggaggtatggttgctcccgccgcgagcggtgttccttattattatccaccgatgggacaaccggcggttcctggagggatgatgattggaagaccggcgatggatcctagcggtgtttatgctcagcctccttctcaggcatggcaaagcgtttggcagaattcagctggtggtggtgatgatgtgtcttatggaagtggaggaagtagcggccatggtaatctcgatagccaagggtaagtgaattctagta

SEQ ID NO: 4527 - DNA, 1188 bp, Artificial Sequence
  P7120 (opLexA::G568, G568 is from A. thaliana)
cggtcaaccaaagactaaagctgtgttgttggttcacttctgttctcttttccaatgttgtcatcagctaagcatcagagaaaccatagactctctgctacaaacaagaaccagactctcaccaaagtttcttccatttcatcctcatcaccatcgtcttcttcttcatcatcatcaacctcatcatcatctcctttaccttctcaagactctcaagcccagaagagatctcttgtcaccatggaagaagtttggaatgacatcaaccttgcttccatccaccacctaaaccgacacagccctcatccacaacacaaccacgagccaaggttcaggggccaaaaccaccacaaccaaaaccctaactcaatcttccaagattttctcaaaggatctttgaaccaggaaccagcacccacaagccagaccacgggttctgcgcctaatggcgattccaccacggtcactgttctttacagctctccttttccacctcctgcaactgttctgagcttgaattccggcgctggcttcgagtttctcgataaccaagatcctcttgttacctcaaactctaatcttcatacccaccatcacctctcaaacgctcatgccttcaacacctctttcgaggctctggttccatccagttcttttggtaagaaaagaggccaagattccaatgaaggttcagggaatagaagacataagcgtatgatcaagaacagagaatctgcagctcgttcccgcgctaggaaacaggcttatacaaacgagttagaacttgaagttgctcacttgcaggcagaaaatgcaagactcaagagacaacaagatcaaaaaatggctgcagcaattcagcaacccaaaaagaacacacttcaacggtcttccacagctccattttgagaaatctacaagtccttgtttctcttttggggattgagattgtctcatgaagaagtgaaaaaatggcaaaagtttgtacccttttttattagctataagtataactaagcctaaaattgtagaactaagatattgtaggggaaaaaagaagatgtaaaacaaaagacccggaaagagaaaaggatctttcaatttcctaaggcacaggaacacctgtcctgggtcctctcttaatgttctgtcgttttcctatgcaaacccttttttcacttctgtacg

SEQ ID NO: 4528 - DNA, 920 bp, Artificial Sequence
  P7123 (opLexA::G674, G674 is from A. thaliana)
tgtcaaagattgtcatcaccaatctacatatttttattcatcagtaccatacacgtatatataatatatctatttcaaatataaaaaaaaactttggaaaaataaaaatggtgtttaaatcagaaaaatcaaaccgggaaatgaaatcaaaggagaagcaaaggaagggattatggtcacccgaggaagatgagaagcttaggagtcatgtcctcaaatatggccatggatgctggagtactattcctcttcaagctggattgcagaggaatgggaagagttgtagattaaggtgggttaattatttaagacctggacttaagaagtctttattcactaaacaagaggaaactatacttctttcacttcattccatgttgggtaacaaatggtctcagatatcgaaattcttaccaggaagaaccgacaacgagatcaaaaactattggcattctaatctaaagaagggtgtaactttgaaacaacatgaaaccacaaaaaaacatcaaacacctttaatcacaaactcacttgaggccttgcagagttcaactgaaagatcttcttcatctatcaatgtcggagaaacgtctaatgctcaaacctcaagcttttcgccaaatctcgtgttctcggaatggttagatcatagtttgcttatggatcagtcacctcaaaagtctagctatgttcaaaatcttgttttaccggaagagagaggattcattggaccatgtggccctcgttatttgggaaacgactctttgcctgatttcgtgccaaattcagaatttttgttggatgatgagatatcatctgagatcgagttctgtacttcattttcagacaactttttgttcgatggtctcatcaacgagctacgaccaatgtaaatgttcggagagaggtccaagtaaata

SEQ ID NO: 4529 - DNA, 827 bp, Artificial Sequence; identical to SEQ ID NO: 601
  P7125 (opLexA::G2291, G2291 is from A. thaliana)

SEQ ID NO: 4530 - DNA, 1027 bp, Artificial Sequence
  P7130 (opLexA::G531, G531 is from A. thaliana)
gacaaatccctaattccaaaatcctctcggatctaaaagagtgtgtgataacataagatgtcgtcttctcgggaagagaatgtgtacttagccaagttagctgagcaagctgaacgttatgaggaaatggttgagttcatggagaaagttgcaaagactgttgacaccgatgagcttactgtcgaagagagaaacctcttgtctgttgcttacaagaacgtcattggtgctaggagagcttcctggaggatcatatcttccattgaacagaaggaagaaagcagaggaaacgatgatcatgtttccattatcaaggactacagaggaaagatcgaaactgaactcagcaaaatctgtgatggaatactcaatcttctggattctcaccttgttcccactgcatctttggccgagtccaaagtcttttacctcaaaatgaaaggagattaccacaggtaccttgctgagtttaagactggagctgagaggaaagaagctgctgagagcactctggttgcttacaagtcagctcaggatattgcacttgctgatttagctcctactcatccgattagactgggacttgctcttaacttctctgtcttctactacgagattctcaactcacctgatcgtgcctgcagtctcgcaaaacaggcttttgatgaggccatttctgagctggatacattaggagaagaatcatacaaagacagtacgttgataatgcaacttctccgtgacaatctgaccctttggaactctgacatcaatgatgaggcgggcggtgatgagatcaaggaggcgtcaaaacatgagccggaagaggggaaaccagctgagacagggcagtgaccagagagagagggagagacatttctaagtatgtatggtatggattttccaaaaacatatgatatgattaggggatttgtagaagcagagagaaagatctttatttgattttctccaaaaatctctgttcccttttttttttattgggttattaaagctgtttgagtccaaa

SEQ ID NO: 4531 - DNA, 1086 bp, Artificial Sequence
  P7131 (opLexA::G532, G532 is from A. thaliana)
cgacgaaggaagaagaagaagaagaagaagaaaaaactatggagaatgagagggaaaagcaggtttacttggctaagctctccgagcaaaccgaaagatacgatgaaatggtggaggcgatgaagaaagttgctcagcttgatgtggagctaactgtggaagagaggaatcttgtatctgtagggtacaagaatgtgattggtgcaaggagagcatcatggagaatactatcttccattgagcagaaggaagagtccaagggaaatgatgaaaatgtcaagaggcttaagaattatcgtaagagagttgaagatgagcttgctaaagtttgtaatgacatcttgtctgtcattgataagcatctcattccatcgtctaacgctgtggagtcaactgtctttttctacaaaatgaaaggagattactatcgctatcttgcggagttcagttctggtgctgaacgcaaggaagctgcagatcagtctcttgaagcatataaggctgctgttgctgctgcagagaatggtttggcacccacacatccagttagacttggcttggcgttgaacttttcagttttctactatgagatcttgaactctcccgaaagcgcatgccaattggctaagcaagcattcgatgatgcaattgctgaacttgacagcctcaacgaggaatcatacaaagacagcactcttattatgcagctacttagagacaatctcaccttgtggacttcagaccttaatgaggaaggagatgagagaaccaaaggtgctgatgagcctcaagatgagaactaaatcctctgtgagaagagaaacgactcttgctgcatcctgaatcttgaagtgaagacagtaagtgtcgttgtttgttactcgaatgtgtaatttttaatctatgtctttcttgatggtgttttccagattcttgaacttttcacaacacaacactgcgttgcgtatcttcaaccctcttatgatgtggttgaattctgttttacgcttagtttgcttcttttgttgttgaattgagccagcaggcatgatttgggtttttgtttatcagaatattaggcgtaaa

SEQ ID NO: 4532 - DNA, 1086 bp, Artificial Sequence
  P7134 (opLexA::G641, G641 is from A. thaliana)
tcttgattctttcatatggatggacatcagcatcatcaccttcaccagcttcaatatctcaacaagcatcatcttcatactcaatcgcaaacgccggaaatagcctctccggtagctgttggggataggtttccacagtggagcgtcgaagagacaaaagagttgatagggataagaggagagctagatcaaactttcatggagacaaaacggaacaagcttctttgggaagttatctctaacaagatgagagacaaaagctttcctcgtagccctgaacagtgcaagtgcaagtggaagaacctcgtcactcgttttaagggatgtgagacaatggaggcagagacagcgagacaacagttccctttttatgatgatatgcaaaatatatttaccactagaatgcagagaatgctatgggctgaatccgagggaggaggagggggaacaagcggggcagcgagaaagagagagtattcttcagatgaggaagaagagaatgtgaatgaagagctagtagatgtcagcaacgacccaaaaattctaaatccgaaaaagaacattgcaaagaagcgaaaaggcggtagtaatagtagtaatagcaataatggtgtaagagaagtgttggaagagtttatgagacatcaagtgagaatggagagcgagtggagagaaggatgggaggctagggagaaggaaagagcagagaaagaagaagaatggagaaggaagatggaggagcttgagaaggagaggttggcaatggagcggatgtggcgggatagagaggagcaacggcggtcgagggaggagatgagagcagagaagagggattcacttatcaatgcattgcttgctaagcttactagagatggttccctctaatcttttgtcagctttgcttaacctaaattaacttgttcttatatgcttgtttggggtgtagtgtaggtacaattatttggtgggggaagataatatctacggcaaatctcaacactcatatattgattgatatgatgacatatttgagttttagtgaggctttagtaatttatcatccccacatttttcttcctagttaaa

SEQ ID NO: 4533 - DNA, 900 bp, Artificial Sequence
  P7145 (opLexA::G1006, G1006 is from A. thaliana)
gataaatcaatcaacaaaacaaaaaaaactctatagttagtttctctgaaaatgtacggacagtgcaatatagaatccgactacgctttgttggagtcgataacacgtcacttgctaggaggaggaggagagaacgagctgcgactcaatgagtcaacaccgagttcgtgtttcacagagagttggggaggtttgccattgaaagagaatgattcagaggacatgttggtgtacggactcctcaaagatgccttccattttgacacgtcatcatcggacttgagctgtctttttgattttccggcggttaaagtcgagccaactgagaactttacggcgatggaggagaaaccaaagaaagcgataccggttacggagacggcagtgaaggcgaagcattacagaggagtgaggcagagaccgtgggggaaattcgcggcggagatacgtgatccggcgaagaatggagctagggtttggttagggacgtttgagacggcggaagatgcggctttagcttacgatatagctgcttttaggatgcgtggttcccgcgctttattgaattttccgttgagggttaattccggtgaacctgacccggttcggatcacgtctaagagatcttcttcgtcgtcgtcgtcgtcgtcctcttctacgtcgtcgtctgaaaacgggaagttgaaacgaaggagaaaagcagagaatctgacgtcggaggtggtgcaggtgaagtgtgaggttggtgatgagacacgtgttgatgagttattggtttcataagtttgatcttgtgtgttttgtagttgaatagttttgctataaatgttgaggcaccaagtaaaagtgttcccgtgatgtaaattagttactaaacagagccatatatcttcaatcaaa

SEQ ID NO: 4534 - DNA, 1319 bp, Artificial Sequence
  P7148 (opLexA::G1133, G1133 is from A. thaliana)
ttcaagaaagaatcaccaagtgttgcgttccacacatttgagcaacagcttccacaatcgtattgtattcctgtaaagttcccttggcttaaactgcaagagcatgcctcttgataccaaacagcagaaatggttgccattaggcttaaatcctcaagcttgtgtccaggacaaggcgactgagtatttccgtcctggaattccttttccggaactcggtaaagtttatgcagctgagcatcagtttcgctatttgcagccaccgttccaagccttattgtctagatatgatcagcagtcttgtggaaaacaagtttcatgtttgaatgggcgatctagcaacggtgctgctccagagggggcactcaagtcttctcggaaaagatttatagtattcgatcagtcgggagagcagactcgtttgttacaatgtggatttcctctgcggtttccttcttctatggatgcagagcgagggaacattctcggtgccctacacccagagaaagggtttagtaaagatcatgccattcaagaaaagatattgcaacatgaagatcatgaaaatggcgaagaagactcggaaatgcacgaagacactgaggaaatcaacgcgttactgtattctgatgatgacgataatgatgattgggaaagtgatgatgaagtaatgagcactggtcactctccattcacagttgaacaacaagcgtgcaacataacaacagaagagctggatgaaactgaaagcactgttgatggtccacttcttaaaagacagaaactactggaccattcgtacagagactcatcaccatcccttgtgggcaccactaaagtcaaaggcttatcagatgaaaaccttcctgaatcaaacatttcaagcaaacaagaaacgggttctggtttgagcgacgagcagtcaagaaaagacaagattcacaccgctctgagaatcctggagagtgtagttccaggggcaaagggaaaagaagctcttttactactagacgaagccattgattacctcaagttgctgaagcaaagcttaaactcatcaaagggtttgaataaccattggtgaaaaacctacaaccccttttgtcctattgataaggcatgtttggttggttaaagagaagacatgggacaaaagataatcaatgaggtaaaggactgatgaagaagattctctcaaattcattaacgtgggtttgaaacaattagaacacgcctggtgaccctagtgggaccgtatccactgttcatctagctggatcaatagtggtttacttttggatttggcatgctctctcaaa

SEQ ID NO: 4535 - DNA, 1319 bp, Artificial Sequence; identical to SEQ ID NO: 4534
  P7149 (opLexA::G1141, G1141 is from A. thaliana)

SEQ ID NO: 4536 - DNA, 1057 bp, Artificial Sequence; identical to SEQ ID NO: 85
  P7152 (opLexA::G1233, G1233 is from A. thaliana)

SEQ ID NO: 4537 - DNA, 710 bp, Artificial Sequence; identical to SEQ ID NO: 87
  P7153 (opLexA::G1240, G1240 is from A. thaliana)

SEQ ID NO: 4538 - DNA, 859 bp, Artificial Sequence; identical to SEQ ID NO: 99
  P7154 (opLexA::G1266, G1266 is from A. thaliana)

SEQ ID NO: 4539 - DNA, 429 bp, Artificial Sequence
  P7157 (opLexA::G1395, G1395 is from A. thaliana)
attttttccggcgagcggtgctgataacctcgtagctccgaaacgccgccatggccgcagaatttgatggaaaaatcgaaagcaaagggctaaacccgggactgatcgtccttcttgtaataggagggttgctactgacattccttgtaggaaacttcatcctttacacatacgcacagaagaatttacctccgaggaagaagaaacccgtttctaagaagaagatgaagaaagagaagatgaagcaaggcgtccaagttcctggcgagtagcttttgttatatgttgtcgggattatcctttgatgataactcactctgctggactagaacttgtatgactccgttactcattagttttttgatgttttcgatgtagcatgcatgatattttcttgagttgacaatctataagctttactgagataaa

SEQ ID NO: 4540 - DNA, 1519 bp, Artificial Sequence; identical to SEQ ID NO: 1163
  P7159 (opLexA::G615, G615 is from A. thaliana)

SEQ ID NO: 4541 - DNA, 1310 bp, Artificial Sequence
  P7162 (opLexA::G277, G277 is from A. thaliana)
cacgaattcgattctctcttatctcgacgagaaaaccctactgcgaaaaaactccgatctctctggcgagaagtaaatttttatctctgagcttggtttcaccatttctctatctctatctcctcgctgggttacggtttggtaaggtcagtgttctctaaggctgaaatttgggggtttctcagtctcgatgtggtcgtgctccgttaggattcttcacaatcattagggttatatttcttacaaactgatgctcattttctcttccctgtctatggctttatctgtgatccttcaaaagcttagtgtcttcggccctggtttgaatccttctttcccttactgcatcgccaatcactcctttgcctcccgttaattgagttgctctctttcaacttaattacattagtctgcttcctttgctgtctagtctggatagtgttgcaaatcaagtagtatcttctttagacattcttggctgagagatttacactaaaagcatagaataagaaacccctgtttggttagtatctacccgagtctcgtagtcctacacagatccggatcctagtttcgaagctagttcttgtttagctgaagctcagacccaaaatgctccaagaaccgtcggctgcattctccctccggcgtaactcattcagacgccgatctcccagatcaaatgtcgatgacagaggctggaatccgctccatatcaaagccagaaaaggcgatctgaaatctgtcaagcagcttctcgaccaaggaatggatgtgaatgctctagcatggggacccaaatcaaaaggagtgagtgcacttcaccttgcagcagagggaggtcacattgaagtcatggatttactcctagaacgtggggccaacattgatgctaaaacatggggctcatgcgggtggactcctctccacgctgcagccaaagagcggaagagagaagcagtgaagtttctggtggagaacggcgcattcttggcagatgatataactgataccaggtttaatccgccggtgcattactgtcacggccttgaatgggcgtacgaggaaatgaagaagcttaacagcgagtcttcttcttcatctggtggagacacatcttccagttctgacaactgaacttcttcttggttgtttctcggtgtgttttgttttgttttctagttgagactacttatcagaactattatggttggtgtttgatcttatgggctatgtgaaacattgaaactgcggatacattcatgtaatcttcagtgtgttattttgcaactccagtttgatatcctaaa

SEQ ID NO: 4542 - DNA, 1135 bp, Artificial Sequence; identical to SEQ ID NO: 335
  P7165 (opLexA::G1763, G1763 is from A. thaliana)

SEQ ID NO: 4543 - DNA, 820 bp, Artificial Sequence
  P7170 (opLexA::G2107, G2107 is from A. thaliana)
accacaaaacagagcaacacacaacacaaagcttcatttcaattctgtttcgagaaccctttgagaaccagatcggagatggaaaacgacgatatcaccgtggcggagatgaagccaaagaagcgtgctggacggaggattttcaaggagacacgtcacccaatctacagaggcgtgcggcgtagggacggcgacaaatgggtatgcgaagtccgtgaaccgattcatcagcgtcgagtctggctcggaacttatccgacggcagatatggccgcacgtgctcacgacgtggcggttcttgctctgcgcgggagatccgcgtgtttgaatttctccgattctgcttggaggttgccggtgccggcatccactgatccggacacgatcaggcgcacggcggccgaagcagcggagatgttcaggccgccggagtttagtacaggaattacggttttaccctcagccagtgagtttgacacgtcggatgaaggagtcgctggaatgatgatgaggctcgcggaggagccgttgatgtcgccgccaagatcgtacattgatatgaatacgagtgtgtacgtggacgaagaaatgtgttacgaagatttgtcactttggagttactaaaatacgtatgtgttaaaaaaccaaagatcgtatgtgtatgtatgcataataaatgggcttaatgatgggcatagatatgataggtccagcctatatgttaaatgtgttttattttttggtttatctagtttcctaggtatttaccaaattgtattagtataagttttattaagaaataatcaaaaatgttgttgcc

SEQ ID NO: 4544 - DNA, 1975 bp, Artificial Sequence
  P7184 (opLexA::G1367, G1367 is from A. thaliana)
tccttccacaaaacttttttaattttatctgaaaaattaaaacaaccgaaacaaaaaaaaaaaactaaaaatcaaaaatctcatcaccttccttgctctgtattttttctctctcactaaatcctccatggatccttctctctctgcaaccaatgatcctcatcatcctcctcctcctcagttcacatctttccctcctttcaccaacaccaaccccttcgcctctccaaaccaccccttcttcaccggacccaccgccgtcgcgccgccaaacaacatccatctctatcaagcagctcctccgcagcagccacaaacatctccagttcctcctcatccatctatttcccaccctccttactctgacatgatttgcacggcgattgcagcgttaaacgaaccagatgggtcaagcaagcaagctatttcgaggtacatagagagaatttacactgggattcctactgctcatggagctttgttgacacaccatctcaagactttgaagaccagtgggattcttgtcatggttaagaaatcttacaagcttgcttctactcctcctcctcctcctcctactagtgtagctcctagtcttgaacctcccagatctgatttcatagtcaacgagaaccaacctttacctgatccggttttggcttcttctactcctcagactattaaacgtggtcgtggtcgacctccaaaagctaaaccagatgttgttcaacctcaacctctgactaatggaaaactcacctgggaacagagtgaattacctgtctctcgaccagaggagatacagatacagccgccacagttaccgttacagccacagcagccggttaagagaccgccgggtcgtcctagaaaagatggaacttcgccgacggtgaagccagctgcttctgtttccggtggtgtggagactgtgaaacgaagaggtagacctccgagtggaagagctgctgggagggagagaaagcctatagtagtctcagctccagcttcagtgttcccgtatgttgctaatggtggtgttagacgccgagggagaccaaagagagttgacgctggtggtgcttcctctgttgctccaccaccaccaccaccaactaacgtagagagtggaggagaggaggttgcagtcaagaaacgaggaagaggacggcctcctaagattggaggtgttatcaggaagcctatgaagccgatgagaagctttgctcgtactggaaaacccgtaggaagacccagaaagaatgcggtgtcagtgggagcttctggacgacaagatggtgactatggagaactgaagaagaagtttgagttgtttcaagcgagagctaaggatattgtaattgtgttgaaatccgagataggaggaagtggaaatcaagcagtggttcaagccatacaggacctggaagggatagcagagacaacaaacgagccaaagcacatggaagaagtgcagctgccagacgaggaacaccttgaaaccgaaccagaagcagagggtcaaggacagacagaagcagaggcaatgcaagaagctctgttctaaagataaagccttgacataaaaagctagcaagtggtgggtttacttgttgtgtgttacatgaaatttttaatcttataagggtgtttgcaggagaaaaacaaaaagaacaatgtgatgaactgatgatgatgattgtgtctctaaccaaacaacaaggagaggtagggtaatgtctgtaaagtgaattaggatgttaccattgttcatgcttcccatctctctccatcgtccatatctgtgtaggcagctttgttctttgttccctcgtgttttttttagactgttgtgtctcttattctattttgtctccttaggctttttaggagttgttgttgatgtttatcaaaaacgcttatgtaatttttatgaccacttctactttttatgatggtttcttaaaaaaaaaaa

SEQ ID NO: 4545 - DNA, 884 bp, Artificial Sequence
  P7198 (opLexA::G634, G634 is from A. thaliana)
tcgaccggagctagagagaaagagagagtgtgtgtgtagaaaaagattgaaacatcatcaagattgatggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaacagcaactacaacaacaagaatcaatgataggtgagtatgaaaaaggc

SEQ ID NO: 4546 - DNA, 1376 bp, Artificial Sequence
  P7446 (opLexA::G1824, G1824 is from A. thaliana)
ctctatctacgattatatttggatctacaagtgaagattgatcgatgttagctctgtctccggcgacaagagatggttgcgacggagcgtcagagtttcttgatacgtcgtgtggattcacgattataaacccggaggaggaggaggagtttccggatttcgctgaccacggtgatcttcttgacatcattgacttcgacgatatattcggtgtggccggagatgtgcttcctgacttggagatcgaccctgagatcttatccggggatttctccaatcacatgaacgcttcttcaacgattactacgacgtcggataagactgatagtcaaggggagactactaagggtagttcggggaaaggtgaagaagtcgtaagcaaaagagacgatgttgcggcggagacggtgacttatgacggtgacagtgaccggaaaaggaagtattcctcttcagcttcttccaagaacaatcggatcagtaacaacgaagggaagagaaaggtgaaggtggattggacaccagagctacacaggagattcgtggaggcagtggaacagttaggagtggacaaagctgttccttctcgaattctggagcttatgggagtccattgtctcactcgtcacaacgttgctagtcacctccaaaaatataggtctcatcggaaacatttgctagctcgtgaggccgaagcggctaattggacacgcaaaaggcatatctatggagtagacaccggtgctaatcttaatggtcggactaaaaatggatggcttgcaccggcacccactctcgggtttccaccaccaccacccgtggctgttgcaccgccacctgtccaccaccatcattttaggcccctgcatgtgtggggacatcccacggttgatcagtccattatgccgcatgtgtggcccaaacacttacctccgccttctaccgccatgcctaatccgccgttttgggtctccgattctccctattggcatccaatgcataacgggacgactccgtatttaccgaccgtagctacgagatttagagcaccgccagttgccggaatcccgcatgctctgccgccgcatcacacgatgtacaaaccaaatcttggatttggtggtgctcgtcctccggtagacttacatccgtcaaaagagagcgtggatgcagccataggagatgtattgacgaggccatggctgccacttccgttgggattaaatccgccggctgttgacggtgttatgacagagcttcaccgtcacggtgtctctgaggttcctccgaccgcgtcttgtgcctgaaacgcacaagatccgtaggcaagcgagaaccaaacaaaaattcgacgacatgtctttcaattattgtac

SEQ ID NO: 4547 - DNA, 1134 bp, Artificial Sequence
  P7451 (opLexA::G1957, G1957 is from A. thaliana)
caagaaccatctcgtaaatcaagatttctccaaggaaaatcagataagtcataatggatctatccctggctccgacaacaacaacaagttccgaccaagaacaagacagagaccaagaattaacctccaacatcggagcaagcagcagctccggtcccagcggaaacaacaacaaccttccgatgatgatgattccacctccggagaaagaacacatgttcgacaaagtggtaacaccaagcgacgtcggaaaactcaacagactcgtgatccctaaacaacacgctgagaggtatttccctctagactcctcaaacaaccaaaacggcacgcttttgaacttccaagacagaaacggcaagatgtggagattccgttactcgtattggaactctagccagagctacgttatgaccaaaggatggagccgtttcgtcaaagagaaaaagctcgatgcaggagacattgtctctttccaacgaggcatcggagatgagtcagaaagatccaaactttacatagattggaggcatagacccgacatgagcctcgttcaagcacatcagtttggtaattttggtttcaatttcaatttcccgaccacttctcaatattccaacagatttcatccattgccagaatataactccgtcccgattcaccggggcttaaacatcggaaatcaccaacgttcctattataacacccagcgtcaagagttcgtagggtatggttatgggaatttagctggaaggtgttactacacgggatcaccgttggatcataggaacattgttggatcagagccgttggttatagactcagtccctgtggttcccgggagattaactccggtgatgttaccgccgcttcctccgcctccttctacggcgggaaagagactaaggctctttggggtgaatatggaatgtggcaatgactataatcaacaagaagagtcatggttggtgccacgtggcgaaattggtgcatcttcttcttcttcttcagctctacgactaaatttatcgactgatcatgatgatgataatgatgatggtgatgatggcgatgatgatcaatttgctaagaaagggaagtcttcactttctctcaatttcaatccatgagaag

SEQ ID NO: 4548 - DNA, 1597 bp, Artificial Sequence
  P7452 (opLexA::G896, G896 is from A. thaliana)
ccgattcgtcttcatctgattccctcccttccgagaataataatgtacccgccacctccctcaagcatctacgctcctccgatgctggtgaattgctccggttgccggacgcctctccagctcccatccggcgcccgatctattcgctgcgctctctgccaggctgttactcatatcgccgaccctcgcaccgcccctcctccgcaaccttcctccgccccttctccgcctccccaaatccacgcgcctcccggtcagctgcctcacccccatggcaggaagagggccgtgatctgtggcatctcgtatcgtttctctcgccacgagctcaaaggctgcatcaacgacgccaagtgcatgcgtcaccttctcatcaacaaattcaaattctccccagattcaattctcatgcttaccggtacagagtatttctatcttttcaaatgcctatgtttgctactatactactattccttggattttgaatacaattttccttggcctcttcaatctgataaacacacattccaagttaccatttcgaaccactttgataaaaatgtgttgcattccatagctgactaactaattgttcatcatggatggttttcattctcagaggaagaaactgatccatatcgtatcccgaccaagcaaaacatgaggatggcattgtattggctcgtacagggatgcacagcaggcgactcacttgtcttccactactctggtcatggttcgcgtcaaagaaactacaacggtgatgaagttgatggctatgatgaaacactctgtcctctggattttgaaactcaggggatgattgtagacgatgagatcaacgcaaccattgtacgccctcttccacatggtgtcaagctccattcaattatcgatgcttgccatagtggtaccgttctggatttacccttcctatgcagaatgaacaggttattagtccctcaaccgcttctaaaagggatgttgcttacctctctcgttatatttaacatacatccatttttttttttaattgaaacagagctgggcagtatgtgtgggaggatcatcggcctaggtcaggtttgtggaaaggaactgctggtggagaagccatttcaattagtggatgtgatgatgatcagacttcggccgacacatcagtaagtagaacgactctaatcatacgtcttgctgttgtagttggttcctcctctcatgattaaaacacatacacaggcgctgtcgaagatcacgtctacgggtgctatgactttctgttttattcaagcaattgaacgcagcgcacaaggcacaacctatggaagccttctgaattctatgcgcaccacaataaggaatacagggaatgatggtggtggtagtggtggagttgtgacgactgtgctgagcatgcttctgacagggggaagtgcgattgggggattaagacaggtaaaattctttcttgctctcttgtgttgatacagatcgataaatgttttcttaaatctgttttttgacaggagcctcaactgactgcttgccaaacattcgatgtctatgcaaagcctttcactctctagtaaaggacaag

SEQ ID NO: 4549 - DNA, 948 bp, Artificial Sequence
  P7456 (opLexA::G1474, G1474 is from A. thaliana)
caatattgtcatatacaatggagaaacctggtggcttctggatccccaagaaaagcaacaaagagtcatcttgggaagagctggcctttgcagaagacgatgccgccggatctttgtggccgccaagatcttatacgtgtagcttctgccggagagaatttaaatcggctcaagccctcggtggccatatgaacgttcaccgaagagacagagcacggcttaagcaagccgacgaccaatacttattccccaaatcttcttcgtctccagagtatccatctcataaagatagcgataatattcatgaaacctcttgctatactttggtttttaacaccaaacctaattattttaagactcaacactcttgtgttattgatctttcttcgtcttcttctttaccatatttgactccttctagggtttcttctggtttgcctggaaagcaacatacttcttcttctcctccttctttcgttgtagaaccttccaagaactctaaatatattccctcttcttccccatggtcgtgcccaagtactgttgtggagcaaaagagttgtgatctatatgaaattccggctatggaaggagaaaagaagagaaagactgagagtgatgtgccaaaaatcgggcataaagcaaaacttagtcttggaaacaccactgatctctcggtgagtatgaatctggtcatccaccaaagttttccgattactgctcacggtagcgatgaagagattggtagggtggatatccgtaaaagaagacgaagacatgagagtccgtcgcagcagtcgattttcatttcaagtttatcttgtaagagtgacataattacaagaaacgaggaaagcaaacacaaaggtgatcgctttgaggatttagatcttgagcttaggctagggactgatccaccaaaaggaatttgattgatggaccgatgaa

SEQ ID NO: 4550 - DNA, 2306 bp, Artificial Sequence
  P7458 (opLexA::G2020, G2020 is from A. thaliana)
tcaaacaatttgtgtcacgattaaagtttgagatggattattgtgaagcacgtctagatacaatccaggtacataggtcaacggttgtgtgtcttgacaccgaatctgttccagagttccttaccagtctcagattttcggatcttttcaacctccctggtgaatatgtgccgatgaatcctgagatctttagcgcaatgagagcggggaacatagagcttctggaaaagttgaaaagctacgaaacgccaatggcatgtcttaagagcgatggcggagattctgttcttcaccttgctgctgcttcgggtcatcttgaactagtgaagaacataatcactgaatgtccttgtcttttattggagccaaactcgaagtatcagattccgcttcatgtggccgctcgtgctggccgttcagcagttgtgaaggctcttgttgcttctgtattatatttttcacctagagtgcctgaagaagatagggatagactgaatatatatgttctgaaggacatagatggagatactcctctgcatgcggccttgaaagacctccatgaaaaagcagaggtaagccatgtaagataaaacatatttgtgtgaggaatgaagacttttgtttttatcagtcaaatttaagtttagggtataagaaataagacactcgtaaagtttgctacaaaattttctatatcaatggactttactaattttgttccatgtttctatgctttgttgaattccttgttgcattaggatccgcctcttactcgtctttgttttagaccaaatatcttgatcgtctaatcttatctccaacagcttacctatgtgtctgatgaatctataatttctgtcctagcttttgagatatcaggagcgcatcagaaaactatccttgtctcaccttattatgcattggcgacgtagcagatgcatttcattttctgatgcatcaacacgccaaatggagacagctgcctgtctagtgaatgcagaccaacatgcctcatttcttgcgaataaagatggaacatctcccttgtatttggcagttgaagctggtaatgtatcacttgtgagagcgatgttgaaccgtcctggtaataaaatccaaggaaaaacctctaccttagcttcacaattggaagggagaaaatcgcttttacacgcagccctcaaggccaaaaatacaggtctgtctccaaatttagttgttcaaaagttctttgctagaagaaactaattgaaatactacttgtttgggcagatgttcttaatgttattcttaatgatgacccgagccttgtcaacgagcgagatgaagaagggcgaacttgtctttctgttggagcatccatggggtattacaaaggaatatgtaagctattagatcgatcaacaaagagtgtttatgaatgcgacaaagatggttcctttccaattcatatggctgtagagaaaggtcatttgaaagttgtgaaagagattctaaaacgttgtccagattcgaaagagctggttaacaaacaaggtcaaaacatgcttcacattgcagcaaagagtgcgaaagtgggatcttttcttttgggttatataaggagacttgatacggagaatcatctgatcgaggagcaagatgtggatgggaatgcacctttgcacctagccaccataaattggcgctgtcgaactgttgataaacttgctgcctttgcttctaccgaaacaaaaatcctgaatatacagaacaaagatggattgagacctctggatattgcagagttaaatctacagcctgactacgttttacgggaggtgtataacatttatttttccatgtattcctttttgttccaatgtcaaaccaaatagagctcattgcctttgtctctatcttacttgggataacagagattgacgttgatggtactgctgtgcgtttacgcaccgaaaagtgttggttggctaccgacgagtggaatgacactaagaagcagatcagagcctctagacgctaaaaaatacaaagaccatatcaacgctcttctgctggtggcaactcttgtagccactgttacatttgctgcaggttttacaatacctggtggctttaacagctctgctccaaacatgggtatggccactttggccgatgactccaccctcttcttttttctggtattagacaccttggcgatgcaaagctctattgtagcaatagttgctctgatttaggcacagttgggggatcctgcaatcgttcacagagcttttcatttggctttgccatcactcttcgtt

SEQ ID NO: 4551 - DNA, 1229 bp, Artificial Sequence
  P7459 (opLexA::G243, G243 is from A. thaliana)
tgatctattgtcgttgtaatgatctttgattacaaaggaaaaaaaaaactaagacccttgacgaaaataataaccgtattcgtaatctctgatatcctacattatgtactatttctgatttttgtttcttatacgcacttttgttctagatataactaagaaaatgtcaaagagaccatattgtatcggagaaggactgaagaaaggagcatggactacagaagaggataaaaaactcatctcttatatccacgaccacggtgaaggaggctggcgtgacattccagaaaaagctgggctgaaacggtgtggaaagagttgtagattacggtggactaactatttgaaaccagatatcaagagaggagagtttagctatgaggaagagcagattatcatcatgcttcatgcatctcgtggcaataagtggtctgtcatagctagacatttgccaaaaagaacggataacgaggtcaaaaactattggaacacacatctcaagaaacgtttaatcgatgatggcattgatcccgtgacacacaagccactagcttcttctaaccctaatccagttgagcccatgaagttcgatttccaaaagaaatccaatcaggatgagcactcttcacagtctagttctacaactccagcatctcttcccctttcctcgaatttgaacagtgttaaatccaaaattagcagtggtgagacgcagatagaaagtggtcacgtgagctgcaagaaacgttttggacgatcgagctctacatcaaggttgttaaacaaagttgcagctagagcttcttccatcggcaacatcttatcaacatccatagaaggaaccttgagatctcctgcatcatcttcaggactcccagactcgttctctcaatcatatgagtacatgatcgataacaaagaagatctcggtacgagcattgatctcaacatccccgagtatgatttcccacagtttcttgagcaactcattaacgatgacgacgaaaatgagaacattgttgggcccgaacaagatctccttatgtccgatttcccatcaacattcgttgatgaagacgatatacttggagacataaccagttggtcaacttatcttcttgaccatcccaattttatgtatgaatcggatcaagattccgacgagaagaacttcttatgatctgtctatagatggcttgtcaatttcccaatgttgacatgcccaagat

SEQ ID NO: 4552 - DNA, 1626 bp, Artificial Sequence
  P7462 (opLexA::G1313, G1313 is from A. thaliana)
tccggagttagggtgggagcttgatgtctaaattgttactgtcagtggtttaattagaaaagagatgagttacacgagcactgacagtgaccataatgagtcaccagctgctgatgataatggaagtgactgcagaagtagatgggatggtcatgctctcaagaaaggcccttggagttcagctgaagatgatattcttattgactatgtgaataagcatggtgagggtaactggaatgctgtgcagaaacacaccagcttgtttcgttgtggtaaaagctgtcgtctaagatgggctaatcatctgaggccaaatttgaagaaaggagcttttagtcaagaagaagaacagcttatcgttgaattgcatgccaagatgggtaatagatgggcacgtatggctgcacatgtaagtgttttgtttctgataaggatatggttccttttgtaaaagtgtgtttcgagactaatttcatagagtttttgtttgctccagttgcctggccgaacggataatgagataaagaattattggaacactcgtatcaagaggcgacaacgagctggtttgccactttatcctcctgagatgcatgttgaggcacttgagtggagtcaagagtatgccaagagtagagttatgggagaagatagaagacatcaagatttcttgcagctggggagttgtgaatctaatgtcttctttgatactcttaattttaccgacatggtacctggtacttttgatctagcagatatgactgcctacaaaaatatgggtaactgtgcaagttctcctcgatatgaaaacttcatgacaccaacaatcccctcctcgaagcgactttgggaatctgagttgttgtatcctgggtgtagcagtaccataaagcaagaattctcgtcgcctgaacaattccggaacacatctccacaaacgatttccaaaacttgcagcttctcagttccttgtgatgttgagcatcctctctatggaaaccgacattcacctgttatgattccagatagccatacccctacggatggcattgttccttattctaagcccttatatggggcagtgaagctggagctcccttcattccaatattcagaaacaacatttgaccagtggaagaaatcgtcatctcctccacactctgatctccttgatccctttgatacttacattcagtctccaccaccaccaacggggggagaagagtcagatttatattcaaattttgatactggtctgctcgatatgttgcttctggaagccaagatcagaaataatagtacaaagaacaatttgtacaggagctgcgcttcaactattccatcagctgatcttggccaggttactgtatcccaaactaaatccgaggagtttgacaattcccttaagagcttcttggttcattccgaaatgtccacacaaaatgcagatgaaactccaccaagtgagttactattcaccttaccatcacttgaaatagtttgttgaagatttcatctttttccctagaattctatttggtatcctgattttactttttgagaatcatcacttgcattaatttgtttcttatagccgagattttgagctgatcaagaactcaccta

SEQ ID NO: 4553 - DNA, 618 bp, Artificial Sequence
  P7464 (opLexA::G2063, G2063 is from A. thaliana)
tttttataaccaataaactcataattgtttttttctccaaaatgaatcccaagaaaaccaaaggaaaacaaaagattaacatcaagaaaattgaaaaagatgaaggcagatcggtcacattctctaagcgtctaaatggtatctacactaaaatcagtgagctttctattctctgtggtgttgaagttgcgtttatcgggtattcttgctctggaaaaccatacacttttggcagtccatccttccaagccgtggcggagcggtttctcaacggcgatgcctcgtcgtcttcttcatcatcattggtcatgaatgctcacaagcaagcgaagattcaagagctttgcaaaaaatacaatagattggtggaggagttaaaggtggacgaagtcaaagtcaagaaggcagctgcattggcggagacgagggtcgtgaataaggatgtgtggtggaaagtggatccaaatgacgtgaaggatcacgaaaaggcgaagaagatgatggagaagtatcaagagctctatgataaactgtgtgagcaagctgcttcaaggatcaagagaggacatgatgagaataataacaaatgattcataatcaagattttaattagtagat

SEQ ID NO: 4554 - DNA, 2431 bp, Artificial Sequence
  P7465 (opLexA::G2015, G2015 is from A. thaliana)
ctcttgcattactgatcttcttcttccacttggtaagtctttctctgccccctcttcatgcaatggttgacttttttgtttgtggtcgtggaagttagtaacttaaatctgtgtttccaaactatttgtgtgattagtttaggtttgcgatggacagttctgaagcagagctagatagaattgaggcacaaaggtcaacagatgcgtctcatgatcaacagaacagaacatacttacccatgaacatacacggttcacaagacttctctcaaagcggaggagatggcgtcacgccacttacaggagacaccgaatctgtgccagagttccttactaaccttagattgtcggatctttacgctatccgtggtgaagatgtccggatgattccagaggtttttagtaaaataagtgatgggaacaaagaatgtctggagaagttgagaagccgtggaatttcagtggcacgtatcaagagcaatacaggagattcaattcttcatcttgctgttacatggggtcatctagaactagtgaaggagattgtctgtgaatgcccgcgtcttctcttggagcaaaactcaagcggtcagacaccgctacatgtggcggctcatagcggtcataccactattgttgaggcttttgtcgcattggtaacattttcttcagctagactgtgtaatgaagagagtgagagaatgaacccatatgttctcaaggacaaagatggaaatactgctctgtactacgcgattgaagggcgctatttcgagatggctgtatgtctggtgaacgcaaaccaggatgctccttttcttggaaataagtatggagtatcttccttgtttgtggcaataaatactggagatgtatctcttgtgaaagcaattttgaaaatcataggcaacaaggaccttaaagggaagaagtctaacttggagtcaaagttacaagggcagaaatctcttgcacatgttgctttggtgacccagagtataggtttgtttttcgctttaaccagtagcagctgcatttattctattcaaatatgtaaaaccagtttgagacgggaatttcctcctcaaggcggtaaaaatatttgtatgtatactaattgttgttcccaattgtttgagcaggtgtccttgatgttattcttgatgaatatccaagtcttatggacgagcgagatataaatggttggacttgtctttcactcgcagcacatatagggtattatgaaggagtatgcaacctcttagaacgatcaacaaagggtgtttatgtctgcgaccaagatggttcttttccaattcatacagctgcagagaaaggtcatgaaaatattgttgaagagtttataaaacgatgtccaggttcaaaacacttacttaacaaacttggtcagaacgttctccacattgcagcaaaaaatgggaaattttggatttcgaacatgttgataattaataaagatacggaacatctgggtgttgggcaagatgtggacgggaatacacctttgcatcttgccgtcatgaactggcactttaaatccattacttggcttgctaggagtagcaagatactgaaagtgcggaacaaaaacggcttaagagctagggatattgccgagagagaggtgaaaccccactacatctttcaggaggtatgtataatttcgtttcatacaacaaaatttgatatcacataaatgatttatagctcgacccccattttttgagttacagaggtggacactggcgctcttattatacgctattcactcaaggggtttcgaatctgtacactcattaacaaaaccgtcagtgccactagaccctaaaaataacagagattacgtcaacactcttctcctggtagctgctcttgtagccacaatgacgtttgctgcaggttttacaataccaggtgggtttaacagctctgctccacacttgggcagggcaactttggccactaatccaactctcttcatttttctggtacttgacatcttggccatgcaaagttccgttgcaacaataggtattcttatttgggcgcagttaggtgatccagtgctcattcgctcatccttacatgtggctttgcccttactgctttttgctttactctgcatgcccttggcattcctttttggcgtggtcactgcagttgggcatgtgaaatggcttgtagtcatcatttgcattatatctgttttattcttttcttgggcgatctttgtccttggccctcacgtcatgctacaacggtcatacgtttctcccaagtacgctggtgactttctcgtgacttttatgcagtataaagacataattgggctttttgtgtctttgataaagtttcttttttgtggttgttattaagagtttgtagcctattcaaaggcattcttcgtatg

SEQ ID NO: 4555 - DNA, 948 bp, Artificial Sequence
  P7474 (opLexA::G137, G137 is from A. thaliana)
aaagtggaaattaaggtaacaaaaagaaatgggaagaggaagagtagagctgaagaggatagagaacaaaatcaacagacaagtaacgtttgcaaagcgtaggaacggtttgttgaagaaagcttatgaattgtctgttctctgtgatgctgaagttgctctcatcatcttctccaaccgtggaaagctctatgagttttgcagctcctcaaacatgctcaagacacttgatcggtaccagaaatgcagctatggatccattgaagtcaacaacaaacctgccaaagaacttgagaacagctacagagaatatctgaagcttaagggtagatatgagaaccttcaacgtcaacagagaaatcttcttggggaggatttaggacctttgaattcaaaggagttagagcagcttgagcgtcaactggacggctctctcaagcaagttcggtccatcaagacacagtacatgcttgaccagctctcggatcttcaaaataaagagcaaatgttgcttgaaaccaatagagctttggcaatgaagctggatgatatgattggtgtgagaagtcatcatatgggaggaggaggaggatgggaaggtggtgaacagaatgttacctacgcgcatcatcaagctcagtctcagggactataccagcctcttgaatgcaatccaactctgcaaatggggtatgataatccggtatgctcagagcaaataactgcgacaacccaagctcaggcgcagcagggaaacggttacatcccggggtggatgctctgagagtcatgtgctgtgttaaagctcaccaacaaaagatcttttatatatataaaagtatagacacaagactttggatttgtagacataagtggctatatataatggtcctgaggatcttcaagacatttgtatcttttgggaatccttgcttatattaagaattc

SEQ ID NO: 4556 - DNA, 1034 bp, Artificial Sequence
  P7475 (opLexA::G138, G138 is from A. thaliana)
agagttttcagttgggttttggtttcttggtgagagaagagagaaaaagagaggatgggaagagggaaagttgagctgaagaggatagagaacaagatcaatagacaagttacttttgcaaagagaagaaatggtttgctcaagaaggcttatgagctttctgtcctttgtgatgctgagattgctcttctcattttctctaaccgtggcaagctctacgaattctgcagcagccctagtggtatggcgaggacggttgataagtatagaaaacatagttatgcaacaatggatccaaatcaatcagctaaagacttgcaggataagtatcaagactacttgaagcttaaatcaagagttgagatccttcaacattcacaaaggcatttgctaggtgaagagctatccgagatggatgtgaatgagcttgagcatctcgaacgccaagtagatgcatcactaagacaaataagatctaccaaggctcggtctatgcttgatcaactatctgacctcaaaactaaggaggaaatgttattggaaaccaatagagatcttaggagaaagttggaggacagtgatgcagcacttactcaatcgttttggggaagttctgctgcagaacaacaacaacaacatcaacaacagcaacaaggcatgagctcttatcaatcaaaccctccaattcaggaagcaggtttcttcaagcctctacaaggcaatgtagcattgcaaatgagtcattacaatcacaatcctgcaaatgcaaccaactctgcaacaacatcacagaatgttaatggattcttccctggatggatggtctgaaaacaatacatatctatatatgtacacatatgtgtgttttatagatcaaagatcattgcttgtgtcatttgatttttgccagagaaacatagttcattattacaaaactttgttatataatcaaggctctaatgtcaaacaccagattattacttttttgttctttgttttttggctctcttgaaatataaaatattgttttggga

SEQ ID NO: 4557 - DNA, 1057 bp, Artificial Sequence
  P7476 (opLexA::G139, G139 is from A. thaliana)
gcataaaagagggaaaataagatagggattttttggggtgaggaaagatgggaagaggaagagtagagctcaagaggatagagaacaaaatcaacagacaagtgacgtttgctaaacgtagaaatggtttgctgaaaaaagcttatgagctttctgttctctgcgatgctgaagtctctctcatcgtcttctccaaccgtggcaagctctacgagttctgcagcacctccaacatgctcaagacactggaaaggtatcagaagtgtagctatggctccattgaagtcaacaacaaacctgctaaagagcttgagaacagctacagagagtacttgaagctgaaaggtagatatgaaaatctgcaacgtcagcagagaaatcttcttggagaggatcttggacctctgaattcaaaggagctagagcagcttgagcgtcaactagacggctctctgaagcaagttcgctgcatcaagacacagtatatgcttgaccagctctctgatcttcaaggtaaggagcatatcttgcttgatgccaacagagctttgtcaatgaagctggaagatatgatcggcgtgagacatcaccatataggaggaggatgggaaggtggtgatcaacagaatattgcctatggacatcctcaggctcattctcagggactataccaatctcttgaatgtgatcccactttgcaaattggatatagccatccagtgtgctcagagcaaatggctgtgacggtgcaaggtcagtcccaacaaggaaacggctacatccctggctggatgctgtgagcgatacttcttcccccaataaagatcttaagcaagtactggtggggtcttcgtggtgtgatcttagatcttatgcatatgaataataatgttattgcacaagacttttgcttttgtagacacaagtggctatagctgtaatagccttcaacatctctcttctgtttcaggatttgtttgtgcctattgtaattgcttatatatgtatggtttgtataatgtgtgaaatgttaacatcgaccatgtctcatctggtg

SEQ ID NO: 4558 - DNA, 905 bp, Artificial Sequence
  P7477 (opLexA::G146, G146 is from A. thaliana)
acgagagcaaattctcaggatgggaagaggaaagatagaaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactccaacaggaatctgatgggagactctttgagttccttaagtgtcaaggaactaaaacaagttgagaatcgccttgagaaagctatctctaggatcaggtccaagaagcatgagttgcttttagttgaaatcgaaaacgcgcagaaaagggagattgagcttgacaatgagaacatctatctaagaactaaggtagcagaagtggagaggtatcaacaacaccatcatcaaatggttagtggttcagagattaatgcaattgaagctttagcctcacgcaattactttgctcatagcattatgactgctggttctggatctggtaatggaggttcttactctgatcccgacaagaaaattcttcatctcggataatctcgtctgcgaaaaaccgagctgcaataactctctgcatgcatctggggattctttgctcagatttatctctacataaaatatgttttggtgcaaaataattcaaagtacaatgaaggtattggtccttcaagactcattgcaatttgtgttgtgtaatgattaagacatactctagtttttattgcttcgt

SEQ ID NO: 4559 - DNA, 997 bp, Artificial Sequence
  P7479 (opLexA::G1384, G1384 is from A. thaliana)
atttcaggaaactccgatggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacctattttcttcttcttcttactataatcctcatgcatctttattcccttcacattccacaacctcttacccggatatttattctggatccatgacctatccatcttcattcgggtcggatcttcaacaacccgaaaactaccaatctcagttccattaccaaaacactatcacttacactcaccaagacaacaacacttgcatgcttaacttcattgagccgagccaaccgggttttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgataccggcgaatatggtcctattcaagctgccgtagacgctaaactagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtgaaaaattaggattcaattcatttttattcattttaac

SEQ ID NO: 4560 - DNA, 1093 bp, Artificial Sequence
  P7485 (opLexA::G2377, G2377 is from A. thaliana)
cagaaattcttatcctaagcctctttctccaccgcgcacgttagcctcctctctttcccactccgagatggagacgacgccggagactcagtcgaagactcaccgtctaccggcgggaagagaggattggtggagcgaagacgctacggcgacattgatcgaagcttggggagatcgttacgtcaatctcaaccggggaaatctccggcaaaacgattggaaagaagtcgccgacgccgtcaattcaagccacgggaatggccggccaaagaccgatgtacagtgcaaaaaccggatcgatacgttgaagaagaagtacaaaactgaaaaggcgaaacctttatcgaattggtgcttctttgatagactcgatttcttaatcggtccggttatgaagaaatcgtccggtgctgttgttaaatcggcgttgatgaaccctaatttgaatcctactggatctaaatcaactggtagctctctcgatgacgatgatgatgatgatgatgacgacgaagaagatgatgatgatgcgggtgattggggatttgtggtgaggaagcatcgtaaagttgaagatgtagattcgagtgaaggatcagcctttagggagctagcgagatcgattctgaagttaggggaagcgtttgagagaatcgaggggaagaagcaacagatgatgattgaattggagaaacagagaatggaagttgcaaaggagcttgagttacaacgaatgaatatgttgatggagatgcaattggagcttgagaaatctaaacttgggaaacgaagagctgcttcaggtaagaagttgtaggattgtagattgtggaggagttactgatgtgaagcaaggagcaatggttggatctaaagctcatacgatttggagaagatgttattattattgatctttaggttttcttaagttatagcgcgatgctttttttcttcttcttctttttcattctcttttttagcattgtagagttacattggtagtagcaatgcgaattaccaaaagaactctcatagtatctgacatatcaagatgtacttttgtgaagtatcaatgtatgatggtttgtgtaaa

SEQ ID NO: 4561 - DNA, 991 bp, Artificial Sequence
  P7494 (opLexA::G3054, G3054 is from A. thaliana)
ttcttcatctactctttctctctctatctctttccacttcctcttgcttttactcctgggttagggtttagggtttcttggtcgacgtgatgagtcatcggcgagattacggcagtgatgcagttcacgtgagaatcacccacgaccctccgcctgagaattgttttccaaattccggcgacagttccgtctgggccactgaggatgattacagccgtgtctgggccataaactctgatggcgcagagtctccgagcaagaagacacgatcttcctcctcctccgagatcgggaaatcgttcttcaagacgaagctttgcttcaaattccgcgccggaacttgtccctactccgcgagctcttgccactttgctcacagcgcggaggagctccgtcttcctccgccgccgccgcccaattggcaggagacggtgacagaggcttcaagaaacagagaaagctttgcggttagtttaggccctcgtggcaatgttgctcagactctcaagtctccgaattggaagacaaggatttgcaataagtggcagactactggctattgtccttttggttctcactgccattttgctcatggaccttcagagttgcatacatttggcggaggactcgttgaaggagaatgtaagatcggaacatccgccactttggacacaaagcagagaggacaagtagacacagtgactagccttgtttctcctggagtctcatcccaacggacatctagtgctgttacgcagaaacccaacggagtcagaactcaacggaaatggaaaggaccagataaaatcagtcgtgtttatggtgattggatcgacgatattgagtaaagtcactgcattttcactgatttgttgatcaaggtatagcttcttttagacttgtaactgtgtggacatattagcttcctcccttctgtggttgtagattgtgactcactcaacaaagacaaaaactctcatctttttgtttt

SEQ ID NO: 4562 - DNA, 961 bp, Artificial Sequence
  P7495 (opLexA::G3067, G3067 is from A. thaliana)
gaaaagaaaaaaacacaaaacctggtgttttttctctcgtcgtcgtttggtcgtgtcctaagacaagaaccggcgaacgaagaacaaactttttgaatctaacatccgaaagaaagagagaaaatgtcgtttacaggaacattggataaatgcaaggcctgtgacaaaaccgtgtacgtgatggatttgttaacattagagggtaatacttatcacaaatcatgtttcagatgcacccattgcaaaggcactctcgtgataagcaattactcatcaatggatggagttctttactgtaagccacacttcgaacagcttttcaaagaatctggcaattacagcaagaattttcaggcaggaaagaccgagaagcccaatgatcatctgactcgaactccaagcaagttatcatcattcttcagtggaacacaagacaaatgtgcgacttgtaagaagacggtttacccacttgagaaagtaacaatggaaggagaaagttaccacaagacttgcttcaggtgcacacacagtggttgtcctttgactcactcttcttacgcttctcttaatggcgtcctctactgtaaagtccacttcaatcagctctttctcgagaaaggcagttacaatcacgtccatcaagccgctgctaaccaccgtcgatccgcctcttctggtggcgcttctcctccttctgatgatcacaaacctgacgacaccgcctcaattcccgaagcaaaagaagatgacgctgcccctgaagctgcaggagaagaggagcctgagccggtcgttgagtcttgaaaatgtcgtggaggaatgatcttatcagttctcaagtttgaagtttttatatgcgtttctgtttaatgaatatataaatacaaattgttgttgtttcttcttgtaaattcttgtaaagttttaaagctctttttggagagaatctgttgtaaacaaa

SEQ ID NO: 4563 - DNA, 1128 bp, Artificial Sequence; identical to SEQ ID NO: 821
  P7497 (opLexA::G2790, G2790 is from A. thaliana)

SEQ ID NO: 4564 - DNA, 2577 bp, Artificial Sequence
  P7507 (opLexA::G2574, G2574 is from A. thaliana)
ggaaaaaaacagacaacaaaaagaaaagaaaatccaaacaagaagaagaagacgaaaatcttctgatatttctgacaatggaggttcttttgaaattaccctcttcagagtctcctcttaaggataaatttggatctgttcaaatccatgaagctaataaggtaaataccaactctatatgtgcatatacaaaattatacatgtatatggaaataatttagatcacaaaaccagaaaactgaccgttcttattctttatcggtgtgttttatgctttaacgtaattcttgtatcctgagatgtctcttccactctataatggcctctctcttttttcttattatcgtaattggtttaaaaagaaaaactcaaaactctaccatgttcattttttttatggaaacgggaagattatattagttatctatctagaaatattgaataattcgttagaattaagaatggaagtatgatgtgttagaaacttagaataaagaacatttttagatttagttgagaaattaatcaacttttttattcaatgatattaatcagggtgatggtgatcatcaagaacttgaatctgccaaggcagagatgagcgaggtgaaggaagagaacgagaagcttaaaggaatgctcgaacgaattgaaagtgattacaaatctctcaagctcagattcttcgacataattcaacaagaaccttcaaacaccgcaactaaaaatcaaaacatggttgatcatcccaagccaacgacgacggatttgagttcttttgaccaagaacgcgagcttgtatcgctttcactagggagaagaagttcttccccaagtgatagcgtccccaaaaaggaagagaaaacggacgcaatcagcgcagaagtcaacgctgacgaagagttgactaaggccggcttgaccttagggatcaataatggcaacggaggtgaaccgaaagagggtttatctatggagaatcgtgcaaattctggctcggaagaagcttgggcgccaggtaaagttacggggaagagaagctctccagcaccagcctccggtggcgatgctgacggtgaggccggtcaacaaaaccatgttaagagagctagagtttgtgttagagcaagatgtgacacaccaacggtacgtcctttaaattatacattaaataagttgatctataacgttaattaaaagatttgattatttatatgtgactaatgttgattcggacatgtttattaattatgttgtatagatgaatgatggttgtcaatggagaaaatatggacaaaagattgcgaaaggaaatccatgtccacgagcatattatcgctgcacggttgcacctggatgtcccgttagaaaacaggtatatttcgtattctatatagtctatttaagaatggaataaaaaatcggtttgaatttttcgtctggttttattttcatttccgtttgagttggatctgattttagttgttaaaatgtatcattcaatttaaactgaacaacataatttaagataaaaatgtatcattcagtttattttattttttgcgtttgcctttgcgtttccatggtattatagaaagtaagaaacatttgtgaccagtgtacaaataaaaagaaacgatctaactatttgtcctcgattatgtatgttttaggtccaaagatgtgcagatgacatgtctatactaatcacaacctatgaaggaacacacagccactctcttccactctcagccaccaccatggcttccaccacatcagccgctgcctccatgctcctctctggctcctcctcctcaccagccgctgaaatgatcggaaataacctctacgacaattcaagattcaacaacaacaacaaatccttctattcacccacccttcactccccattacatcccaccgtcactctagacctcactgctccacaacactcttcctcgtcttcttcttcattgctttctttaaatttcaacaaattctcgaactctttccaaagattcccatctacaagcctaaatttctcttctacttcatcaacatcatcaaacccgtctactctcaacctacccgcgatttggggtaatgggtattcttcttatactccatatccttacaacaacgtccaatttgggacgtccaacctaggaaaaacagtccaaaatagccagtccttaaccgaaaccctaacaaaagcgcttacttccgacccaagtttccactcggtgatcgctgctgccatctcaactatggtcggatcaaatggagaacaacagattgtcggtccacggcattcgattagcaataacattcaacaaaccaacacgacgaataataacaaaggatgtggaggctattttagcagcttattgatgtctaacattatggcgagtaatcaaacgggtgcttctttggatcaaccatcgtcgcaacttcctcccttctctatgttcaagaattcttcttcttcgtcttctacgactaatttcgtgaacaaggaagagaaaagctagtcattgttcttgttttttgttttttgggtgattttttattaggtgt

SEQ ID NO: 4565 - DNA, 629 bp, Artificial Sequence
  P7508 (opLexA::G2688, G2688 is from A. thaliana)
gatatcttaacaaactccaatcaattatcaaacaaaaagagaggaacaaaattcttcttcttttggaattcaggtggatcggtctgtctcgttgttataatcaagattccacaaataattaggaatatggagggatatgataatgggtcgttgtatgctccttttttgtcgttgaaatctcattcgaaaccagagctgcatcaaggcgaagaagagagctcaaaggttagatcagaaggttgttcgaaaagcgtggagtcgtcgaaaaagaaggggaagaaacaaaggtatgcgtttcaaacaaggagccaagtggatattcttgatgatggttatcgatggaggaaatatggccaaaaggccgtcaagaacaacaagttccctaggagttactataggtgtacatatggaggatgcaatgtgaagaagcaagtgcaaagattaacagtggaccaagaagtggtcgtgacaacctacgaaggagtgcattcgcatcccatcgagaaatccaccgaaaacttcgagcatattctcactcaaatgcaaatctactcttctttctagttaattctctcaaaatcttttataccttattttagagcctataattcttagagctcatgttgtaa

SEQ ID NO: 4566 - DNA, 1414 bp, Artificial Sequence
  P7509 (opLexA::G2109, G2109 is from A. thaliana)
gtattggttttgaacaggggatgggaagggttaagttgaagattaaaagacttgagagcacaagcaacaggcaagttacatacacgaagagaaaaaatgggattttgaagaaagccaaagagttatcgattttgtgtgatattgatattgtccttcttatgttttcccctaccggaagagctactgctttccatggagaacacagttgcattgaagaggttatttccaagtttgcgcaattaactccacaagaaaggacaaaaaggaaactggagagccttgaagcattgaagaaaacttttaagaaactggatcatgatgtaaatatacatgactttttaggagcaaggaatcaaactattgagggtctaagtaaccaagtagccatttaccaagctcagctaatggagtgtcataggaggttgagttgttggacgaacatcgatagaatagaaaacactgagcacctcgatttattggaagaatcattgaggaaatccattgaaagaatccagattcacaaggaacattacagaaagaaccaactcttgccaatagaatgtgcaacaacacagtttcacagcgggatacagttgcctatggcgatgggaggtaatagtagtatgcaagaagctcactccatgtcttggcttcctgataatgatcaccagcaaacaatcttacctggtgattccagttttcttccccatagagagatggatggttcgattcccgtttactcaagctgcttctttgagtctacgaaaccagaagatcagatatgcagcaacccgggacaacagtttgagcagttagaacaacaaggaaacggttgtttggggttacaacaacttggagaggaatattcatatcctacaccgtttggtactactttgggaatggaagaagatcaagagaaaaagataaaatctgaaatggaattgaacaacttgcaacaacagcaacagcaacaacaacaacaacaacaacaagatccttcaatgtatgatcccatggctaataataatggtggctgctttcagattcctcatgatcagtccatgtttgtcaatgatcatcatcatcatcatcaccaccatcatcaaaattgggttccagattcaatgtttggtcagacttcttacaaccagcaaccgaactaactcaagacatggctcatgtatgtatgatgactggacttatgtctgaccaaggactagtttgagccattgcctacaatgtctaagataaatatatatatgtagacagcgagagagtgtgtgtacatgtttttgtatgtgtgagcttgtgtcatatactcaggggagttttaggcatttgtgtataagagatgttgtctaggaaccgtatattacctttaacaagaatgataagtatatccaatatattaatg

SEQ ID NO: 4567 - DNA, 1062 bp, Artificial Sequence
  P7511 (opLexA::G1423, G1423 is from A. thaliana)
ctcaacaaaattgagaaaaatcaatcagaatggtgaaaaaaggtggcacgaagaggaagattgcgattgagacgatacagaagagagattcccttagggttacctgcaccaaacgccgtgaaggtctctatagcaaagcctctcagctttgtcttctctcagacgcacagatcgctatcttagcgactcctccttcttctgaatccaacgtatccttctactctttcggtcactcctctgttgatgccgttgtctctgcttttctctccggacaacgtcctgttccgaaggataacaaagagacgagggaggacgttggtatctgtttgactcgcaataatctagggttaggtttttggtggaacgacgagagccttgccagatcggagaatcctcaagagattagtgaagcgatcgactctatgcggacgctgttgaggaatctcaaggaattgcgtgcggatgaagctttagcctgtaatcaagctttcgttaatgatcgcgaggacctgaagaacaacgacaagtgcgattttgtttcagaccacgaaactcatgatcaaaccctaattcttcagtccgcttctccaatttgttgcatcccagaaaatctcaacgagattactcaagagccaaatcaaaccctaaatattcagtcgagtacttctgcaatttgttgcgtccctgataattcacctgaaaatttcaatgagatcactgaagaacaagatcagattcgctcgatttgtgaaactttttgtgttatggataacaacgctgctttacctgaaatgaacctggattacgatcaagacattggcttcgacacgccttttgagagcgcgctaaatgattggttttcggacaacactactcatcaggagattagtgcaagtattttgaacgctgttgttgatgatcaagtctcggtggatctaactccgttttcttattttcagagatgtttggatggagataatctacgattctctgattgtttcaaagactttgcaaacactatttcagcactttgaagataatttctctgcagttttcaaacta

SEQ ID NO: 4568 - DNA, 925 bp, Artificial Sequence
  P7513 (opLexA::G2996, G2996 is from A. thaliana)
tgagaaacctcctctccccaaaaacgacgtagtttcacatttctcgacttcttgaatggagtttgaagacaacaacaacaacaacgacgaagagcaagaagaggatatgaatcttcatgaggaagaagaagacgacgacgccgtttacgactctcctcctctctctcgtgttctccccaaagcctcgacagaaagtcatgaaaccaccggaactacttccacaggcggtggcggaggattcatggttgttcacggcggtggagggagcaggtttaggttccgtgagtgtctcaagaaccaagcggtgaacataggaggacacgcggtcgatggttgtggtgagtttatgccagctggaatcgaaggtaccatcgacgctctaaaatgcgccgcttgtggctgtcaccgtaacttccaccgcaaggaattaccttacttccatcacgcgccgccacaacatcagcctcctcctcccccgccagggttttaccgtcttccagctccggttagctaccgaccaccaccgtcacaagctcctcctcttcagctcgctcttccccctccacaaagagagagatcagaagatccaatggagacgtcttcagctgaagcaggaggagggattaggaagaggcataggactaagtttacggctgagcaaaaggaaaggatgttagctttagctgagaggattggatggagaattcagagacaagacgatgaagtgattcagagattttgtcaggagactggtgttccgagacaagttcttaaggtttggttacataacaacaaacacactcttggtaagtcgccttcaccacttcatcatcatcaggctcctcctcctccaccaccacagtcttcgtttcatcatgaacaagaccaaccatgaatcttgaatttctttgatcactagggtttt

SEQ ID NO: 4569 - DNA, 1031 bp, Artificial Sequence
  P7514 (opLexA::G2989, G2989 is from A. thaliana)
taagcttaacataaaccctaatattttcttgatttttttcaagaaaataaaaacataaagatgcttgaagttagatcaatggatatgactccaaaatcaccagaacccgaatccgaaactccgacccggatccaaccagctaaaccaatctctttcagtaacggaatcatcaaacgccaccaccaccaccaccacaacaacaacaaagtcacttacaaagaatgtctcaagaaccacgcggcggcgattggtggtcacgcgcttgacggttgcggcgaatttatgccgtctccttcgtcaacaccttccgatccaacttctctcaagtgtgcagcttgtggttgtcaccgtaacttccaccgccgtgaaactgacgattcctccgccgttccaccaccgtctcttcttccatcttcaacaacaaccgccgcaattgagtatcagcctcatcaccgtcatcatcctcctcctccgctagctcctccgttaccacgtagtcctaattcatcttctccgccgcctatctcttcctcctacatgcttttagctctctccggtaataataaaaccgcaccgttctcagatctaaacttcgccgccgcggctaaccatctctccgccacgcctggctcgaggaagcgattcaggacgaagtttagctcaaatcagaaagagaagatgcatgaattcgccgatcgaatcggttggaagattcagaaacgtgacgaagacgaagttcgtgatttttgccgtgagatcggagttgataaaggtgttctcaaagtttggatgcataataacaaaaactccttcaaattctccggcggaggagcaaccaccgtgcagagaaacgataacggtatcggcggcgagaacagtaacgatgatggagttcgcggtttagctaacgacggtgacggtggtggtgggagatttgagagtgatagtggaggagctgatggtggcggaaacgtaaacgcctcgtcgtcttcgtcgtgaagaagaaaacatcatgtcgttttgcagggaaa

SEQ ID NO: 4570 - DNA, 1132 bp, Artificial Sequence
  P7515 (opLexA::G2990, G2990 is from A. thaliana)
aaagctcttaacccaaaaaccctaagtcttttttttcttcaaattattggttatattaatgttttaagctatgatggatatgactcctacaataacaacaacaacaacaccaactcctaaatcacccgaacccgaatccgaaactccgacccggatccaaccggcgaaacccatttcctttagcaacggcatcatcaaacgccaccaccaccaccaccatcctctcctctttacttacaaagaatgtctcaaaaaccacgcggcggctttaggtggtcacgctctcgacggttgcggcgaattcatgccgtctccgtcgtcaatctcctccgatccaacttctctcaaatgtgctgcttgtggctgccaccgtaatttccaccgccgtgatccagataacaacaacgactcttcccaaatccctcctcctccttccaccgccgtagagtatcaacctcaccaccgtcatcatccaccaccaccaccacctcctccaccaccacgtagtcctaactcagcttctcctccaccaatctcttcctcttacatgctcttatctctctccggtactaataacaacaacaacaacttagcttctttctccgatcttaacttctccgccggaaacaaccaccaccaccaccaccaacatactcttcacggatctcgtaaaagattccgaacaaaattcagccagtttcagaaagagaagatgcatgaattcgccgaacgtgttggttggaagatgcaaaaacgtgacgaagacgatgttcgtgatttttgccggcagatcggagttgataaaagtgttctcaaagtttggatgcataacaacaaaaacacctttaaccgccgtgatatcgccggaaacgagatccggcaaatcgataacggcggaggaaaccacactccgattctcgccggcgagattaataaccataacaatggacaccacggtgtcggaggaggaggagagcttcaccagagtgttagtagcggcggtggtggcggaggatttgatagtgatagcggcggagctaacggtggtaacgttaacggatcatcgtcgtcgtgaagttaaagatgagagtgtcaggttaataagaagcttagagtaagcttattcgtatta

SEQ ID NO: 4571 - DNA, 817 bp, Artificial Sequence
  P7516 (opLexA::G2995, G2995 is from A. thaliana)
atgtcattgacaacatttccagaaacagagtataaacgcactagtgagtgaaataagaatcagacatgagctcgttatcaaaaccaaacagacaatttttgtcaccaacaacaaacaaccaagacaccggcagagaacaaacaatcgcctgcgcccgagatatggttgtcttgtacaacgagtgccttaaaaaccacgcggtcagtctcggaggccacgctcttgacggctgcggtgagttcacaccaaagtcaaccaccatcctcacggaccctccgtcccttaggtgcgatgcttgtggctgccatcgcaacttccaccgtcgtagtccttctgacggcttcagtcagcaccggtcaccaccgtctccgttacagctgcagccactcgcccctgttccgaacttgcttctctctcttagctccggtttctttggaccctcggatcaagaagtcaagaacaaatttacggtggaaagggatgttaggaagactgcgatgattaagaaacataagaggacgaaattcacggcggagcagaaggtgaagatgagaggtttcgcggagagagcggggtggaagattaacggctgggatgagaagtgggtgagagagttttgtagtgaagttggaatagagagaaaagttcttaaggtttggatccacaacaataagtactttaacaacgggaggagcagagacacgacgtcctctatgtctttgaatttgaagttgtagatctctttacagtgatgggtcttcatcttcttgagataaggaaaaaccgaaacaaaaagaggttacggtagtctctgatc

SEQ ID NO: 4572 - DNA, 1160 bp, Artificial Sequence
  P7517 (opLexA::G2998, G2998 is from A. thaliana)
cgtgtacttgttcatcttatctcctctgtaagtctctgattctcactgccatttagttttcttttttgccttattagtaatctcattatcatgttctttttcaggcataaacttcattgaagaaaaagtcttttttattttgttgatctcttttaattaagatccttttgggttttaatttattaatctccaagaaaaaaaatggatatgagaagccatgaaatgatagagagaagaagagaagacaatggcaacaacaatggtggtgttgttattagtaacatcattagtactaatattgatgataattgcaatggtaataacaacaacactcgtgtctcttgcaactctcaaaccctagatcaccaccaatccaagtctccctcttcgttttccatctccgccgcagctaaacccaccgtaagataccgtgagtgtctaaagaatcatgcggcgagcgtcggcggaagtgttcacgacggatgcggcgagtttatgccgagtggtgaagaaggaacaatcgaagctctcagatgcgctgcttgtgattgtcaccgtaatttccaccggaaagaaatggacggcgttggaagctcggatttgatctctcaccaccgtcatcaccactaccaccataaccaatacggtggaggaggagggagaagacctccgccgccgaatatgatgcttaacccactcatgcttcctccgccaccgaattatcagccgattcaccaccacaagtatggaatgagtcctcccggaggaggaggaatggtgacgccgatgagcgttgcttacggcggtggaggaggaggagctgagtcgtctagtgaagatctgaatctgtacggacaatcaagcggagaaggagctggtgcggcggcgggacaaatggcgttttcgatgtcgtcgtctaagaaaagattcaggacaaagttcacgacggatcagaaggagaggatgatggactttgcggagaagctagggtggaggatgaacaagcaagacgaagaagagcttaagagattctgcggcgagatcggagtgaagagacaagtcttcaaagtttggatgcataacaacaagaacaatgctaagaaaccaccaacaccaacaactactctctaatcagtgatcatatgattaattgagagatt

SEQ ID NO: 4573 - DNA, 2406 bp, Artificial Sequence
  P7527 (opLexA::G2553, G2553 is from A. thaliana)
gaggttggggaggagatagtataaaacaactgtttagagttctgatttgtggtttttgagtccggggttttgaggtttaccctttagaatgggttctacttctcaagagatactgaagagcttttgctttaacacggactgggactatgctgtgttctggcaacttaatcatcgaggatctcgaatggtacttaccttggaggatgcttactatgaccatcatgggacgaatatgcatggagcacatgacccccttgggttagctgtggcaaagatgtcttatcatgtctattctctaggggaagggattgtaggacaagttgcagtttctggagaacaccaatgggtatttcccgaaaattataacaactgtaactcagcatttgagtttcataacgtttgggaaagtcaaatttctgctggaattaagaccattcttgtagtagctgttggtccatgtggagttgttcagctaggctctttgtgtaaagttaatgaagatgtgaattttgtgaatcatatccgacatttatttctggcacttagggatccattggcagaccatgcagcaaatttaaggcaatgtaatatgaacaattcgttatgtctgccaaaaatgccttctgaaggtttacatgctgaggctttccctgattgctctggagaagttgacaaagctatggacgtggaagagtccaatattctaactcaatacaaaactagaagaagtgatagcatgccttacaatactccttcgtcatgtcttgtcatggagaaggcagcccaagttgttggtggtcgtgaagttgtgcaaggatctacttgtgggagttatagtggtgttacgtttggctttccagttgacttggttggtgccaaacatgagaatcaagtaggtactaatataatcagggatgcacctcatgtgggaatgactagtggctgcaaagattcaagggatttagatcctaatttacatctgtatatgaagaatcatgtgctcaatgatacaagcacatctgctttagcaattgaggctgaaagattgataacaagccaatcatatccacgcctggactcaacttttcaggctacctcgagaacagataaagaaagttcttaccataatgaagtgttccaactatctgagaaccaaggaaataaatacataaaagagactgagcgtatgctggggaggaactgcgagtctagtcaatttgatgctttgatctcatctgggtatacttttgctggcagcgagctactagaagcgttaggctctgctttcaagcaaacgaacactggtcaggaggagctactgaagtctgaacatggttcaacaatgagaccaacagacgatatgagtcatagccagctcacgtttgaccctggccctgagaatcttctagatgctgtggttgctaatgtgtgtcaaagagatggtaatgcgagggatgatatgatgtcgagcagatcggtacaatcattgcttactaacatggaactggcagaaccctcaggtcagaagaagcataatattgttaacccaattaatagtgctatgaatcagccaccaatggcagaggtggatacccaacaaaattcatcagatatttgtggagcgttttcttcaattggattctcatctacgtaccccagctcctctagtgatcagtttcagacatccctggacatacccaagaagaacaaaaagagggccaaacctggtgaaagttctcgacctcgcccaagagacaggcaacttattcaagatcgaatcaaggaacttagagaacttgtgcctaatggatctaagtgcagtatcgattctttgctagaacgaacgatcaaacacatgctctttttgcagaatgttactaagcatgctgaaaagctcagtaaaagtgctaatgaaaagatgcaacaaaaggaaactggtatgcaaggttcaagctgcgcagtggaggttggaggtcatcttcaagtaagctcgatcatcgtggagaatctgaacaagcaggggatggtgcttatcgagatgttatgtgaagaatgtggccattttcttgagatagcaaacgtcataaggagcttagacctcgtcatcctaagaggtttcaccgagactcagggcgagaaaacatggatatgctttgtaactgagagccaaaacagcaaagtaatgcagaggatggacattttgtggtctctggtgcaaatatttcaaccaaaggccaatgagaaggggtaacaggcgtggttgcagagtttgcgtttacgtaagataaagaataggcttgtgtgggcttgtacagtgttgttgtgacactcactgcaatactttcatttgtttgttttgattttttgtataaaagataggacttcaaagttgagtgtttagtgtgt

SEQ ID NO: 4574 - DNA, 1176 bp, Artificial Sequence
  P7531 (opLexA::G2655, G2655 is from A. thaliana)
aagtttaatttccctagagtgtctttaccttttgccttgtctccctctcgagacaaaaagagaaagagaaacactttctgtcctctttttttttcctctctttttctctctcgctggaaaccttttcatattcaagtgtaattttaatatttcaagcaattttctagctaattatggccttggaggctgtagtttacccgcaagatccgttctcctacatctcttgcaaagattttccgttttacgacttatactttcaagaagaagaagatcaagatccacaagatactaagaacaacattaagctagggcaaggacaaggacatggttttgcgagtaataattacaacggtagaaccggagattatagtgatgattataattacaacgaagaggatctccaatggccacgagaccttccttatggatctgccgtcgacaccgagagccagcctccaccgtcggatgtggcggcgggaggagggaggaggaaaaggaggaggacgaggagtagcaagaacaaagaagagatcgagaaccagaggatgactcacatcgccgttgaaagaaatcgccggaaacagatgaacgagtacctcgccgttctccggtctctcatgccaccttattatgctcaaaggggagatcaagcatcgatagtaggcggagccattaactacttaaaggagcttgagcatcatttacaatcaatggaacctccggttaagaccgccacagaagacaccggagccggccacgaccagaccaaaacaacctcggctagttcgtcgggaccattctcggatttctttgcatttcctcagtactcgaaccggcctacctctgcggcggcggctgaggggatggcggagatagaggtaacgatggtagagagccatgcgagtctgaaaatacttgcgaaaaagagaccgagacagcttcttaaactggtctcatcgatacagagcctaaggctcactcttctccatctaaacgtcacaactcgagacgactccgtcctctattccatcagcgtcaaggttgaagaagggagccaattgaatacagtagaagatattgcagcagctgtgaatcaaatcctaaggaggatcgaagaagagtcatcctttagctagtattgttgaattttagttatggcacatttagaggagctct

SEQ ID NO: 4575 - DNA, 1641 bp, Artificial Sequence
  P7536 (opLexA::G936, G936 is from A. thaliana)
ctatatctagctaagcctagaacttctctatcgtttaccactttctttctatatttcttctgaatttgtaacatcagaagtaataatgattccaagtatggagggaggcgggaagactaacagagaagaagaggaggaggaagaggaagaagaagaagaaggtgaagagagtaaggtttcaagcaatagtacagtggaagagagcgacaagaagactaaggttaggccttatgtgagatctaaagtccctcgactccggtggactcctgatcttcatcttcgctttgtccgcgccgttgagaggcttggaggtcaagaaagtacgtccatagctactaacttcatctttcatcacctcctccacatatatataaaagcataagcaatttcttagttattcttaggttaactatttggtcaaaacctcatgtgattttcttttttttaatgtgtatgtttggttatgtataggagcaactccaaagttggttcgtcagatgatgaacatcaaagggcttagtattgctcatgtcaagagccatctacaggtatttgatctacatacatctaaaacgtacctatatatgtgttgtattttcgatttcgtttcaaataatctctgaaattagaaaaaaaaagaaatcactaaattgtgtattggaaaattttagatgtacagaagcaagaagatagatgatcaaggtcaaggtattgattctttctatttgtgttcattagttagttatcaagttatacatgtataggccaataaagtggggtttgaattgttggcagctatagctggtcacaaacatctcttcgagacttccacagatcgaaatatttataaactaagtcagctaccgatgttccgaggctataatcataaccatgattctccattcaggttgatataacttttttttttgaaaattttagattttatgtgttccttaatttgaatgatattccgttttaattatatttattcggaaactaaattaattgtcttcttttgtttttggtagatatggaagtaaaatttcaaatgcttctttgtggaactctagctctcaaggaacagaaaggagtttgatagaccaaattaggcccggtttaatccgcaacgcgtcggttagcaataacatccgtggtagtgattattggactaacaacaagtctttccaaaacatctactcttcttcaatttctaatcactttccgaaactacgacacgatcatcacgaacggaccaattcagtcacattcaacagcattcaaggacactcaagaacttttcaaaagttccataacggtgttgaggagaacactaatcattcttattgtagcaagacaaatggcaaaagagacgcaagtaggagcattgatcttgatctatctcttaagctaagacaaccggagaagacaattttggaagagacagaaacagcagcaacaacaacggatcaaacgttgtccttgtcgctatgtccagggtcgtcttcgtggaaaaagagccgactgatgaaagatgaagaggatcggacggttaagattggtcaggagagtactctggatctgactctatgaattatatttaagaatgagacaaattctaagtgagatcttgaggtacttacc

SEQ ID NO: 4576 - DNA, 626 bp, Artificial Sequence
  P7537 (opLexA::G468, G468 is from A. thaliana)
agagctagagatatgggaagagggagaagttcatcgtcttcttcaatagagagtagcagcaagagcaacccattcggtgcttcgtcaagtactcgaaacctaagcacggacctgagactcggactcagcttcgggacatcctcagggactcaatatttcaacggtggctatgggtactccgttgcagctccggcggtagaggatgcggaatatgtggcggctgtggaggaggaagaagagaatgagtgtaacagtgtagggagcttttacgtgaaagtgaacatggaaggagttccaattggaagaaagatcgatctaatgtctcttaatggctaccgcgacttgatcagaacccttgatttcatgttcaacgcatccattctctgggctgaagaagaagacatgtgcaatgagaagagtcacgtgctaacgtacgcagataaggaaggtgactggatgatggttggagatgttccttgggagatgttcttgtctactgtgagaagactgaagatttcaagagctaattaccactactgatatataagtctacgtacttgttgtgtttaaatcgaagtaatgccaagaaaaaagtttttgcctgatgtaaatcaatggtcggatat

SEQ ID NO: 4577 - DNA, 575 bp, Artificial Sequence
  P7539 (opLexA::G2129, G2129 is from A. thaliana)
tttgagatcattttaaattgtcctctcttttattttccggttaagcaccatgatgtctactatttccccggttttctcaaccgaaccgggtctattaacctctgtcctcccagcttttgaaaccagtttcactccatgggacatttcacacctcttctcggtcttcgattcattaatcgatccaaaaccggtttcgacccatgactatggttcagtaaaccagatcggttcagacatgtctccgaccgacaataccgacgagcggaaaaagaaacggaaattatcgaaccgggaatcggctaagcggtcaagagagaagaaacaaaagcacttggaggagatgagtatccagctaaaccaactcaaaattcagaaccaagaattgaagaaccagcttcggtacgttttataccattgtcaacgaacgaagatggaaaatgatcgtctacttatggagcaccgtatactgcatgataagttgttgaacatcagacaagttttgatgtttcgtcaaacctaacgaagctcatcaaactgtgccacttggccttgtaataacagtactgttgttacgg

SEQ ID NO: 4578 - DNA, 1145 bp, Artificial Sequence
  P7541 (opLexA::G2213, G2213 is from A. thaliana)
gcaatccctatgaacattcatctttgtttttacagagactatatatgagttcgtcaaaacattcctctgtttttaactattctgctctgtttctatcactgtttcttcaacaaatggatcagaactctcttcatcatctcgattctccaaaaatcgaaaacgagtatgaaccagattcgttatacgacatgttagataagtaagttggaaaccctttgatactttttcttgctaaacaagttatctctcttttctttactgttttttctcattcgtttttggtctacaggttgcctccgcttgattctctcctagatatggaagatttgaaaccaaatgcagggttgcactttcagttccattacaatagctttgaagatttcttcgaaaacattgaagtggataacacaattccatctgatattcacttgttgacacaagagccctacttctcaagtgactcctcttcctcttcaccattggctatccaaaacgacggtctcatttccaacgtgaaagttgaaaaggtaacagttaagaagaagaggaaccttaagaaaaagaggcaagacaaattggagatgtctgagatcaaacaatttttcgataggccgatcatgaaagcggctaaagaactgaacgtgggactcactgtgttgaagaagcgatgcagggaattaggaatttaccggtggcctcaccggaagctcaagagtctaaactctcttataaagaatctcaaggtgcaacaacattaatttattaatagcatttgcttgtgattcacgagtagcgttttaggttttattatattacgttcttgatttcgaaaggttaatagtttgttcatgtttttggtgatagaatgttggaatggaagaggaagtgaagaacttggaggaacataggtttcttattgaacaagaacctgatgcagaactcagtgatggaaccaagaagctaaggcaagcttgtttcaaagccaattataagagaagaaaatcacttggtgatgattattattgatttcattttcttttagactgatgtttttttttaatcttgttgacccaattggtcaatctagattatctagggaatgtttctttaggttttcctcattgaacttgtttatcaattatttt

SEQ ID NO: 4579 - DNA, 1000 bp, Artificial Sequence
  P7546 (opLexA::G3080, G3080 is from A. thaliana)
gcattcacgaactaaccaacgaagaaagatggcgactagttcttcgagttatgggattgaacaacttcaaaaaggatgttactatgagtggatgagtgtgcaggctaaacacatagttgatctcaaagaagcactcatgagtcatcgatccaaagaagatcacaagcttgaagaactcgttggtaaaatcgtcaatgacttccaaaaatacaccgaaaaacgatctgagctctctcgccgaagctgctcaagctactttgcaccgtcgtggaactctcctctagagaacggtttactatggatgggaggatgtcgtccatcgtctttcattagagttatttactctctttgtggatcccaagccgaaacgcagctttctcagtatcttctaaagatcgatgaaaatgtcgaagtaaaccatggtggttccatgagtgatctaaacgcgtcgcagcttgcaaaaatcaatgatttgcatataaaggttatagagaaagaggacaagataacaaagaaatcggcgaatttgcaagagaatgttgcggatatgcctatagccatcgcggcttatgccacggacttgatgaatggtgacgtggtggtggaagatgctttagataagtatgaggagggcatggcggttttaatggtggaagctgataaactgaggtttgagacgcttaggaagatcgtggatgttgttacgccggttcaagcggcggagtttttgctcgcagggaaaagattacacatatcattgcacgagtggggaagagttagagaagagcaacgttttgggtgtgtacgtacggatgcagcggctgccacgggaggagcgggaaccgagaagtcaaagaggtcaagcttgttgatgtgagtttaaagttgaatatatataacttgtgttatatttgtctatgtagagataaaatcgtgtttaagtgtctttatgtgtaatatatgtatgagagagtgcggctagtttcgagatgatgcaagc

SEQ ID NO: 4580 - DNA, 994 bp, Artificial Sequence
  P7557 (opLexA::G2005, G2005 is from A. thaliana)
ctccctctcttctcaggcgagtatgcaaagcaagaacatgatcgtggcttcatctcatcagcagcaacaacaacagcaaccgcagcagccacaaccgcaacttaaatgccctcgttgcgattcttccaacacaaagttctgctactacaacaactacagcctctctcaaccacggcacttttgcaaggcttgcaagaggtactggacgagaggtgggactctcaggaacgttcccgtagggggtagctaccggaagaacaaacgtgtaaagcggccatcaaccgcaaccacaaccactgcctccaccgtctcgacgactaattcttcatcccctaataaccctcatcagatctctcatttctcttccatgaatcatcatcctttgttctatggtttatcagatcatatgagcagttgtaataataatcttccaatgatcccaagccgtttcagtgattcttcaaagacttgttcatcaagtggtttagagagtgagtttctctcatctggttttagcagtcttagtgctcttggattagggcttccgcatcagatgagtcatgaccacaccattaatggtagcttcatcaacaactccacaacaaacaaaccctttcttctatcgggtctattcggatcctcgatgtcttcttcttctactcttctccagcacccacataaacccatgaacaatggtggtgacatgttgggacaatcccatctccaaaccctagcatcacttcaagatttgcatgttggaggtaacaatgaagatatgaagtacaaagaaggaaagcttgatcagatctctgggaacatcaatgggttcatgtcatcatcatcatctttggatccttcaaactacaacaacatgtggaataatgcaagtgttgtcaatggagcatggcttgatccaacaaataataacgttggatcctccctcacctctttgatataaaccaaaactttggttatatgatctataactaggtag

SEQ ID NO: 4581 - DNA, 807 bp, Artificial Sequence
  P7565 (opLexA::G2930, G2930 is from A. thaliana)
ccatcggtggtaggaaagagcacaagcctcttttttgttcctcttgccgtcgtatatatatgtcttctcaaccgaatcatcagacttcaatatcaagtttactccatgatcgcttgcatatccctcctgcagaaacaatcgttgagaaagagtctgcagagaaggacacttgtcaatcacaaagaaaaaggaaagaaccagttttgcatgaggttgatggctcaagtagtggtgcagcaaagaaacaagaccataacgctaaggagcgtttaaggaggatgagacttcatgcctcttacctcactcttggcactcttcttcctgaccattcttcttcttcttcaaagaagaaatggtctgcaccatctataatcgataatgtaatcacttacattcccaagctacagaatgaagttggagagctaactctaagaaagcagaagcttgtggagttagagagacgaggtccttctattcgagcaatctcggttcttgaattgggggaatcaggttatgaggctgttgtacagatatgcttgaagaaagaaaacgaagatgagttctccaacttgcttcatgtaatggaggtgcaaggtttgagtgttttaagtgcttctacttctcaagtttgccgagagcaaagggtggtttgctacaacttccatgtcaagatggatgagaagccatgtgaaggtgatgactacatcacagtgttaaagaacaacatcatttcttcgcttcgtgacaacacaaagtgcaaatgatatatagtgaggtatagaatcaacagaatatctttgatgatgc

SEQ ID NO: 4582 - DNA, 557 bp, Artificial Sequence
  P7566 (opLexA::G3021, G3021 is from A. thaliana)
ctcccttgtagactttcatttgcagcaaaaatagtttctcatatggagaggcaaatcataaacaggaagaaacgagtgttttctcttgaaccaaacaagaaccctagtgcagttttcacgagaaaatacacaagccacttggttcctgcactcaagaagctcaacatgaacaagaactcttcaaaacaaaccgtgaagcatgaagtagatatggctttggctttgtctgctcaagaatttgcatggagccgtttcttgctgcagaagctatcgtcctcatcgaatccaaccactaccactagttcttcttccgatggaattcggattcttgaaagacccgataaagaaggcggaaacgaagaaggagggatagaggagagactgagggaattgaagaagcttttgccaggtggggaagagatgaatgtggaagaaatgttgagtgagattggtaactacattaaatgtcttgagttgcagacgattgctctcaagtccattgttcaagatagtacttgacttttagtttaagtgtataatttatagtttgtttcatg

SEQ ID NO: 4583 - DNA, 2409 bp, Artificial Sequence
  P7568 (opLexA::G3012, G3012 is from A. thaliana)
cttattgttgattgagagagtgagagtaagagagagagagagagagagagagtgagagagagagagagagagagtgagatgatgatgatgagaggtggtgagagagtgaaggagtttcttcgaccctttgtcgattccagaacttgggacttatgtgttatctggaaactcggtgatgatccttctaggttcaacacactctccggtttttctttgttatttgttcgttgttcatgtgaatcatcatcagctgtctactattttgtttcagtagcaaagcttccgtttttatgtatactgatgggtttttcgtgtttgtcttttatctttgctttctgaattaggacttttttttttgtttttgctctgttattggcttcctgaaactattttgtttcagtagcaaagtttccatttttttgattttgattagtccttagtaacttctggctctgttctatcaaatttctctggtttctgtttttttttttttttgctcatctggtttttgattttaatggtttatggtttgttttgctttaccatctacctcctgttcttggttttgtcttgtctagttttactaaaagtttgtgggttttatgatcttcatctcgtaattggtatgaattccatttaaactacaggtttattgaatgggtgggatgctgctgcagtggttgttatattgataagaatataaagcttgaaaactcagaagaaggaggaactgggagaaaaaagaaggcttctttctgtagagatgaccacaacaagcatcgtataagaaccttagcttgtgaagcgctttctcgttttcctctcttcatgcctctctatcccgggtatgtttccatctattcaaccccctttcaagttaattttttcttcaagaataatatgaagcttctttctcaattgcaggattcatggagaagtagtgatgtcaaaatctccaaagtggttggttaattcaggatctaaaatggtaaaaaagactcttttcgtcagccttttttactcgtttgatcataagaacaatctgatctccatgtgttttggcaggaaatgttcagcactcgtgttcttgttcctgtgagtgatggtctcgttgagctgttcgctttcgatatggtaaaaacatgttagcatttcgcatagaaagtctgtcattggttttggtggttacttcataaaatgttggtctgtatcagagaccgtttgatgaaagcatggtgcatttgatcatgtcgcgttgtaccaccttctttgaaccattccctgaacaaaggctgcagttcaggatcattccccgagcagaggaatctatgagtagcggtgtgaatctcagcgttgagggcggcggatcatcaagtgtttccaatccctccagtgaaactcagaatcttttcggcaattacccgaatgctagttgtgtggaaattctcagggaggaacaaacaccgtgtttgataatgaacaaggaaaaggatgttgtggtgcaaaatgccaacgattccaaagctaataagaagctgcttcctacggaaaacttcaaatcaaagaaccttcattcagagaggaaaagaagagagagaattaatcaggccatgtatggtctaagagccgtagtccctaaaatcacaaaggtttcttctgaaactcaatgcagtttctggatcactcttcttgtggtcaatgtagcactttccataggattattatatttatctttctttgtgctatatgcagttgaacaaaattggaattttcagtgatgctgttgattacatcaatgaactgctagtggagaagcagaaacttgaagatgagcttaaaggaatcaatgagatggaatgcaaagaaatcgctgcagaggaacaatctgcaatagctgatccagaagctgaaagagtttcctctaaaagcaacaagagagtgaagaaaaacgaggtattattcgaatatatagaccttcaagataatctatatctgagttgtaaaatcccacaaactctggtttcttttcaggtgaaaattgaagtccacgagactggtgagcgagatttcttgattcgggttgtgcaggaacataaacaagatggattcaagaggttgatagaagctgtagatttatgtgaacttgagatcattgacgtcaatttcaccagactcgatctcacagtcatgaccgttctcaatgtcaaggtagtaacgtaatcacatctcattgcccctgcacgtaatctcagattcttgaattctgataaacagttttggatttattcattcttaggcgaacaaagacgggattgcatgtggaatattgagagatttactgctcaagatgatgataacttcaatatgaaaactcagtaaaacagagtacataacctcaaaaggtcaaat

SEQ ID NO: 4584 - DNA, 628 bp, Artificial Sequence
  P7571 (opLexA::G3023, G3023 is from A. thaliana)
catggtctatgtgaaacaattcaggaataaaaaaagaaatggagccgagccattcaaacacaggtcaatcaagatctgtagatcgcaaaacggttgagaaaaatagaaggatgcaaatgaagtctctctactcagaactcatctctcttcttcctcatcattcttctacggagcctttaacactacctgatcagctagatgaagctgcaaactacatcaagaagctacaagtgaacgtggagaaaaagagagaaaggaaaaggaacctcgttgcgactacaactttggagaaactgaattccgtcggatcttcatcggtttcgtcgagcgtcgatgtctccgtgccaagaaagctgccaaaaatcgagattcaagaaactggttccatttttcacatctttcttgtgacaagcttggaacacaagtttatgttttgtgagatcattcgtgttctcaccgaggaattaggagctgagatcactcatgctggatactccattgttgatgatgctgtcttccacacccttcactgcaaggtggaagaacacgattatggagctaggagtcaaattcctgaaagactggagaagattgtgaacagtgttcactaatattgattccttgttcc

SEQ ID NO: 4585 - DNA, 924 bp, Artificial Sequence
  P7573 (opLexA::G2848, G2848 is from A. thaliana)
ggatgtcgaaaaaccgatcatttttgttttgtttgatgacaaggaatggaatactctagagactcggcagagatgatgatggagactaagcgcaatgtctactcgcttgaagataacaaaattaaacgacacaagtcatctgatctctctttctcttccaaggtcttgtgatacatcaaaatcaaaattcattgtggctatgaagctaccggacatttctgtaccagcatgctaatgatcttgaaactttgttgttctgtggtttaaacaggagaggaaagacaaattagcagaacgtatttcagctcttcaacaactagtttccccttacggaaaggtactacttggtccgaaataatctttcttacacgctctttgtcttctctagccatgttcaagtctctatctatgcagaccgacactgcatcagttcttctagagggaatgcaatacattcagtttcttcaagaacaagtcaaggtctgctcaagttttctaatcaaatacttttcattcattcacctcctccaatccaatgatgattatgcttgattttctctgttcaggttctaagtgctccttatctgcaagcaaccccttctactacagaggtgagctgaatctatgatctggatctcgtttacttggatcacaatgcaagactgatattttccatctctgtaactaggaggaagtggaagagtacagcttaagaagtaaagggctatgtcttgttccattggagtatacatcagaagttgctcaaaccaatggtgctgatatttgggctcctgtgaagactccaacatcttctcatgcttttaatctctcgtcttctaattcgccctttcaatgagctgctgctaaattctctgtctcaagactaatgaaaattagccaaagctttggtctgatcatgtattg

SEQ ID NO: 4586 - DNA, 2424 bp, Artificial Sequence
  P7576 (opLexA::G2554, G2554 is from A. thaliana)
gggctcttcccggcttggattcctaaatatgggttcagagtataagcatatattgaagagtctctgtttaagccatggatggtcttatgctgtgttttggcgttatgatcccatcaattccatgtaatttctctcttttttctttcgaatgttatatgcatgttcctgtcttggataatatttgcataaaactagttttgttttccgttgatttaggcaaaagactgaattgcatatcctctggttttatatgtggcttccctactttggtgtccataaatgtaatttagttttgttgaattccatcaggatattgagatttgaagaagcatacaatgatgaacaatcagtcgcactagttgatgatatggttctccaggctcctatcttaggccaagggtatgcttttacacttcactcaaatcttttatatatctgtctctgtgtttgtgtttatatatcttcaatatacttttcttttgatgaaattagaattgtgggagaagtagcttcatccggaaaccatcaatggctgttctcagacacattgtttcaggtttgttcacttctttttcttggtgtttgatttttctcatctgtgagctataatgtatgtcgaaatatagtgactgcatagaacatttcatgatgaagaagaaaaaagatttgatattcgtgcgtttgattgttttgcagtgggaacatgagtttcagaatcagtttctctgtggctttaaggtaatttatattttgtcttctctccaagtttaaggattcatatatccattttgaatcagattcttatacggcagtttacttatacacagactatcgcaatcattccactaggatccagcggcgttgttcagctaggatctactcaaaaggtttgcatatataattatataacaatgttttcttgttgtggaagtcatggtctaattacttactatcaatctttagattcttgagagcacagagatattggaacaaacaacaagagctctccaggagacgtgtttaaagccacatgattccggtgatctcgatactctgtttgagtcactgggagattgtgagattttcccagctgaatcttttcaaggatttagctttgatgacatcttcgctgaggacaatcctccttctttgctcagccctgagatgatctcctctgaagcagcttcttccaaccaagatctgaccaatggagatgattatgggttcgacattctccagtcttactctctggacgatctataccagctgctcgctgatccaccagaacagaactgctcttccatggtgatccaaggagttgacaaggatcttttcgacattttggggatgaattctcaaacgcctacaatggctttgccacctaaaggactcttctcagagctcataagcagcagtcttagcaacaacacttgtagtagttctctcacgaacgtgcaagagtactctggtgtgaaccagagcaaaagacggaagcttgatacatcatcggcgcatagctcaagcttgttccctcaggaggagacagtaacaagtcggagtttgtggattgatgatgatgagagatcaagtattggagggaactggaagaagcctcacgaagaaggtgtgaagaagaaaagagcaaaggcaggagaaagcaggaggccgaggcctaaggaccgtcagatgatacaagaccgtatcaaggagttgcgagggatgattccaaatggagctaaggtaaattgaataataatatagtttagtttagggcatccaaattatagattaacaaatgcattctctaataagtttcgatatatatttaaacagtgtagcatagatacgttgctggatctgaccataaaacacatggtgttcatgcaaagcctcgccaagtatgcagagagactcaaacaaccatacgagtctaaggtaatgaatcaaatatatccattcagtaagtacacaagtgtttgagtattgatgagtgaatgatgtttatcagctggtgaaggagaaagagagaacatgggcgttggaagtgggggaagaaggagtggtatgtccgataatggtggaggaattgaacagggaaggagaaatgcagatagagatggtgtgtgaggaaagagaggagttcttggagataggacaagtggtgagaggattgggattgaagatattgaaaggagtgatggaaacaagaaaaggacaaatatgggcacacttcatcgtacaggcaaagccacaagtcacaaggattcaagtcttgtactcacttgttcagctctttcaacaccacaccaaacatgatgatttattatcatagtataatacctaccactttgattttctttctttttgttacaacaacaacacaagaatctgttgataaatagtagtaacattacatcaaagaag

SEQ ID NO: 4587 - DNA, 2008 bp, Artificial Sequence
  P7582 (opLexA::G2018, G2018 is from A. thaliana)
gcaagctaggaatattttcaggagtgggattttcaatgggaaggccggatgtgcacttggatcgacgagtagcagaaaaccatcaggcaataccaagaaacaatgtcagatccacaccatctctcgatttgtccactctcttcgacgaaaccagtgaaactaagccgatggatccaaagacgatggctgcagtaagagcaggtaaggaaaattacctgagaagtaataacagttacattagtgttgctccaaccttagtgaacgaccgtggaaatacaatacttcatcttgctgcttcatcgggtcacgtaagccttgtgcgttatataatccagaaatgcccaggtttgctactgaagtcaaatatgatgggagaagttgctctccatttggcagcagaagcaggccatctagatgttgtatggaatctaattgatttcataaatgatatatcttgtactaaccttcctgttgcaaaaaggatatattttgctaagaacaaaaaccaagacactgctttgcatgttgctttgaaagggaaacatgaggtggtcgcttcctatttggtctctgcagcgaaatctttgtcttttgttgcaaacagagatgggttttctcccttgtatcttgctattgaagctggacatacaagtcttgtgacaacaatgtgtcacggaacaaatgaattaagttcaaaggttggaggaagatccattgtacatgcagcattgaaggctaataggaaagatatccttgatgctttacttagcaaagatgcaagtcttatcaacttgagagatgaaggaaggacttctctttcttttggagcatccataggatattatcaagggttttcctatcttttcgacaaaaatcgagacaaggtttatgtcagcgatgatgatggcttatttccaactcatatggcggccaagtatggtcatgttcaaattcttgaggaaattcttaagcattgtccagaggcaattgagttgcttgatagagacggtcaaaatattcttcaccttgcggcaaagtatgggaaactcaaagtcatcaagtttatcctaagctgttgtaaggataagaacaagaaaaagttgattaatgaacaagatgtgaatggaaacacaccgttgcatctagccaccataaactggcaccctaaagttgtgagtatgtttacttgggaccatagagttgacctgaaaaaaagaaactacattggtttcacagctttagatgttgctgaggagaacattgattcgagctacatagttcaccagagattgacttggatggctttgatcaatgctggtgcaccaaaaagttctactccaattacagaaaatcttagatcattcaagaagccagatggtggaaagtacaaagatcgagtcaatactcttatgttggttgcaactctagtagccactatgactttcactgcaggattcacattacctggtgggtacaacgactcttttccccacttgggaatggccgttttggccaagagaacggcttttcaagtctttcttgtatgcgacacattggcaatgtactcttctatcataacaatagttgctctcatttgggcacaactcggtgatctttctatcatactcaaagccttcaacatagcacttccatttctcggacttgctcttacatcaatgtcaatagcatttatggctggcacgtatgttgcggtaagccatctccccttgcttggttatttcgttttgggtattggaatcatcttcctattggttttgttgctgctccttgttccttatgtgtctccatatgctcatgcccaaccccttcttcgacacattttctactatccctatttccttaagcttttggctgctggtgacaacaaaaatattgttgatgtgtacactgcatcagatgaatgaagttatagctttctgtttttctaataaaattgtaaccatgtatattttattctggatgttaacgtgttaatcgataaataccc

SEQ ID NO: 4588 - DNA, 444 bp, Artificial Sequence
  P7588 (opLexA::G2896, G2896 is from A. thaliana)
cctaaacgtgttcacacagagatctcgagatgaaagataaccaaacggaagttgaatcgaggagcactgatgatagattgaaagttagagggaacaaagttggaaagaaaacaaaggatccaaacaggcctaagaaaccaccaagtcctttcttcgtcttcctggacgatttccgaaaggagtttaatctggctaaccctgacaacaaatccgtcggtaatgttggtagagcagctggaaagaaatggaaaaccatgactgaagaagaaagagcaccttttgtagcaaaatcacagagcaaaaagactgagtatgctgtgactatgcaacagtataacatggaactggctaatggaaacaagacaactggagatgatgagaaacaagagaaagctgctgatgattaggaagttggatcagtgatttgtgtatcaactatatctg

SEQ ID NO: 4589 - DNA, 780 bp, Artificial Sequence
  P7594 (opLexA::G2803, G2803 is from A. thaliana)
ggcagcttggagcttattcattggacgacgaactctttttcttcatctctttctgttttctttttctcttcttttgttctgagaataatgggcccaacatacagagctttgccagtaggtatgaggtttcgtccttcagatttggagttggctgtttactttttgatcaagaaagctttaggacttcccatgaaagctcttactgtgcccgacgaatgtaatgatatcttctcaacacatcctcgcgacttgcctggctatggaagcgaagagcattggtacttctactgcaagaaacccaagaatcaagttactagaacgaaatcttataacctctggataccaacgggagaaaaaactgatgtgttagatccaaagaagaatggcggcgaattagtcggtatcaagcattcgtttactttcattgagaacgaagaagaagaagaatctgataacaagaacggcgatgaagaagaacctccacaatgcaattggttcttggatgaaatcagcctcccattgacagttgtggatactgattggactctgtgtcatatcttttacgagaaggttaaacctgaatttggtaatttgcatatagtcgaatctgaatccgaatccgaagaagaagaagaagatgaaagtgttgataagcctgcagagagtttggatagtgttaaagagaaagatggaactgttcttcctccacctcctgctacaccttagcttcttcatgatatagtgttttactgttagtgttggtggattgtagattctctc

SEQ ID NO: 4590 - DNA, 1068 bp, Artificial Sequence
  P7597 (opLexA::G2972, G2972 is from A. thaliana)
ctatgagctttgtttcaattttcaggtttttgtcggcgaaatgtctcagagacttcatggttgcaaaacatgcgggagaaagtttggaactttaaaaggtgtgtatggtcaccagaggatgcattctggtaatcacaatagaatcgaagatgagaatggtttggaaaggatttggggtcttaagaagaagtctagggtttgctctgtttcagcttttgatcgattcaaaggatcttcttttatggctgagattgagaaacatgaggtgattgaagctgcattgaacttggttatgttgtgtcaaggagtttatgactttgcttctatcagtaatttgcctctaggtgatggtttcatggatttagagcttaaaccttgtcctttgagaaggaaactacagaaaaaatctcgctccagttataaatgcagtatatgtgagaagagttttgtgtgttctcaagctcttggtagtcaccagagacttcacagatggaaactagtgcctaaacctgagtacattgaagatgatagttcactgttagactcatcagaagctaagaagattgtttcaaaaccatcaagctttgaacatgctcaggaggagaagatcttacaatgtgttgagccgaaactagagttccacgaacagcttgctcactcgggtttcgacaagtttgatacttgcagtaaaatcaggttcagtgcattaccttctcctccagaagctaagaagattgtttcacaaccaccaagctttgaagtctctgtggatgaaaagatcttatatcgtgctgagccaaaactaaacttcagcgaaccgcttgctcactcgtgtttcgacaattctagtagctatagaagcataatatgtggcaagagttttgtgtgttcacaagcattaggtggtcaccaaacacttcacagatcgattaaaggccaattagcgggtactgaagatggtaattcactctctgtgactgactcagaagctagcaagattgttgcacaaccatcaagctacaagtctcaggggatataaaaatgtcagtgctttgatgtttccaagtc

SEQ ID NO: 4591 - DNA, 1144 bp, Artificial Sequence
  P7599 (opLexA::G2906, G2906 is from A. thaliana)
ctccgtcgattttaaagatcccggcgatgttttcaagatttgtcctaaaaagttggagacctaaaacccaaaccacatctctcaattcaatcaaaggttttagctttagctctagctcgataaaccctaaacccaaaatccgagtaggggtttggtgggatctagacaacaaaccaccagcctctttcccgccttacgacgccgccgtcaagctccgaaccgccgcgtcgtctttcggaaccgtgaagctaatgatggcgtatgcgaatcgtcacgcctttagctacgttcctttagaagttcgagaacagaggaaagataggaaattgctaaacaaattagagaacaaaggtttagttaaaccaccggagccttacttctgcggtgtttgtgaccggagattctacactaacgagaagctaattaatcatttcaagcagattcatgagacagagaatcagaaacgtatgagacagattgaatcttcgaaaggacatcgaagagtgagacttgtggctaagtattcgatgaagattgagaagtataaaagagcggcgaggaatgttttgactccgaaggaaggttacggtttagctgatgagctgaaacgagctggtttttgggtgaagatggttagtgataagccagatgctgctgataaggcgttgaaggaacatttggttgaagtgatggataagagagaagtggagtgtgttgttttagtgtctgatgattctgattttgcggggattttgtgggaagctaaggagaggtgtttgaggacggttgtgattggagattcgaacgaaggtgcgctgaagcgagtagcggatgttgcgtattcgtggaaggaagtgacgatggggaaggcgaagaaggaagttgagaaagttgtggggaagtggaaggatagagatgtgttgaagaagttggagtggacttatgatcctgctttggagaaagagagaggtggttcttgcggtgtttgggattacgagtttgattatgatgatgagattgagaatggaacagaggtggaacctgtggagattggtgatggtgttgactggtggaagatcgatactgaagatggtgttggatcttcaagaacttgtcgataacatcatcgcatatgtcgtggttg

SEQ ID NO: 4592 - DNA, 549 bp, Artificial Sequence
  P7700 (opLexA::G2604, G2604 is from A. thaliana)
gagattgagagaagagatttatccaaaaaaatattgcaattcttcttggagtgaataatgccagtccctcttgcaccatatccaacacctccggcaccggcactggctccgtcgtacaacactcctccggcaaatggaagtacaagtgggcagagccagttagtgtgttcaggttgcagaaaccttctgatgtatcccgtcggagcaacctccgtctgttgcgccgtctgtaacgccgtcacggccgttcctccgcccggaacggagatggcacagttggtatgtggaggatgtcatacactcttaatgtacattcgtggagctacaagtgttcaatgttcttgttgtcacactgttaatctcgccctcgaagcaaaccaagtagcgcatgtgaattgcggaaactgcatgatgctactaatgtatcaatatggagcaagatcagtgaaatgtgccgtttgtaactttgtcacatctgttgggggttcaacgagcacgactgattcgaagtttaacaattaaaacttggatctatctacctatcaatac

SEQ ID NO: 4593 - DNA, 1174 bp, Artificial Sequence
  P7702 (opLexA::G3066, G3066 is from A. thaliana)
catctcgtcttccaacaagcttcgttttaatggaagaacaacaagaatttgagaaacccatcttcgaattccgtcctaagaagctcagaacctctcgagtttcgagaaatctcatgaagaagactggcttcagagaatctatgaatcattacgaagagctctcttgcaactacggattgagggaaaacccgaagaaaacccagaaatctttactcgatcatcgattctgtacgaggaggaggagaaataaaaagatcctgattcgatgcaaagaatgcgggaaagggtttctttacgagaaatgtctgtttaatcatctccaagtgacgcattctgaagaatctacaagaagaagcctgttttgtaggtttagtattgtgcagaggagaaaaagatcgaagagagtttccaggtacaagaagattcttcctcgattctctgtttcttcttcttcgtgtactatgtttcctgtttctgtggatgatggaggattattagaagtcgctgagtctctgattctcttgtccatgagtggtggaaagttcgtgaatggtttggaacattttggtaaagctctgggttcgactcagagaaaatttgaagacgggttattgagaaatgagcagagacttgttggtgaagctctggattcgaatccagaggtgaatttgagaaaagatggagactttgaatatgggcttttgagtaatgagcagaagaaacttgtggggataagcagagcatctgttggaacatcgaaagagctttcgggttacttggcaaacaagaagggcagagaagatgatgaattgggtcagcagaaacaggctggagcaagaatacttagagaagaaactgataacgaacagaaacttgttcgtcaagaaactgcatttgaagattcagtatcaggatttgagatgaatatagagcatcggtgtgggctctgtcacaaggttttctcgacttatcaaactcttggtggtcatcagacgttccatagaatgagaaacaaatccaaaagtcaaaccaagagatgcagagaagaatcgatagaagctgaagctgggattaataatggttcagtgacgttgacaataagtgcagagtttgctgaaggctgtttaggtcagtacatgctttaagaggttacaagaagtgtcaccacacgaga

SEQ ID NO: 4594 - DNA, 380 bp, Artificial Sequence
  P7709 (opLexA::G2965, G2965 is from A. thaliana)
ctcatttctcgtagccgccgcagcaatcaacgatgacaggcaaagcaaagccaaagaagcacacagcgaaggagctccaagctaaagccgatgcagcgttgaccaatcgcggtggaggaaaggcagggctcgccgatagaaccggtaaggagaaaggtggtcacgcaaagtacgagtgtcctcactgcaagatcactgtaccggatctaaagacgatgcagatccatcatgaatcgaagcatccaaagctgacttatgaagagccgaggaatcttcatgaggctttagctgctcctgctgaatcatctaagcctaagcctggaatcagaggaagccttaagaagtgaagtgaagatggtttgggattgtatcgaatttcg

SEQ ID NO: 4595 - DNA, 869 bp, Artificial Sequence
  P7720 (opLexA::G1549, G1549 is from A. thaliana)
cttgaaagtgattgttgtaagcagagatagacaaaagaggtaaaaaaaaagaagaagagaagatggaatattggagcagctccttcatcgatggcgcgtcttcttccagcttcatctctcctttctataactttgaccatttttcaggtaacatgcatccatagtactaggttttagtagagctagtttatatgcttaatgcttaatcattcactcaactgtatgtcgctttacaagtctctctctgtcttgtattgaatttgtaggaaaccaagacaacagatgtttaggtacaatgatgggtgcacaacaagatatacttcatgttcctctagcaatggtagagagtggctatggagaagaaagcaacagttttaatggacaggagaagaaaaaaaagaagatgacgagcgagcagctaaagttcctcgagagaagtttccaagaagagataaagctgaatccggacaggaagatgaagctgaatccggacaggaagatgaagctgtccaaagaactggggctgcagccgagacagattgcggtttggttccagaacaggaaagccaggtggaagaacaaacaacttgagcatctctatgaatcactaagacaagagtttgatattgtctctagagaaaaggaattgctacaagaagaggtaattactccagtgatcaatactaacttaataaataagctttcgagttacaatccattgagttactttcactttgtttcaacagctaatacaactgaaatcaatgataagagaggatagttcatgcaagaagaaacaaacctgggaaaaagcctgcagctgaggcaatagtatataagttccacttcagttatatctccaaaatggc

SEQ ID NO: 4596 - DNA, 587 bp, Artificial Sequence
  P7723 (opLexA::G2315, G2315 is from A. thaliana)
ctgcagtgtatataaactctcaatggatagttatcaaaagagtatgtagcaaatagaaaagagacgagacaattcaatggacgtaacgttacctcatcatgtggtagaagatattcttgaacgacttcctgtaaaaacactccgtaaattcaaatgcgtttgtagcacatggagatccactatagactcacaacgtttcaaggatagacatatgattcatggacaactactcgaagatcccgatatcctccttctcgggcgttgggatcctcccagtctatccaaaaacgcttctctaatgacattgacgtttgactcatcgaccatgccgttttctttcaagattcaaactatacccggaaaagccaacttttacaaagtcactcaaagtcactcaaagtcactcaaagttgtgacggtctatgattcgaacatggaggctactggtttagtgctatatgatatgactcaatcagaaagaacatttgctaacttttgtttatcattcaaaaacagagagacacccactgcttatttcccaagcttaatcactatttaactttgacatagttaattgatagtctttg

SEQ ID NO: 4597 - DNA, 789 bp, Artificial Sequence
  P7727 (opLexA::G2826, G2826 is from A. thaliana)
ctaaagacatacatatttaatggaggagctggattttagttcaaaaacaacaacttctcgtctaaagctatttggatttagtgttgatggagaagaagatttctccgatcaatcagtcaaaactaacctatcttctgtatcaccggaacgtggcgagtttccggcaggatcttccggaagaagtggcggtggtgtacgaagccgaggcggaggaggaggaggaggagaacgtaagtatgagtgtcagtattgttgtagagagtttggtaactcacaagccttaggtggtcaccaaaacgctcacaagaaagagcgtcaacagcttaaacgtgctcagcttcaagctacacgaaacgcagccgcaaatttctcaaacgctggatcagcgtctcagtttttaaggaatcctatagtctctgcttttgctcctccgcctcatcttttatcatcatccgccgtgcctcagcctatgggaggtccttggatgtatcttccacgtgtttctccatctcaacttcacgtgtctcatggctgcgtcatccaagatggttcgggtggtgcgggtgctggtgggttctcgtacgagtatggggctcgtgattcagggtttggagtagttggggctcagatgagacatgttcaggcccatgggccgagaccatcggttaatgggttttcaagagaagtaggaactacttttgatgatggtttagggttggatttgcatctcagtcttgcacctgctggtcattgacgtgttttttaaagctcttgtatatttatcaacat

SEQ ID NO: 4598 - DNA, 393 bp, Artificial Sequence
  P7734 (opLexA::G2721, G2721 is from A. thaliana)
gcaactttcaacactcagtactctctcttttcaatctctttcctttccatctcaagttataagaaattaatggcgtcaaactcaagaagttcaatctcaccatggacgtttagtcaaaacaagatgttcgagagggccttggcagtttacgacaaggacacacccgaccgatggcacaatgtggcaaaagctgtcggagggaaaactgtagaagaagtgaagcgccactatgacattctcgtcgaggatctcatcaacatcgagactggtcgtgtccctttgcccaattacaagaccttcgaatctaactcaagaagcatcaatgactttgacacaaggaaaatgaagaatttgaagatctaacatcagcgtgaagaagtcctgtaaagattc

SEQ ID NO: 4599 - DNA, 1318 bp, Artificial Sequence
  P7737 (opLexA::G1247, G1247 is from A. thaliana)
cttacatatgaagctcattcatgatgggtaaaattttccatgattcaggatcaagcgaatgatttattagcaatgaagaaaacttttactaagtctaaatggaaaccagaggaagatagaattttgaaagattatgttattcaatatggtgatagaacttggactcatgttccaaaacgcacgggccttcctcataatcctgcaagttgtcgttttcgttggatgaatcatcttaagccaagcttgaaaaaagggccctttaccgatgaggaagagaagcgtgttctccaacttcatgctgttttggggaacaaatggtcacaaatggctagagaagtatgtaactctctttcctttttttttcactctctacattttcatcttcttttactgtttgatttaaacttttgtttctttaagttccctggtcgaacagataacgagataaagaatttttggaacgcaagacgtatgcgattgaaaggaaagggtttaccagtttaccctgatgaagttcgagagcaggcgatacgtacagcagcacaatatggtgtaaaagttgaattattgaatgctcattatagtcaagactcattgatggcaggcaatgtcgagaaacctcaagaactcaataacttggcactcaatcaatgttctccgtattaccagtcaacgcttgccaatgttcagcctagccgcaatcgcgttatggaaccagaaacaacatttcctttcacgggtggatctgccatgaacgagcaaaaccctactctcttgtgtaatccttacgtggagagcactcaagaacagttacctgacagccatttgtttggaaatgttacatattcttctcctcctatgcctctcattcacgaggttgagaacttggagctcccttcattccaaggctttgattttcatgaagagcctagcagttttggagcagaacaatataacccaatgctgaatcttgagccacacaacactttggtccagtctcctctgataggccagacaccaacagatttcccatcatcattctatgatgaattgttggatgaattgttggaatcagttgttaacggttcattaggagaaataccgaaaaccgataccagttcggagtcccaactgtttcagtcctctctacgtagccataccgatgctacaccagacattgcaaacacaactggtaaaccttttttagtctctacgcattacattacaatcacttcattttttgtgtgttcaattcaagaggtttccactaatctttatgcatgacaaaacttcaattttgaaacagatttaggttatg

SEQ ID NO: 4600 - DNA, 1461 bp, Artificial Sequence
  P7738 (opLexA::G3075, G3075 is from A. thaliana)
ggcgaaagggtgaaacatactgtagttctaaaaaattaatggtgtcgtcaaagaaacccaaggagaagaaggcgaggagcgatgtcgtcgtcaataaagcgagtggtcggagtaaacgcagctccggttccagaacgaagaagacgtcgaacaaggttaacattgtgaagaagaagccggagatttacgagatctcagaatcatcgagcagtgactctgtggaagaagcaataagaggcgatgaggcgaagaaaagtaacggcgtcgtgagcaagaggggtaacggaaagagtgtaggaattccgacgaagacgagtaaaaatcgagaagaggacgatggaggcgcggaagatgctaagatcaagtttccgatgaatcggattcggcggatcatgagaagcgataattctgctcctcagattatgcaggatgctgtatttcttgtcaacaaagccacggtatagtactaattagacatataaatttagcttgaggaacttaatttcacatggtttttgatgaatttgggagtatcaattgctagtcagtgttaattgggcgttataatctcgcaaattgctacagtaatgagattgtttctgttaattaagccgggaattaacgttattgcttcatctccatgtgtgtttgatgaaaccgtagttactgtgcttgattgtcataggtttagcttttacatccagaacttgtagacacctaacacatgagaaagtccttatatatgatttaggttcatattttcaaagcttaagtgatgagtgtttaattttcctgtattggaacttggcattgttttttctttcttttgatttcatcttgtgttcatcgaaattgatgttcattgcgtttacagtacattaactggtttttgtgattgaaggagatgttcattgagcggttttctgaagaagcttatgatagttccgtcaaggacaaaaagaaattcatccactacaaacacctctgtaagctctaatctcgtccctatttgccaatatctggttacctcaatactgaatcccatgtcgaaaatctcatgctgctgcaccaattgctgaacttaggatttctggcttctgcacaagggccagtagttagtcttaggaagagtttagataatgagttaatccgttcgtatcacttgcaagatttgttgcactcctaacataattgatgacactgtcatttctactcgttggcagcatccgtagtgagtaacgaccagagatacgagttccttgcaggtacttaataacctctgaagtattcgttttatgagttccatgtggtttacgaacagcattttaatacctgtaatatcttgaatgcagatagtgttcccgagaaacttaaagcagaggccgcgttggaggaatgggaaagaggcatgacagatgcaggctgaaataaatccggttggaatcgaactgaaccatttgg

SEQ ID NO: 4601 - DNA, 1173 bp, Artificial Sequence
  P7741 (opLexA::G2840, G2840 is from A. thaliana)
ctcaagctagattcttcatatacatgcatatacatatgatgaatcgagatgagcatattgcaaagaaagttgaaggatcaatctctagcttctccggggagaccagtacttcctcaaaacaaatctatgttaatcccgtgaccacgaccgggacgaaatcaatggaagacgacgacgtttcactctctcttctatacaatctatctaccttacatgaaaaagtccatcagatccaatctctggtcagcttctacatggtatctactaataacattaaccaatcctcggggtcaacgtctttggccgtggctaacatcggaagtttggttcaagagatcatcacggctgcttcatccatgttatatacttgccaacaactccaaatcggatctaacaacaacaacaacgatatcgataatgatcaaaccgtagatgcaatggttttggagttttcccgacaagaaaccgacccgggtcatgattttgtgcaagagtcgaccaacctttttggtgtccaagaaagagggcagatctcgtttcccgaccagaatcttgattggtacaacaccgaaaccataaaccctaaaaaagataaacatcgttctaaaccaagttccgggagctacgatatactggagctagacgtagcggacctactagcgaaatacacgcattactgccagatttgtgggaaagggtttaagagagacgctaatctaaggatgcacatgagagcgcacggggatgagtacaagacacgtgaggccttgatcagcccaacgagccaagacaagaaaggaggatactcgttaaagaaacattactactcctgtcctcaacacgggtgtagatggaaccagaggcacgagaagtttcaaccgttgaaatctgtgatttgcgccaagaatcattacaagaggagtcattgtcccaaaatgtatatgtgcaggagatgtagtgtgaagcatttctcggttctgtctgatcttaggacacacgagaagcattgtggggatataaagtgggtttgctcttgtgggactaaattttctaggaaagacaagctgatgagccacgtttctttgtttttgggccacgtaccggcacatgggtcgtccaagccgccgacaatcaccctaaagtaagaacataggaagtttgaggtctatagag

SEQ ID NO: 4602 - DNA, 1332 bp, Artificial Sequence
  P7745 (opLexA::G3055, G3055 is from A. thaliana)
tctcgaattcacgaaatctctcagcttttccgtgattcttggtaaaaattcacaaaatcgaaattggagaaagaaagaaaaaattagggtttgaggaaaagcttcgatttttcacacgatgagtcatcaccggcgagattccggcggagatgtagttcacgtgattcccacaaacaatcctccgccggataattggtttccgaatctcggcgatagtgctgtttgggcgacggaagatgattacaatagagcttgggctatgaatcccgataacacctccggcgacaacaatggtccaccgaacaagaagactcgaggctctccgtcgtcttcatcagccacgactacttctgctgcgagcaatcgtactaaagcgattgggaaaatgttcttcaagacgaagctttgttgcaagtttcgtgctgggacttgtccgtatataacgaattgtaactttgctcatacggtggaggagcttcgtcgtccaccgccgaattggcaggagattgtggcggctcatgaggaggagagatctggtggtatgggaactcctacagtttctgtggttgagattccacgggaggagtttcagatcccgtctttggtgtcatcgacggctgagagtgggagatcttttaaaggaagacattgtaagaagttttatactgaagaaggatgtccttatggagaaagttgtacgtttctgcatgatgaggcttcgaggaatagagagagtgttgctattagcttaggacctggtggttatggaagtggtggtggtggtggaagtggcggtggttctgttggtggtggtggtagtagtagcaatgtagtagtgcttggtggtggtggtggaagtggaagtggaagtgggattcagattttgaagccttcaaattggaagacaaggatttgcaacaaatgggagattactgggtattgtccatttggtgctaagtgtcattttgctcatggagctgcagagttacatagatttggcggaggactcgtggaagaagaaggcaaagatggagtatcacccaatccggacacaaagcaaacagtacaaaaccccaaaggactatcagacacaacaacacttctatctccaggagtacctcataatgcagatgccagttaccacactggagttgcattgcaacgagcgtctagtgcggttacacaaaagcctggaattagaactcatcagaagtggaaaggaccggcgaaaatcagtcggatatacggtgattggatcgacgatattgaatgatgttacctctttcttttttctacacatttagataactgctaagaaaattacaatctccc

SEQ ID NO: 4603 - DNA, 1927 bp, Artificial Sequence
  P7748 (opLexA::G756, G756 is from A. thaliana)
gcttcaaattctgcttcagaagactcttagaaaatggaaaaagttacaaacaaagaataatatttattttctgtcagtttttctgatcatcaattacttttcttgaatctacaggatagtattatgtgcagtggaccaaagagcaatctctgctcttcaagaaccttaacagaaatcgaatcaaggcaaaaggaagaagaaacaatgcttctcctcgaattcgctgcttgtgatgatcttgactcgttcaagagagaggttgaagagaaagggcttgatttggatgagtcagggttatggtattgcagacgtgtcggttctaagaagatgggtcttgaagaaagaacacctttaatggttgcagctatgtatggaagcataaaggttttgactttcatcgtttccactggaaaatctgatgtgaacagagcttgtggtgaagagagagttactccgcttcactgtgctgttgctggctgttctgtgaatatgattgaagtcatcaatgtcttgcttgatgcttctgctttggttaactctgttgatgctaatgggaatcaacctttggatgtgtttgttcgagtttcgaggtttgtggctagtccgaggaggaaagcggttgagttgttgctgagaggaggaggtgttggaggattgatcgatgaggcggttgaagaagagatcaagattgtctctaagtatccagctgatgcttctttaccggatataaacgaaggggtttatggaagtgatgagtttaggatgtatagctttaaggttaagccatgttctagggcttattctcatgattggaccgagtgtgcttttgttcatccgggagaaaatgcgaggaggagagatccgaggaagtatccttacacttgtgtcccctgtcccgagttccgtaaaggatcatgcccgaaaggagattcttgcgagtatgctcacggggttttcgagtcgtggcttcaccccgcgcagtataaaacccggctttgtaaagatgaaacgggttgtgcaaggaaagtttgtttctttgctcataaacgcgaagagatgagacctgttaatgcttcaactggctctgccgtggctcagtctccgtttagcagcttggagatgatgccagggttgtctcctcttgcttattcttcaggagtttcgactcctccggtttctccaatggctaatggtgttccttcctctccaagaaacggcggatcatggcagaacagagtcaatacccttactccaccggctttgcagctcaatggtggaagcagattgaagtccacactgagcgctagagatatcgatatggagatggagatggaattgagactccgcggttttggcaacaatgtggaagagacgttcgggtcttatgtttcctctccaagtaggaattctcaaatgggtcaaaacatgaaccaacattatccatcttccccggtgagacaaccgccatctcaacacgggttcgaatcttcagcagctgcagcggttgcagtgatgaaagcgagatcaaccgcctttgcgaaacgtagcttgagcttcaaaccagctactcaagcagcaccacagtcgaatctctcggattggggatctccaaacgggaagctggaatggggaatgaaaggagaagagctgaataagatgagaagaagtgtttcctttggaatccatggaaacaacaacaataacgcagctagagactacagggacgagccagatgtgtcatgggttaactctttagttaaagacagtactgtggtgtctgagagaagctttggaatgaatgagagggttcggataatgtcgtgggctgagcaaatgtacagagagaaggagcagactgtggtgtaaacacacacaaagatggtttcttatatatattgcttttgggccatctctgcaaatttgattc

SEQ ID NO: 4604 - DNA, 1125 bp, Artificial Sequence
  P7753 (opLexA::G2606, G2606 is from A. thaliana)
aatcacatacaaatatatataaatacttagacatataaaccaaacccaccaaacactctttgatacttctctccatatatacatatacgacctcttgtgttcttgaaatacagagagcaaataaaaaacggaggatcatgacaagtgttcttgaggagagtggagaccacgcgcgtcttgttctcctcatcaagggcaaacgcaccaaacgtcagcgttctgcgtctcctcttatgatgaacgctgctgcagtatccagcgtttgtagcggtgaacgatcatcagtggaggtaagagaagaagaagctgctggtgaagtagaattccaaggagctaccgatgaagacgaagatatggcgaattgtctgatcttgttgtcgcaaggacatcaagcaaagagcagcgacgatcatttgtcgatgcagagaatgggtttctttagcaacaagaaaccggtggcttctctagggttagggctagacggtgtttaccagtgcaaaacgtgtgataaaagcttccattcgttccaagcgctaggagggcacagggctagtcacaagaagccaaaacttggagctagcgttttcaaatgcgtcgagaagaaaacggcgtctgcgtctacggttgaaacagtggaagctggagccgtaggaagctttctttccctacaagtgactagtagtgatggtagcaagaaaccggagaaaacacatgaatgttcaatctgcaaggccgagttttcttcaggacaagccttaggaggacatatgaggagacatagaggtttaacaataaacgcaaacgctacttcagcaatcaaaacagcgatatcatcatcaagtcatcatcaccatgaagaatctatacggccaaagaactttctccagttagatctgaatcttccagcacccgaagatgaacgatgctgcgagaaaccgaaattcgcgtttgcatccaaagatcagattcttctcttcacggccgcgtcaaattctttgattgattgtcatcactaattaagtagttctttgtaattacttttttattacattgatatgttaaatcattaacccttctcttattattgtccattcattcttgtaatctgacattgattgaattaaa

SEQ ID NO: 4605 - DNA, 1234 bp, Artificial Sequence
  P7756 (opLexA::G2061, G2061 is from A. thaliana)
cggattcccgcgctaatcttcattcatatgctcaacaacatttaaaattttaaaagagagaaataaaaatcgaagagtgatcatgacaagaaagaaagtaaaacttgtatggatcgagaatgacaagtcaagagcaacaagtttgcaaaaaatgagggtaggattacttaaaaaggtgaaagagctaaccatattgtgtgctgtaagggctattgtaatcattttcagccccgataaggttggaccattggtgtggccatctcctcaggcgactcatggtctcctagacgaatttttcgctttaccgaagtccgtgcagaagaagaaagagtcaaatgtcgaatcctacctaaaagagaagacacataagtttcaagaacaattgaagaagagtaaaaagaagaacaaggagcatgtcattgatgagctgatgatgcaactccaaagcggtcgtgaaattgctgatcttaaccaaagtgagatgtatgccttgttatctttctcaagagatactatcctactttgtaggaagaaactagctttcatgcaatttcctcctcttcgcgatccaccagtgtttccatttgaaatacaagtcgaagagttcaaaaccaccacaaatgatggttttgtaggaggcggtcaagataataaaagagctggaaggacagatgaagcaacaagattcatcaacaccgatatatttaagcagagtaaaagttattacttttttgatgaatgggtttttccacctagtccacctaaatatgaaataccgcaacaaatggagaacggaaatccaaaccctaaaagctatcgtctttatcaaggaagcagtagcaacggaaaccctcatttggaaatggatccatttcgtctccaaatgatgacttcccaaggtttggctgggtcagtctcccaacctttacaacatcacagcatgatcaataatccaacaatggctatgaatcaaccaagccaagatccttttgattacatgagaagtgagctgggaataaacgaaggaatcaacattaacaactcacaattttacatgagcaacaacactataacggctaatgatggtgttcgccaagaaccatatcctaatgtaacaaccgctggagaaaacaatggtgatgcgacgacgtctaataccaacatggtgtggccgggttttaacaatcatcatttctaaactcttgatttggtttgtgttctaagtttgtatgcg

SEQ ID NO: 4606 - DNA, 1411 bp, Artificial Sequence
  P7759 (opLexA::G2699, G2699 is from A. thaliana)
catggacatgtcattgtctccaccctactatactctttttttgttctttttgtttcctcttgtgtcacaaaaataacaagattaaacgtacatttctctctaaaaccagactcaaatgaccaaaacccggattctcaacccgacccgattcccttctcccaaacccttacgtggctgcggcgacgctaacttcatggaacagctcctccttcactgcgccaccgccatagactccaacgacgctgcattaactcaccaaatcctctgggtcctcaacaacatcgctccaccagacggtgactccacccaacgtcttacatccgcattcctccgcgcgttgctctcacgcgccgtctccaaaacccctacactatcatccaccattagcttcctacctcaggccgatgaactccatcgtttctcagtcgtggagttagccgctttcgtagacctcactccgtggcaccggttcggattcattgcagccaacgccgcgatcttaaccgccgttgaaggttactcaacggttcacatcgttgacttaagtttgactcattgtatgcaaatccctactcttatagacgccatggcaagccgactcaacaaacctcctccgcttcttaaactcaccgtcgtctcttcctccgaccacttcccaccattcatcaacatctcctacgaagaactcggatctaaactagtcaacttcgccaccacacgaaacattacaatggagttcacaatcgtaccttctacttactccgatggcttctcctccctcttacaacagttacggatttatccttcttcattcaacgaagctctcgtcgttaactgtcacatgatgctccgttacatccctgaagaacccctaacttcatcatcatcatcgctccgaacagttttcttgaaacaactccgatctttgaatccaagaatcgtaaccctaatcgaagaagacgtagatctcacatcggagaacttggttaaccggttaaaatcggcgtttaactacttctggattccgttcgatacgacggacacgtttatgagtgagcagagacggtggtacgaggcggagataagttggaagatagaaaacgtggtggcgaaggaaggtgcggagagagtggagaggacggagacgaagagacggtggatagagagaatgagagaggctgagttcggtggagttagggttaaagaagatgcggtggcggatgtgaaggcgatgctggaggagcacgctgtcgggtggggaatgaagaaggaagacgacgacgagagtctcgtgctgacgtggaaaggtcatagtgttgtgtttgctaccgtttgggttcccatttaaatcaggttgatttaatttaattagcgttttaattggatacctaatatagtagaatagcattgc

SEQ ID NO: 4607 - DNA, 1537 bp, Artificial Sequence
  P7762 (opLexA::G1969, G1969 is from A. thaliana)
ctcactctcctgtgtttgattcttgtgggtttaacgtatttgatgctgaaacaggttcaatcagatgaaagttttcatcttggtggcaaaatccataaccttcatgtatgtggttaccagaggattgattctggtgtttactcggtttgctaaggatttgggggtctttgttcggtttcagtgtcactaaaagaaacttcttttatgactgagactattgtggagcatgagatggaagaagaagctgcaatgagcttggttttgttttcagaaaaagtatggctttgaattgtctcctcatgatgatgattccatggatttagatggtgttgagttgttactagacttgagggaaatggtttctcaatcgggtttcgaaaagtctactacttgcagtggtgttattgctctgagaagtaatctgcagagtaaatcaagtcacaaatgcaaaatatgtggcaagagttttgagtgttatcaagctctaggtggtcaccaaagaattcacagaccgattaaagagaaactagtgcgtaaaagggagtatactaaatttgataattcattgtttgagtccttagatgctatttcaaaaccatcaaaatttgaagtctcccaagaggagaagatgttagattgtgtttgagtcgaaacaagagttcagtgaagtatatcctcggaagagtaagttgcagaaaagacctgagagtagtagctcctgctatgaatgcaaagtatgtggcaagatttttgggtgttatcgaggtctaggtggccacacgaaacttcacagatcgactaagagggaattagcgagtactcaagatgagaattcactgttagactcatcagaagctaagaagattgtttcacaaccatcaagctttaaagtctctcaggaggagaagttcttacattgtgtggagttaaaacaagacttcagtgaaccgctttctcattcgggtgcattaccatctactctgagaagtaaattgcagacaaaaactcagtggaaatcaagctgtcattgcaaaatatgtggcaagagttttgtgtgttctcaaggtttaggtaatcacaaaagagttcacagagagattagcgggaaattagcgtgtaaaaggaagtacactgaagactataatccattctctgactcattaaaagctaagaagattgttaaaaaaccatcaagctttgaagtctctcaggaggagaagatcttacattgtgttgagttaaaacaagacttcggtgaactgcttgctcactcgggtttcgacaagtctattagttgcagcaaatcgatcaaagtgaaaaaagtagcgcgtaaaaatgagaaaactgaagatagtacttcactgtttggcgtgattgactcagaagctagcaagtttgcttcactaccatcaagcattgaaatctatcatgagaagaccttccattgtgttgagtcaaaacaagacttcagtgaactgttttctcgctagtctactagttgaatctttttctcttctaagtacagaagttgcagatg

SEQ ID NO: 4608 - DNA, 758 bp, Artificial Sequence
  P7765 (opLexA::G2836, G2836 is from A. thaliana)
ctagttcccatgtttcaaaagtttcttcatcttcattgagaaccaacatggtttctcctttcagtatgcctttcatagctcaaactagtggttttgttaactattctcaagtttttatcactcaaaccatcgcaaaaaggtatcatgctcttattccgacaagcaatatggtcattgtccaaaatgataatgatcgtgtcaaccgtttcatgacttcttatccaccaattttgaaatctacagttaaccccccaaatgattttgataaacagtatgaaaccttcacacctaaacccatcgatttcttttgttcgcaacaagactatgcatgtcgtcagcatttggatatattttcatcctccccaaaacactatcatgagcaatatgttcataaaaatggtcggtcggtgaaatatatctgtaaaccaacagaggtccttgaagaaattcatgacgaaatcgattatgaaaaagacggtggttggatatatagcctgccgtttgagaaagacagttcatttatatgtctaaagtgcaatagtttgtttgatacttcacaaatgttggttgtacatacagagttaattcattctaagaatgagactaagaaaaggcttaaattacatcatcaagaattccatggtaaatctcataagatcaacaaagatcaaactggaggacaaagttgcagaagaaagttgaggcaatagagacgatcaagtgattatgaaactcccagcatcatgtatttggtgaag

SEQ ID NO: 4609 - DNA, 1867 bp, Artificial Sequence
  P7769 (opLexA::G1136, G1136 is from A. thaliana)
ctacacgtcacctctctcttcttctcaccggaaaaaagtcttcacctttcaccggaaaatatcaccttttcaaccggcgtatgttcacatgaacggcacaacatcatcaatcaacttcttgacctccgacgatgacgcgtcggcggcggctatggaagctttcattggaacaaaccaccactcatctctctttcctccaccaccacaacaaccacctcagcctcagttcaacgaagatactcttcaacaacgtctccaagctttaatagaatccgccggagaaaactggacttacgctatcttctggcagatctcacacgacttcgattcatccaccggagataacacagtgatcctcggctggggagatggttactacaaaggagaggaagataaagagaagaagaagaacaacaccaacacggcggagcaagagcatcggaaaagagtaatacgtgagcttaactcgttaatctccggcggaattggggtttccgatgaatcaaacgatgaagaagtaacagatactgaatggttcttcttagtttcgatgactcaaagcttcgttaacggtgttggtctccccggagaatctttcttaaactctcgtgtgatttggttatccgggtctggtgctttaaccgggtcgggttgtgaaagagcgggtcaaggtcagatttacgggttaaagacgatggtgtgtatcgcgactcaaaacggcgtcgttgagcttggttcgtcggaggttataagtcaaagctcagatctgatgcataaagttaacaacttgtttaatttcaacaacggtggtggaaacaatggtgttgaagcttcttcgtggggttttaatctgaatccagatcaaggagagaatgatccagctttgtggattagtgaaccgacgaacaccggaatcgaatctccggcgagggttaataatggtaataactcgaattctaattctaagtctgattctcatcaaatttctaagcttgagaagaatgatattagctctgtagagaatcagaatcgtcaaagttcgtgtcttgtcgagaaagatttgacctttcaaggtgggttgttgaaatctaatgagactttgagtttctgtggtaatgagagtagtaagaagagaacttcggtatctaaagggagtaataatgatgaagggatgctttcgtttagtactgtggttagatcagctgcgaatgattcggatcattctgatcttgaagcatctgttgttaaggaagcgattgttgttgagccaccggagaagaagccgaggaaacgggggaggaaaccggcgaatgggagagaagagccgttgaatcatgttgaagcagagaggcagagaagagagaagttaaaccagagattctactctttgagagctgttgttcctaacgtttcgaagatggataaagcttcgcttctcggagacgcgatttcgtatatcaatgagcttaagtcgaagctgcagcaagcggagtctgataaagaggagattcagaagaagctagatgggatgagtaaggaagggaataatgggaaaggttgcgggtcaagggcaaaagaacggaaaagttcgaatcaagattctacggcgagttctatagaaatggagattgatgttaagatcataggttgggatgtgatgatacgtgtacaatgcggcaagaaagatcatcccggtgctaggttcatggaagcacttaaggaattggatttggaagtgaatcatgcgagtttatccgttgtgaatgatttgatgattcaacaagctacggtgaagatggggagccaatttttcaatcatgaccagctcaaagttgctttgatgacgaaagtcggagaaaactattga

SEQ ID NO: 4610 - DNA, 1621 bp, Artificial Sequence
  P7770 (opLexA::G1361, G1361 is from A. thaliana)
ctccctcatacctttgtttattctgatgaagttgtgagcactgaaagaaaagaagagaggagaagagagatatgcacaagaagaattaaacttagggacacaaaacaacatgacttggtgcaatgaccgtagcgatgttcagaccgttgaaagaatcattccctccccgggggcggctgagtcccccgtagcctcacttccggtctcttgtcacaaaacttgcccttcttgtggccataacttcaagtttcacgaacaggttcttgtttctctttctacctatatcaagtttaaactttagatgatattggatatttgaatataatatattaatatgtaatgtaggctgggatccatgacttgccgggacttcctgctggagtaaaatttgatccgacggatcaagaggtcttggagcatcttgaaggcaaggtaagagatgacgcaaaaaagcttcatcctctcattgatgagtttatccgtaccatcgatggtgaaaacggcatttgttatacccatcctgaaaaattgccaggtgattctatgttgcatgttcaatcatcaattaatcggttacaaattgagactatagttacaaattttccgtcttcaaatgatcttctagttatgcttattgaaaactacataaatacgttgaaaaaacaatttaatcatattttaatacgatggaaattgtcatatagaaaaagaaaatgtagctaatccaatttcttaattaaattaagtttgatgaatgctaattagtcgttgaatacatatataggagtgaacaaggacgggacggtgcgtcatttcttccaccgaccgtcgaaggcatacacgacgggaacaagaaagcgacgtaaagtccacactgattctgacgtcggtggagagacacggtggcacaagacaggaaaaacacggccagttcttgctggaggaagagtgagaggctacaagaaaatcctagtgctctacacaaactacggcaaacaaaaaaaacccgagaagactaattgggtaatgcatcaatatcatcttggcactagcgaggaagagaaagaaggtgagctcgtcgtctccaaagtcttttaccagactcaaccacgtcaatgcggtggctccgttgctgctgcagccaccgctaaggaccgaccttacctccacggcctcggtggaggtggtggccgccaccttcattaccatcttcatcataacaacggtaacggtaagagcaacggcagtgggggaaccgccggagccggtgagtattatcacaatattccggctattatctcgttcaatcagaccgggatacagaaccacttggttcatgactctcaaccttttatcccttaaaaacaaaatgattttatatcaacgatcctaaaataaaacaaacggtatataatctaagcattatctttgatatacacatacatatatacgttgaaaataatttaaaatttacagtgcattcttgtattcgtaacttgttttttgtttctcttaattcttttttccttttgattttacggctttgtacaatttaaattccttggactgagactgaccatgaaaaatatgtacaaagatctccattggctattgttacatg

SEQ ID NO: 4611 - DNA, 859 bp, Artificial Sequence
  P7771 (opLexA::G140, G140 is from A. thaliana)
atggagggtggtgcgagtaatgaagtagcagagagcagcaagaagatagggagagggaagatagagataaagaggatagagaacactacgaatcgtcaagtcactttctgcaaacgacgcaatggtttactcaagaaagcttatgagctctctgtcttgtgtgacgctgaggttgctcttgtcatcttctccactcgaggccgtctctacgagtacgccaacaacagtgtgagaggaacaatagaaaggtacaagaaagcttgctccgacgccgttaaccctccgaccatcaccgaagctaatactcagtactatcagcaagaggcgtctaaactccggagacagattcgggacattcagaatttgaacagacacattcttggtgaatctcttggttccttgaactttaaggaactcaagaaccttgaaagtaggcttgagaaaggaatcagtcgtgtccgatccaagaagcacgagatgttagttgcagagattgaatacatgcaaaaaagggaaatcgagctgcaaaacgataacatgtatctccgctccaagattactgaaagaacaggtctacagcaacaagaatcgagtgtgatacatcaagggacagtttacgagtcgggtgttacttcttctcaccagtcggggcagtataaccggaattatattgcggttaaccttcttgaaccgaatcagaattcctccaaccaagaccaaccacctctgcaacttgtttgattcagtctaacataagcttctttcctcagcctgagatcgatcttatgcatatatatattcatgttacacttactgtcaaaaaacttaaaatgcagatggtaacgatttgagagggacc

SEQ ID NO: 4612 - DNA, 775 bp, Artificial Sequence; identical to SEQ ID NO: 1025
  P7773 (opLexA::G351, G351 is from A. thaliana)

SEQ ID NO: 4613 - DNA, 1501 bp, Artificial Sequence
  P7783 (opLexA::G2462, G2462 is from A. thaliana)
gcttaccggagatccgagtttccgtgacaattttcgccgtttcttttttttttttgggggattttttatcgagattcgttcttatgtctgaagaagtacctcaacaattcccatcttctaagcggcagcttcatccttctctttcttctatgaagcctcctctagttgctcctggtgagtatcaccggtttgatgcggcggagactcgcggtggtggagctgttgctgatcaggttgtctctgacgcgattgtgatcaaatctactctgaagcgtaagacagatttggtaaaccaaatagttgaggtcaatgaattgaataccggtgttcttcaaacacctgtatcagggaaaggggggaaagccaagaaaacttctaggtctgcgaagtctaataagtctggaacgctagcttctggctctaatgcaggttctcctggaaataactttgcacaggccggtacttgtcgatatgatagttcgttaggtcttttgacaaagaaatttatcaatttgataaaacaagcagaggatggtattcttgatctaaacaaagcagctgatactttagaggtacaaaagagaaggatatatgatataaccaatgtgttagaaggaataggtttgatagagaagacgcttaagaacaggattcagtggaaagggtctcgatgtctcaaaaccaggagaaacaatcgaaagcatagctaacctacaggatgaagtacaaaacctcgcagctgaggaggcaagattagatgaccaaatcagagaatcacaagaaagattaacaagcttgagtgaggatgaaaacaacaaaagaacctaccatgcttccagaataagacgctgatagctgtaaaggcaccgcatggaacaactcttgaggttccagatcctgatgaggctggtggttatcagaggaggtacagaatcattctgagaagcacaatgggaccaatagacgtgtacctagtcagtcaattcgaagagagctttgaggacattcctcaggctgatgaaccttcaaatgttcctgatgaaccctctaatgtccctgatgtaccttcaaatcttccatcaacatctggtctccctgagaaccatgatgtatctatgccgatgaaagaggaaagcaccgaaagaaacatggaaacacaggaagttgatgatacgcaaagagtttactctgacatcgaatctcatgactttgtcgatggtatcatgaagattgttcctccagatttggatatgggtgtagattactggtttcgatcagaggtaggcgaagtcagcatcacagacatgtggccagatgaatctggaccagactggaaccagatgattacatttgatcaagaccacgctggaccgagcgacaacaaaatcttggagcagccacaaactccatcgagcccaacaccagaagaatccactgctacgagatcacctacaggtagctgaagttaccataccacattacaagcaccacaatatatctg

SEQ ID NO: 4614 - DNA, 774 bp, Artificial Sequence
  P7784 (opLexA::G2849, G2849 is from A. thaliana)
ttgctctaggatggtaaccttgtaccctatgtaacatgtcttgttagtataaattttgggtcatgttgtgttgatgactctttagcgcatttcttattgacaaaaggtatggaattctctagagacgctggaatgatgatggagaataagcggaatgtctgctctctcggagaaagcagtatcaaacgccacaagtctgatctctctttcagttccaaggagaggaaggacaaggttggagaacgtatttcagctcttcagcaaatagtttccccttatggaaagaccgacactgcatcagttcttctagacgcgatgcattacatagagtttcttcacgaacaagtgaaggtgctaagtgctccgtatctgcaaacggtacctgatgctacgcaggaggagctggagcagtacagcctgagaaacagaggattatgtcttgttccaatggagaatacagttggagttgctcaaagcaacggcgctgatatatgggcgcccgtgaagactcctctatcaccagctttcagtgtcacatctcaatcaccctttagatgaccaattcgactaatcacctactacgatctttgtgttaagcctaaaaaagaatgaccaattgttatttttctgatgatgcctctgtaacatatatagacagagagcacatgatgttggtttagaacagctcatggttggcaatgattgttattattattcgactgcttaatgcatccccttactttggacttgtgtaatatgcccaaacaggaacca

SEQ ID NO: 4615 - DNA, 1335 bp, Artificial Sequence
  P7786 (opLexA::G1033, G1033 is from A. thaliana)
gattcaattcgttggttgtatagttgctacgatgaaaacagcaaaggggaaagataaagttaagaccacaaaggaagccttgaagccagttgatgacaggttaatcccattatcacttggtaacttaaacattaataacgagaaattatggctattgagaaaagtatatcttcttgctaaatcagcttttaaagtagctttgcaaatctgacttagctgaaacagttagtaatcatcatgcttgaagccgttgtttactttgtagcttaggttggacagactggtttaacattgttgcttgtgatttggtctcatatttagttcctgtttaattttcagaaaggtgggaaagaggaaggcaccggctgagaagcctactaaacgagagactcgtaaagagaagaaggctaaaaaggacccaaacaaaccaaaaagagctcctagtgccttctttgtctttctgtaagtatttgtgtatgattttcactctaggagattctcacttgtattgttgaacttcatataaattcttactgttttttttgtttctttgtttcagagaagattttagggtcacgttcaagaaagaaaatccaaatgtgaaggccgtctctgctgtaagcatttggcagattccttgatagtttacatgtacggtagtctttactaggtgaagtcctcatggtctcaccttctcttttccttgtcaaggttgggaaagctggagggcagaaatggaagtcaatgtctcaagctgtaagtatctttgaaacttccctgtctgatactgtgaggaaaatagtgtgagattgacatgagtttcacttcttcctttgtaaaggaaaaagctccatatgaagagaaagctgcaaaaaggaaagctgaatatgagaagcaaatggatgcatacaacaaaaacttggtaagccctaagccttactctcatatatacaaactcgtacatagctaactctgatttccttgcaatggggaacaggaggaagggagtgatgaatctgaaaagtctagatctgagataaatgatgaagatgaagccagtggggaggtaacaattccactaagcaatgtagagtttctctatataatgtcttttattcatgacccattttcttctgtacctggtgcttgctttctgaagatgtatgtttggcttaatatttctctgcaggaagaactattagagaaggaagcggcaggtgatgatgaagaagaagaagaggaagaagatgacgatgatgatgacgacgaggaagaagactaaatcagggatagaaatcagattttgtatctcaagcttaactgcagatccttaag

SEQ ID NO: 4616 - DNA, 1043 bp, Artificial Sequence
  P7787 (opLexA::G2993, G2993 is from A. thaliana)
ccttgtggttattctcaagaaaggtttcattttgagataaagtttgctgctctttctggttgtggatagatcaaaagaatggagattgcaagtcaagaagatcctattccaataaacactagttatggtaatagtggaggtgggcatgggaacatgaaccatcatcatcatgccaattctgcaccatcatctctcaacattactacttcaaacccactactagtctcctcaaatagtaatggtcttggtaaaaatcatgatcattctcatcatcatcatgtgggttacaacatcatggttaccaacatcaagaaagagaagcctgtggtgataaagtacaaggaatgcctaaagaaccatgcagctaccatgggaggcaatgctattgatggttgtggagagtttatgccaagtggtgaagaaggttccattgaagctctcacttgctcagtttgcaactgccatagaaactttcatagaagagaaaccgaaggtgaagagaaaacattcttttccccttacctcaaccaccaccaaccacctccgcagcagagaaaactcatgttccaccacaagatgatcaaatcaccattaccacaacaaatgataatgcctattggcgttacaaccgctggatccaactcagagtcagaggatcttatggaggaagaaggcggaggaagcttgacattccggcagccaccaccaccaccatcaccgtatagttacggacataatcagaaggaaaggtttaggacaaagtttacacaagagcaaaaggagaagatgattagttttgcggaaagagttggttggaagattcagagacaagaggaatctgttgttcaacagctttgtcaagagattggaattaggagaagagttcttaaagtttggatgcacaacaacaaacaaaatctctccaagaagagcaacaacgttagtaacaatgtcgacctttctgctggtaataacgacattactgaaaatcttgcttctactaatccttagttaagttcagattgttgttatataacttcact

SEQ ID NO: 4617 - DNA, 2066 bp, Artificial Sequence
  P7788 (opLexA::G1559, G1559 is from A. thaliana)
ctcacgcgccttttatattaatctttgacatcttctgctatctctccttcttccttggagaaaacatgtttgtttccgataacaacaatccttcacgggacataaacatgatgatcggcgatgttacatcaaacggagatctacagccacaccagatcatcctcggagaaagcagtggaggagaggatcatgagatcatcaaagcaccaaagaaacgagcagagacatgggcacaagacgagactcgaaccttaatctcattacggagagaaatggacaatcttttcaacacttccaaatctaacaaacatctctgggaacagatttctaagaaaatgagagagaaagggtttgatcgatcaccatctatgtgtacggacaagtggaggaacatattgaaagagtttaagaaagctaagcaacatgaagataaagcaacaagtggaggatcaacgaagatgtcttattacaatgagattgaagatattttcagagaaagaaagaagaaagtggcattctataagagtcctgctactactacaccatcttctgctaaagttgattcctttatgcaatttacagataaaggtacaatctttagcttggttttggggattctgattgatttgttgcaggtttggataaaatttcttaatgggttttggtttagatttggattgagaagataaagactgatcttttttggttttagttttgttcctcttttagtgctaaacctggttaaagaggcttttgaccattaatggctaattataaagttgtagatttggtttgttaaactagattgactttttatagtaaatttgggttttcttctaaaattgatctttatctttatcttcttgtaggttttgaagatactggtatttcatttacatctgttgaaggtattgatctcacatttattgaatctttgagtgtatatataaatggtggtgttgaaatcttttttagttggggaattactttgagagaaatggttgtatcagtcctaactttgggtaaacaattgtgcaacaacttatgattctcttataattcagtgaaataaaagtgaactcataccaaattgtagaatgttagtgataatgtgaagccgattttgtttggtttgtggaagtagtgttagtcactttagtcttgatatgagttgtatctgtatgcagctaatggcaggccaacgctaaatcttgaaacggagcttgatcatgatggtcttcctctccccattgctgctgatcccatcacagcaaatggagttcctccttggaattggagagacacccctggaaatggtaagtaaccagacaatctaacttagagagagcctctccttgtttattaagcttttgaacttttatggcaactactactaatcgttgtcatgtttgaagcaggcgttgatggtcagccatttgctgggaggatcataacggtgaaatttggagattacacaagacgagttgggattgatggtactgctgaagcaattaaggaagctatcagatccgcgtttagattgagaacaagacgagctttttggctagaagatgaagaacaggttattcgctctcttgaccgagacatgcctttagggaactatatactccgcattgatgaaggtaaatccactctttcttctatgctattcatcgaatactctctggttagaggtttctcaatatccatttgaattcagggatagccgttagagtgtgccactatgatgaatctgatccgttaccagtccatcaagaggagaagatattctacaccgaagaagattaccgagatttcttggctcgacgaggatggacatgtctgagagagtttgacgcgtttcaaaacatagacaatatggacgagcttcaatccggtcgcttatacagaggaatgagatgagaaaacggttactacagaaggctagaagaaaccttttatttttcatcagtcactataaatagctttttttgatccaaaatactttattttcatcagtcactgtacatatgcacctcttttgacatgccattgtgaatcagagg

SEQ ID NO: 4618 - DNA, 1179 bp, Artificial Sequence
  P7789 (opLexA::G1812, G1812 is from A. thaliana)
gcgagagtcagacagagagagagatttcgaatatcgaatgtcgaagataaccttagggaacgagtcaatagttgggtctttgactccatcgaataagaaatcgtacaaagtgacgaataggattcaggaagggaagaaacctttgtatgctgttgttttcaacttccttgatgctcgtttcttcgatgtcttcgttaccgctggtggaaatcggattactctgtacaattgtctcggagatggtgccatatcagcattgcaatcctatgctgatgaagataaggaagagtcgttttacacggtaagttgggcgtgtggcgttaatgggaacccatatgttgcggctggaggagtaaaaggtataatccgagtcattgacgtcaacagtgaaacgattcataagagtcttgtgggtcatggagattcagtgaacgaaatcaggacacaacctttaaaacctcaacttgtgattactgctagcaaggatgaatctgttcgtttgtggaatgttgaaactgggatatgtattttgatatttgctggagctggaggtcatcgctatgaagttctaagtgtggattttcatccgtctgatatttaccgctttgctagttgtggtatggacaccactattaaaatatggtcaatgaaagagttttggacgtacgtcgagaagtcattcacatggactgatgatccatcaaaattccccacaaaatttgtccaattccctgtatttacagcttccattcatacaaattatgtagattgtaaccgttggtttggtgattttatcctctcaaagagtgtggacaacgagatcctgttgtgggaaccacaactgaaagagaattctcctggcgagggagcttcagatgttctattaagatacccggttccaatgtgtgatatttggtttatcaagttttcttgtgacctccatttaagttctgttgcgataggtaatcaggaaggaaaggtttatgtctgggatttgaaaagttgccctcctgttttgattacaaagttatcacacaatcaatcaaagtctgtaatcaggcaaacagccatgtctgtcgatggaagcacgattcttgcttgctgcgaggacgggactatatggcgctgggacgtgattaccaagtagcggtctgagtcttgtaggaattgatgaattag

SEQ ID NO: 4619 - DNA, 1303 bp, Artificial Sequence
  P7794 (opLexA::G4, G4 is from A. thaliana)
aaagaatcgaatatttattatttcgccccgaagattctatttctgatcatttacacccctaaaaagagtagagctttcgtgaagccaccatgtgtggaggagctataatctccgatttcatacctccgccgaggtccctccgcgtcactaacgagtttatctggccggatctgaaaaacaaagtgaaagcttcaaagaagagatcgaataagcgatccgatttcttcgatcttgacgatgatttcgaagctgatttccaagggtttaaggatgactcggcttttgactgcgaagacgatgatgatgtcttcgtcaatgttaagcctttcgtcttcaccgcaactactaagcccgtagcttccgctttcgtctccactgtaggttcagcatatgccaagaaaactgtagagtccgctgagcaagctgagaaatcttctaagaggaagaggaagaatcaataccgagggattaggcagcgtccttggggaaaatgggctgcggagatccgtgatccgagaaaaggctcccgagaatggcttggaacattcgacactgctgaggaagcagcaagagcttatgatgctgcagcacgcagaatccgtggcacgaaagctaaggtgaattttcccgaggagaagaaccctagcgtcgtatcccagaaacgtcctagtgctaagactaataatcttcagaaatcagtggctaaaccaaacaaaagcgtaactttggttcagcagccaacacatctgagtcagcagtactgcaacaactcctttgacaactcttttggtgatatgagtttcatggaagagaagcctcagatgtacaacaatcagtttgggttaacaaactcgttcgatgctggaggtaacaatggataccagtatttcagttccgatcagggcagtaactccttcgactgttctgagttcgggtggagtgatcacggccctaaaacacccgagatctcttcaatgcttgtcaataacaacgaagcatcatttgttgaagaaaccaatgcagccaagaagctcaaaccaaactctgatgagtcagacgatctgatggcataccttgacaacgccttgtgggacaccccactagaagtggaagccatgcttggcgcagatgctggtgctgtgactcaggaagaggaaaacccagtggagctatggagcttagatgagatcaatttcatgctggaaggagacttttgaagtgatcgatggttccttagtttgtaaataaagctgtgttggattttgctgttgggggatggtacaagtcacacctcaagctctat

SEQ ID NO: 4620 - DNA, 949 bp, Artificial Sequence
  P7826 (opLexA::G28, G28 is from A. thaliana)
gaaatctcaacaagaaccaaaccaaacaacaaaaaaacattcttaataattatctttctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattttgatttttctttgttggatgattatatgattcttcaaaaaagaagaacgttaataaaaaaattcgtttattattaaa

SEQ ID NO: 4621 - DNA, 1473 bp, Artificial Sequence; identical to SEQ ID NO: 29
  P7832 (opLexA::G1067, G1067 is from A. thaliana)

SEQ ID NO: 4622 - DNA, 894 bp, Artificial Sequence
  P7844 (opLexA::G2421, G2421 is from A. thaliana)
agtttgcttagatatctatctttggtccatggagggttcgtccaaagggttgaggaaaggtgcatggactgctgaagaagatagtctcttgaggcagtgtattggtaagtatggagaaggcaaatggcatcaagttcctttaagagctgggctaaatcggtgcaggaaaagttgtagactaagatggttaaactatttgaagccaagtatcaagagaggaaaatttagttctgatgaagttgatcttcttcttcgtcttcataagcttctaggaaataggtggtccttgattgctggtcgattacctggtcggaccgctaatgatgtcaagaactactggaacacccatctgagtaagaagcatgaaccgtgttgtaaaactaagataaaaaggataaatattataacccctcctaatacaccggcccaaaaagtcgatattttttagcctcggcctcgattcttctctataaaaaccggctgcaaccatctcgatggacagtctgaagttggtgtaattcctccatgccttggactcgacaacgataatgtttgtgaaaatagtatcacatgtaacaaagatgatgagaaagatgattttgtggataattttatggttggagataatatatggttggagcgtttgctagacgagggccaagaggtagatgtgctggttacagaagcggcggcaacagaaaaggagggcactttggcgtttgacgttgagcaactttggaatttgttcgatggagagactgtgatctttgattagtgtttataaacgtttgtgttctcttgtttgtgaggtttctctatttaatttagtatctattttctaaattaactaatatcttatagtattttaggcaaaccttatgtttccgtttctgt

SEQ ID NO: 4623 - DNA, 915 bp, Artificial Sequence
  P7845 (opLexA::G1842, G1842 is from A. thaliana)
agaaaaaaagcaaacacattttgggtccccggtggttaggatcaaattagggcacaaaccttatcggagaaagaagccatgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagcaagcttgaagaatcaaatgtcgataatgtaagtgtagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgtgc

SEQ ID NO: 4624 - DNA, 1799 bp, Artificial Sequence
  P7850 (opLexA::G1216, G1216 is from A. thaliana)
atggtgtcgcataagtgtgtagaagaatttggatacgcaagctacctggtaccttccaatgcaagagcacccagatccgcccggaagaggcgcagtatcgagaagaggataagtaaagaagatgataatatgtgtgcaattgatctattggccaccgtagctggacacttgtcatttgagagtgggagttctctcatgtctattgacaaactgattgaagatcatcgtgtaaaggaggaattcccggaggaagaaaaacctctaatgccagtagctttatccccttatcggggatctttgagtccctgcggattcagttctgtgataaatggcaaagtagagaatgaggtagatggttttagttactctggtggtagtgatgcttgtcaagtcgggaacttcagtcaagatgtaaaaccggatatcgatggtgatgcagtagttctggatgcgagacctaatgttgtagttagtttaggtagtagtagtagaaccgaagtgccatcaattgggaactgtgtttcccatggcgttcgggatgatgtaaatttgtttagtagagatgatgatgaaaacttttccaagtacattcacccgcgtgttacaaaacattcacctaggactgtacctcgtattggggacagaagaatcaggaagatattggcttctagacattggaaaggaggttcaaggcattcagatacgaaaccgtggagaaattattacttgcaccagcagaggagctatcctatcaagaaaaggaaaaactttgaccacatatctgattccgttactgatgattaccgtatgcgtactaagatgcatagaggtagtagaaaaggtcaaggggcatcctttgtggcaagcgactcccatgtgaaactacggatcaagtcgttcagggtgcctgagcttttcatagagattccagaaactgctactgttggctcattgaagagaatggtgatggaagcagtgagcactttactgagtgatggacaccgagttggtctgatggttcaggggaagaaagtccgtgacgataacaaaacccttcatcagactggtatctctcaggataactcccacctggactctcttgattttagccttgaacccagctcagaaatgcctcaactgttaactagtcacccgttgggacatgcttgtgaggagctgctacctgtgtgccaagctactaaaatagacaatgtgttggaatctgaccatcatgactcagcattattcccatctgactcattaggcaacaataatgtgacagaagattctaaagctatgatttctgtggcgctcaacgaattgtcttctcaatcacaaccaccttcccggaaatctagaagaagtgaacagcagcagcagcaggctgcacaacgcagaattcgtcgacctttctcagttgctgaagtagaagcacttgttcaagcagttgagaaactcggtactggaaggtggagagatgttaagctttgtgctttcgaggatgctgaccaccgcacttacgtagatctcaaggataaatggaaaacgctggtccacacggctaagatatctccacaacagaggagaggagagccagtgccgcaggaacttctaaaccgagtcttgaacgcccatggctactggacgcagcaacagatgcagcagctgcagcagaatgtgaacaagctggagcaggagacacagtctcaaacgacagagggtctgttacttctctaaatgaatctgctgcagccttggaggtcgtctctcctttgtgtattactactactattgatgat

SEQ ID NO: 4625 - DNA, 1631 bp, Artificial Sequence
  P7856 (opLexA::G588, G588 is from A. thaliana)
tcttctctttgatcattcctttctcagcaatataaattagagttatatcctttataaaggattttgctttttcaccaacaaaccctaaattcggtgtctcagcaagaatcacgtgattctcgttcctcttcctcacgaaacccatcatcttctatctcatttgagaaatgggtcaaaagttttgggagaatcaagaagatcgagcgatggttgaatccaccataggctctgaagcttgcgactttttcatctcaacagcttcagcttccaacactgccttgtccaagcttgtctcaccaccaagtgattccaatctccaacaagggttacgtcacgttgttgaaggatctgattgggattatgctcttttctggctagcgtccaacgttaatagctctgatggttgtgtcttgatctggggagatggtcattgccgtgtcaaaaagggtgcttcaggtgaggattactctcagcaagatgagatcaaaagacgtgtgcttcgcaagcttcacttgtcgttcgttggttcagatgaagatcatcgtttggtgaaatcaggagctcttactgatctcgacatgttttatctggcttctttgtacttttcctttaggtgtgataccaataagtacggtcctgctggaacctatgtgtctgggaagcctctttgggctgcagatttgcctagctgcttgagttattatagggttaggtctttcttagctaggtcagctggttttcagactgtgttgtctgtaccagtgaattctggagttgtggagcttggttctttaagacatattccagaagataagagtgtgattgagatggtgaaatcagtgtttggtgggtctgactttgttcaggctaaagaagctcctaaaatctttggtcgacagctgagtcttggtggagcaaaacctcggtctatgagtattaatttctccccgaagaccgaggatgacacgggtttctcattggaatcgtatgaggtgcaagcgatcggaggctctaatcaagtgtatggttatgagcaagggaaagatgagacattgtatctaactgacgagcaaaagccgaggaagagagggagaaaaccagcaaatggaagagaagaggctctaaaccatgtggaagcggaacggcagaggagggagaagctgaaccagagattctacgctttgagagcggtggtgcctaacatctccaagatggacaaggcttcgctccttgcagacgcaatcacttacatcacggatatgcagaagaaaatcagggtgtatgaaacagagaagcagataatgaagaggagggagagtaatcagataactccagcagaggttgattatcaacagaggcatgatgatgcagttgtaaggctaagctgtccgttggaaactcatccagtttcaaaggtgatacaaacgttgagggagaatgaagttatgcctcatgattccaacgtggccatcacagaggagggtgtggttcacacattcactctccggcctcagggtggctgcaccgctgagcagttgaaggacaagctccttgcctctctatcacagtaactatcacagcagtaactgctatgtaataagtgtaaccgtgttggaggttgtatcaatgta

SEQ ID NO: 4626 - DNA, 948 bp, Artificial Sequence
  P7859 (opLexA::G2295, G2295 is from A. thaliana)
gtaatatataacaataactcaggttacaaaggatggttccgaaagtggtcgacctacaaaggatagcgaacgataagacaaggataacaacttacaagaagaggaaagctagtctttacaagaaggcacaagagttctcaactctctgcggcgtcgagacatgtctcatcgtctacggtcccacgaaggctaccgatgtggtgatttccgagccagagatatggccgaaggacgagaccaaagtcagggccatcatacgcaagtacaaagacacagtgtcgaccagctgcaggaaagaaaccaacgtggagactttcgtcaacgatgtagggaaaggaaacgaggtggtgactaaaaagagagtgaagcgtgagaataagtattctagttgggaggagaagctagacaagtgttcacgagagcaactacatgggattttctgtgccgtggatagcaagttaaatgaagctgtaacgagacaggagcgtagtatgtttagggttaatcatcaagccatggacacaccattcccgcagaatttaatggaccaacaattcatgccacagtattttcatgagcagccacagtttcaaggcttccctaataatttcaataatatgggtttctcgttgatttcacctcatgatggtcagattcaaatggacccaaatctcatggagaagtggaccgacttggctttgactcaaagcttgatgatgtcaaagggaaacgatggtactcaattcatgcagaggcaagaacaaccatactataatcgtgaacaggttgtatcgaggtctgcaggtttcaatgttaacccgtttatgggatatcaagtcccgtttaatattcctaattggagattatcgggaaatcaagttgaaaattgggagctttcagggaagaaaacgatatgatttgaattacggagctttattagtttttagg

SEQ ID NO: 4627 - DNA, 1209 bp, Artificial Sequence; identical to SEQ ID NO: 597
  P7860 (opLexA::G229, G229 is from A. thaliana)

SEQ ID NO: 4628 - DNA, 902 bp, Artificial Sequence
  P7861 (opLexA::G714, G714 is from A. thaliana)
agtttggtagagaaatggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaaggcgtatatgggtcagccaatgtggcaacaaccaggacctgagcagcaggatcctgacaattagcttggcctaataaactagccgtctaattcgaagctctccccggtggatctactcaagaagaagaatgttaatagaaaactattgcgacataaaaagtttggtgtagtagaataatttctgttttatgatccatggatttatcaattgttattcagtttggtttatcttgtcatcaaactgttttcggtcaatgtaacaaattcataaattgagaattgaacttacaaaaggcta

SEQ ID NO: 4629 - DNA, 894 bp, Artificial Sequence
  P7863 (opLexA::G1634, G1634 is from A. thaliana)
ttatctcgtagcctttaaacgatggagactctgcatccactactctcgcacgtgccaacttctgaccaccggtttgtagttcaagagatgatgtgcttgcaaagctcgagctggactaaagaagagaacaagaagtttgagcgagctcttgctgtctacgctgatgacacgcctgatcgctggttcaaagttgctgctatgatccctggaaagaccatatcagatgtcatgaggcaatactctaagcttgaagaagacctcttcgatatcgaagcaggacttgtcccgatcccgggttaccgttcagttactccttgtggatttgatcaggttgtgagtccacgtgactttgatgcgtatcgtaaacttcctaatggagccagaggatttgatcaagaccgtaggaaaggagttccatggacggaggaagaacacaggagattcttgttagggcttctcaagtatgggaaaggagattggagaaacatatcgaggaactttgtgggatcaaaaacaccaactcaggttgcaagtcatgcccaaaagtactaccaaagacagctttccggtgcgaaagacaaacgacggcctagcattcacgacatcaccaccgtcaatcttctcaatgccaatcttagccgtccatcgtctgatcacggttgcttagtctcaaaacaggccgagccgaaactagggttcaccgacagggataatgcagaggagggagttatgtttcttggtcagaatctatcctcggtcttctcttcctacgatcctgccattaagttttccggagcaaatgtttacggtgaaggaggttactgtatctcacaagatcttgaaacgagaaaatgagaattttgaaattttaactattgcaacgaaaccataatt

SEQ ID NO: 4630 - DNA, 1205 bp, Artificial Sequence
  P7864 (opLexA::G1355, G1355 is from A. thaliana)
ccgtcgacccgtcacatactcgatcaattataattatatattcggctgcgaagatttacaagaaataatggagccaatggaatcttgtagcgttcctccaggatttaggttccatccgacggacgaagagcttgtcgggtactatctaaggaagaaaatcgcatcgcaaaagattgatctcgacgtcatcagagacatcgatctctacagaatagaaccatgggatctacaagaacaatgtcgaatcggttatgaggaacaaaatgaatggtatttttttagtcacaaggacaagaaatatccaacggggacaagaactaatagagcgaccatggctggattttggaaagccacgggaagagacaaagctgtttacgacaaaacaaaactaattggtatgaggaaaacacttgtgttctacaaaggacgtgcacctaatggcaagaaatccgattggatcatgcatgagtaccggctcgagtcagatgagaatgcaccgccccaggaagaaggatgggtggtttgtagagcattcaaaaaaagagctacagggcaagccaagaacacggaaacttggagctcaagttacttttacgatgaagttgcaccgaatggagttaactcggttatggaccccattgattacatatctaagcagcaacataacatttttgggaaaggtttgatgtgtaagcaagaactagaaggaatggttgatggtataaactatatacaatcgaatcaattcattcagctcccacaactccaaagcccttctctcccgctgatgaaaagaccttcaagctcgatgtccataacatcaatggataacaattacaactataaactcccattagcggatgaagaaagcttcgagtcattcataagaggagaggatagaaggaagaagaaaaagcaagtaatgatgacgggaaattggagagagttagacaagtttgttgcttcacaacttatgagccaagaagacaatggaacttcaagtttcgcaggtcatcatatagttaatgaagataaaaacaacaatgatgtggagatggattcgtcaatgtttttgagcgaaagagaagaagaaaacaggttcgtcagtgaattcttgagtacaaactcggattatgatattgggatttgcgtatttgataattgaatgaaactacatagatggcatgtgagatttgttggtacgt

SEQ ID NO: 4631 - DNA, 1140 bp, Artificial Sequence
  P7865 (opLexA::G1022, G1022 is from A. thaliana)
aagaatctgagtggttggtctctgatttgatgagatgactgttgagctgatgatgagcagctacagcggcggcggaggaggaggtgatggttttcctgcaatcgccgcggcggcgaaaatggaagataccgctttgagagaagctgcttctgcagggattcacggtgtggaggagtttcttaaactgatcggtcaaagtcaacaaccaacggagaagagtcagacggagataaccgcggtgactgacgtcgccgttaacagcttcaagaaggtcatttctctactcggtagatctagaaccggacacgctagattcagacgagctcccgcgtcaacgcaaacgccgtttaagcaaacgccggtggttgaggaggaggtggaggtggaggagaagaagccagaaacaagctccgtgttaacaaaacagaaaacagagcaatatcacggtggtggatctgcgtttagagtttattgtccaacaccaattcatcgtcgtcctcctctatcacacaataacaacaacaatcagaatcaaacaaagaacggttcgtcttcttcatctcctccgatgctcgcaaacggagcaccgtcaacgataaactttgcgccgtcaccaccagtctcagcgacgaactcattcatgtcttctcatagatgtgacaccgatagtactcacatgtcatcaggattcgagttcactaacccatctcagctctctggttcgagaggtaaacctcctttatcatcagcttcgttgaagagaagatgtaattcatctccctcaagccgttgccattgctccaagaaaaggaaatcaagagtaaaaagagtgattagagttccagcagtaagtagcaaaatggctgatataccatcagatgagttttcatggagaaaatatggtcaaaaaccaatcaaaggctctcctcatcctcggggatattacaagtgcagcagtgtaagaggttgtccggcgcgtaagcatgtggagcgtgcactagatgatgcgatgatgctaatcgtgacgtacgaaggagaccacaaccatgctttggttctcgagacgacgacgatgaatcatgacaaaactctttagtttctcgagtttgaggggaactgtctgtgtgtgaccactatcca

SEQ ID NO: 4632 - DNA, 1349 bp, Artificial Sequence
  P7867 (opLexA::G1850, G1850 is from A. thaliana)
ttgggtattgggattaaggaaagtttagatttttgatctataactcatgccgggggaacaaaccggagaaactccgacggtggccggagttggcggcggtggagctggttgtagcgccgggaatagtggtggaagtagtggatgtggtgctggtggtggcggtggtggtagtggtggaggtggtggcggaggaggagattcacagaggtcaattccgacgccgtttttgacgaaaacgtatcagcttgtggaagatccggtttacgacgaattgatctcgtggaacgaagatggaaccacttttattgtgtggcgaccagctgaattcgctagagatcttcttcccaaatacttcaaacataataacttctcgagttttgttcgtcagctcaatacttacgtgagtctcaatatacgtttgaatcgaaattttcagttattaggttttttagtagtgagctcttattttggtttattattggttttagggatttcgaaaagtagttccagatcgttgggagttttctaatgattgttttaagagaggtgagaagattctgcttcgggatattcaacggcggaaaatctctcagcctgctatggccgcggctgctgcagcggcggcggcagccgtagcggcttcggctgttacagtagcagctgttcctgttgtagctcatattgtttctccatcgaactctggagaagaacaggttatatcgtctaattcttcgcctgcggctgctgctgctgctataggaggagtggttggtggtggttctttgcagaggacaacgagctgcaccactgcaccagagctggttgaggagaatgagcgattgaggaaagataatgagcgattgaggaaagagatgacaaagcttaaaggattgtatgcgaatatctacacattaatggcgaatttcacaccgggtcaagaagattgtgcgcatttgttacctgaagggaaacctttagatcttttaccggagagacaagagatgagtgaagccattatggcttctgaaatagagacagggattggtctgaaacttggtgaggatttgactccaaggttgtttggggtttctattggggtcaagcgagctagaagagaagaagaattgggtgctgcagaggaagaagatgatgatagacgagaagctgctgcccaagagggagaacaaagttctgatgttaaggcagagccaatggaggagaataactccggtaaccataatgggtcgtggcttgaactcggaaaatgaaaaacacttgccgattcagaggcattgttgaatatgcaagaaactgttactgatccccattgcataggcaagccattgcgc

SEQ ID NO: 4633 - DNA, 2089 bp, Artificial Sequence
  P7869 (opLexA::G1775, G1775 is from A. thaliana)
cggagctgggcctgctagctagtagtagtttatacaagatcaagtcttagaagagataattgttatagcaaaatcctaaattttcaaggagtttgtttcgcttgcttcctctaaattatcctcaaaattgttttatggtttctgcagccgccggccatggattattcagatgatgacatgatcgataacgaatcaggggaggagaataacagcgatggtggtggtaatgaatcctacaactacaacgctgcggtagacacaattattctatctgagaaaagttacgtgattatcaaggaagaagagattctgaagcttcaaagagacgacatcgaacgagtttccacgattctctttctaagccaagtggaagcgattgttctgcttcttcactatcattggtgtgttagtaaactcgaagatgaatggtttacggacgaagagagaatccgtaaaaccgttggtatattaaaggagcctgtcgttgatgttaatggtacagaagtggatattcaatgtggaatttgctttgaatcatacactcgaaaggaaattgctagtgtttcttgtggtcatccttattgcaagacctgctggactggttacatcactacgaaaatcgaagacggtccgggatgtttaagggttaaatgtcccgaaccttcttgttacgctgttgttggtcaagacatgatcgatgaggttactgagaagaaagataaggacaagtattatagatattttcttaggtcttatgtcgaagacgggaagaagatgaaatggtgtccatcaccgggatgcgaatgcgcggttgaatttggtgaaagtagtggttacgatgttgcttgtttgtgttcgtataggttttgctggaattgcagtgaagatgctcacagtcctgtggattgtgaaacagtgtcaaaatggatattcaagaaccaagatgagtcggagaacaagaattggatactagcgaattcgaagccatgtcctaaatgcaaacgtcctatcgagaagagccatggatgtaaccatatgacatgctcagcgtcgtgtggccatcgtttttgttggatttgtggtaaatcatatagtgatcactatgcttgcaacaattatgttgaagatgctgatcacgataagagaacattgcttcagagtgaaatcaaaagatacacgcattattatgtaagatgggtagaaaatcaatcgtcgaggcttaaggctatgagtgatctggagaaattccaatcggtgcagctaaagcagcttagtgacaatcagtgcaaaccaaaaattgatctccaattcattgtagatgcatggcttcaggttagtaacattacgaaactgtatattaaaaaaagaattgtatgtgcaatgttacacagagaatgtaggaatgaccatcgtagaaatttgaaaaaacgatttcatgattatacttatatattaatcttgaactatgaatggatcactaaaaagtgtgattagtataatatttggaatgacgaaatcattccaccattatgaatttgataaattacaacactgttcgttgttgaacaagtacggacatgtgattgattttactgttgcagatcatcgaatgtaggagagtcttgaaatggacatatgcatatggatactaccttgataatctcgccaagcgaccattgtttgagtatttgcaaggttagttttcgttaaggaaacatttaaatatgtacgttgtgatcataatttgtccattgtagctaattaaatttttgttgtcaggggaggctgaaacaggtttggagaggcttcatcattgtgcagagaatgagttgaaacaatttttcattaaaagtgaagatccatccgatactttcaatgcattccggatgaaattaactggtttgactaaagtaactaaaacctatttcgataatctggtgaaagctttggagaatggtcttgctgatgtgaccaaatcaagtgaagaatctgctgattttctcgaaacacaaaagctatatgatgcttatataagtgaaggctgcttcttctgagatctctctcccttagtttaatccctttgttatta

SEQ ID NO: 4634 - DNA, 1117 bp, Artificial Sequence
  P7870 (opLexA::G1231, G1231 is from A. thaliana)
caaacccaaattctctcagcgccggtcaaatacttgtctctctctctctctctctttcactcttgtcttgtctccttcgaagctgtttgttctgtaagaaagatggaagcaggtggcgcgtacaatccacgcactgttgaagaggtgtttagggattttaagggtcgtagagctggcatgattaaggctttaaccactgatgttcaggagtttttccgactttgtgatcccgaaaaggagaacctttgcctttacggacatccaaatgagcactgggaagtgaatttgccagctgaagaggttcctcctgagctcccagagcctgtcttgggtatcaattttgccagagacgggatggcggaaaaggattggttgtcccttgttgctgtccacagtgatgcttggcttcttgctgttgctttcttttttggagccaggtttggatttgacaaagctgataggaagaggcttttcaatatggtgaatgacctcccaacaatctttgaggttgtagctggcactgctaagaaacaaggaaaagataagtcctctgtttccaacaacagcagcaacagatccaaatcaagctccaagcgaggatctgaatcccgtgccaagttctcaaagccggagcccaaagatgatgaggaggaggaagaggaaggtgtggaagaggaggatgaggatgagcaaggtgaaacacagtgtggagcatgtggtgagagctatgcagctgatgagttctggatttgctgtgacctctgtgagatgtggtttcatggaaagtgtgttaagataacaccagcaagagctgagcacatcaagcaatacaagtgcccttcttgcagcaacaaaagggctcgttcctaaatttgttgaccgctcgcttctgtgtatctacctttgcatatgatgatgaacagcttaactgtttggtttagatcagatttgtcatatggatttggtaatttaggaagacattttagttttttcattgttacattttggcgattgaagggataactctttgtttaggggtaatgatcttttgctctgttttatgtttgtttattaacattcttcaaactcaatcaaaagtattttggttagtcttaaa

SEQ ID NO: 4635 - DNA, 1095 bp, Artificial Sequence
  P7871 (opLexA::G1303, G1303 is from A. thaliana)
ttggaaaccattgatgcagacctcaatccatctctaacaccactgatctatctacttaggtcttctctaacaatacttgtaattttctttctttttgcttcttccgtcactacatctatggccgctgagtcttctaaccctcgcaccgtcgaagagatcttcaaggattttagcggtcgtcgctccggttttcttcgagctctctccgtagatgttgacaagttctactctttatgcgatccggaaatggagaatctgtgtttgtacggacacccgaatgggacatgggaagtgaatcttccagctgaggaagtgcctccggagctacctgagccagctcttggaatcaatttcgctagagatggtatgcagcgtaaagattggctctctttagttgctgtccacagtgattgttggttactctctgtttcttcttacttcggcgctcgtcttaatcgcaatgagaggaaacgtctatttagtctgatcaacgatctcccaactctctttgaagtagtgacgggtaggacacccatcaaagacggtaaaccaagcatggatctcggaagcaaatccagaaacggcgtaaagagatcaattgaagggcagacaaagagcacgccgaaactaatggaagagagctatgaagatgaagacgatgagcatggagacacactctgtggaagttgtggaggaaactacacaaacgacgagttctggatatgttgtgatgtgtgtgaacgttggtaccatgggaagtgtgtgaagataacaccagccaaagcagagagcatcaagcaatacaaatgcccttcttgctgcactaagaaaggaagacagtgagtgaatgaatgaattctcaaaaagggcgttttaaaatagtaatgagggtatgagacatggagagagtcatagagacaccagctgcttagagagcttcgtcaacttttgatcaaatatgccatgtgtttgtatatgtagcgactctactactttcatcgtttatgtgtgtaatctctctttaggctaatataaaaaaaaatattcttatgtaaggttgatcttcataatctctcatatggtattttaactaaa

SEQ ID NO: 4636 - DNA, 2643 bp, Artificial Sequence
  P7872 (opLexA::G2342, G2342 is from A. thaliana)
tctggatttggtgatttatatgggttttttaggaggaaagaagtgaaatgaaaattgagattcaatgtatggagaataagcaaccattagctgcttcttgctcttctgcatccgaaggtagtggctgtttcttcctcaagtcacctgaaatcgcaactcctgccacagtatcttcatttcctcggtacttttactatcttttacatttcatcttctatctgtgtgtttatacaacttattatgaaattgattgattggaaagactgtgctttgatgacttacaccgaactcattttgggtttctgcaatgttttaatgttgatctgcaggaggactagtggacctatgagacgagcaaaaggtggttggactccagaggaggttagtggttgcttttgtttcataattttgttggtgtgtggagcaacctcattcgactatgtatcttatatgtataaggattagtgtttacttgaatgaaagacgagactagccttattgtggtctgtaattggtttttatcactattcaggatgagacacttagacgagcagttgaaaagtataaggggaagaggtggaagaaaataggtaaatttcttttcttgaatgtaaaagtagtattgcaatacattagaatgagattataggtcttctaatcacactcttgtcttgatgtatacttgaatgtataatttatacatttttaaaactgaactcgtatcttaaatctgctgagaattttgtgaatttttctcattcagtaaacatgatctctgctgtgcactttgcaagagaaccatgatttcttttttgtctcttaaatgttaaagtagctggtttcggtcaatgttctgtttgtttgatttttttgtatttcatcttacagcggaatttttcccagagagaacagaagtccaatgcttgcacaggtggcagaaagttcttaatccagagcttgttaaaggaccttggactcaagaggttctcttatcattttcatgttctgaaactttttttggttttcattttacgtaaaaatttggtagctctaaaattctctttctttcgtgaattgtaggaggatgataaaatcgttgaacttgtaaaaaaatatggacctgccaaatggtctgtcatcgccaagtccttaccaggtcgtattgggaaacaatgtcgagaaaggtaacaaagattagaatattgactatctgaagaatagagcctgtacctccgttgagtttggaagcctcaacgagtttacgattacaggtggcacaaccatttaaatcctggtattagaaaggatgcttggaccgtagaagaagaatcagctctcatgaattctcatcgaatgtacggaaacaaatgggcggaaattgctaaggttttaccaggaaggtatacttacttgtagttgaaaaaggccttgtgaaaaataaagttaatggacatttttgaacatctcatacagtttttgcttctgatgtctacctgtactttttgcaggactgataacgccataaagaaccattggaatagttcactgaagaaaaaattagagttctacttagcaactggtaacttgccaccgccagcaagcaaattcatcgttctgaaagatattgctgatggagacagagattccaagcagtctagtgcaactaaacctttcaaggattctgattcgcttacccaaacctcttcaggaaatacagattcaaatgaagttggaagagaccattttgactcttcttccgctctgcttgaagaagtagctgcttcacgaagaatcggtgtcaatgagtatgcttgctctcctgttgagtacaagcctcagttgcctaatctggaaccaatttcagaggaagtcagaatcaactcaaaagcttattttgagagatcaatccagaggaaagtagaaaacgggtttggaactccaaagcatgggaatttatactataagtctccacttgactattactttccatcagaagcggatctgcaacatatgtacggatatgaatgtggttgcagtcccggtgctgcatcaccagtcagcttaatgactacaccctgtaataaagacagtggtttaactgcaacgagaagtcctgaatctttcttgagagaagctgctaggacttttccaaacacaccttctatttttaggaaaaggcgaaaggttgttttggcagcgaaaacagatgctgttgttgttgttaatggtgtagttaaggaagttgatcgaaaagaagaaagtaaagatatgagaaaaagtttgttgctggagacaactgataattgcagtgatgatgaagaactcgggttaaatggaaatgctttcaatttgtctccaccatatcggttaagagctaaaagaacagctgtaatcaaatcaagacagcttgagtttacatctgaaaaggagaagcagccagataatgagattgagtttacatctgcaaaagagaagcagcctgataatgaaattaaaacgtctgaggaagacaagcctgtgtagaacccttcttcccttagaaaactgtgagtgaaaatttcaaatcttttatttaatgtcactaatctgagtaacaaatctaaaataattccatccttgttgacacagagatcgtgtgaagaa

SEQ ID NO: 4637 - DNA, 1451 bp, Artificial Sequence; identical to SEQ ID NO: 433
  P7874 (opLexA::G1933, G1933 is from A. thaliana)

SEQ ID NO: 4638 - DNA, 1179 bp, Artificial Sequence
  P7877 (opLexA::G2148, G2148 is from A. thaliana)
aaatgtaaaggcgaacgcataagaaaagaaaaatggagaatgaagcttttgtagatggtgaattggagtctcttttggggatgttcaactttgatcaatgttcatctaacgaatcgagcttttgcaatgctccaaatgagactgatgttttctcttctgatgatttcttcccatttggtacaattctgcaaagtaactatgcggccgttcttgatggttccaaccaccaaacgaaccgaaatgtcgactcaagacaagtaagtttaagtaaaaaatgttaagtttcctatgtttacatttgtcgaatattaacccataacggtaatgcaaagcaggatctgttgaaaccaaggaagaagcaaaagttaagctcggaaagcaatttggttaccgagcctaagactgcttggagagatggtcaaagcctaagcagttataatagttcagatgatgaaaaggctttaggtttagtgtctaatacatcaaaaagcctaaaacgcaaagcgaaagccaacagagggatagcttccgatcctcagagcctatacgctagggtaattcaagataacctaaacaaatattttcattgttgatttgagtttttaggttttgtggaataataatgttgatgaatgttgcagaaacgaagagaaaggataaacgataggctaaagacattgcagagcctagttcctaatgggacaaaggtcgatataagcacaatgctggaagatgctgtccattacgtgaagttcctgcagcttcaaatcaaggtaacgactttttttcttgttggagtattgatcgtttcttgtactgcaagaaaccatgtaaaactcttacctaaactctgttttaccatttttcctaaccaaacacttttgtcgtttttggaaattttgcaatgtagctcttgagttcagaagatctatggatgtatgcacctcttgctcacaatggtctgaatatgggactacatcacaatcttttgtctcggcttatttaagacaaaatcattggaataacataacttacagtacttgttttttttctcgttctatattcatgattatggttattttttgtttgagttgttcaatttttctgtctattgcgttctatgaacttgacactctttttgtaattattatatgctaaagacaatttggactaacagca

SEQ ID NO: 4639 - DNA, 938 bp, Artificial Sequence
  P8070 (opLexA::G2371, G2371 is from A. thaliana)
tcctctctctctctctcactccaagaaaccaaaaaaaaagatgtcagtcaaccattaccacaacactctctcgttgcatcatcaccaccaaaacgacgtagctatagcacaacgagagtctttgttcgagaaatcactcacaccaagcgacgtcggaaagctaaaccgcttagtcataccaaaacaacacgccgagaaatacttccctctcaataataataataataatggcggcagcggagatgacgtggcgacgacggagaaagggatgcttcttagcttcgaggatgagtcaggcaagtgttggaaattcagatactcttattggaacagtagccaaagctacgtgttgaccaaaggatggagcaggtacgtcaaagacaaacacctcgacgcaggcgacgttgttttctttcaacgtcaccgttttgatctccatagactcttcattggctggcggagacgcggtgaagcttcttcctctcccgctgtctccgttgtgtctcaagaagctctagttaatacgacggcgtattggagcggcttgactacaccttatcgtcaagtacacgcgtcaactacttaccctaatattcaccaagagtattcacactatggcgccgtcgttgatcatgctcagtcgataccaccggtggtcgcaggtagctcgaggacggtgaggctttttggcgtgaacctcgaatgtcatggtgatgccgtcgagccaccaccgcgtcctgatgtctataatgaccaacacatttactattactcaactcctcatcccatgaatatatcatttgctggggaagcattggagcaggtaggagatggacgaggttgatgactgacattcaaaaagaagtgacaactttctagatttttaactttagaatttagattatgggcccatacttggcccaattgtcatagagaaa

SEQ ID NO: 4640 - DNA, 979 bp, Artificial Sequence
  P8080 (opLexA::G2686, G2686 is from A. thaliana)
cagaatctaaaccagaaaatgttttcaaacatcgatcacaaggctgtggcagcactccttcatggccagggatgcgctaacatcctcaagacggtcctcgacaactgtaaagttagctctgtttcaacagaacctctcattaacaccattcttgattccttttcactagctctatcttctgtgaattctcctaatcgtcaaccacaccatgagtcttcttctcgagacatggcaggtcttgtgcctcaaagatcatcaaagaagtaagttaccatttaccaacaaaaagctaaacactcggtgcgtatgttataaacaaagttcatgagtttatactacaacatcgcaggaagatttgcggagtaaaaggtttagagatttacagagatgattcccccaatccccgccttgatgacggcttcacctggaggaaatatggacaaaaaaccatcaaaacctctttgtaccaaaggttagtcaattaggtagactacaaaaacagagcaaatggcatgtacataaaaaaacagagtcaatgctcttctctgttctatggaaagacatgtaattacaagtgtgataatttacaggtgttactatcgttgtgcctatgcaaaagaccaaaactgctatgctacaaagcgggtgcagatgatccaagacagtcctccagtttacagaaccacttatttgggacaacatacatgtaaagcctttggggtgcatgataatacgtatggctctgaaatgataaacttcgaccaagttgtatctgaatcggttatgcgtcaacttgcaacaattggtgaacaagctgttctcatggaggacgaagctaaccatatcatgaaccaagaatatgatattaatgattatttggtggatgatgaagtcttttgggggaatgaatttcctctattttcatcggaagacctgatgttgttttgaaaacgttgatgcttttgattagaaacctttc

SEQ ID NO: 4641 - DNA, 767 bp, Artificial Sequence
  P8122 (opLexA::G2992, G2992 is from A. thaliana)
gctatggatttgtcttccaaaccacaacaacaacttctaaactctcttcccatcgccggagaactaactgtcaccggagaaatgggtgtttgttacaaagagtgtttgaaaaaccacgcggctaatctcggcggccatgctctcgacggttgcggcgagtttatgccgagtcccacggctacttccaccgatccttcttctctccgttgcgctgcttgtggctgccaccgtaacttccaccgccgtgacccttccgagaatctcaacttcctcaccgcgcctccgatttcttctccctccggcactgagtcgccgccgtctcgtcacgtgtcttctcctgttccttgctcttactacacctcagctcctccacatcacgtgattctctctctcagctccggtttccctggaccgtcagatcaagatccaacggtggttaggtcagagaacagttcaagaggagcaatgaggaaacgaacaagaaccaaattcacgccggagcagaagatcaagatgagagccttcgcagagaaagctggttggaaaatcaacggatgtgatgaaaagtcggtgagagagttttgtaacgaagttgggattgagagaggagttcttaaagtgtggatgcataacaacaagtactcacttctcaatggcaagatcagagagatcgaacatggcctgtgtctgaacactcacagcaatgatggtgatgggtcttacatctttcttgaagaaagattcaagattcgggttaaaccgaatta

SEQ ID NO: 4642 - DNA, 1020 bp, Artificial Sequence
  P8126 (opLexA::G2748, G2748 is from A. thaliana)
tgagagtagcgttacaatggaggttgacgaagacattgagttacaaaaacatcaagaacaacaaagcagaaagctacaaagattctcagaggacaacactggactaatgaggaattggaacaatccatcgtctcgtatcattagggtttcacgagcttctggtggcaaagatagacatagcaaagtgttaacatcaaaaggtttaagagatcgaagaatacgtctctcagttgctacagcaatccagttctatgatcttcaagatcgtcttggatttgatcagccaagtaaagctgttgaatggttaatcaatgcagcttctgattcaatcactgatcttcctttgcttaacacaaattttgatcatcttgatcagaatcagaatcagaccaaatctgcttgtagtagtggaacatctgagagttcgctgttgtcgttatcaagaacagagattcgtgggaaagcaagagagagagctagagaaagaacagctaaagacagagataaagatttgcagaatgctcatagctcattcactcagcttctcactggtggttttgaccaacaaccgagtaaccggaattggaccggtggttctgattgctttaacccggttcagctgcaaataccaaactcttcctctcaagagccaatgaatcacccattctcctttgtacctgattacaactttggaatctcttcttcttcttctgccattaatggtggttacagtagtagggggacccttcagtccaattcacaatctctctttctgaataacaacaacaacattactcaaaggtcatcgatttcttcgtcttcttcttcctcttctccaatggatagtcaaagcatttcctttttcatggctacacctccacctcttgaccaccataaccaccagcttccggagacttttgatggtcggctatatctttattacggcgaaggaaaccggagctctgatgacaaggcaaaggaaaggagatagtaaaaacaaaatgcttcctttcatctctc

SEQ ID NO: 4643 - DNA, 979 bp, Artificial Sequence
  P8127 (opLexA::G2747, G2747 is from A. thaliana)
ggtgaggaagtcaaaatcttgagagatctgagattgtaagaagatgaatcaagaagataaagagaagcctattgaagaagcttcttcatcaatggagagagaacacatgttcgacaaagtagtaacaccaagcgacgttggcaaactaaaccgactcgtgatccctaagcaacacgcagagagatacttcccattagataactccacaacaaacgacagcaacaaaggtttgcttctaaacttcgaagatcgaagtggaaactcatggaggttccgttactcttactggaacagtagtcaaagctatgtcatgactaaaggttggagccgttttgtcaaagacaagaagcttgatgctggagacatcgtttcttttcagagagattcttgtaataaagacaagctttacatcgattggaggagacgacctaagattcccgatcatcatcatcagcaattcgccggagctatgttccctaggttttacacttttcctcatcctcagatgccgacaaattacgaaactcacaacctttatcatcgatttcatcaacgagatctaggaattggatactatgtgaggtcaatggagaggagtcatccaacggctgtgattgaatctgtgccggtgatgatgcaaaggagagcacaagtggcttcaatggcttcgagaggagagaagcggttaaggctgtttggtgtagatatggagtgcggaggaggaggagggagtgtgaatagtacggaggaagagtcgtcgtcttccggtggtagtataccacgtggcagagtttctatggttggtgctggttctctcctccagttgaggttagtgagcagtgatgatgagtctttagtagcaatggaagctgcaagtcttgaggatcatcacttctttacaaagaaaggaaaaccttctttgtcttttgatttggataggtgatgattatgcatgagattaatcactatttaaaaatgc

SEQ ID NO: 4644 - DNA, 1375 bp, Artificial Sequence
  P8133 (opLexA::G2791, G2791 is from A. thaliana)
gaacaaatgaaacggccagtaaattaaaaaaatagaaatcaaatttttttgaaaagaataaaaacaggggagggaacagaggaagaaaccagaagaagagaagaagagatggaaaatggaaatggagaaggaaaaggagaattcataaaccaaaacaatgacttcttccttgattccatgtcaatgctctcctctctccctccttgttgggatccatctcttcctcctcctcctcctccgccacaatctcttttccacgctctagccgtcgacgcccccttccccgaccagttccatcatcctcaggtaccaaaactattatcttacatcataactcaccaaaactaagaatgtttctgatccttttctgtgttgttgttgttgtttgtcaatgcaggagtcaggaggtccaacaatgggtagccaagaagggttacagccacaaggtacagtgtcgaccacgagcgcacctgttgttcgtcaaaagccaagagttcgagccaggagaggccaagccaccgatcctcacagtatcgctgagagggtatctcattgttcacttcctccatatccttcttctcttatcttgtgtttctgattgtatggttttgtacagcttagaagggaacgcatcgcagagcgtatgaagtctctccaagaactggttcccaacaccaacaaggtattcactactttcctaatttatgaatcttgtttggatttgcataataaccgaattggttgatggtgagatgcagacggataaggcatcaatgttggacgagatcatcgagtatgttaggttccttcagcttcaagtcaaagtactaagcatgagcagattgggaggtgcaggatcagttggtccacgcctcaatggtctctccgcagaggtcagtttcttagtcccttatggctttcaacatatgtatagtggcatcaccaatcatcatcaatcgtcatggtttttggtaatgtaggcaggaggacggctcaatgccctcactgcaccgtgcaatggcttaaatgggaatggaaacgctacaggatcgtccaatgagagcctaaggtcaacagaacaaagagtggcgaaactgatggaggaagacatgggatcagcaatgcaataccttcaagggaaggggctttgcttaatgccaatatctctcgcaaccgcgatatcatcatcaactactcactctcgtggatccctctttaaccccatctccagtgctgtagcagcagaggattcaaatgtaacagcaactgcagttgctgcacctgaagcctcgtctactatggatgatgtatctgcttccaaggcctgaaccatagaatactcatgtgtttcgttttctcagtttaagtcaaacgc

SEQ ID NO: 4645 - DNA, 1614 bp, Artificial Sequence
  P8141 (opLexA::G2898, G2898 is from A. thaliana)
gcgaacgaaagttcgattccgagaaagtgagagaaaatgacgaagagagctcccaagtcagggcctttgtctccgtcgtgcagcggaggctctagtcggtaagttttgtgtctggctttgataggttacagaacaagtttggctttttacacctggttttgctttgatttctctgtttagggtttaagggttctgcttagtctctctggttattactgattaagtggttagatagggaattggatatgaaagttgtgaactttatgctatccaatggcaaatgggtgagaagaagagcaaggaaagaggatgttagttagatttttgttaattgtgttgtaaaatcttggcaggaacttagagttggctgtgaagtcaagtgaaggtgcaaggaggtctacaagactgagacttcagcctttgagaaagccaaagacaagccccaagaagaaacccgttaaactccaaacgaagatgcccaagaaacctgccactgctttcttctttttcctgtaggtactctctctcatatgattccaaattgttatctaaatatttaagctcagctggacttccttaagtcttctcttaagtagaaatttgtgtgcattttgccattggtctttaggatgcgattatttatgttgttatgtgttctggttactttagaaaacatacgaagaaacacttgttgtattcattttcctcttgcctcatattgtcttatctttttggctccaaagggatgatttccggaagcaatatcaagaggagaatccagatgtcaagtccatgcgcgaggttgtagaatattactttgttggttttgtatgtcaaagtaaaacatggtggctattatgttcactttgattcttttgctaaagttgttttgttcttcattctgtacagattgggaagacatgtggagagaaatggaaaacaatgacttacgaggtaacatttgggtttcgcttttctgtcccagttagtctattgtctctatcttctaaaagtctcctctataatgttattcaaatcatagtcaaatgtatgatatctgacattgggatgactcacaaaagcaatgaaataggtttcatgttagcatatatagtggttggatagatatgttctaaaatgagtcaggtgttgccagtcttgttctttttggcgaacaatatctcattttattcttcttacctagatatctttggttgagaccttgacggaagtttcttactcctagattgtttgttcctcaactgttttgtaggaaaaggtaaagtattatgatatagctactgagaagagggaagaatttcaccgagcaatgacagaatataccaagagaatggtaccaccgttttcttcatttttccttgtttttgcttaatatttattcacatcagtgggttcttcatttttccttgtttttgcttaatatttattcacatcagtgtcccactgatgcggtgataaaacattagtctgagcttttcattttactattttgcaggaatcaggtgcccacgatgaatcagagaccgactcagactattctgaatagattactttttagtttctaccacattagaaacattgttctaagccttc

SEQ ID NO: 4646 - DNA, 2451 bp, Artificial Sequence
  P8143 (opLexA::G2885, G2885 is from A. thaliana)
gaagagaggagacttgcaaacgtattgcatcaaatatggagtttggaagcactgaagatggaaggcatgacaagtttcctgtaggaatgagggttcttgctgtggatgacaatccaacctgccttcggaaactcgaagagttgctgcttcgttgcaagtatcatggtactacatattctttgcttttgtttttttttacctgtctgcttcggaattggggtgcatggtcaatgatgtttgattgattacgccagtgacaaagacaatggagtcgaggaaagctctggaaatgctgagagaaaacagcaacatgtttgatctggtgataagcgatgtagagatgccagacacggatggttttaagttgcttgaaattggtcttgaaatggaccttcctgtcatcagtacgtctcctaccattgtttttcatatcaactctagcccttattgtaacctgcttcattgtctcagtgttgtcagctcatagcgactatgacagcgttatgaaaggtattatacatggcgcttgcgattatctggtcaagcctgttggactcaaggagcttcagaatatatggcatcatgttgtgaagaagaacattaaatcttacgcaaaactgctcccaccttctgaatctgattccgtcccaagcgccagcaggaaacggaaagacaaagtcaatgacagtggtgatgaagatgacagtgacagagaagaggatgatggtgaggggagtgaacaggatggtgacgggtcaggtacgcggaagaagccacgtgttgtttggtctcaggagcttcaccagaagtttgtcagtgccgttcagcaattgggcctcgacagtgagtttccccatagacctctttaaacctttccttatgtgtgatgtccactcttgtttctcctatagagttattttgatgctttcatgtgtgggatcctcttttcatttctccttgtgttcatcacagaggctgttcccaaaaaaatacttgatctcatgagtatagaaggtctcactagggaaaacgtagccagtcatttgcaggtactaattccccattctctcttgcatttttccccttctttcgcaaatataatcttggatggttagacttgttttattctctggttttggttgcagaagtacagactgtacttgaaaaagatagacgaaggtcagcagcaaaatatgaccccagatgcatttggaacaagagattcatcttactttcagatggctcaacttgatggacttagagattttactgccgcaagacaaattccaagctcaggactcttatcgcgttcccatctcaccaaactccaaccccctatgtattcatcgataaatctccaaggaatgaactcctccagcttcatccaacaggggcatcaccagaactcaagcaattcagctaatccgtttggaacatatcacagtactctgtcaccaagaatccagaacgtgaatctgtttcagcgaacttcatctccactagaacccctccagtttcctagaagcaagtcatacattggagattttaaaggcttaggggacagagctattggcggtagcttcctagatacttgtatgccatttggtagctctagcacctctttaccaagtgcttccaccaatcctctaatgttgcaagcaaactatacacaacccctgcatatagcctcagatggaattcagccttgcatcgagggaactccgtccaactctgcctccccaaacatcagtttccaaggcttatctagatttcctggtcatagctggcaagggaatttgaacacaaccagattcccaccgagttccttaccactaaatcttgctttcttgccggatcaagtgacatgtgcagggaacaatctgggagattgtacttctttggtttctgcagagaatcctggtggagagatgcagtgtgatcctcaattacttggcggcttcatgcagaacgtgaatccgttaggcggacagaaatgggagcaacagaactgcaccatgctgaacaatccattcggtaacattgagtatcctctacccgcagataacatggttttcagagacaacaattcaaccagaagcaaaggcttggatgagtcactgatgaacccaatagacaacagtcaagagtatgttggaaaagctactacaatgctggatccagagatgaagtcgggaaagccagagaatgacaaccagcatgatgtattcgatgacataatgaatgagatgatgaaacaggtaacgcggttgttttcttgattggattaaaagcttttgtagtttgtagaaaatgaaagtgaatgtgtttgttgcaggaggagaataacggaatggtgccagtggctactagatttggctttgattcatttcctccaccttagctagtcatctctttctctaccagttgcattaagtttctccacttgagacc

SEQ ID NO: 4647 - DNA, 841 bp, Artificial Sequence
  P8144 (opLexA::G2650, G2650 is from A. thaliana)
cccaacgacttcgtcaagcttaccagtttttctgtatcgacagaggacatgggaataaaaaaagaagatcagaaaagttccttgtccttgttgacgcaacgatggaataatccgaggatcgtgcgagtctcccgagcatttggaggcaaagatagacacagcaaagtgtgcacagttcgtggtctccgagacaggaggataaggttgtcggtgatgacagcgatccaagtctacgaccttcaagaacgattagggctgagtcagcctagcaaagtcattgattggctcttagaagttgccaaaaacgacgtcgatttgcttcctcctttgcaattcccacctggttttcaccaacttaaccctaatctcaccggccttggagaatcttttcccggggtcttcgatcttggaagaacacagagagaagctttggatcttgagaaaaggaaatgggttaatcttgatcatgtgtttgatcacatcgatcatcacaaccatttctcgaattcaatccagagcaacaagctttatttccctacaattacttcgtctagcagctcttatcactacaaccttggacatctccaacagtcactactagaccaatctggtaacgtcactgtcgcattttctaataactataataataataatctcaatcctccggcggcggaaactatgagttctctattcccaacaaggtacccttcgtttctcggtggtggtcaacttcaactctttagtagcacaagctcacaaccagaccatatcgagtagttccagctgcagattatttttagacgatctttaacaagttgaagaattcaagtcatgtgacatg

SEQ ID NO: 4648 - DNA, 1209 bp, Artificial Sequence
  P8150 (opLexA::G999, G999 is from A. thaliana)
ctccaatactatagctataaacatcctttataattttgtttcttttaaaggaaaatggtgagatcttgttcttcaaaatcaaagaatccttggacaaacgaagaagacacaacccaaaagtttgtgtttgcgtctgcgtccaaaaacggatgtgcagctcctaagaaaataggttacaaaagcatttctctttttcttttaattgtatgatgttgatatgatatatctatgtatatgtgtttttaccatttataggacttaggagatgtggaaagagttgcagagtgagaaagactgatcattcaggaaccaaacatgagagcttcacttctgaagacgaagatctgatcatcaagatgcacgcagcaatgggaagcaggttgtgtagatatcgcgaatcactcgaaaactctttgagattttacagattctgatgattttgtttgtgtggatatatagatggcaacttattgcacaacatttaccaggaaagacagaagaagaagtgaagatgttttggaacacaaaactgaagaagaaactgtcggaaatggggatagatcatgtcactcaccgtcccttttctcacgtacttgctgaatacggcaacatcaatggtggtggaaacctaaaccctaatccctcgaaccaagccggatctcttggacgcaatcactcgctcaatgatgatggtcatcaacaacaacctaatgattcaggagatctcatgtttcatttacaagcaatcaagcttatgacagattcatcgaaccaagtcaagcctgagtctacgtttgtgtacgcctcttcgtcttcttctaactcgtctcctccattgttctcttcaacttgttctaccatagctcaggagaattcagaggttaacttcacttggtctgacttccttcttgaccaagaaaccttccatgaaaaccaacagaatcatcctcaagaactagacagcttgtttgggaacgacttctccgaggtaacagcagctacaatggctaacacatcaaccgtaccatctcagatcgaagaagaatctttgagcaatgggttcgttgaatcgattatcgctaaagaaaaggagtttttcttgggatttccgagctatctggaacaacctttccacttttagttcatatttcagttacaaataaataagcgacctaataaagagaaagagttgcttcttataaatcttcg

SEQ ID NO: 4649 - DNA, 1989 bp, Artificial Sequence
  P8151 (opLexA::G1991, G1991 is from A. thaliana)
aaaagagaagagattaaaaacctcatccgatgatagactacgagagaagcaataccaccaagaacatcaacacccatcatcacaaccctcctccatcttcatcttcctctgatcttcttcccgacggtaatggaaccgccgtgactcagaagcggaaacggagacccgccgggacaccgggtatttaacaattttcttatcaagaattactagttgttagattctatatccggaaagttatcaaatagttctgttaaagattttgatttatccggtggcagatccggaggcggaggtggtatctttatcaccaagaacgttactagaatcggatcggtacgtatgtgagatctgtaaccaagggtttcaaagggaccagaatctacagatgcatagaagacgacataaagttccatggaagcttcttaaaagagagaccaacgaggaagtgaggaaaagagtctacgtctgtccggagccgacatgtctccaccacaacccttgccacgcgctcggagatctcgtgggaatcaagaaacacttccgacggaaacatagtaaccacaagcaatggatctgcgagcgatgctcaaaaggctacgcagttcaatctgattacaaagctcatctcaaaacctgtggcactcgcggccactcctgtgactgcggccgagttttttccaggttccattccttagtaacaaaccctagctttttaatttttatttttattatatatttaggatatatatttatcggaatccttaaagtaaatcaaagaatgttttttctagtatggcgtgtccatgttttgatttttagataacgcacatagatcttgaaacaacgtttactaatggaacctgatgaggtttgtttggatgtactgttgtctgaaaatacttttaattaatttaataattaggaactatgttttgattactcacgttgaccccataatagatttcattatcaaactttgttaagtatataccatactaaacctcgaagtcttgcatatctcatactcaaatatataatccaaaagatacctaactccactaacttaattatttatattatctgtcacgagatacaaatattcctttgtgctttccattttagtttaacttatataatacactcttatttctcagagtggaaagtttcatagagcaccaagacacttgcaccgtacgccgatcccaaccctccaaccaccgtttacatgagcagcaacaacataccacaaacgctacacaaaccgcttcaaccgcggaaaacaacgagaacggggacctctccattggtcctatattgcctggacatcctttacaaagaagacaatccccaccgtcggaacaacaaccatccactttgctctatcccttcgttactaatggtagtatcgagcttcagctacttccatcgaggaattgtgctgatgagaccagccttagtctgtctatagggacaatggatcaaaagacaatgtcggaagttgagaagaagagctacgagaagggagaaacgagcctagaaagagaggaggcgagaagagaaacaaagaggcagatcgaaatcgcggaattggagtttgctgaagccaagagaataaggcaacatgcgagagctgagcttcacaaagctcatctttttagagaagaagcaagtaggaggattagtgcaacgatgatgcaaataacttgccacaattgcaagcaacattttcaagctccggctgctttggttcctcctcctcctcagacgcattgtaccgatgagagcacgtctctggccgtgagctacatgtcttcggcgactaccgaaggagaaaaggcgagtgatagagcatcttcatagaccttgaagagagaacacaaaagaaaacaaatattcttcttttttttctttgattggaattaaagatcatcttttgatattcgttggttttcttacatattcttggtttgtgggttaccaggtttg

SEQ ID NO: 4650 - DNA, 1975 bp, Artificial Sequence
  P8161 (opLexA::G2696, G2696 is from A. thaliana)
cttaaattctctttctgactctgtaagattggtcatgcccctgccctttgagcaatttcaagggaagggggttctgggtttcttagattcttcttcttctccgggatacaaaatctgggctaatccagagaagctccatggacgagtagaagaagatctctgctttgttgtcaacaatggtggtttctcggagccgacgtctgttttagactctgttagaagtccaagccctttcgtctcttcttcaaccaccacgctgtcttcttctcacggtggtcccagcggcggcggcgctgctgctgctactttttccggcgccgatgggaaatgcgaccaaatgggtttcgaggatctcgatggtgttctctccggtggctcgccgggacaagaacagagtatttttagattaatcatggctggcgatgtagtggatccgggttcggagtttgtgggtttcgacatcggttctggatccgacccggttattgataatcctaatccactctttggatatggcttcccttttcaaaacgcaccggaagaagaaaagtttcagatttcaataaacccaaatccgggtttcttctcggatcctccgtcgtctcctcctgcgaaacggctcaattcgggtcaacccggatctcaacacctccagtgggttttcccgttctcggatccgggtcacgaatctcacgacccgtttctcacaccgccaaagatagccggagaagaccaaaacgaccaagaccagtcagcggtaatcatcgaccagctattctctgcggcggcggagctcaccacaaacggcggagataacaatcccgttctcgcgcaagggatattggcgcggctcaatcacaaccttaacaacaacaacgacgacactaacaacaatcctaaacctccgttccacagagcagcttcgtatataacagaagctcttcactctctccttcaagactcatcattatcaccaccgtctctctcacctcctcaaaacctaatctttcggatcgcagcttacagagctttctcagaaacgtcaccgtttcttcaattcgtcaacttcacagcaaaccaaacgattctcgagtcattcgaagggtttgatcggatccacattgtcgatttcgatatcggttatggaggtcaatgggcgtctctgattcaagagctcgccggaaaaagaaacagatcttcatcagctccgtcgctaaagattacagctttcgcttctccttcaactgtctccgacgaattcgagctccgattcactgaagaaaatctcagaagcttcgccggcgaaacaggtgtctccttcgaaatcgagctcttaaacatggagattctcttgaatccaacttattggccactgtctttattccgatcatcggagaaagaagcaatcgctgtgaatctcccaatcagctccatggtctccggttacctcccattgatacttcgtttcctcaagcaaatctcaccaaacgtcgtcgtttgctcagacagaagctgcgaccgtaacaacgacgcgccgttccctaacggtgtgattaacgcgcttcagtactacacatctctgctcgagtctctcgactctgggaatctgaataatgcggaagctgctacgagtattgagaggttttgtgtgcaaccgtcgatacagaaactgttgacgaatcgttaccgttggatggagagatcaccgccgtggagaagcttatttgggcaatgtgggtttactcctgtgacgctgagtcagacggcggagacacaagcggagtatttgttgcagaggaatccaatgagagggtttcacttggagaagagacagtcttcgtcgccttcacttgtcttgtgttggcagaggaaagaacttgttactgtctcagcttggaaatgttaagacgaaaaaggaggatattttcacggtttaattttctttttgtagcttttcaatttgggttagatcacg

SEQ ID NO: 4651 - DNA, 638 bp, Artificial Sequence
  P8163 (opLexA::G2712, G2712 is from A. thaliana)
cactatcttcttcatcaaattctcttgattctgtttctttttatcctcctccatggccctctcacctaattcaagctctttagatttaacaatctcaattccgagcttctctccatctccttcacttggtgatcatcacgggatgagagattttgacataaaccaaacaccaaagacggaagaagatcgtgagtggatgatcggtgcaacaccacatgtcaacgaagatgatagcaactcgggtggccggcggcgcaaaaagctccgtctaacgaaagaacaatcacatcttcttgaagagagtttcatacaaaaccataccttaacccctaagcaaaaaaaagatttggccacctttttgaagcttagtcaaaggcaagttgaggtgtggtttcaaaatcgaagagctcggaacaaaatcgacggctacaaatagaagttgaagaactacgagcgctaaagccatcatcgacctcggctttaaccatgtgtcctcggtgtgaacgtgtgactgatgcagtagataatgactctaatgccgttcaagagggggcagttcttagcagccggtcacggatgacaatttcctcttcctcttccctctgttgactggtttggtcgaagtcaaaagtcaaaag

SEQ ID NO: 4652 - DNA, 964 bp, Artificial Sequence
  P8166 (opLexA::G3074, G3074 is from A. thaliana)
gcgttttctcattcgacgatttctggatttggggatttcaaaaccatgaggaagaagctcgatactcggttcccagctgctcgtattaaaaagattatgcaagctgatgaggatgttggcaagatagctttggcagtgcctgtcttagtctcaaaatctttggagttgttcttgcaagacctttgtgatcgtacatatgaaattacccttgaaagaggtgccaagactgtgagctcattgcacctaaaacattgtgtggaaagatataacgtgtttgattttctgagggaagttgtgagtaaggtgcctgactatggccattcccaagggcaaggacatggtgatgttaccatggatgatcgcagcatctccaagagaaggaagcccatcagcgatgaagtgaatgacagtgacgaggaatataagaaaagcaaaacgcaagagatagggagtgctaagaccagtggcaggggtggtagaggaagagggcgaggaagaggtcgtggtggacgagctgcaaaagcagccgaaagagagggtctcaaccgcgagatggaagtagaagccgccaattctggacagccaccaccagaagacaatgtcaagatgcatgcgtcagagtcatcaccacaagaggatgagaagaaaggcatcgacggcacagcagcatcgaacgaagacaccaagcaacaccttcaaagtcccaaagaaggcattgactttgatctcaacgctgaatccctcgacctaaacgagaccaaactggcaccagccacaggcacaaccacaaccacaactgcagcaacagactctgaggagtattcgggctggcctatgatggacataagcaaaatggatccagcacagcttgctagtctgggtaagaggatagacgaggatgaggaagattatgacgaagaaggctaagtcataacagcactataggatatatagagtagcagcg

SEQ ID NO: 4653 - DNA, 1182 bp, Artificial Sequence
  P8167 (opLexA::G335, G335 is from A. thaliana)
gacttcctcttcattagctcaatatgtcggatgagttgtggaatgagatacaaaacctagaattaggtcaagaagatccagccctttttatccctcatgaggcttatgtgatggtggaagctaccaatagacttagtatgatagctagacctctgaacccaagggtccagaacctcaattctgttgtggtagcattaccaagaacatggggtttaacaaatcaagttcatggcagaatacttgatgctacttatgttcagtttctttttcaaaatgaaattgatctaatgatggttcaacgcaaggagccttggctttttaacaattggtttgttgcagctactcgatgggaggtggcaccggctcataacttcgttactacaattgatctgtgggtgcagattcgtggaatccctctgccatatgtttctgaggagacggttatggagattgctcaagatctgggggaagttcttatgctagactaccatgatacaacatctattcagattgcttacatacgggtgagagtgcgctttggtattacggacaggctaaggttctttcagcgaattgtctttgactccggggaaactgcaacaataagatttcagtatgaacgtctccggagaatctgcagtagctgcttcagattcactcacaacagagcttattgtccataccgaccaagacctctcagcattgcaagggaaagagctctgtttagggatagtgtgcatcgttcctccatgaactctcagtctcagatgactgatagttcatttccaattccccagactccaccaccaagaatatcccacccaccactgaatcatgatgagtttgtagctgcttatcctcacttggactcaggtaggaatgaccacatcagatgtgagggagaatcaagcaatttcagacaagacttgtcttcagcttcaaactccataactccaagaagggaaccacaatacctaactgatagaagacactttgaacctggtcaatcctcaagaagacatgatgttcgggatttaagaagagggtcagagaggattgggaatctcaatcaacagaactatgtgcaaagatcaggagggatactgaaacctccgaagaaacgctaaacactctaccaacttctgttttttttggattgaagtctgcaggttaacaaggaag

SEQ ID NO: 4654 - DNA, 1115 bp, Artificial Sequence
  P8174 (opLexA::G1764, G1764 is from A. thaliana)
gctgtctttagttggagacaagagaaggaaaacgtaaatcgaaatgggttcttcgtcgaacggaggagtgccacctggtttccggtttcatccgacggacgaagagcttctccattactacttgaagaagaaaatctcttaccaaaagtttgagatggaagtcatcagagaggttgacttaaacaagcttgagccttgggatttgcaagagagatgcaagataggatcaacaccacaaaacgaatggtacttcttcagccacaaggacaggaaatatccgacggggtcaaggaccaaccgtgctactcatgcagggttctggaaggcgacgggacgtgacaagtgcataaggaactcttacaaaaagataggaatgaggaagacacttgtgttctacaaaggtagagctcctcatggccaaaagactgattggatcatgcatgagtaccgtcttgaagacgctgatgatcctcaagccaaccctagtgaagatggatgggtggtatgtagagtgtttatgaagaaaaatttgttcaaggtagtaaatgaaggtagctcaagcattaactcattggaccaacacaaccatgacgcatctaacaacaaccatgcacttcaagctcgtagctttatgcaccgagacagtccataccagctagtacgtaaccacggagccatgacattcgaacttaacaagcctgaccttgctcttcatcaatacccaccaatcttccacaagccaccttcacttggatttgactactcttcaggacttgcaagggacagtgagagtgcggctagtgaagggttacaataccagcaagcgtgtgagccgggtttagacgttggtacatgtgagacagtggctagtcataatcatcaacaaggtctaggtgaatgggcaatgatggatagacttgtgacttgtcacatgggaaatgaagattcctctagagggattacgtatgaggatggtaacaacaattcgtcctctgtggttcagccagttcccgcgacgaaccagctaacattgcgtagtgagatggatttctggggttattctaaatagatgtttatatgtctttcttatgagtctacgacaatataagtgttgg

SEQ ID NO: 4655 - DNA, 816 bp, Artificial Sequence
  P8177 (opLexA::G3060, G3060 is from A. thaliana)
caatttgatttctactctcgtatcggatctatacttaatcatggatactcgtaagagaggacggcctgaagctggctcattcaactccaatggcggcggatacaagaagtctaagcaagagatggaatcatattcaactggtttaggaagcaaatcgaagccatgcacaaaatttttcagtacttctggctgtcctttcggagagaattgccatttcttgcattatgttcccggaggatacaatgctgtatcgcagatgacaaatatgggaccacccattcctcaagtttccagaaacatgcaaggttctggtaatggaggccgattctcagggaggggagagtctgggcctggccatgtctctaactttggtgactcagccactgccagattcagtgttgatgcctctttagccggtgcaatcattgggaaaggcggagtcagttcaaagcagatatgtcgtcagacgggagtaaaattatcaattcaagatcacgagagagacccaaacttgaagaacattgtgcttgaaggaacacttgagcagataagcgaagcgagtgcaatggtaaaagatttgattgggaggcttaattcagcagctaagaaaccacctggtggtggtcttggtggtggtggtggcatgggttctgaagggaaaccacatccagggagcaacttcaagactaagatatgtgagagattctcaaaaggaaactgtacatttggtgatagatgtcactttgctcatggggaagcagagctacgcaagtcaggaatcgtctagttgttgcttgcagatagagaatttgctgg

SEQ ID NO: 4656 - DNA, 2194 bp, Artificial Sequence
  P8178 (opLexA::G2887, G2887 is from A. thaliana)
ctttactggtgaagagtttacagaagattgttcaaagttttcccctttggattcttcgccaatggggaaaactcaactcgctcctggatttcgtttccatccgactgatgttgaactcgtgaggtattacttgaagaggaaaatactggggaaaaagctccttgtcgatgctattgctgaagttgacatttacaagtttgaaccccctgatttacctggtatccatttctaaaacactcttgttctgttcatgtgtttgcatctaagttctctgactcggagacttgttctttacagatatgtcttttataagaagtggggatcttaagtggcacttcttctgccccagggaaaagaagtatgctagtggggtaagggcaaaccgtgcaactgagtgtggctactggaagaccacggggaaggagagaccagttctgtgcaattctgaggttgtgggaaagatcaaaactctggtttatcactttggcaagtcgcctcgtggggagcggactgattgggttatgcatgaatacaggcttgacgacaaagtactgacgcagatgaatgttcctcaggtaatatatactacttattataaatggcaaatatgatttcaacttgaacaggtgtttaggtttacgagtatttactgatgatagcttgccgttttaatttgttccttaattgctttgatagtgtgttactgtcctgcctgcaattttttccttcttccacttatatattgtttcctgcttgtttagttttatagatttatgtatcatccatgtaagcttatatcactctctctttacttacaattatgttttggactgcaggatacttatgtggtgtgtgttctgttcaagaaagatggtcctggacctagaaatggagctcaatatggagctccgtttaaggaagaggactggagtgatgaggaagtacgtactgatgttccttctactagtaatcccacaaaccttcttgagcctagcaaagaaaccactctggctttgactgccccagatgactccaataaggattgttttggtggcatgatatcagagtcatgtgtctcggatttcctaccagctacaactaataccaccagcgagcttccacatccaagtgatgcagctaccactcctatgtctactgcacctctggcagagaccgttcagacccccaacaatgatgacttatattcaatgttggatctatttgatgatgacgaagagttcttagggttcaacaataatgaggtagtttttttttgcattcttcttctttggcttagtatagtgataacaagccggtgtcactgcatgttcttaagctagcaaggctactttaaagctgttaagtgttttagtggcattggaacgtagtagttacccattagacaaagcttctttgctatatcttcgatcttagtatccaacatcaatatgtgctcttttgtatctgcttgttctccaacatcaatatgtgctcttttgtatctgcaaaatacattctcatatttaatcaatctacaggtaagatatgatcccggtgtctcagctccagtttgcttagaagaagaaggcattttcaacggactaccagagttgagcagcatgccaaggacggcctcttacgacctagttgaaaactcggagttatacctagagctacaagacctcactgctccattaaatccccaaactgggctacaagacctcactgctccatttaatcctcaaactgggctacaagacctcactgctccatttaatcatcaaactgggctacaagaccacactgctccatttaatcctcaaactgggctacaagaccacactgctccatttaatcatcaaactgggctacaagacctcactgctccatttaatcctcaaactgggctacaagacctcactgctccatttaatcctcaaactgggctacatgacctcacttctccatttaatcctcaaactgggctacaagacctcactgctccattaaatcctcaaactgggaatcgcaatgacccgagaagctcctcctttctgtataatcaaggccattttgacttctctggtggtaatgatgatgatccttatggcttttctgcttccatgagacatagaccaaaaatgtaaaaaaagaagaagagaagagaagcaggatttacaaatccaacagatgc

SEQ ID NO: 4657 - DNA, 1679 bp, Artificial Sequence
  P8197 (opLexA::G2, G2 is from A. thaliana)
tctctctctctctttagctctttttttttttttgttttcattaaagtttttattttattttctaccaaccaaaagcttttctctttggtttctcttatttagcttctaaccttgaggagaatataccagaggattgaagtttgaaccttcaaagatcaaaatcaagaaaccaaaaaaaaacaaaaaaaatgtgggatctaaacgacgcaccacaccaaacacaaagagaagaagaatctgaagagttttgttattcttcaccaagtaaacgggttggatctttctctaattcaagctcttcagctgttgttatcgaagatggatccgatgacgatgaacttaaccgggtcagacccaataacccacttgtcacccatcagttcttccctgagatggattctaacggcggtggtgttgcttctggctttcctcgggctcactggtttggtgttaagttttgtcagtcggatctagccaccggatcgtccgcgggtaaagctaccaacgttgccgctgccgtagtggagccggcacagccgttgaaaaagagtcggcgtggaccaagatcaagaagttctcagtatagaggtgttacgttttaccggcgtaccggaagatgggaatctcatatttgggactgtgggaaacaagtttacttaggtggatttgacactgctcatgcagcagctcgagcatatgatagagctgctattaaattccgtggagtagaagcggatatcaatttcaacatcgacgattatgatgatgacttgaaacagatgactaatttaaccaaggaagagttcgtacacgtacttcgccgacaaagcacaggcttccctcgaggaagttcgaagtatagaggtgtcactttgcataagtgtggtcgttgggaagctcgtatgggtcaattcttaggcaaaaagtatgtttatttgggtttgttcgacaccgaggtcgaagctgctagagcttacgataaagctgcaatcaaatgtaacggcaaagacgccgtgaccaactttgatccgagtatttacgatgaggaactcaatgccgagtcatcagggaatcctactactccacaagatcacaacctcgatctgagcttgggaaattcggctaattcgaagcataaaagtcaagatatgcggctcaggatgaaccaacaacaacaagattctctccactctaatgaagttcttggattaggtcaaaccggaatgcttaaccatactcccaattcaaaccaccaatttccgggcagcagcaacattggtagcggaggcggattctcactgtttccggcggctgagaaccaccggtttgatggtcgggcctcgacgaaccaagtgttgacaaatgctgcagcatcatcaggattctctcctcatcatcacaatcagatttttaattctacttctactcctcatcaaaattggctgcagacaaatggcttccaacctcctctcatgagaccttcttgaatcttttatatttttaaggtttattattatataagaaaaacaaaaatgaacctttgaaatccccacatgttcttggtcatttcattaatcatcggcttatattttgcttattttcccctaaatcctcttgttaacttaggcgaacaaaaaaaattaatggaaatctttttccctccatcggttacaaaaata

SEQ ID NO: 4658 - DNA, 1552 bp, Artificial Sequence
  P8206 (opLexA::G421, G421 is from A. thaliana)
aattctctttggaacgttgtgttgtctgaaatcttcccaaaggttctatcagaagaagaaggataaagtttcatagaaacccaatggacaacaacaacaacaacaacacttttagttctctggataatgtcatgactaaccaaaatcctcttctcatggattttataccttcaagagaagattcaacttcattctcaacaatgcttccatggaataccatcagatcagatcctctacaaatgggtggctttgatattttcaattctatgctgactaacaaatacttatcatcttctccacggtctatcgatgttcaagataaccgcaatgttgagttcatggctcctcctcctcatcctcctccacttcatcctttggatcatttaagacactatgatgattcctcaaacaacatgtggggttttgaagcaaatagtgagtttcaggcattttcaggtgtagttggtccaagtgaaccaatgatgtctacattcggtgaagaagatttcccgtttctaatttcgaataaaagaaacaatgagctttcattgagtcttgcatcagatgtttctgatgaatgctcggagataagtctttgtgcagctacaagattagcctcagagcaagcttcttgcagcagcaaagacatttctaataacgttgttactcaaggtttctctcaacttatatttggctcaaaataccttcactctgttcaagaaatactatctcatttcgccgcatactcgctcgattattcatctcgaggaaccgagtcaggagctgctagttcagcctttacttcacgttttgagaatataactgagtttcttgatggtgattctaataactcggaggcgggtttcggatctacatttcaaaggagagcattagaagcaaagaaaacccatctcttggatcttcttcaaatggtggatgatcgatatagtcattgcgtagatgagattcatacggttatatcagcgttccatgctgcaaccgagttagatccacagttacacacccggtttgccctccaaaccgtttccttcttatacaagaacctgagagagagaatctgcaagaagataatctctatgggatctgtattggagagaggcaaagacaagactcaagaaacctctatgttccaccagcattgccttcttcagcagctgaaacgaaagaaccatcagatttggagacctcaacgaggtttgcctgagaaatctgtttcggttctacggaattggatgttccaaaacttccttcacccttacccgaaagattcggagaaacatcttctagctatacgaagtggcttgacaagaagtcaggtatcaaactggtttataaatgcgcgggttaggctatggaagccgatgatagaagagatgtatgcggaaatgaacaagaggaagctcaataacagtcacattcaacccaacggaccaactcttcgaatgccaaaatctgttatgatgagccaagcaatgcataaataagacaacaattgtgtttaccaactttgtgataattaggcaattgctac

SEQ ID NO: 4659 - DNA, 1572 bp, Artificial Sequence
  P8209 (opLexA::G2304, G2304 is from A. thaliana)
catattggatgttggatgtggagtggcgagctttggcggtttcctctttgaaagagatgttatagcaatgtctcttgcaccaaaagatgaacacgaggctcaagtccagtttgctcttgaaagaaagattccagccatctcagcagttatgggctctaagcgactgccattcccgagcagagtgtttgatcttatccactgtgcacgttgtagagtcccatggcataatgagggtggtatgcttcttctggaacttaatcggatgcttaggcctggaggttattttgtctggtcagcaacaccagtctaccagaagcttgaagaagatgttcaaatctggaaaggtaatgactaaagtaaaatgcttgaacttaactagagttcctccttcttttgtttgtttcactgaacctgagatgttttgagtgatgtagaaatgtccgcgttgacaaaatccttgtgctgggaacttgtgacaatcaacaaggataaactcaatggtattggtgctgcaatctaccagaaacctgccaccaatgaatgttacgagaaaagaaagcacaacaagcctccactgtgcaaaaacaacgacgatgcaaatgcagcctggtatgattgtttccacaatttgcatagggaatgaataaccataaggttttaacagaacaaagaaagtcaaaacttgaatggaaatttcaggtatgtacccctacaagcatgtatgcataaagttcctaccaatgtggtcgagagaggaagcaagtggcccgtgaattggccccgtcggcttcaaacaccgccttactggttaaacagctctcaaatggggatatatgggaaaccagctcctcgagatttcactacagattatgaacactggaaacatgttgtaagcaaagtatacatgaatgaaataggaatcagctggtcaaatgtgaggaatgtaatggacatgcgagctgtctacggagggtgagcatcaacgaaaacaaatcaaactaaaatctcacttaccaaaactaaacctttttttactaactacgtaaaaatgcaggtttgcagcagctctgaaggacctacaggtgtgggtaatgaatgtagtaaacataaattcaccagatacactaccgataatctacgagagaggcctattcggaatatatcatgactggtgtgaatcatttagcacataccctcgaagctatgatctcttacatgcagatcatcttttctcaaagttgagaacaaggtataagcgtaactcataatatccacaccttttggtaacgtttcatcaacaataagtctcttgttttgttttgttttgaaaggtgcaatcttgttccagtaatggcagaagtggatagaatagtaagaccaggaggtaaactaatagttcgtgacgaatcaaatgtgataagagaagttgagaacatgttgaagtcactgcactgggatgttcacttaactttctccaaacaccaagaaggaatcttaagtgcacaaaaaggattctggagaccagaaacttctcaatgaaagacgctctgagaatctgcatttgaaagtagc

SEQ ID NO: 4660 - DNA, 2231 bp, Artificial Sequence; identical to SEQ ID NO: 805
  P8215 (opLexA::G2750, G2750 is from A. thaliana)

SEQ ID NO: 4661 - DNA, 2244 bp, Artificial Sequence
  P8220 (opLexA::G3041, G3041 is from A. thaliana)
ccttgtgtttgagttttggtccatcgagtatatgggtcgtggctcagtaacatcgctcgctcctgggtttcgttttcatcccacagacgaagaactcgttcgttactatctgaaacgaaagatctgcaataaaccttttaagttcgatgctatctctgttaccgatgtatacaaatctgagccttgggatctcccaggtcagttcttcaatatgttgatgatttgatcgatattgtataggaaccgatgatagaatttgaattctgttttgtattttggtgggaaatagacaagtcgaggctgaaaagtagagacttggagtggtacttcttcagtatgcttgataagaagtatagaaatggatcaaagacgaatcgtgcgactgagatgggatattggaagactacagggaaagatcgagagattcttaatggttcaaaagtcgttgggatgaagaagactcttgtttatcacaaaggtcgagctcctcgtggcgaaagaaccaattgggttatgcatgagtatcggttggttgatcaagaccttgataaaactggtgttcaccaagtaagactttgatctttttgagttccttgttgtttaatgggatttgtgttgttgactttgttgtggaattgtgggaaggatgcgtttgtgctttgtaggatttttcagaagagtggctccggacctaaaaatggagagcagtacggtgctccgtttgttgaggaggagtgggaggaggaggatgatatgacatttgtacctgaccaagaagatcttggaagtgaagatcatgtttatgtccatatggatgacattgatcaggtttgtgttctagtatttgatatctcttgattagcttttggtcgaatgttgtgttcctttgtattcattgaggaatgaaagaagcttgtgaaaatctctccttctcattccctgatttggtcagagttccatctaggctgtttattatgttcttctaattttatgattcgaattttatatcttgcagaagtctgaaaactttgtggtctatgatgccattcctattccgttaaactttattcacggggagtcgagcaataatgttgaaacaaactactcagactccataaactatatacaacaaacaggaaactatatggactctggtggctactttgagcaaccagcagaatcttatgagaaagatcagaagcctatcatccgtgaccgtgatggtagccttcaaaatgaaggaattggatgtggggtccaggacaagcactcggaaactttgcaatcttctgacaacatctttgggactgatacatcatgctacaatgattttccagttgagagcaactatttgattggtgaggcgtttctggatccgaacagtaatcttctggagaatgatggtctgtacctggaaacaaatgatctcagtagtactcagcaagatggtttcgactttgaagattatcttaccttctttgatgaaacttttgatccttcgcaactgatgggaaatgaagatgtttttttcgatcaagaagagctctttcaagaggtataaaactttctatttccacttgcttttgtttcctttattttttaactcacgtttcaaccaataggttgagactaaggaactagagaaagaggagacttcaagaagcaaacatgtggtggaagaaaaggaaaaggatgaagcatcttgttcaaaacaagttgatgcagatgcaacagagtttgagccaggtaaagaattatgttaccacaatcagactttacccccatttgttaataggtgtgacgtgttctgtttagatgatggatcaatttctgaaaatgcagattacaagtacccgttactaaagaaggcaagccacatgttgggtgctattcctgctccgcttgcaaatgcttctgagttccctacaaaggatgcagctatccggttacacgcagcacaatcatcaggttcagttcatgtaaccgcaggtatgatcacgatatcagacagcaacatgggctggtcatacggcaaaaacgagaaccttgacttgatcctttctttggggttggtccaagggaataccgcccccgaaaaatcagggaatagttcagcatgggcaatgttaatattcatgtgtttctgggttcttctactctcagttagtttcaaagtgagcattttggtctcttccaggtgataggtaaccctttcttgttcaaacaagacttttgtgtttgtac

SEQ ID NO: 4662 - DNA, 1951 bp, Artificial Sequence
  P8221 (opLexA::G2985, G2985 is from A. thaliana)
gctttaatttaacggtcacactatatcatcggttttatcgaaatggaattcggcgacggcgtttccttcgccgtcgtccccactgtcttcaaaagagaagactacaaacgaactaaacacgacaccgtcttctccaagtggcaggtcctctgtctttctctttctcgatttgtagattgagaattttcgctcgatcttgtgttttctctgaaacccatttcggaattctcagattttcagttgaatcgaaaaatctgatcttccatttccaggatttcagtgtaaagatcccattttgaatgcctagtgtgtctgctttgtcccaaatgcattttctctggatttctgttagaattggtcgctaactatatgtatatctaattagcctaattctgtttcatttgctacttgaagtggttggttttagatcttagttttatctgattgtgtaaagtttgatgctgcacaggtacttataggatccaacgattgggaagatttcaaaaacggaaaagatggtgtaggtagatacagagtccagaacttacctcgtaaatcttgtccgggtctgtatgagctcggtgtagcggtcatcggtcaagaacaatgtcgaaagcttgaaccagatattgttcttgcttcatatctaggacaagctgaaagtgttaggtctagacttcagcgttatggaagatccggtgctcatttgcgcaatgttaacaaccttaacgactgtgaaactattgaatctccagttaaggctgttactggaggtttatttgaagacatattttcgaaaggaggctcgattttatacagatgggctccggttagtaaatacatttcttcttttcttctatattggtttgctaagtatacaactttgatctaactcatgtgattgtatcagatgggatctaagagagaagctgaggcaacagaagggatgctcttgagcacatttgactatgcttggaacaaaggaagtaacggggagcgaaggcagcttgatttgcttaagaagctcggtgatcgcgagtttatgagcaagagaaagtccggtatatctcgaatgctgtttccttttcttcggaaccaagttggtatcagaataaaaggagagaagcatgtgcttaaagaagagaggaagctaacctgtgatgttgatgaagagaagagtaataatttcctcacttcaatactcaaactcacccggtctagacctcaaccggtttcagacagatttgatgaggttgatggttcttgttctgatattgtttgtggagtcttacttgaagatggtggctgttgcattagaagtccagtcaaagggagaaagagatgcatagagcataaaggacagagagtttgccgtgtttcacccgaaaaacagacaccgccaaagtccgagattttcactggacaagatcatcacaatcataaagactctgatgttgtgtgtggagtgatcttacctgacatggaaccttgcaataagagacctgttcctggaagaaaacgatgtgaggatcataaaggcatgaggatcaatgcttttctttttcttcttaaccaaactgaccgtgagaaaaccgtcaaagacgagaaacctgatcccgaatcgcataccgagtcaatcgaagaagaagctttgactcgcttctgtgaagctacaacaaagaatgggttaccttgcacaagaagttctcctaaaggaagcaaaaggtgttggcaacataaggagaaaacttccagcgatacttcgccggtatattttcagccagaggcagcaaaaaacgtagcttgtggagttaaattaggcaatggattgatctgtgagagatctccggtaaaaggacgtaagagatgtgaagagcataagggaatgagaatcacctaacctctgcatcacttgtttatgttatttgttacctaaccagaattgtttgta

SEQ ID NO: 4663 - DNA, 1278 bp, Artificial Sequence
  P8222 (opLexA::G961, G961 is from A. thaliana)
aacctcacatgctctattcttgcttgatttttgagttaatcttgaatctctttgatgatgtcaaaatctatgagcatatcagtgaacggacaatctcaagtgcctcctgggtttaggtttcatccgaccgaggaagagctgttgcagtattatctccggaagaaagttaatagcatcgagatcgatcttgatgtcattcgcgacgttgatctcaacaagctcgagccttgggacattcaagagatgtgtaaaataggaacaacgccacaaaacgactggtatttctttagccacaaggacaaaaaatatccgacgggaacgagaactaacagagccactgcggctggattttggaaagcaactggccgcgacaagatcatatatagcaatggccgtagaattgggatgagaaagactcttgttttctacaaaggccgagctcctcacggccaaaaatctgattggatcatgcatgaatatagactcgatgacaacattatttcccccgaggatgtcaccgttcatgaggtcgtgagtattataggggaagcatcacaagacgaaggatgggtggtgtgtcgtattttcaagaagaagaatcttcacaaaaccctaaacagtcccgtcggaggagcttccctgagcggcggcggagatacgccgaagacgacatcatctcagatcttcaacgaggatactctcgaccaatttcttgaacttatggggagatcttgtaaagaagagctaaatcttgaccctttcatgaaactcccaaacctcgaaagccctaacagtcaggcaatcaacaactgccacgtaagctctcccgacactaatcataatatccacgtcagcaacgtggtcgacactagctttgttactagctgggcggctttagaccgcctcgtggcctcgcagcttaacggacccacatcatattcaattacagccgtcaatgagagccacgtgggccatgatcatctcgctttgccttccgtccgatctccgtaccccagcctaaaccggtccgcttcgtaccacgccggtttaacacaggaatatacaccggagatggagctatggaatacgacgacgtcgtctctatcgtcatcgcctggcccattttgtcacgtgtcgaatggtagtggataacggaaatggagggaaagagagagaggcacacacacataagacatttcacatttgtgtaaaaagatataatcataccatatagttgttgaaacatataaaagaaagtcagatttgtgataattacag

SEQ ID NO: 4664 - DNA, 2734 bp, Artificial Sequence
  P8224 (opLexA::G1772, G1772 is from A. thaliana)
caccggaactgtgatctcaccggaatatccctcctttatttatcctctactcatccgttttactctctccctccgtcgatcttctctttctcttgatcgcctccgtccattctttatcatttcttaattcagaattgtgatcgatggatgattattttagcgcggaggaagaggcttgctattactcctccgatcaagattctttggatggaattgataatgaagagtctgaattgcagcctctgtcctctaaaagatcaaacactcaggttctcttatatacactcttcttcctctcttcattcttctatctctttcttcttaatatccgtgattgtttcatatttggttgttattggtaattctcttccccctcaatttttgtgggttgttgatatttcgtgaaaattttgaaccttttcaaagtgaatttcattgcaattgtgagattgaaaatctggttccggcatcattgttcatctgaatttctcatttttcacagtgtttaggattctaatttattgcagaattgttctgttctgttcttctctgtttgaaattagggtttgttaacagttattctacaattttgcaggtcatcactcaggaatcgcttctagcagcacaggtaaaatcagcagagatgattttactctcgggtttaattttaagctttagtttggtttgagttattggttttctgatgcagagagaagatttgctaagggtgatggaattgttatcaataaaggagcaccatgcacggactcttcttattcattaccagtgggatgtggagaagttgtttgctgtgtttgttgagaaaggaaaagatagcttgttttctggagctggtgtcactgtcttcgattatcaatatggcaactcttcctttcctcagtcttcacagatgagttgtgatgtttgcatggaggatttaccaggtgatcacatgacaagaatggactgtggccattgcttttgcaataattgtgagtaccctcttgctgtaatttgttgcaaaggttgacatatgatgtaacacagttcttgtttcgttttaggttggacggagcattttactgtgcagataaatgaaggtcagagcaaaaggattagatgcatggctcatcaatgtaatgctatttgtgatgaagatattgtcaggagtctagtcagtaaaaagcgtccagatctagctgcgaagtttgatcgttaccttcttgagtcgtacatcgaagataacagaatggtcaagtggtgtcctagcactccgcattgtgggaatgctatacgagctgaggatgacaagttgtgcgaagttgaatgttcttgtggtcttcagttctgtttcagttgtctgtgtcaagcccactccccttgctcttgtttgatgtgggagttatggagaaagaagtgtcgagatgagtctgagacaatcaactggataaccgttcacacaaagctgtgtcccaaatgttacaaacctgtggaaaagaatggtggatgcaatctcgtgaggtgtatttgtgggcagtgtttttggtaagaactcgagccttgtttcctcaatgcttttttttcctattttgcatttgttttttctatgctttgagacgatcaaatgtcaaatggtggaagtgtctctcatgtttggttattaaaatgtacagttggctatgtggtggagctactggaagtgatcacacttataggagtatcgctggtcacagttgtggtcggtaccaagatgacaaagagaagcagatggaaagagcgaagagagatttaaacaggtatacgcattatcatcaccgatacaaagctcatacagattcatcaaagctagaagataaacttagggatactatccatgagaaagtgtcgaaatcagaaaagagggagttgaagcttaaagacttcagctgggtcaccaatggactcgaccggttattcagatcaaggcgagttctttcatattcgtatgcttttgcatattatatgtttggtgaagagatgtttaaagatgagatgacccctgaggagagagagataaagaagaatttgtttgaggatcagcagcaacaacttgaaagtaatgtggagaaactttcgcagttccttgaggagccctttgatgaatttagtaatgataaagttatggcgataaggattcaaatcatcaatttgtctgtcgccgtcgatacactctgcaagaaaatgtacgagtgcattgagaatgacttactcggatctctccaacttggcatccacaacatctcaccttacagatcgaagggaatcgaacaagcagctcagttttatgcttcctggaattccaaagatgctgacaaattccaacctttggatagtggtacaagcggtaatcaactctcggtgaacgatgatcattgtattctagtaacgaatcaatgaatcaaaatcctaatgagtgataaatatttttatacaggagtgacatcgaggcctgagcaagcttcaggatcaaggagctcggaagacaccatttgctcatcttcacagaaacgtcccaaaaaagaaggaagtttcttaaacaacaaagtcactttattggatttgaacttgccagctgatttcgtcgaccagaactgaactcaaatcctctcttgcttagtccaaatgagatatgatgacatagcaaaaggtgtttgactatatatctatcaccttcaagactcgtgactctggactg

SEQ ID NO: 4665 - DNA, 1331 bp, Artificial Sequence
  P8225 (opLexA::G379, G379 is from A. thaliana)
aatggagacatggtggctaaagtgaagagagaaacggtggtggcatgcatgacttgtcctctctgtgacaaactcctccgtgacgccactaccatttcagagtgtcttcacacgttttgtaggaaatgcatttatgagaaaatcacagaggatgagatagagagctgtccagtatgcgatattgacctcgggggtaccccactggagaaactaaggcctgaccacattttgcaagacttgagagccaaattatttcctctaaaacgtaaaaaggagagagcgcctgaagttgtgtcctccatctcattacctgcaaagaggaaggagaggtctatctcgtctttggtggtaagcacacccagggtttcagcacaagctggtacaacaggaaaaagaacaaaagctgctacgagaaaagatgtaagaggtagtggttcattcactaagagaacagtgaagaaggaagaagaatttggagatgatcatgtagagagcgcaagctcgcctgaaacacttaaaaagtttactcagaataaaagacagtcttcatatgcaaatcctaaccagtccctctctaatcgaagaaacaaggatgttgatgaaccatgggattccaaattacatctttggaaacctctaaattttcttgtggatgtggcaaacggaacaaaggacccaaaatctgagcttggaaacgcatcccacaatgatgttcaggggagtaaaaccaaaacaaaggatcataaaagaaagtgtaaactcgaggaagagatcagcaataacggtgatcctacaacatcagaaactgctacacttaaacgaacgcgtcggactcgtcgcaaaaggtcatctacttttggtgattctagaattccactgttaccaggtgcagcaagcctaaaacaggagaggagaaacggtcatgtttggttctcacttgtagcgtcaagtaatcaggaaggagaagcatcattgcctcagattccagcaaactacttgagaataagggatggaaatattccagtttcttttatccaaaagtacctcatgaggaagcttgatctcaagagtgaagatgaggtagagataacatgtatgggagaaccagtgatcccaacgttgcagcttcacagcttagtagacctatggttggaaacaacttctaagcatcaaagagtcgctgcgtcaataggttcatctgcaaaggaatttgtaatggtgctagtttattctcggaagctccctgaatgcaacaactaaagagctattcattgaatcttttctagaccgagaagaaagaaaagtgcaggagcagtggaatgtcttgtgta

SEQ ID NO: 4666 - DNA, 1156 bp, Artificial Sequence
  P8226 (opLexA::G2092, G2092 is from A. thaliana)
aaacatgccgaatgagaggaaagaacggtccgtatctcttgataagtataaacgatcgccactgtgttgtgaggcaagccttgctttgaagccgagtgagaaacaagttaaggaatgggaagaggctcgttgtcctgtttgtatggaacatcctcacaatgggattcttctcatttgttcttcttatgaaaatggttgtcgaccttacatgtgcgacactagccatcggcattctaactgtttcgatcagttccgcaaagcttctaaagagaaaccttctttgtctttacttcgtgaggaagaggaaagtaatgaaccaactgagatggaagatgtggattcagactcaactgctgtaaatctattaggagaagctgcatctgagataacagttgtggatttaagtgatggtgagagaggagaagaagaagtagaagaagaagaagaagaagtagtagtagaagaagaagaagaaggaattgtaacaacagaagaagatcaagaaaaaaacaaaccacaaaagcttacttgtccgttatgtcgtggacatataaaagaatgggtagttgttaaagcagctcgatgtttcatgaactcaaaacatagaagctgttcttgtgagacttgtgatttcagtggaagctattccgatctgagaaagcacgcaaggcttctacatccaggagttaggccatcagaagcagatccagagagacagagaagctggaggaggctagaaaggcagagcgatttaggggatttacttagcacactccaatcttcttttggaggagatgaaataagtaacgatgatgggtttctatttgctgatactcgcttgcttacagtgtactttctcatccgcgtgtttagaccagaatcgagtggctcaaggagtagtagctggtctggtacatctagagctaggacacatacaagtgggagaagaagatcttcaagacctgcaagtctttggggagagagctatgaaggtaatacaggaacatcacctagagatgaggagaataatcaatcttctgatgaacaagtgtctggaactcggagacgtcgttctagaagaagaactgtcattgatgatgatgatgaagaagaagaaccgtgatgctctgcagtttggaaatttggtctttggagt

SEQ ID NO: 4667 - DNA, 1114 bp, Artificial Sequence; identical to SEQ ID NO: 47
  P8230 (opLexA::G1098, G1098 is from A. thaliana)

SEQ ID NO: 4668 - DNA, 500 bp, Artificial Sequence
  P8232 (opLexA::G1113, G1113 is from A. thaliana)
tctttctctcacactcatgggtcttccaacagatttcaaagagcttcagattccaggttacgtactaaaaacactttacgtcatcggtttctttagagacatggtcgatgctctttgtccttacatcggtctaccaagttttcttgaccacaacgagacctctcgatccgacccgacccgactcgctctctccacgtcagcaactcttgccaacgagttaatcccggtggttcgtttctccgatcttttaaccgatccggaagattgctgcacggtttgcttatccgattttgtatccgacgataagattagacagctgccgaagtgtggacacgtgtttcatcatcgttgtttagaccgttggatcgttgactgtaataagataacgtgcccgatttgtcggaaccggttcttaccggaggaaaagtccacgccgtttgattggggtacttcagattggtttagagatgaagtggagagtaccaactaataatgatggt

SEQ ID NO: 4669 - DNA, 547 bp, Artificial Sequence; identical to SEQ ID NO: 245
  P8233 (opLexA::G1530, G1530 is from A. thaliana)

SEQ ID NO: 4670 - DNA, 869 bp, Artificial Sequence; identical to SEQ ID NO: 315
  P8234 (opLexA::G1730, G1730 is from A. thaliana)

SEQ ID NO: 4671 - DNA, 831 bp, Artificial Sequence
  P8235 (opLexA::G1736, G1736 is from A. thaliana)
aatcgcactatccttcgcgagacccttcctctatatagggaagttcatttcatttggagaggacacgctgacaagctgactctagcagatctggtaccgtcgaatcacgagtgtgtacaaaaaagcaggctccgcgggcgcccccttcacctgtgcttcaaggactgttgttcgctactcttgcttaattattactatagctggtgaaaatgggaggttgctgtagttcttcgaggaagtcacatcttgttggaacacctgtttactattattgtccagaatcttttgaagagcttgtcccttcaggaacccgtgctggtgtgggatcagcattcaccacaggcctcttggttgatataggtttggagacatctatacctgacaccttttgtgctcctgctcctcttccatatgatttgcttttggggcgaccacaatgcacagattctgagtccatcaaaggaaggatgagtggaagcagttttgaaacgctagcgacgtgtgaagatcttggggaatcagactgtaaaactctagccagctcagtcattctttcaccgaggaaatcagatttctcgaaacatcaaggattgaagatattggttgatgaagaggaggactgttgtcctatttgctttgaagattatgatgttgagaatccaagactaacgacaaagtgtgagcacgaatttcacctctcttgtcttctggagtggattgaaagaagcgatagatgcccaatatgtgataaggaagttgtgtttgatgatcgcttgaactagcatcattactatcccctggcttgaaagtttgaaggtgtggcgctttgtt

SEQ ID NO: 4672 - DNA, 515 bp, Artificial Sequence
  P8236 (opLexA::G2226, G2226 is from A. thaliana)
tatcgaatccaacaagtgaaagatgggtctatcaagtcttcctggtccatcagaaggaatgttatgtgtgatattagttaatacagcattatcgatctccattgtcaaaggcattgtaagatcattccttggcatagtaggaatcagtctctcgccgtcttcatcctcgccttcttcggtgacggtatcttcagagaattcatcaacttcagagtcatttgatttccgggtctgccaaccagagagttaccttgaggagttcaggaaccggactccgacactgaggtttgagagcttgtgcaggtgcaagaaacaggcagacaatgagtgttctgtgtgtttgtcgaaattccaaggggattcagagatcaacaagctcaagtgcggccatttgtttcacaaaacatgcttggagaaatggatagactattggaacatcacttgcccattgtgtaggactcctcttgttgttgtgccagaagaccatcagctttcttctaatgtttggtgactgc

SEQ ID NO: 4673 - DNA, 1653 bp, Artificial Sequence
  P8237 (opLexA::G1847, G1847 is from A. thaliana)
gctatcacatctcttcaccttcaatgtcaaaagtttttccaaaaaattcataactatttcttccggtcaccgtaaaccggggttttaccgcctttcgaatttactcaagacactaaaagtaacatggaaatgatgaattgggagcggaggagtttgctaaacgagctaattcatggactaaaagcggccaagcagcttcagggttcgtcttctccatcgttgtcagcttcttcttcatatttgacgacggagataaaggagaatctcttacataacatagtttcttccttcaaaaaagctattttgatgctcaacggatccaccacacaacacaatccaacgatagagcttgcgcctgatcccctagctcatcccggaaaggttccaggatctccagcatcgatcaccggaaatccgagaagcgaagagtttttcaatgtaagatcgaaagaattcaacttaagttctaaaaagaggtaaaaatttgaacttaaattagcgttataaagaagagaaaagcttattaaaatttaataataataataataatattagaattcaaaaaaaatagccagattttttgaattagagatttgacaattaatgaaaatttgcaggaagatgttgccaaagtggacagagcaagtgagaattagcccagagagaggcttagaaggacctcatgacgatatcttcagctggagaaaatatggccagaaagacattttgggcgccaaattcccaaggtacatcatcatactctatcatcatcatcataatcatcatgtttacgaatagtacatttgttaaaagattggttaatagcagcggataaatgttgagtataattatatgagtaatatatacctaaaattactattcaaagtgtattctcatattaaaaactattttgcataatttaaatatcgaatatgtaatgaataattctgaatataatacaagataaattagatatttaaaattattatccgagtttgctatatgaaggtcggatttgtatataatcagatagttttttttggctaaatttacgtggctttaagaagaagaaaaaattagttttagttttactaatttaggactaatttgtgtttttattgcaggagttattacagatgcacatttcgtaacacacagtactgttgggctacgaaacaagtccaaagatcggacggtgatccaacgatcttcgaagtaacatacagaggaacacacacttgttcacaggggatcccacttccagagaaacgagaaaccaaaccaaaacacacagtagcagtaaattaccagaatctcagggccagtcttaccgtacgtaccggcggacttggaagcgaagctttctcattccccgtcacgtcgccgttatacacttacgagtccatcaacggtggtggaacgttttaccaccacgtgggaagttctggtccgtcggatttcactggattgatctcaacaaatacttccacaggaagttctccaatcttcgacgttaattttcaatttgatccaacggctgagattaacacaggcttccccacttttttccacaattcgatttaagtagtacagtattgaatattcttgagattaatataatcccgattagcgcctagcgatttaagtagcaga

SEQ ID NO: 4674 - DNA, 1431 bp, Artificial Sequence
  P8238 (opLexA::G2575, G2575 is from A. thaliana)
cttgatcacccaaagtccacatataacctaacacctaagtttgaagaaccaaatctcttcctcttcttctctttctcctcttcttcaatggatgatcatgttgagcacaattataacacatctttagaagaagtacacttcaagagcttaagtgattgcttacaaagctcattagtaatggattataactcactagagaaggtcttcaaattctcaccttatagttccccttttcaatcggtttcaccgtcagtaaacaacccttacttaaatctcacttcgaattctccggtggtctcatcttcctccaatgaaggcgagcctaaagagaacaccaacgataagagtgaccaaatggaggataacgaaggcgacctacatggtgttggtgaaagctccaagcaactgtgagtttttttcaaccttttacttttctttcggagttcctcacatatttttgttctttatggactagatgtcctgaaacaaaatttagactatataattaacgtgaagcttataaaaatcaacaatcacttgccaacatagaacgtggaaacccttgagattgatatgctttagatggatgggtatggtcaggacaaaacaaggtaaaaagaaaggagagaagaaagagagagaagttagggttgcatttatgaccaaaagcgagattgatcatcttgaagatggttatagatggcgaaaatatggacaaaaagcagtgaagaacagcccttatccaaggttcatttattcactacactctattcaaatccacacatttataagttacagatatatatatcataatggttttgtaagaaaataaagtgtatattatcataatatcataatttgtttatgcgttttcaggagttactataggtgcacaacacagaagtgtaacgtgaagaaacgtgtagagagatcgtttcaagatccgtcgatcgtaattacaacctacgaaggaaaacacaaccatccgatcccatcgacgttgagaggaaccgtggcagctgaacatctactagtccaccgtggtggtggaggcagtttactccatagcttccctcgtcaccatcaagattttctcatgatgaaacattctccggccaattatcaatcggtgggatctctgtcgtacgaacatggccatgggacctctagttacaattttaataataatcaaccagttgttgactatggtcttcttcaggacattgttccttcaatgttctccaagaacgagtcttgagagaggggtatgtacgtactatagatcgtatcgttatggttgcattatataagcataaatcatttgtactatatgtatgtaagtagattcttaggtaatgtatttattcatatctatacatgcatgttaatttatatatatttcactgacacactggcactgctactaatcat

SEQ ID NO: 4675 - DNA, 713 bp, Artificial Sequence
  P8239 (opLexA::G1274, G1274 is from A. thaliana)
tcttcacttctctagttcttggatgctttaaacctctctctctctctctctcaattatttttttttctatttcaaaaacaaaaaaaaatgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaatccaaatctctcatcctcgttgagattgtaagataccaaca

SEQ ID NO: 4676 - DNA, 1765 bp, Artificial Sequence
  P8241 (opLexA::G2682, G2682 is from A. thaliana)
ttgtgtggcgactataatgtgtcaaggaccgatatgacaggaaacgcagattccggcaaaatcgcgacagagaaagaccctaggaagctcgttttcaccaaattggaggtatctcccgtcttccgagaatctcctgttaaagaacttcctctttttcctccgatttctcggtattgttccagtttctctgccaattttcactagagatgcttctcgtttgagtaatttcaatccaaaatctactctctgatctccactggtcttgattttgaagcagagagcattcagaagcaaaggataagacagatgaagaaggcattacttcgaggaaacacaaaggatgtcgatgcaagcagtccaaatgtttaaagttgtaagttcatttcaggatccaagaattacttagtgttaagctgatagagatttgagtataatgttgaatagtgagatttctattatctgctgtagattgatgcattattggatatttgtttgacgcttggttattaggtactgtgactgttttgcatcaggagtggtatgtacagactgtgattgtgttgattgtcataacaactctgagaaatgtgatgctagagaagcagctatggtgaatgtactaggtcgcaacccaaatgccttcagtgaaaaggctttaggtagcctaactgataatcaggtatgttcttgacacctatcacttttgtaggttaagcttcaaagaggtatatttcacatcctttttcatttgtaagtatctgggatgttctgtgttttgtattgtagtgtaaggctgcacctgatactaaacctggactgctttcgagaggctgcaaatgtaaaagaaccaggtgtttgaagaagtactgtgagtgctttcaggctaatcttctgtgctcagacaactgtaaatgcatcaactgcaagaatgttagtgaagcgttccagcctcctgcattttctgctcacaattccccacaagtataccggaggagaagagaccgagagctaactgaggcaagtgaaatatactacttgcttcataacatatatgcacttttgggtttatctccataaaactcatttttctgtccggaatagcagtggaattcttgtccagctccgttattttcgatacctgacaattccattcaaaatgctctgggttcccctatgtcttgctctcctaaacttccttacaggttcgattttgcatttcctaaaatgatagttcatcttccttcacctcataatcataaatattttaactgaattttcattgtgctactagaaagaaaaggtccctcatgggatacacctctacacttcttccggacttgggagatttatgctcacttctcgttgcagcgtcagaatctgctacaacaactgcaggtatatctgtagtctcttacaaaatctacactttactggatctactattcctttggcttcatcaacatacttcctttaaaatctcacttagaggaccagaacaggatatttacaaagcctgatgataaggaagccattgagctgtcaagtgagtctgagagtcgtaatgtggaagaagaaatacaatcacgtggaagattgatcgaactgatagatgttcaatacaatggagaagaggattcccaatgtaagaccaagacaagtgtcaatgaaacagatatatacatggagcaggaaagggcagtgcttgaaactttcagagactgtctccaaaagttcatcaaatcgagactggaatcataacaggtaa

SEQ ID NO: 4677 - DNA, 1828 bp, Artificial Sequence
  P8244 (opLexA::G1510, G1510 is from A. thaliana)
tgccgtctatgatctctctcaatctctcatcttagctttctttctctctctctttgtgtcttcatttgtttatctcatcaatggattcaaattttcattactcgatagatcttaacgaagatcaaaaccatcacgaacaaccctttttctatcctcttggatcctcttcctcgcttcatcatcatcatcatcatcatcatcatcaagtcccttctaattcttcatcttcttcttcgtccatttcatcgctctcctcttacctccctttcttgatcaactctcaagaagatcaacatgttgcctacaacaacacttatcacgctgatcatctccatctttctcaacccctcaaggtaaatttacaattacatatcaaccttaagtgtgtgtgtataaatgttattcttgtacgatcgttctttttagtttagcagttaaaatcatgcctgatcatgtaaaattcatacaataatattagtttctgaatttgtatgtcgagaattctatatagacgaaatttaatttatcaaataaaaaggagggatcttaagaagccatatcattatattattatgtacaattccatctgttgttgattataaaccttgatcggtgatatatatataccaggccaagatgtttgtggctaacggtggatcatcagcatgcgatcacatggtgccaaagaaggagacaagactgaaactaacgataaggaaaaaagatcacgaagaccaaccccatcctcttcatcaaaacccgacaaaacccgattcagactccgacaagtggttgatgtccccaaagatgcggttgatcaagaaaacaatcaccaacaataaacagctcattgatcagactaataataataatcataaagaaagtgatcactaccctttgaatcataagactaatttcgacgaggatcaccatgaagatcttaatttcaagaacgtcttgaccaggaagaccacggccgcgaccaccgagaatcgctacaatacaatcaacgagaacggttatagtaataacaatggcgtgattagggtttgttcggattgtaacaccaccaagactcctctttggcgaagtggacctcgaggtcccaaggtagattaatcacacttacttcaatcgaaattgtcttgatatatgtcatactatctatatctacctagtttagttcacatttttaaaattaatagttatatttcaagaatgtagatatttaatttatttaaacctgatacatcctttaaacattaatactttaatcaatgatactcataagtccaacattctatgattttttttttgtcatctacagttcgcatactaattttcatttatcattgcagtctctttgtaacgcatgtggtatacggcaaagaaaggcaaggcgagccgctatggccgcggccgctgcagccggcgaccaagaggtggcggtagcgccccgagtgcaacaattaccgctgaaaaagaagttgcaaaataaaaaaaagagatcaaacggaggggaaaaatacaatcactctcctccaatggtggccaaggccaaaaagtgcaagatcaaagaggaagaggagaaggaaatggaagcggaaacggttgccggagattcagagatcagcaaatctacaacttcttctaattcttcgatttcgtcaaacaaattttgcttcgatgatttgacaataatgttgagcaaaagctcagcttatcaacaagtgttcccacaagatgagaaggaggctgctgttttgctcatggctctgtcgtatggaatggttcacggttgatcagatcatcacaatatcctcattac

SEQ ID NO: 4678 - DNA, 1314 bp, Artificial Sequence
  P8247 (opLexA::G2237, G2237 is from A. thaliana)
tctgctcaactctctgttctacttctgaatcgtcgttttccttcatataaccaaaccaattctgttgaatcatcttggcacattcattgttttgagaaggaacagaaaaagttctgatcttgtccctattcgcacatcaatggacgataatagatctactcatagctcaatgttcggtgacctatcaacagaagaggtcacaagtaagatcattctcacagcaatcattgttctattcatggcggttctgttcgtccttatcctccatctatacgccaaactctactggtggagaatagatcagctccaacagcaacagcaacaacaacagcaagagcaagagcaagaagaagaccaatcatccattgctccacctgtagtcactcgccgtcagcgacgtcgtttcatcttcgtcccaggccaagacgctctaagcaacactggactaacctcttttgaacttagttccttaccaattgtgtttttcagacaagatagttgcaaagatggtttggaatgctctatttgtttgtctgagcttgttaaaggagataaagctaggctgcttccaaagtgtaaccatagcttccatgttgagtgtattgacatgtggtttcagtctcactctacttgtccgatttgtagaaacactgttcttggtcctgagcaagctagctcaaagagagttgaacaagttccagacaatgcagaaaatgctggtaccaccaataacaaccatgatgctttgtctcaactttcaacttcttctccagaatttcccaccaatgtcttggtatggggtcgtcaggatcaagttagtaccggaaacaccaatgttgggactcaagaagacggtgctgctggtaatggtgcttctcagagtcaagaagctgttgttctggatatcagcgattcttccagtagaaatcataatgtatcatcttcgtcgtcatctatgaggtttattgttgaggaggaagaagcaaaatctccaatgacaacgaggttgaggtccttaaggaggtttctgagcagagacaagagagtgggttgtagcaatagtagtactagtaatagtagcagctccaatgctgttgcttctgttgatccttgaagattgtaattagcttagctgagtgagattgcctgaagatgtcaaactgtgtgtatgtggtctcggctctttattggctaagggtgggcgcgccgacccagctttcttgtacaaagtggtgatggccgctctaggcaggcctcgtaccggatcctctagctagagctttcgttcgtatgcatcggtttcgacaacgttcg

SEQ ID NO: 4679 - DNA, 808 bp, Artificial Sequence; identical to SEQ ID NO: 583
  P8248 (opLexA::G2238, G2238 is from A. thaliana)

SEQ ID NO: 4680 - DNA, 679 bp, Artificial Sequence
  P8249 (opLexA::G2251, G2251 is from A. thaliana)
tcacccattctccaccttatcatcacaatccaaaactctctctctctctctctctgtctcttgtcttatcatttatctctctaacggcgaggcaatgggttttccggtgggatattctgagctacttctcccaaaaatctttttctacttgttatctttcttaggtttgatacgtaaactcatctccacaatgttcaagatcattggtctaccagatttcttagaacctgaaccggtttcaacctcatggcccgacccaccacccacgttgaccaaacctgactcagcagcaatactagccggagagatgttaccggttgttcgattctcggatataaaccgaccggaatccgagtgttgcgcagtgtgtctctacgatttcgagaacgacgacgagatccgacggctgacgaattgtcgacatatatttcatcggggatgtttggaccgttggatgatgggttataatcagatgacgtgtccactttgtcgtacacagtttatacctgatcatcttcaactggagtttaatcaaaggctctggtctcaatcttctgctgtttcttctcaacttcttgatgaatcatcatcttaggacgtattaaatctttgtcccaaccaaaaaaaaagacatattaaatcctttttttttggtactttcattgggaattgggtttgg

SEQ ID NO: 4681 - DNA, 1041 bp, Artificial Sequence
  P8250 (opLexA::G2252, G2252 is from A. thaliana)
acccgacgattaattgcacgatgtccgatgctccgtcgtcttccccggatgccacggcgtcgcactggtgctatcactgcaacaaacgcgtcgtcgttgaaaccttagatgactttgtcgtgtgctgcgaatgtaacaaaggtttcgtcgagtcaattcaaccgactcccgccgcttattcatcgccggcgccaccgcagccactttccccagatctgaatgtagaagactccagtattggctcgcatttcctccagatgctccgcttgttagcccacgcgccttctcagcgttcaccaccacgacaccttgatgttttatcttacgaagatgatttcttcaggttggagctcaatagtagaaacgaaatcgacgatgacgaagacgaagatgaagatgatggagatgaagaagaagaggatgaggaagagaatttaaccgtcaacgacgaagaagacgaagaagatgatctgaggaggagaaatcgttttcctctcacgacgacgcagtcgagaaccggaagaaacagaattctcgattgggctgagattttgatgggaatcgaagacaattcgattgagttccgtatggaatcagatcgatacgcaggaaatccggctgattacatagacgatgcagccggatacgaagctttgctacagaatttagcagaaggagatggtggtggtggcggaggaaggagaggcgcaccaccggctgcgaaatcggcaatagaggcattggagactttcgaggttagttcttcggagggagagatggttatggtttgtgctgtgtgtaaagatggaatggtgatgggagaaactggtaagaagttaccgtgtggacattgttaccacggagattgtattgtgccatggttaggaacaaggaactcttgtcctgtctgtagattccagcttgagactgatgatgctgaatatgaggaagagaggaaaaaaagaacttctaccgtgtcagattctgctgctgcttcttcttcttcttcaacttctcgttactgaagtggaggaaatgccc

SEQ ID NO: 4682 - DNA, 689 bp, Artificial Sequence
  P8252 (opLexA::G2269, G2269 is from A. thaliana)
acgccaatcccacatggccctaacctctttcttcaccatcaaatgtcaaccgccaccctcgtcgtcttccctcctccacctcctgtccctatccctacctatataactagcctcggccttggctactccatagccatagctctaggtttcctcgttcttatctccacaatcattctctcttcttacatctgttgccgcgcctcacgcctccgcttctctgcctccgccgcaaacgcaaacgcaaacgcatcgtttagcgaccgtggcgttatcgtcccaagaatcatattcgtagctgaagacgacgatcttgagtctggaaacgtcgtcgttggaggtcttgatcattcagtcatcaactcttaccctaaattccatttcactaaagatatcaccgccgtagtaaacggtgatgggtttcacgacggagaaggaagagagacgacgtgttcgatctgtttatgtgagtacatggaagaagagatgttaaggatgatgcctgagtgtaaacactacttccatgtttattgtcttgacgcttggcttaagctcaatggttcttgtcccgtttgtcggaattctccacttccgacgccgcaatctacgccgcagtcaactcctttgtcggaagttgtgccgttgtctcaatacgccgccgatcggaggagatccagaagataaaacatttc

SEQ ID NO: 4683 - DNA, 698 bp, Artificial Sequence
  P8255 (opLexA::G2400, G2400 is from A. thaliana)
tctctcctccctaagcaaaactaaaacaagctatggctggtatgcttcccggagttgagtgtgcaaggaggcggcgcttccacggtggtgctcctccgattgaatcctcgaacacagcttctgtggcggctgcggcgggacacgtctggacacggcgaccatcgttctctctttacactaccaatcatgagagccaccaggcccatgtctccttctcggagagaagtgttaggaataaatcttatggagaagacaacgatgagaaacttgacggagcagccaaagaggcaaagcagaggcttaacaagcggctgagaatcccaccacgtacaagttcaggcaaaatggtaaagacaaagggaataaattggagcaaggaaagggtaaacctctcggggacttaccgaccgaggtggtcgggttaaagaagagccgaggaaggttgatggaatggttcaagcggcgagttagggaacaacaagattgtgctatatgtctagaccggttcaagaagggtgagaccttggtacacctaccatgtgcccataagtttcactccatatgcttattgccttggctagacaccaatgtttattgcccatattgtagaactgatatttggaattaaatgttatatttttgatgtcatatttcgagatgtttttttatggcttatcttaggttttaggaatttaaac

SEQ ID NO: 4684 - DNA, 1227 bp, Artificial Sequence
  P8256 (opLexA::G2223, G2223 is from A. thaliana)
gaatcacacaagcttcacaatgtcatcatcatcatcaacgacgacgaacacaacaacagaatcagattcatcatctctacctactcacatcggtagatcaaattccgacggaatcatcgacactacaccatttcttcctcccaccgttacaagaaccataagcgtagatgaagaatccaatccaattcatcgatccgctagacgacaaggtctaagagaagcagcgaggttcctccgtcacgctggtagccggagaatgatgcgtgaaccatcgatgctcgttagagaaaccgctgctgagcaattagaagagagacaaagtgattgggcgtattctaaacctgtggtgtttcttgacattttgtggaatcttgcttttgttgccatcggtgttgctgttctgatacttagccgtgacgagaagcctaatatgccgttgagagtttgggttgttggttatgggattcaatgttggttacatatggcttgtgtttgtgttgagtataggcggaggagacgacgacgtcacccggaggatggtggtggttctgggttgacgaattcttcgtcgcagcaatatgtttcgttagcgcaattggaggatagaggagagactagtaatcctgcgaagcatcttgaatcagccaatacgatgttctcattcatctggtggataattggattctactgggtttctgcaggaggccaaacactatctagtgactctcctcagctctattggctgtgtatcatttttctcggtttcgatgttttctttgttgtgttctgtgttgcattggcttgtgttatcggccttgctgtttgctgttgtcttccatgtataattgcaattctatatgctgttgccgaccaggagggagcatcgaagaacgacatagatcaaatgccgaaattcagatttacaaaaactggcaatgttgaaaagctctcaggcaaagcacggggaataatgacggaatgtggaacagattcacctattgaacgctcgctctctccagaagacgcggaatgctgcatctgtctctgtgaatatgaagatggagttgaacttagagaactcccttgtaaccatcactttcattgcacttgcatcgataaatggcttcatataaactcacgttgcccgctctgcaagtttaacatcttgaagaacgcaaacaacgaagtctagtaaaatctgttctggttctaggatcaatccgaacg

SEQ ID NO: 4685 - DNA, 1625 bp, Artificial Sequence
  P8490 (opLexA::G2966, G2966 is from A. thaliana)
cggagaaagaaagagagagatatcgacaacaacaatggaagattcaagcaaaaaaagccaaaagaagaagaagaacaaaagcaagaacaacatcccaactgtttggttctcactcaagaaatccctccactgtaaatccgaaccatctgatgtccacgacccaatatccaccactaaacagcaacaacacctctccacaatctccaccaagaaaatctccggcatatcatccggcggagccgccgtatgcggtggtggtttatcaggatgttcaagatcaatagcaaatctcaaagacgtaatccatggaagcaaaagacatttcgagaaaccaccaataagtagtcctcgttctattggaagcaatgagtttctaaatcctataactcatgaagttattcttagtaactcaacttgtgagcttaagatcactggtgtcggagacatggcttcacctgtcggagcagcggattccggcggaggtggcggtggaggaaatggtcggtctacgacttatgtagggatgcttagaccaggaacaccgatgcattatcttaaccattcagcttcttacaggagccaaacaagaaagggttcgtttgctttgtcggagagagatcgaggaggaggaggaggaggagaagggttagggtttcatacaaacagaagggtttcattggagatgaacagagaatccaccattaatggaggcaacaattcctctgtttcttgtcataaatgtggtgaacagttcaataagcttgaagctgctgaagctcatcatctctctaaacatgccgtaacggagcttgtagaaggagattcatcaagaaaaatagtggagataatctgcagaacaagctggttaaagtcagagaaccaatgtggaagaatcgatagagttttaaaagtacacaacatgcagaagacattagctagattcgaggaatacagagaaacagttaaaatcagagcaagcaaacttcagaagaagcatccaagatgtctcgcagacggtaacgagctacttaggttccacggaaccaccgtggcttgtggtttaggyataaacgggtcaacaagtgtttgcacggcggagaaatgttgtgtctgtcggattatacgaaacgggttctcgtcgaaacgggagaagaataatggggttggtgttttcacggcgtctactagtggaagagcgttcgagtcgattttggttaacggtggagatgagagtggagatgttgatcggacggtgaggaaagtgttgattgtgtgtagggttatcgccggaagagttcatcggccggtggagaatgtggaggagatgaatgggttgatgagtgggtttgattctttggctggcaaagttggtttgtatacaaatgtggaggagctttatttgcttaatcctaaagctttgcttccttgctttgtggtcatttgcaagccctaaaacatttagcatgttggggaaaaagattgaattttcttttgttgataaatttatgtatcgtataatgagaattgaaatcaatagataattgatatctagattttacttatttcaattttttttgccatttttttttgaaatggtaatggtggaatgaatcgatttatttgta

SEQ ID NO: 4686 - DNA, 1950 bp, Artificial Sequence; identical to SEQ ID NO: 951
  P8491 (opLexA::G3009, G3009 is from A. thaliana)

SEQ ID NO: 4687 - DNA, 1556 bp, Artificial Sequence
  P8492 (opLexA::G1981, G1981 is from A. thaliana)
ctctctcattcaaacccaaataggaaacaaatacacaaaagtataataaaaagtctttctctcatctttcgccacgtagacatggacgtcgaacatcacaaatccggccacatcagtagaccaacggtggatattccaccgaggaagcttctttcctccgccaagtctccgtcgtcagtttcaagtccccttcgcgactataaagaacagaaagactattgttacgactctgactctgaggatccttacgctggagaccatttccggatgtacgaattcaagatccgacggtgcacgcgtagccgtagccatgactggaccgactgtcctttctctcatcccggtgaaaaggctcgtcgccgtgaccctcgccggtttcactacaccggagaagtatgccctgagtttagccgtcacggtgattgtagccgtggtgatgaatgcggtttcgctcacggggttttcgagtgttggcttcatccgagtcgttaccgtacggaagcttgtaaagacggtaagcattgtaagaggaaagtttgtttctttgctcattctccacgtcagctgagagttcttccaccgtccccggagaatcatatttccggtggttgcggtggatcaccgtcgtcatcccctgcatcggttttaagcaataaaaataatcgatgttgcttgttttgttcccattctccgacgagtactctcttgaatttatcacgatcaccttcatcgtctccgcctttgtctccagctgataaagccgatgcattttcacggctgagccgccgtcgcaccgccgtactaaacgaactgattagttctttagattccttaagtctcacggaagcacttgcagcttcttcatcgtctcccgttaccatgcccatttccacggcgacgatgatcgcttcatcgaatctaagcagcaaccaccaccaccaccgtcttccgccgtggcttgatgtcggagacagagatctccaattacaacagagtagtcctctacgatttgctctttcaccttcttcaactccaagttacctccatggccagcttcagccaccaccgtcgagcttctttggcgatgaattcacaccacgtggtggccggctaagcgatttctcggtggctgcagctgcggcggcccaagctagggataaaaatagctttgaagtcggttctagtggcgatcttgatctaggatgggtgaacgatcttttgacatgaacagtatgacatcaactgtgaactacttgagatctttcccgacgggaataattatacggcggcgccgcggcggaggtccgtcgtggtacattgtttattaaaaaagtatttacgattttttccacgagagctaattaagagtctgtagtactatgtcgtgctttaaaaatatatttttactgtattttttgttaaataagagagtccataacttctattgttatattgatctcttggaacttgtaatatctactacattgtgatcgaattcctatgtaatgtttacttcaaaatattctgtttaatagaaaatgatgatgtagttatat

SEQ ID NO: 4688 - DNA, 1020 bp, Artificial Sequence
  P8493 (opLexA::G724, G724 is from A. thaliana)
agatttgtgttctttttttttttgttagtgttgaggatgagagaagaagattccaattggtttgctaaatgggaagaagagcttccgtcgccggaggaactcatacctttatctcaatctttaatcacgcctgatctcgccatcgccttcgatctccaccgtaacaacaactcaaactccggtcaacctctacctcaaaccacaccgccacaacccaattcctcagccgaaatcgccggagactctaccggagacgaaccagcaagaacgctaaaacgaccgcgtttagtatggacgccacagctacacaaacgtttcgtagacgcggtggctcatctcgggataaaaaacgcggttcctaaaaccatcatgcagcttatgagcgttgatggtttaacaagagaaaacgtcgctagccatttgcaaaaatacagactttacctcaaaagaatgaaatccggcggcggaggaggcggcagcggtgattccgatcatctctttgccagctcacctgttcctccacatttcctccatccgacaagtagacagagctccgaccttttcataccctcttttgtcccaatttcaactcagcagcaacatatcgcagcaccaccgtctcagttcctccaccgacaaatctccgccgttaatttcacttcaccgaccaaagcgaccgaccaagcaatgttcttggctaggcagcagagtgaactacagcaaccagttttcaaaccatcttcattgcatttacatagtcaagtcgctaattacacgcaagatttgaaatcaggagccaaaacggtcttgactctgtttccaactcgagacgattgaatttttattaaacgtcaacaatccgagttctgctttttttttctggtcttgctgttgtgactagatctttaatgtttctaatgtttccacgatcttgaggaacatttggtctccttaaagattgagttttactctgtaatgaaatgcataaaaagaagtgatctttcacttgttgtctagaaa

SEQ ID NO: 4689 - DNA, 1476 bp, Artificial Sequence
  P8495 (opLexA::G3064, G3064 is from A. thaliana)
gccgtcgtcttcctcgccggacatgctagaagataacaatccacacccaaacttacccagagagacaatctctgattcacgtccactacaattaccgaatctctccgaagccaccgatcacctacgctagtttcagtggcaattcgaagcttccaatgagtttgttctgtaattcaatcgaaaccctttatccaaaaccattcctttcacacaaatctcacttctttaccttctccaattccaaattccaaaaccctaaattcacaagcttcccacttcgtcaccaatggcggatcgaatcatgtctgaaatcagcatcttcatcagaaatcgatatggtaagaaacaaagaaggtatctttgcaccaaaggagaagaaagttgtagtcttatgggacttagacaacaaaccaccacgaggtccaccatacgaagccgcaacagctctccgtaaagtcgctgagaaactcggccgagtcgtcgaaatctccgcttacgcaaatcgtcatgcttttatccatttacctcattgggtcgtcgaagagagacgagaaaggaggaaccttgatttcatggagaggaaaggagaagtgactccaattgatccgtacatttgtggtgtttgtggtcgcaagtgtaaaaccaatcttgatttgaagaaacatttcaagcagcttcatgagagggagagacagaagaaagttaataggatgagatctttgaaaggtaagaaacgtcagaagtttaaggagcgttatgtttcagggaatgagaagtataatgaggctgcgaggagtttgttgactcctaaagttggatatggtttagaggctgagctacgtcgagcaggggtttatgttaagacggttgaggataagcctcaggctgcggattgggcggttaagagacagatacaacattcaatgactagagggattgattggttggttttggtgtcggatgataaggatttttctgatatgttgaggaaagctagagaggctgatcttgggactttggttgttagtgatatggatagagcattgggaaggcatgctgatttgtgggtgccttggagtggtgttgagaagggagagattggtgagaaggatttgattccggggaagagaccaaggtttgaggaggatgaggtgggatttggtggtaatgatgagttgttttcgttgtcgtatgatgaggatgagaaggcggagatgacggtggagagtgatgggtttgggaggtttaatgtatcggcgttttcggaagatgaatgggtggaggatgaaggagactttgtgttgagtgatagtagtgatgatgatagtgatgatgagcttttctgattcatggtgaattgagttgcatttctaagtgttgttaattggtttacgaatagagttcataggagctttggtcgatgtaattaaaatcaaatgtaaaaccattcttacataagccaagataaaaagcaaa

SEQ ID NO: 4690 - DNA, 1540 bp, Artificial Sequence; identical to SEQ ID NO: 453
  P8504 (opLexA::G1972, G1972 is from A. thaliana)

SEQ ID NO: 4691 - DNA, 749 bp, Artificial Sequence
  P8513 (opLexA::G2710, G2710 is from A. thaliana)
ctcttgccttagcctaagcacttctatctatctccttcttctttatcatcatccaaatgtcatctagctcaaacaagaattctaataaggatcatgatgatcatcataatgatcaaggccaacacaataccatccatactccgtctttcatgcacacctttgaaataagtaacatttcttctccatcttctccaggtatatatatgtattcacaaatccaacaacactatgaatatttttcttagttacatcaaatatgtgtacgtatatatttatatacatgtgtttgatttgactatgacttctaaatgtcttcttctcttctttgttacatttactaattaataacacattctttttttgctacgtaattacattctcttaaatagtaaacgatatctaacaattcacccttttatgaattagtcgtatcggatcctaaaccagaatggaaaccaaatcaacatcaagctcaaatactcgaagaacttttcatcggcggtacggttaacccgtctctaaccagtatcaaacaaatcacgatcaaacttcaaagttatggtgaagaagtcgacgacgcagacgtctacaagtggtttcacaaccgaaaatatagtcgcaaaccgaagttagtatcatattttatgttcttgtaaataattgtgggtattattaccggtatctattatttactttaatgttttggttttgcagatcctgatctagaaatgttgaagatatacagtggg

SEQ ID NO: 4692 - DNA, 1980 bp, Artificial Sequence
  P8515 (opLexA::G2982, G2982 is from A. thaliana)
caactaattgatttgatttcgtgtagctaactttgttaattggtaaattgtgtagagaaggatgagtatggagatggagttgtttgtcactccagagaagcagaggcaacatccttcagtgagcgttgagaaaactccagtgagaaggaaattgattgttgatgatgattctgaaattgggtcagtgttaattattcttcttactcacaaagtctctggtttttttacttggagctaaaatgtctgtattgaatttgtgtttaaaagatcagagaagaaagggcaatcaagaacttctggaggcgggcttcgtcaattcagtgttatgggtcagtgatatatctctcttagctcaaacatgcctgaagtgaaagtattgttgttttgctgattttgatttaacttcacacagtttgtcagaagttggaagccaagaagataactacttacaaggaggtattactctctttgttccattaaggaattggtgatgtaatcaatgagttttcagtttaagacgcattagaattgatctttatatgaacaagtattcacttcaagaagcaatcctctaagttagttgttgagcattgtctcaaattcttcttctaatcaggagtcttgcccttatatagaggcattgtatcagaaaatgtgaaaatctacgtttgagactgtggctcttgtgattccaggttgcagacgaaattatttcagattttgccacaattaagcaaaacgcagagaagcctttgaatgaaaatgaggtatagcgagatggaaagctcatatcatctgtcttgagttatttggaaaaaaaaaaagctataacaacattctcttatgttcaatcagtacaatgagaagaacataaggcggagagtctacgatgcgctcaatgtgttcatggcgttggatattattgcaagggataaaaaggaaatccggtggaaaggacttcctattacctgcaaaaaggatgtggaagaagtcaaggtttagcttccaagcttttcctttcagttatctcatctatgtaattgctctctctcttcgtcttctctactaatctctctacctctatttgcagatggatcgtaataaagttatgagcagtgtgcaaaagaaggctgcttttcttaaagagttgagagaaaaggtgatcttctttctgtttgatggaaaatttaaatacaagactctcttagaatttgagatcttgttatgcatgtcaatagatgacaaaagttattgatattgcaggttttctagaatccatagatacgtcgtgtattgaatcattttatgttgtcttaatgaaatgttaaaccgtctttctacgttttgcttataatgttactcaaatgttgttatcatcaggtctcaagtcttgagagtcttatgtcgagaaatcaagagatggttgtgaagactcaaggcccagcagaaggatttaccttaccattcattctacttgaggtacttcaaaaatctctttctcgtccgtagtttctatttcatgtttttcgatatcctaatctatttccatctctatagacaaaccctcacgcagtagtcgaaatcgagatttctgaagatatgcaacttgtacacctcgacttcaataggtaaaaataaacaacatttcttctcaaaatcaaaatcagttctgctatctcttaaatcggaattgaaatcttcgtaaattttgttgtgagcagcacacctttctcggtccatgatgatgcttacattttgaaactgatgcaagaacagaagcaagaacagaacagagtatcttcttcttcatctacacatcaccaatctcaacatagctccgctcattcttcatccagttcttgcattgcttctggaacctcaggcccggtttgctggaactcgggatccattgatactcgctgaccgagcttctattcccaaattcttcaagaagaagaagtaatgatctaattggtatac

SEQ ID NO: 4693 - DNA, 995 bp, Artificial Sequence
  P8528 (opLexA::G730, G730 is from A. thaliana)
attcaccaattctctcttcttatggagcttttcccttcacaacctgacttgtacttgaagatcagccgaagaagagaagaagaacaagaaaaagaaagtcaagaactacaagaacaagaagtcgaaaggagattagggtttcagagtaaagcctcagatttagacaacaagtcttcaaataatctcatccacactctccagttcacttcaaacaatgaagccaccaagattaatagtaatcaagaacacaaggaatctctcgatcaagacttgagatctatttttatgatgagaccaataagaggaatccctctttaccagaatcaagtccttgaccactactactactcatctacctctcccaatcctttcttcttcagtgaagtcaacggtcaacatgctagtcgtcgcttaatcacaaaccctaattgtagttttaatctccacaaccgtcatcggcgtcaagctcaaccgcagccgccaagattcaccgccaaaagaggagtaagggctccaaggatgcggtggacgacgaccctccacgcccattttgtacacgctgttcaattattgggtggtcatgaaagagcaaccccaaaatcagtacttgagctgatggatgtgcaagatctcacattggctcatgttaaatcccatctacagatgtatcgaaccatcaagtctactgaaaaacctacaacgtcatcagggcagtcagattgtgagaatggatcacaagtaaacagtgagagagaagcaagaaatctcacgggtctatggaataactcctcaagtgaagctcggttccagttgaaggcaaaggcatcatcaggtgtagacatttcatccaatgagaatgaatggaagaatcgaagatgtccaagcaacgaacggttgtcgtcagattcgtcaagccttacagggacaagaccagagactgaaactcccaatcttgatttcactttagctacaccaaacctctctccctaattttc

SEQ ID NO: 4694 - DNA, 1329 bp, Artificial Sequence
  P8536 (opLexA::G2800, G2800 is from A. thaliana)
tacttgatgacgatgcctggaagaaacaagcgcaaagaaagatcctggccggaaccgcaaacgcaaccacagtcagagattccttcttgtcttctttggcagctgttaacatgtctcctccgtcgacgatagcttacgtattaccgccaggttttaagtttgtgccaaacgatgaagaagtcatccattgttacttgaaaccttactcggacggcaacacgaacgtattgctccatgttcctattcatctcgtcaatatctacgagtcgaatccacaaacactttcaggttaacttgtctccgtccatatgtattgtttacttagttgaattctttagtttattaagttattaacatatatctatatatatatatttttgaaacagaggaattccagaagggtaacgataaagaatggtttattataacggagaggaacaaagttgatcaaggtttaagccaaacaaagagagttggttatggtgcgaaaaggcagaaacgtgtcgacactaacggaggatattggcacgcaacagtggctgcccaaaagatcaacgctggagatggtgtcgttcgcaacaaaaggccactggcatactacgttgggaaaccatcagaaggcgtcaaaactgattggttaatgcaagaatactctcttgatcactcttctcacaacaacgacaaggtaagaagtgtttcttggttcccaagttatttaggttttcaagttttggattctgttttgagtcttgtttttgttgtgcgtctaggattacactttgtgcaagatctatcttactccacaagcaacaaagatgaataaagaagtgggagaagagaagaagaagcagaagaaaggagaagccgttgtttcagttgcacctgtggaagcattggaagagcagctgccttgtaatgtcgagtatcatcaaccgctagcaccgctagattcttgccaaccgcagcctcatgatttggcgtatcaacagcagcagttttgtccaggcccactggattcttatcaaccgcagcctcatgatatggagaatcagcaaccgcataatgagaagctgaagaaagaagaagacgttgagcagctggatttgcatcaaccagaccaaggaaaaggatgctaattgatctctttcctctatcggcaatgttctccaaaaccagagataattctccctgtctttattgcttttgatgccttgatataaaacatttatactcaatttgtccaacattttcttagcgtcttagacttataaactaacacatacagatatagatataaaacaccggtgtattccagtttcagattaccca

SEQ ID NO: 4695 - DNA, 2162 bp, Artificial Sequence
  P8537 (opLexA::G148, G148 is from A. thaliana)
ccaacattgagagatattaaagacaagaaacaacgtagaaagaagagagagagcgagtgagagatgggaagaggcaaagtggaagtgaagagaattgagaacaagatcactagacaagtaaccttctccaaaagaaaaagtggtttgctcaagaaagcctacgaactctctgttctttgtgatgcagaggtttctctcataatcttctccaccggtggcaagctctacgagttcagcaatgtcgggtacgtatatccattcattcaagatcattaattcggttttcctaatgatgaaaacctaggttttcatgggtaatatgattaagatcatccatgtttgatttgtgtctgttcttaagatcaagaaaccaaattctgtcttgtgggtatctgaaaaaggttatgtctttttattctaaccctaactagttaaggttgatcaccatccatcgatctctcaggatccatcggacatatgggtcagtttagcttttagatccggtaaatcttttgaaagaaaacttctttgttttattttgggttttaattgttatcaccagctttgatatgtgtatgtccttaagatccatgaaacctcatatatacgttttgcctctttaaatagatatgtctttctaattctaattagagaaattaattagggtttatcatgggtagccgtagatctataatccattacgcagatatatcttcccagagatttttgtgtaattagaatttcctttagacatgcattaaaagttaacacagaacttaaggttttcgttctttggttttgaatttaagcaaattcagattattaattaaaatatcttgtggtttcttttgttttataaactgtagagttggcagaaccattgagaggtactatcgctgtaaagacaatcttttggacaatgatacgcttgaagatactcaggtcaatcattttttttcttaagtatgttcattttatctttatatatatacggaatttgacctttgttcattctaagtgtatacatagtcaaactaactattatattataacgatgtataaaataaatagagctaagataaattgtagttaatcttctgctttttggtgcagggcttgcgtcaagaggtgacaaagctcaaatgcaaatacgaatctcttcttcgcactcataggtttaactaatcgtactcctcgtaatccattacttcctataattgtacatttcctaatttctgctactaataatcgttttgaatcgttgaaaaaggaatttggttggggaagatcttgaagggatgagtataaaggaattgcagacgctggagagacagcttgaaggagctctttccgcaacccgaaaacaaaaggcatgacatatttcatacgtagaccaatttttcttgcgcatcatttagacctgcaaaatacattattgaaatgtatatctttatatgcatgtatgtatatagacgcaggttatgatggaacaaatggaagagcttcggagaaaggcaagtactcgaaatgatgttctacaatatatgcatgcattgtatgtaaatgtactcatgtgtatatcatttttgtatttggaatggcaggagagggagctcggagatataaacaataagctaaaggttaatgtttttaactggacatccaaattatatatcaagtctttcttagttactatgattttgtgttagttaattagtgtattgtctactcataaatcttataaaatggataatcttcataatcagcttgagacagaagatcatgattttaaaggctttcaagacctactgcttaacccggtgctcaccgccggttgttccactgatttttccttgcaatcaactcatcaaaattatatatcggattgcaaccttggatattttttacagattgggtacgtaataatcgatatttttgcttctctactgatgaaatacaagtcatggttttatgaataaatttggccttattggatacatatataatatgaatatgatacatatgtaggtttcaacaacactatgagcaaggtgaaggatcttcggtgacaaagagtaatgcaagaagtgatgctgagaccaactttgtccaatgatgggtttcgttgtcttggtttggactcattgagtcacgacgaagcg

SEQ ID NO: 4696 - DNA, 1141 bp, Artificial Sequence
  P8539 (opLexA::G2983, G2983 is from A. thaliana)
atgcatagcatttgctagttttaacatatagcaatgaaggttcatgagttttcgaatgggttttcttcatcgtgggatcaacatgactcgacatcatcccttagcctaagctgcaaacgcctccgtcctctcgcccctaagctctccggcagccctccctcccctccttcttcttcctccggcgtcacttcagccacttttgaccttaaaaacttcattagacccgatcaaaccggtccgacaaaatttgaacacaaacgagaccctcctcatcaagtcagttccattattgtacttcgtacattttacatcgtttctttcgtttgaaaaaagaagaagaattcactctagaagaattttgataattgcggcatacctaatactttgacatttataaattataacgactggagtggttccttttattattaattttatttatttattttaatgtatgattcctaacaaatgtaatgaaataatgtgtgggttcagttggagacgcacccgggagggacaaggtggaacccgactcaagaacagatagggatacttgagatgttgtacaaaggtggaatgcgtactcctaatgctcaacagattgagcatatcacattgcaactcggtaagtacgggaaaatcgaagggaaaaatgtgttctattggttccagaaccacaaagcccgcgagagacagaagcagaagaggaacaacctcatcagcctaagttgccaaagcagcttcacgaccactggtgtctttaatccgagtgtaactatgaagacaagaacatcatcgtcactagacattatggtaggaatttaaggattttgtatagttttgtggttttgatcaactatatttaaggataatttttatgattgtgtagagagaaccaatggtggagaaggaggagttagtggaagagaatgagtacaagaggacatgtaggagctggggatttgagaacttggagatagagaacaggagaaacaaaaatagtagtactatggcaactacttttaataaaatcattgacaatgtaaccctcgagctttttcctctccatcctgaagggagatgaagtcatgaaggtgaggcagaaaattgtggaattcttatgtagatctggtttaggttc

SEQ ID NO: 4697 - DNA, 1197 bp, Artificial Sequence; identical to SEQ ID NO: 1285
  P8548 (opLexA::G905, G905 is from A. thaliana)

SEQ ID NO: 4698 - DNA, 2767 bp, Artificial Sequence
  P8552 (opLexA::G1297, G1297 is from A. thaliana)
tggaattaacgacgttcgaagaaactccagaggtctcttcattttccttttgtatactggtaaaaattggtggtctcttctttgtctccgagtatggagaaaatgagagggaagcgaatcagaccaagagattccggcgagttagtcgaagatgggagatctgaaagcgagcgtaagacgaggaagaaagagaatgatgttgtgagcaaaggaagaatcggaagaggaagaggaagaggagaggtttcgaagcgatctattgaaatagacatttctaatcccgagaaggatattaagcctgacggaagcagaaagtgtttgggttcgacgtgtcatcattgtaagatcttgacgagtgagagtgatcttatcttctgttcaaagtgtaacaagaagtgttattgctttgactgcatcaagagatcgtattcagaaagaacacatgaggaagttagagctgcttgtccattctgtatgatgacttgcatttgcagagcttgtttgcggttgcctttggttatcaagcctccaagtgaaaaagatacagatgtcaagcttaagcagctgcagtatctgttagtcaaagttctcccagttcttaaggatatttatacggagcagaaccgtgaactagagattgaatcaacaattagaggacaccctgtgacagaagctaatatcaagaggtgcaaacttgacccaagcgaacgcatatactgtgatctctgccgcacatccattgccaattttcacagaagctgtccgaacaaaaattgttcagtcgatatatgtctttcttgctgcaaggaactaagtgagggcttccatcaagagagagatgggaagaaaaatgcagaagggaaaggatatgaatgtcgaatcccagcaggtcaaggaaaagactcggacgcatatgttccactgcatttctcgacttggaagcttaactcagacagtagcattccatgccctccaaaagagtgtggtggttgtggtacttcaacactggagttgagacgcttatggaaaagagattgggttgaaaaattaataacgaatgccgagaaatgtactctgaattttaggccaacagatgtggatattgttcatgaatgttcctcatgctctaccaattctgattccattagaaggcaggcagcttttaggaagaatgctcatgataatttcttatactccccaaatgctgttgatctggctgaagacgatattgctcattttcagtttcattggatgaaggcagaacctgtgatagtcagaaatgttctcgagaagacatctggactaagttgggaaccaatggttatgtggagggcttgtagggaaatggatccaaagcgtaaaggtacagaagaagagacaacaaaagtgaaagctttggattgcttggactggtgtgaggttgaaataaatctgcatcagttttttgagggctacttagaaggccgcatgcataaaaacggttggccagaaatgttgaaattgaaggactggcctccctcagatttatttgaaaagcgccttccaaggcataatgctgagtttattgccgcattgcctttctttgattacactgacccaaagtctggtatcctaaatctcgcaacaagatttccggaaggatccttgaagccagatcttggacccaagacatacattgcgtacggtttccatgaagagcttaatagaggagattcggtgacaaaacttcattgtgacatttctgacgcggtcaatgtgttgacacacacagctaaagtggaaatccctcccgtcaaataccaaaacataaaagtacatcagaaaaaatatgcagaagccatgttgcagaaacaacaatacagtggtcaagtgaaagaagccagcgaacttgaaaacaagtcaatgaaagaagtggatgaaagtaaaaaggatttaaaagacaaggcagctaacgaagaacaatcaaataacagttcaagaccgtcgggctcaggagaagctgagaaagtaattatttcaaaagaggataatcccacacaacctgctgtgagtacaagtgtggaatccatacaagaacagaagctggatgctccaaaagaaactgatggcaataccaatgagaggtcaaaggctgtgcatggtggtgctgtctgggatatctttcgaagagaggatgttccaaaacttattcagtttttgaaaaggcacgagcatgagtttcgtcacttcaataacgaacccctggaatccgttattcacccaattcatgaccagactatgttcttgagtgatagccagaagaaacagctgaaagaagaatttgatatagaaccatggacctttgagcaacacctcggcgaagcagtcttcatacctgcaggttgtcctcaccaagtgaggaatagacagtcttgcataaaggtggcactagactttgtggctcctgaaagcgtcgaagaatgccttaggctaacacaggagttccggagattgcctaaagaccacagttctagcgaggataaattggagcttaagaaaattgcactgtatgctgcgagttcagccataagagaggtaaaagggctaatgcaaagctcccgacgcagtgatacctaacaaatgacaaggaaaagttcccaagtttattttatccctaaactattcctacgcagttgacttgttgtaacttcctctactttaaaatagtagagttggatagagtgtaatgtataattaccatgattaccgagtagtagaattatgtaaa

SEQ ID NO: 4699 - DNA, 2314 bp, Artificial Sequence
  P8555 (opLexA::G3101, G3101 is from A. thaliana)
ctgttccatctccatcctaatcttcaccttctccttgatttcgagatctctgtcaatttgttgaatctgttctttatctaattagctcaactccgagtctttgctggattttgaagcttttgtagctgaagcaaatttgtaatctgtgatggtgtatgcactgattctgggtatggtattgtactctaggatctcgtagcgagaatgccaggcattcctcttgttagtcgtgaaacctcttcttgttcaagaagcacagagcagatgtgccatgaagactcccgtctgcgtatttcggaagaggaggagattgctgctgaagagagcttggctgcctattgcaagcctgttgaactctacaatatcattcaacgccgtgctattaggaatcccttgtttcttcagcgatgtttgcattataagattgaggcaaaacataaaaggagaatacaaatgactgtattcctctcgggcgctatagatgctggggtacaaactcaaaaattattccctctgtatattttgttggcaagactcgtttctcctaagcctgtcgctgagtattctgcagtatataggttcagtcgagcatgtatcctaactggtggattgggggttgatggagttagtcaagcccaagccaactttcttctccctgatatgaatagactcgcattggaggcaaaatcaggatcactcgctatcttgtttatcagctttgctggtgcgcaaaattctcaatttggcattgattcaggcaagattcattcaggaaatataggaggacattgtttatggagcaaaatacctctgcaatcactgtatgcgtcgtggcagaaatcaccaaacatggacttgggacagagagtagacacagtctctcttgttgaaatgcagccttgcttcataaagctaaagtccatgagtgaggaaaagtgtgtctcgattcaggtgcccagcaatccactcacctcgagctctccgcagcaagtgcaagtcaccatatctgcagaagaagttgggtcaacggaaaaatctccttatagttcattttcatataatgacatctcttcctcttccttgttgcaaattatcaggttgagaacaggaaatgtagttttcaactacagatactataacaacaaattgcagaagactgaagtaactgaagacttttcttgtccattctgcttagtaaaatgtgccagtttcaagggcctgagatatcacttgccatcaacccacgatctcctcaatttcgagttttgggtaactgaagaatttcaggcggtaaatgtctccctcaagactgagacaatgatatccaaggttaatgaggatgacgttgacccaaagcagcaaactttctttttttcttccaaaaaattcagacggaggaggcaaaagagtcaggtacggagctcaaggcaagggcctcatcttggattaggttgcgaggtgctagataagactgatgatgctcattctgttagaagtgagaagagccgaataccacctggaaagcattacgaaagaattgggggtgctgagtctggtcaaagagttcctcctggcacgagtcctgcagacgtgcaatcatgtggggatccagattatgtgcagtcgatagctggaagtacaatgttgcagtttgcaaaaacgaggaaaatatctatagaacggtcggacttgaggaaccgaagcctccttcagaagagacagttcttccactctcatcgagctcagcccatggctctagaacaagtactttcggaccgggatagtgaagatgaagttgatgatgatgtggcagattttgaagatagaaggatgctcgatgatttcgttgatgtgactaaagatgagaaacagatgatgcacatgtggaactcgtttgtgaggaagcagcgagtattagcagatggtcacattccatgggcatgcgaggcattctcaagattgcacggacccatcatggttcgaacaccgcacttgatttggtgctggagagtgtttatggtgaaactgtggaaccacggtcttcttgatgcccgaaccatgaacaactgtaatacctttctcgaacagctccaaatttgaaaacccaagaaatcattaatttaagtagaaaaacaaagaaagacaagagaagaagagttttgggttctcatttaactacttttggtgttttaagagaaagaggagcatatttatgcatgaatttgtcctcatcttttttttttttttttttaattataaatgtgtacattggcttatctttgacgcttgttcttcgagtaatgctttatacatg

SEQ ID NO: 4700 - DNA, 590 bp, Artificial Sequence; identical to SEQ ID NO: 675
  P8560 (opLexA::G2457, G2457 is from A. thaliana)

SEQ ID NO: 4701 - DNA, 2432 bp, Artificial Sequence
  P8561 (opLexA::G2499, G2499 is from A. thaliana)
cttctcaatttcaattcaatctgggattcgtaaattctcggaagatgaaacgcgatttcgacgaaatctccgaggaagagtggtctcaacactcgtttaacgcttcgcgagttcttaaacgaccacggactccgaagaagactcgcgcggcgacgaatccaacgccgtcgattgagtcttttgcgtttaggagaccttcgacggcgatgacgattgagagtaatagcagcgatggtgattgtgttgagattgaggatttgggagattcggattcggatgtgaagattgtgaatggtgaggatttgttgttagaggatgaagaagaagtggaagagactaaggttgtgatgcgcgctgcgagagttggtaggagatttgtgattgaagatgaagaagcgagtgatgatgatgatgatgaggctgagagtagtgctagtgaggatgaatttggaggcggaggaggaggaagtggaggaaggagaggagaagatgaagatgttgtggggaaggcattgcaaaagtgtgctaaaatctcagcggatcttcgaaaagagctttatggtacttcttctggtgttactgatagatactctgaagttgaaacttctactgtcaggattgtcacacagaatgatattgatgatgcatgtaaagcagaggattctgattttcagcctatactcaagccgtaccagttagttggtgttaactttcttcttctgttgtataagaaaggaattgaaggagccattttagccgatgagatgggtcttggaaagaccattcaggcaatcacatatttaaccctcctaagtcgcttaaacaatgaccctggtcctcatttggttgtatgccctgcctctgtcttggaaaactgggagagagagctcagaaaatggtgtccgtcgtttactgtacttcaataccacggagctgcgagagcagcctactcaagagaattgaattctttgtcaaaagctgggaagccaccaccattcaatgtgcttcttgtgtgttactctctgtttgaacggcatagtgaacaacagaaagatgaccgaaaagtactgaaacggtggcgctggagctgtgttttgatggatgaagcccatgcgttaaaggataagaatagttataggtggaaaaacttgatgtctgtggccagaaacgcaaaccagcgtcttatgcttacaggaacgcctctacaaaatgatttgcatgaactatggtcgctgttggagttcatgttgcctgatatatttacgacagagaatgttgacttgaagaagttgttgaatgcagaagatactgagttgattactcgaatgaaatctatcttaggtcctttcatcttgaggcgtttaaaatctgatgtcatgcagcaacttgttccgaagatacagcgggttgaatatgtattaatggagagaaagcaggaagatgcatataaagaagccatagaggagtatcgtgctgcttctcaagcacggcttgtgaagctttcatcaaaatccttgaattctttagccaaggcacttccaaagcgtcaaatttcaaactattttactcaattccggaagattgcaaaccatccattgttaattaggcggatatacagcgatgaggatgtcattcgcatcgccaggaaattgcacccaatcggtgcatttggatttgaatgttccttggatagagttatcgaggaagttaagggtttcaacgatttccgtatccaccagcttttgttccaatatggagttaacgataccaaaggaactctctcagacaaacatgtcatgctctcagcaaaatgtcggacattagctgagcttctcccttcaatgaagaaatccggccatcgtgttctaatatttagtcaatggacatcgatgctcgatatcttagaatggacacttgatgtcatcggcgttacataccgaagacttgacggcagtactcaagttacagatagacaaaccatagtcgacacattcaacaacgataagtcgatattcgcatgtctcttgtcaactcgagcaggtggacaaggtcttaatttaaccggagcggatacagtcattattcacgatatggattttaatccacagattgatcggcaagctgaagatcgttgccatcgtattggtcaaacaaaaccagtcactatcttcagactggtgacgaaatcgacggttgatgagaacatctacgagatagcgaagcggaaactagttcttgatgcggcggttctagagtccggagttcacgtagatgacaacggagacacgcctgagaaaaccatgggagagattcttgcttctcttctcatgggataacattattgttaccttttttgttttgaggtaaaattagtcaagaaacgaagttaatgtgttattctaaacatgtgtaaccactagctattattagac

SEQ ID NO: 4702 - DNA, 1136 bp, Artificial Sequence
  P8564 (opLexA::G2927, G2927 is from A. thaliana)
atattctcggttagtagaaactaggaaaagagatgaatagaggagtgttggagagttcgccggttcaacatctcacggcggctggaaaccctaattggtggaataatgtcagccgcggcttgaggccaccaacgccgttgatgagtcacgagccgccgtctaccaccgcttttattccaagtctcttgccaaacttcttctcttctccgacttcctcttcatcttcttcaccttctttccctcctcctaatagtaaccctaacttctcttcttggcttgaaatgagtgatctgcctcttgatcagccatggagccttagtcaactcctcttgggtggattgatgatgggagaggaagagaaaatggagatgatgaaccatcatcatcatcaaaatcaacaccaaagttaccaagcgaagaggatacaaaattgggaagaacaagttttgaggcaccaagcttccatgaaacaagagagtagtaataataatagttatggaataatgtcctcaccaaactcacctccaaacaaatcttgtgctacaattatcaacaccaatgaagacaacaacaataacattcacagtggtcttaacttgtccgagtgtaatagctcagagatgattgggtcttcttttgctaataagaaaccaaaacttcaagttccttcatcacaatcaactctcaaggtgagaaaggagaaacttggaggcagaatagcatctcttcaccagctagtatctccctttggcaagactgacacagcctctgtcttgtcggaggctattggatacattagattcctccacagtcaaattgaggctttaagtctaccatactttggtactccctcgaggaacaatatgatgcaccaacatgcacaaagaaatatgaatggtatatttcctgaggaccctggtcagcttgtgaatgagtattgcatgaaaagaggagtttcattgtcatcgacggacaatcaaaaatcaaatcctaacgaagaaccgatgaaagatttgagaagtagagggctttgtcttgttcccatctcatgcacactacaagttggcagcgacaatggtgccgactattgggctccggcgttcggaaccactctccagtgaactattcactttctg

SEQ ID NO: 4703 - DNA, 2183 bp, Artificial Sequence; identical to SEQ ID NO: 1015
  P8566 (opLexA::G341, G341 is from A. thaliana)

SEQ ID NO: 4704 - DNA, 1121 bp, Artificial Sequence
  P8573 (opLexA::G811, G811 is from A. thaliana)
gagaaagagagagatggaggacgacaatagtaacaacaacaacaacaacaacgtgatcgcacctttcatcgtgaaaacatatcagatggtcaatgatccttccaccgattggctcatcacttggggacctgctcacaacagtttcatagtcgttgatccactcgacttctcgcaacgaatcttacctgcttatttcaaacacaacaatttcagcagttttgttcgtcaactcaacacctatgtaagttaattcataaccgaaactcatacatgaaactggaaacaggggattacgaactaatgatcctttctttatttactttaggggtttaggaaagtggatccggaccggtgggagtttgcgaacgagcattttctaaggggacagaagcatttgttgaataacatagcgcgtaggaaacacgcgcgggggatgtacggtcaagatttggaggacggtgagattgtgagggagatcgaacggttaaaagaagagcagagggagctagaggcagagattcagaggatgaaccggaggatcgaagcgacggagaagagaccggagcagatgatggcgtttctttacaaagtcgttgaagatcctgatcttcttccaagaatgatgctcgagaaagaacggacaaagcaacaacaacaagtttccgacaagaagaagcgtcgtgtcacgatgtcgacggtgaagtcagaggaagaagaagtggaagaagatgaagggagggtctttagggttatgtcatcatcaacaccgtcgccgtcatcaacggagaatctttaccggaatcattcaccggatgggtggattgttcctatgacgcaaggacagtttggtagttacgagacgggtttggtggcgaagtcgatgctctcgaattcaacgtcgtcgacgtcatcatctttgacgtcgacgttttctttgccggagagtgttaacggaggaggaggaggaggatgtgggagtattcagggagaaagaaggtataaagaaacggcgacgtttggaggagtggtagagtcaaatccaccaacaacaccgccttatccattttctctgtttcgaggtggcttttagcgtttagcttcacatgatatatgatctttag

SEQ ID NO: 4705 - DNA, 998 bp, Artificial Sequence; identical to SEQ ID NO: 851
  P8578 (opLexA::G2838, G2838 is from A. thaliana)

SEQ ID NO: 4706 - DNA, 1341 bp, Artificial Sequence
  P8584 (opLexA::G1018, G1018 is from A. thaliana)
aagataaagaaactctcgacgacatcttgagaatcgaacgagaatgatccaaaatctgcaaaaattaccccaagacctccaatcctcggcaatgaagatgcctcctcccttttctgcgtcgaagactcaatacttgttccacgacgagtcatcggaaaactctaaaaagagtttggtctccacaactctttctttgtcgtcttgtgaaaaccctaataagaggaagatgaactctgacgaagttctcaatatttcttgcataccaagagactacaaattaacacaagtagaaagaaagattgcacgaatgaggaatctctcgtatcaagaaaaggcagaggacgaatggtacggtgtctcaacagaactaacactcttcaaggatccgtggatcatcaaaaaggtactaaccactagcgatcttggccagatatacaggagaatccctaatatttgaatcaatatagatgttctggacatattcttaaattatttcatatcgatctgattttttttttttagtcataaaatatgaaaatatttgtaaatgtaaaatttaagaaacgcttttcagaaaccatttatttactaaaaaaaatatatgactaaagaaaagagttttgatcctttggtcaggtttttcactttgcttcagtcttggatatggctcccaactcagtctcaaatactcattgcttgttggacacggagtcaccagaaaacgctgaagagagtttggtctccctggatctgtgtttctatgacaaaacatggccacatgatcccaatgttgcttacaataaaccaacgtccgaagaagcaataaacctggcgtggatgaggactatgtcgaagagagcaagaaaagaagaggagaagtactacgtctcgacagaactaactctcctcaccgtcgctgacccatggaccttgaagatggcaatgaccaaaagcagtattggcaacctataccgtcttgttctaaaggcgagctttgtagacatccacattctgagatatctccctttggatgatcaaatgatggtcaaagaagactctggattagcagtcgaggtgtatgatcacgacactgactctgtgcacaatctggctcttaagaaatgggccaaatcttcaagctttgttctcgtcagcggatggcgtaagtgctttgtcgacagaagaggtttgcaggttggcgatgtgattggaatgtattgggatcgttctgaatctaagcttcatttttgtgtgctttctcgttccgaaacaatggattcagctcctcttcctccaagtccataggacctcactagctatggaggctctgcagagagattc

SEQ ID NO: 4707 - DNA, 3309 bp, Artificial Sequence
  P8585 (opLexA::G2818, G2818 is from A. thaliana)
ccaaatcctgccgctcctgcaaacactaaaagaaaatggcagatcatgaaagaaaaggttcagatgacagaggatgatgattttgatgagcagaatgcagtcattgctgaagctgctgagcagcctctagatttgattataccgctactaaagtaccaaaaggagtttttggcttgggctacaatacaggaactatcagccgtaagaggaggcattctcgctgatgagatgggaatggggaaaacaatacaagccatctctctcgttcttgccagacgggaagttgacagagccaaatctagggaagcagttgggcacacccttgtgcttgttcctcctgttgctctttctcagtggttagatgagatttctcggttgacatccccgggaagcaccagggttcttcaataccatgggccgaagagagacaagaatgttcaaaagttaatgaattacgactttgttttgacaacatctcccatagttgagaatgaatataggaaggatgaaggagtggacgaaacaatgtctcctttacactctattaagtggaatcgtatcatcgtcgatgaggtcagtaccaagacctgctggttcttcttcttttccattttcaagcatgtaaggaaaggggactgtgagatttattgtacagtaaaccacagcaggggaagctcactgcaaatttgctttttgtgaatcttttatccttcaggggaagctcactgcaaatttgatataattcccgtttgtcttcatatcaggctcatgatatcaaaaacagaagtagtcgcactgccaaagctgtttttgctttggaggcgacctacagatgggctctgagtggtacccctctccagaatgatgttgacgagctctactccctggttagttactctttcctcaactttttctatagcacgtaatgatatctcaacattgctgattgtttgtcccagatacgcttccttcgcgtttcgccatactcatattacttttgcaagaaatgtgactgtgaagttcttgatcggaggtaacatcttaccactctcaattcctggttactttctcctttcccatacttctgtttgatagttcataacaatctttgctgtttcatttcctttgtccattgcctttgggctttggcggtgactgcagtgcgcatcgaaaatgtcccagctgtcctcataatgcaaatcaacacatctcttggtggaaagaggtaactttgaggtgccattattaaaaacattttaaaagcaggatcaccattatgttctttggtttttatattttccaatcttgctagaatgtggacaaacggagaaacagagcctgtatattccttaaacaaaatgttctaaaggacattctactaagacgtactaaattgggccgggcagctgaccttgctcttccttctagaatcgtatgttcctttctctcccttgtctgatataaatgaagcttggtatagttgcttccgagcttgatctctacatataaatttagatctctctgaggcgagatgcactaagtgtagtagaagctgatttctatgaatcactatacaaagttagcaagacaacatttgatgggtaagttacttttgttctatggattttcactggtttctgctccatgctttgtgtaaactgaattttattattaaatctgacatgtacatttgtttctgcaggtatattcaggctgggacattgatgaataactatgcacatatatttggtcttcttatccgactgagacaagtgagtggtatcgatagttttgttgttctatttacaagccagtgcatgttttggatgatataggtatatagatttctgatgcattttcttgcaattttttcaggctgttgatcatccatacctggtgagttattctagtcctagtggcgctaacgctaacttgcttgatgcgaacaaaaatgagaaagaatgtggtttcggccatgacccttccaaggactactttgtaagtgttccagtcgatatattgttgctatttcatactatctcgactcttgtttctcagtaactgtatcttctggaaatagctgccaccattttacactttcttaaagaatcatcggatgactaatgttggacttaacttgttcggttaatatgtctttggttctcttactttgaaggtgacttctagtgaacatcaggcaagcaagacaaagcttaaaggatttagagcctctagcattttaaatcggataaacctcgatgattttaaaacaagtacaaagattgaggctttggtatgtgccctttgagatctacagcttctgtctctcccacgcttaaagtttctttggagattggaggctttatctaaccatttggtgataaaaaaaatttgtatgcagagagaagaaatcaggttcatggttgaaagagattggtctgccaaagcaatagtattcagccagttcacatcattcttggacctgataagttacgccttggggaaggtaatttcaagcgcaaccaactacaaaatgctactactactatatctgtgctcctttaacattctctttaatcataatgagacattgaataaaaatgattgactcattttgtacaacgcagtctggggttagctgtgttcaactggtgggaagcatgtccaaggcagctaaagatgctgcactcaaaaattttaaagaagagccagattgcagagttttattaatgagcttgcaagctggaggggttgctctaaatctaacagccgcttcgcatgtaagaagtgtacaacttataaaacagttgctcctagaacatgttttattcactgacattcgggtgtttgattgtataggtgttcatgatggacccgtggtggaacccagcggttgagaggcaagcacaggacagaatacataggatcggacagtgcaagcctgtcaggttatatttttgagttgtccttcaatatactgtatgttgttttggtgggggaagaaagaagaaacatttggttgtgtgacagggttgtaagattcataatggagaaaacagtagaggaaaagatactaacgcttcaaaagaagaaggaagatttgtttgaaaggtttcttattttaaacgatacgcttctctcaactttgctggtttcttattgtcaactgtatgaagcctatatgaagacatatttgctttgttacagtacgttaggtgactctgaagaggccgttgtacaaaagctgggagaagacgatatcaagtccctgttcgcataaccaaatcttgtagatgaagaacatgatag

SEQ ID NO: 4708 - DNA, 2265 bp, Artificial Sequence
  P8586 (opLexA::G2068, G2068 is from A. thaliana)
caacgatgaacggtcgtggaaatatgactcaataccagcagaatcctttcagtactgatgatggtggccagagcaccggcgtgtcactctcttcccggacttctctgtcaccaccactgatccgttatccagccgggtcgccggacttcagccccggaccacggtgtacgactcaaccgtcccctaccttctccgacttcactcaagcgagtccttcactgacgtcattcaataatccggcaagctttacaccttcgtttagcttctccaacattcaccaaatgattcctacgccgtcgtcgtcccataactcaaaggcgtcggtgagctctgcttcgtcgtctagcttctactttccccagacgagtccttcatcatgctctactccgtcgtcgttcagtccagactcgttttctcactccaacaccggaccatggtcgatccctcagccttcccctgtgttctcatccatagcaccggccagttctgctctgtcgtcgttcggtccagactcattttctcactccaacaccggaacatggtcgatccctcagccttcccctgtgttctcatccatagcaccggccagctctgctccgccgttgttcggtcgtgattcatttccccgctccaaccgcggaaaagggtcgttgattcataggtcgcctgtgctttcggtcttaccgccggcgcctgtctactcctctaatccgatggtgagatcatctccgccgggtcacccatctccatcagcacatttggaggaaatgtctaaccgtcccccgttgcatcctcagcctcgggttccagtcacgaggtccaactctgcgaaagtctccggtagcaggcctagaaagtatcataaaaggaccaacagtgagctatcaagtatgttggttggggactcaagccgcggcgaggaaggcggatttggaaagctcatatataatgaggaagcaatgaaggaattctgctctgagtatatgatcatgcctaaccaaagtgctgttaacaatagtgatcagaatcggaatgctgatgttttgatgataaccaatactgattcgggaggtgcaaatgatgctaagaaatataaaaggtaagcaagactgggtgacttatattagggaacaatattttttctttaatatattttattattatcttttgtgatgtatggttgttgacatttatttattcatattgatgctctttcagaatgttggcaaaccgagcctcagctgcacgttctaaggagaatcgggaaaagaagattcgtgatatggaactcagagtagaaactcttgaaaacactcaagcttcactgtttggaacgatgacacttttggaggtgagacatatatatcacaatatcaaccatctacttgtcatgtctaagtttcttctatagggaatttgtttaaacaaaactattgttgttgcatgcagaaggaaaacatagtgatgatgaacgagaataagttagcgaagattcgacttcaattactagagcaacaggcccctcttcttactggtacgttttagccacatatttctcttcataaaaagaattttgaatgagtttttaccaaatctttttttttttttcctttttttttccttttttttttaccaaagtttttaccaaatcttcaactgtgaaatacgtttatttttttctgctatatcgaaaacttgatgtctaactagtatgtaaatcatttttatatgaggttcctaacaagatccttcatcgtaccatcgtttttttatttgaaaaaatatccatgctcggtgactgaagaagatatataagctttcattttttttgtttttgtagctttaactaaacaattagatgaactccgaaggctagaaaaggaggcaaatgaacgagggagtgtcgactattctcaactactgaaacaactgaaacaaagtgaagagctccttgctgaaatcaaccgatttaaagtagcaactggtcaggggatgaaaaatcccaaccagttcgagggttcaaccatgcatcaatcggaccaaaacgtgttccagccgcaactcaacacctatgagttcaatcagcaccagcaattggacccaaacatattcaaagagcaatgcaatgtcaacgagtttaatcatgagcaaccaaaccatgaattttatggacataactaaaggattaaacatgtcttcaagttgttttagatttatctatatatgattataaatttgtaaccgtgagagggttcagacaatatg

SEQ ID NO: 4709 - DNA, 954 bp, Artificial Sequence
  P8587 (opLexA::G2999, G2999 is from A. thaliana)
gcttagggttttggagagagattactaagaaagttttaatgtttgtttaagagaaaagttatatattagggttttctttattcagaagcttcaagatcagaaaagatggaagttagagagaagaaagatgagaaaatggagatgacaagaagaaaatcatcagctctagatcatcatcgtcttcctccgtacacttactcccaaaccgccaacaaagagaaacccaccaccaaaagaaacgggtcggacccggatccggatccggatcttgatactaacccaatttctatatctcatgctccaagatcatacgctaggcctcaaactacttctccggggaaggcaaggtatagagaatgccaaaagaatcacgcggcgagctccggtggacacgttgtcgacggttgcggcgagtttatgtcttccggggaagaaggcacggtggagtctcttctttgtgcagcttgtgattgccaccggagcttccatagaaaagagatcgatggtttgtttgttgtcaatttcaatagctttggccattcacagagaccactcggaagccgccacgtgtctccgataatgatgagttttggtggtggtggtggttgtgcggcggagtcatcgacggaggatctaaacaagtttcatcaatcttttagtggttatggagtggatcagtttcatcattatcaacccaagaaacggtttaggacaaagtttaatgaagaacagaaggagaagatgatggagtttgctgagaagattggttggagaatgacaaaactagaagatgatgaagtgaatcggttttgtcgtgagattaaagttaaaagacaagtgtttaaagtttggatgcacaacaataaacaagcagcaaagaagaaggatttgtaagagatttctatatatatatatatactatttttacttctctttgttcaacattgctttaac

SEQ ID NO: 4710 - DNA, 1228 bp, Artificial Sequence; identical to SEQ ID NO: 585
  P8588 (opLexA::G2239, G2239 is from A. thaliana)

SEQ ID NO: 4711 - DNA, 977 bp, Artificial Sequence
  P8594 (opLexA::G2454, G2454 is from A. thaliana)
atcaagaatcctctgatcagtcaaatacccatcaatcaatcaaatccccaaacactcccaaaaaaagatcagcttccaatatttttccccttcttacaaaaaagatgtctatgtcgtctatgtcctccccttcctcagctgtttgttcaccggaccacttctctccttccgaccatctctgctatgtccaatgcaacttttgccaaaccatccttgcggttaatgttccttacacaagcttgttcaagaccgtaactgtccgatgtggttgctgtaccaatctcctttcggtgaacatgagatcatatgtcctcccagcttctaaccagctccagctccagctcggtcctcactcttacttcaatccccaggatattctggaggagctgagagatgcaccgtctaacatgaatatgatgatgatgaatcaacatcctactatgaatgacataccatctttcatggatcttcatcaacaacatgagattcctaaagcaccacccgttaaccgccctccagagaaaagacagagagtcccatccgcatataaccgattcatcaaggaggagatccaacgtatcaaagctggtaatcctgatataagccacagagaagcctttagtgctgctgccaagaattgggcccacttcccccacatacacttcgggctcgtgccagacaatcaacccgtgaagaaaaccaacatgccccaacaggagggagaggataacatggtgatgaaagaagggttctacgctcctgcagctgctaacgttggtgtgactccttattaaagagataaatataatcgactaagtatttgaggaattgaaatccaatttcttagggtttatcatgtccaaaagttgtggtttcttttcctttcttgaacttatttatatatattataaatatgcatgtgtctttttctgttgttgtaatcaaaaatcttgctaattaatggggtttcttaagtt

SEQ ID NO: 4712 - DNA, 2597 bp, Artificial Sequence; identical to SEQ ID NO: 895
  P8596 (opLexA::G2921, G2921 is from A. thaliana)

SEQ ID NO: 4713 - DNA, 1050 bp, Artificial Sequence
  P8606 (opLexA::G2766, G2766 is from A. thaliana)
cctaagcatcagattagcttttgtagggtttttcttttccggtttcatgtaccctcctaattcctctaagtccaccgctcatgacggcggcggcgatgccgacaccaatcaatatgactcagccgctggagctacccgtgatttctcctctcttggccctcaaacccaccatcatccgccaccgcagcggcagcagcagcatcagcagaatcccaacctcgtcggccattatttaccgggcgagccatcttccatcggattcgattccaacgcttcttcttcgtcttctttgttccgacacagaagctctccggctggattctacgaccaacatcttcccactgatcccaacggtttttctctaggacggccaaacggaggctacggcggaggaggagagcaagggccgtcgaggttgaagtcggagctgagattctctagtgggagtagtagccatcaagaacataattctctaccgcgaatctcggaggttgaagcggctgcagcggctagaaacggtgtcgcatcaagtagtatgagttttggaaataatcgtactaacaattgggacaactcgtcttctcatatcagtttcaccattgatcaacccggaaaacggtccaagaactccgactttttcaccttagaaactcagtatagcatgccgcaaacaactctggaaatggcgacaatggagaacttgatgaacatcccagaggactcggtgccttgtagggctagagccaagcgcggcttcgcgactcacccacgcagcattgctgaaagggagagaagaacgaggataagcgggaagctgaagaagctacaagaacttgtgcctaatatggacaagcaaacgagctacgcagatatgttggatttggctgttgagcatatcaaaggtcttcagcaccaagtagagtcactggaaaagggaatggagagatgtacttgtggggcatgcaagaagcgatgatgaatgatattgttccaagtatgatgcaataaagtatagaagaaaaggagatcacttacgaaccaaattctaag

SEQ ID NO: 4714 - DNA, 2501 bp, Artificial Sequence
  P8610 (opLexA::G1451, G1451 is from A. thaliana)
gtttggtttcttgaagttgaattagacatgaagctgtcaacatctggattgggtcaacagggtcatgaaggagagaagtgtctgaattctgagctatggcatgcttgtgctggaccattagtctctcttccatcatctggtagtcgagttgtttactttccacagggtcacagtgaacaggtagctgctacaactaataaggaagttgatggtcacatacccaattacccaagcctaccaccacaattgatatgccagctccataatgttacaatgcatgcagatgttgagacggatgaagtctatgctcaaatgacacttcaaccattgacaccggaggagcagaaggaaacatttgtaccgattgagttggggataccgagtaagcaacctagtaattatttttgtaagactctcacagctagtgataccagtacacatggagggttttctgttcctagacgtgctgctgagaaagtgtttcctccattggattacacactgcagccaccagctcaagaactgattgcaagggatctccatgatgttgaatggaagtttaggcatatctttcggggacagcccaaacggcatctcctaactactggatggagtgtctttgtcagtgccaagcgactagtagctggagattctgtcattttcatcaggaatgaaaagaatcaactctttttgggaattcgtcatgccactcggccgcagactattgtaccatcatctgttttatctagtgatagcatgcatattggactccttgctgctgctgcacatgcttctgcaactaatagctgtttcactgttttctttcatccaagggctagccaatctgagtttgtgatacaactttccaagtacattaaagccgtttttcacacgcgtatttcagttgggatgcgctttcgcatgctcttcgagacagaagagtcgagtgtccgcaggtacatgggtactataactggtattagtgatctagattctgttcgttggccaaactctcattggcgatctgtgaaggttggttgggatgaatcgactgcaggggagagacagccaagggtttctttatgggagattgagcctctgactacctttcctatgtatccatctctttttcctctcagactaaaacgtccatggcatgctggcacatcatctttgcctgatggaaggggtgatttgggaagtggtctaacatggctaagagggggaggtggagagcagcaaggtttgcttcctctaaattatccatctgttggtttgtttccatggatgcaacaaaggctggatctcagtcaaatggggactgataataatcagcaataccaagcaatgttagctgctgggttgcagaacatcggcggtggagatcctttaagacagcagtttgtacagctgcaagagcctcaccaccaatatcttcaacaatcagcttcccataattctgatttgatgcttcagcagcaacagcagcaacaagcgtcacgccatctcatgcatgctcaaacacagattatgagtgagaatcttccgcagcagaatatgcgacaagaagttagtaaccaaccagctggacagcagcaacagctacagcaaccggaccaaaatgcatatcttaatgctttcaaaatgcaaaatggccatcttcaacagtggcagcagcaatcagagatgccatctccctcgttcatgaagtcagattttactgactcaagcaacaaatttgcaacaactgctagtccggcttctggagatggcaatcttttgaatttttctataaccggtcagtctgtactccctgagcagttaacaacagagggctggtctccaaaagcatccaacactttttctgaaccgttgtcacttccacaagcctatcctgggaagagtcttgctctagaacccggaaatccgcagaatccctctcttttcggtgttgatcccgactctggactcttcctccccagtacggttccccgctttgcttcttcatcaggagatgctgaagcttcccctatgtcactaacagattcaggatttcagaattccttatatagctgcatgcaagacacaactcatgagttattgcatggagctggacagattaactcgtccaaccaaaccaagaactttgtaaaggtttataaatctggttcggttgggcgttcattagacatctcccgattcagcagctaccacgagctgcgagaagagttagggaagatgtttgctatcgaagggttgttggaagacccccttagatcaggctggcagcttgtattcgttgacaaggaaaatgatattcttctccttggtgatgacccatgggagtcatttgtgaataacgtttggtacataaagatactatcaccagaagatgtgcatcaaatgggagatcatggagaaggcagtggtgggttattcccgcaaaacccgacccatctctagaagctgcttcggtgttagtctcatcatgctacaacgcg

SEQ ID NO: 4715 - DNA, 2776 bp, Artificial Sequence
  P8611 (opLexA::G1256, G1256 is from A. thaliana)
ctatctacttgggttctttctttgtctctgagttttagcttttttattgacctttttcttcttggtttcttctctgcatctcaaagactaaaagggtacaataaaaaaacaacttatactatgtcttctttctaaaacttacaaattaaatccaactctttggatttatatttgttctctttgttctcgtaaatgtcttctagtgaattttttttttcatgtcgtcaatctctatggcttcttcctgttcttctaattccccgctttcgttttcttctgaatcatatttgatttttatcttctctctcattttttaaaattattttttctttatggatctttgtagctttagcaaaaaccgaccagctgagaagatgtcttcatcgtacaacacaattgctttgtcctccactccgaccttcctcctctcaagtgccgctgccggacccggaccaaacaactttaaccgtcaagaggctgcgatgaccatggttcaacaacaacccacttcctccgttgctccaccacccaagaagcgaaggaaccaacccggaaacccaagcaagtacctcttacttaatttttttatgaataataagtgaagaattttccattttagccgaaaataatataagaaccctaatcatttccgataaggaaaaaattttgtttagattatataccttttattcgatcaatttaatcaaagaagattagtatttgatgtgcttgcatacaattctctcttgattaatgggttcttgatttttttttttttaattgagcagatccagatgctgaagtgatagcgttatcgccaaagacgataatggcgacgaacaggttcctatgtgaagtgtgcaacaaagggttccagagggaacagaatctgcagctccacaggaggggacacaaccttccatggaagctgaaacaaaagtccaacaaagaggtgaggaggaaggtgtacctttgtccggagccctcgtgcgtccaccatgaccccgcacgtgctctcggagacctcaccggaatcaagaagcattactatcggaagcacggtgagaaaaagtggaagtgcgataagtgctctaagcgttacgctgttcaatctgattggaaagctcactctaagacctgtggtaccaaagagtatcgatgtgactgtggtaccatcttctctaggtaaactatctttcttcattccattccggactcttttttttttttttactgcggattttacatgtcggctctagatttttaaggttagtactctacgcttctgcttgagattcaagtaaaaaaaaaaacatgtcggtcagtgaatagtaaatttttaactatagtagtactggagtgtggtaccctcttatatatatatatattgacttgtgactgaaatctatgcatatagatatagatatcttctatattggccacggaacatcatatttcctacatagggacatgaacaaatatgcatatatacacataggatctatcaatctatttgtttggttgctgatgagtagtgaaagagagaaagacagtgaaggagaaaggggaaaaattaaagatgccaaatttggtcacatgtgagttggatttgtttccattcattcccacttttggattcttcttatctttgcaggttcctctttccatgtaactcctcttcttgtgggcccattccatttctctctccataatattcatattgatttcagacttatatatgtgatttgtgtataagagtggttggtttcattgtttaatcgatgaacatggtggtcagcgtgatatagtaggagtagttgatgaacactttacatttctagggtttttttaatgtcttctttttcgtggttgtacatacattgaccttatcgtgatttacagttttaaattatttgtgtgattgtaggagagacagttacatcacccacagggcattctgtgatgcactcatacaggagtcagcaagaaaccccaccgtgagcttcacggcaatggcagctggtggtggtggtggcgccagacatggcttttacggcggagcttcttccgctctctctcacaaccatttcggtaacaatccaaattccggtttcacccctctagctgctgcaggctacaatctgaaccgttcatcttccgacaagttcgaagacttcgttcctcaggccaccaaccctaatcccggtccgaccaacttcctcatgcaatgctctccgaaccaaggactgttagcccagaacaatcagagtctcatgaaccatcatggtctgatcagcctcggtgataacaacaacaacaaccacaactttttcaacctcgcatactttcaagacaccaagaattctgatcagacaggtgttccttctctgttcaccaatggtgctgataacaacggcccatctgctttgcttagagggctaacttcttcatcttcgtcaagtgtggtcgttaatgactttggagattgtgatcatggaaaccttcaaggactcatgaactctctagctgcgacaacagatcaacaaggccggtcccctagccttttcgaccttcatttcgcaaacaatcttagcatgggtggctcggataggttgactttggactttcttggtgttaatggaggaattgtgagcaccgtcaatggccgtggtggtcgtagtggtggacctcctctggatgctgagatgaagttttcacacccaaatcatccatatggcaaagcttgagatgatcgttatctatctacaaatcatcc

SEQ ID NO: 4716 - DNA, 963 bp, Artificial Sequence
  P8614 (opLexA::G547, G547 is from A. thaliana)
cttccatcacttcctctacgtgctcacaatgaacaacaatcattcctatgatgatcgcagttttcacattccacttcatccttctaacacaagcaaccctaatccaaatctccagtttgctttatcttcaagctacgatcacagtcctaagaagaaacgcaccaaaaccgttgcttcatcctctagttcttcaccaaaatccgcgtcaaaaccaaaatacaccaaaaaaccagacccaaatgcccccaaaatcacacgtccatgtactgaatgtggcagaaagttttggtcttggaaggctctctttggtcacatgagatgtcaccctgagcgtcaatggcgtggcattaatcctcctcctaactaccgtgtgcccaccgcggcttcttcaaaacagttaaaccagatattaccaaattgggtctcatttatgtccgaggaagaccatgaagtcgcttcttgtctcttaatgctgtctaatggtacaccatcatcatcgagtattgaacggttcgagtgtggaggatgtaagaaagtgtttggatcacatcaggctttaggaggacacagagcgagtcataaaaacgttaaaggctgtttcgctatcacaaacgtaaccgatgatcctatgacggtttctacttctagtgggcatgatcatcagggaaaaatccttacgttttcagggcatcataagtgtaatatctgttttagagtgttctcgagtggtcaagctttaggaggtcacatgagatgtcattgggaaaaggaggaggagccgatgatcagtggtgctttggatttgaatgttcctccaacaatacaggatctttctacttcggacacatcagggtgttgtttagatcttaggttaggactctaattagtatctatatatatatataatgtctgtaggtatattggatgtttccttctaattaataggtcaatgtacatgttgtg

SEQ ID NO: 4717 - DNA, 957 bp, Artificial Sequence
  P8615 (opLexA::G1469, G1469 is from A. thaliana)
gtgtttttcatcgtcaaaatgtattcacttctcaagaaaacaaaaatctgtcaggtgtgcaagaaatcattttcaaacgggaaagctcttggtggtcacatgagagctcacactttgaaatttttccctggatcatcttcatcaactggctcgatcactccatcactacgatcatgcaacaaccttggagcaagctttagaagacctaatgaaacagttctggcgagatttgtccacaccagtgaagttgttggtggtccaaagccagatctaaacaaagaagctgagcaacgaacaactgtcaagaaaaagatcgtcgtggatttggaagaggaaaattcgatagagtctgaaagcgatataactattgaagaaagtgctttatgtcttttacaaatgaaggatgacaacatgtcagaatatcttcagaatctgaaatcgattgatagtttggtatcaactcgaaaaagaaaagatactgaaaactatatcgaaatagattctgatgaaaatcacgaagatagtgatgatgagtacgttgttgaagatgaagatgaagacaatgaagatgacgatgttaagtctctcacttcagatgtggaaaacctaataggagacagcgatgaagatgatgatgattatggtgatgaaaacgcatattacggtggaaaaaggaaaaggggtaagaaacaaagtaaatatacgtgtgatacttgtggaaaagttttacgttcgtatcaggcattaggtggtcatcgaacgagccacaaatacaagcgattgaagatttccgacaagaattatttcggggaagatgggccaatagttcgacgacaatacgagtgtcaaatttgtaacagaatgtttgcatctggtcaagcacttggtggtcacaaaaagattcactatatgttcctagctccagccaagtaacttgtcgatttccaccaagtgacc

SEQ ID NO: 4718 - DNA, 2703 bp, Artificial Sequence
  P8616 (opLexA::G1535, G1535 is from A. thaliana)
cttccaagtgatgttgacaatgggagaaggtaatgtgatgacttcaaacaacagatttgcttcgccgccgcagcagccgtcttcttcttctccgggaacaatccaaaaccctaatttcaatttcatacctttcaactcatattcatccattatcccgaaggaagagcatgggatgatgagtatgatgatgatgatgggagatggaacagtagaggaaatgatggaaaacgggtcggcgggtgggtcattcgggtcaggtagtgaacaagcagaagatccaaagtttggaaacgaatctgatgtcaatgagcttcatgacgatgaacaacctcctccggctaagaagaaacgttatcacagacacactaatcgtcagatccaagaaatggaagcgttgtttaaagaaaaccctcatccagacgacaaacaaagaaagagattaagtgctgaacttggtcttaagcctcgacaagtcaagttttggttccaaaataggcgtacccaaatgaaggcacaacaagacagaaatgagaatgtgatgttaagggcagagaacgataatcttaagtcggagaattgtcatcttcaggcggagctacggtgcctctcttgtccttcttgcggcggccccaccgtccttggcgacattcctttcaacgagatccacattgagaactgtcgcctccgtgaagagcttgatcgtctgtgctgcattgcctcgagatacactggccgtccgatgcaatctatgccaccatctcagccattgatcaatccttctccgatgcttccacatcatcaaccttcattggagctagacatgagtgtatacgctgggaactttccagaacaatcttgtacagacatgatgatgcttcctccacaagatacagcttgtttcttcccagatcaaactgccaacaataacaacaacaacaacatgttacttgcggatgaagaaaaggttatcgctatggaattcgctgtctcttgtgttcaagaacttactaaaatgtgtgacacagaagagcctttgtggattaagaagaaatcagacaagattggcggcgaaattttgtgtcttaacgaggaagagtacatgaggttgttcccatggccgatggagaatcaaaacaacaaaggagattttcttagagaagcttcaaaggcgaatgcagtcgttatcatgaacagcataacactagttgacgcctttctaaacgctgataaatggtcagagatgttctgttcaatcgtggctagggcgaaaactgttcagataatttcatcaggagtttctggagctagtggttctctccttctgatgtttgcagagttacaggtactatctcctctggttccaactagagaagcttattttcttcggtatgtggaacaaaacgcagaaaccggaaattgggcaatcgtggatttcccgatcgatagcttccatgaccaaatgcagccaatgaatactattactcatgagtataagagaaaaccttcaggctgcatcattcaggacatgcctaatggatactcacaagtcaagtgggtggagcatgttgaagtagacgagaaacatgtgcacgagacttttgctgagtatgtgaaaagcggaatggcttttggagctaaccgttggctcgacgtgttgcagagacaatgcgagaggatcgctagtctaatggctagaaacataactgatcttggagtaatttcatctgcagaagcaaggaggaacataatgaggttatcacagagacttgtgaaaacattctgtgtgaatataagcactgcatatggacagtcttggaccgctttgtctgagacaactaaggacaccgtgaggatcacgacaaggaaaatgtgtgaacctggtcagccaacaggagttgttctttgtgctgtctcaaccacttggcttccattttctcaccatcaagtctttgatcttatccgtgatcaacatcaccaatctctggtaaacaaaaactagagtcttctctctgttcttgatgccaaaaccctaagatttttcgattttttccctgcagctagaggttttgttcaatggtaattcacctcatgaagttgctcatatcgcaaatggttcacatcctggaaattgcatctctcttcttcgaatcaatgtaagtttcaaaccttcattaaaaccctaattcaaagatttcaattttttccgaataaattagggtttttgcaggtcgcaagcaactcatggcataatgttgagctgatgcttcaagaaagctgcattgataactccggtagcttaatcgtctactccaccgtcgacgttgactcaattcagcaggcgatgaacggtgaagattcttccaatattccgattttacccctcggattctccattgtccccgtgaatcctcccgagggtatttccgtcaattcgcattctccgccgtcgtgtcttctcaccgtcgggattcaggtcttggcgagtaacgtcccaacagcgaaaccaaatctctccaccgtcaccaccatcaataaccatctctgcgccaccgttaatcagatcacttctgccctcagcaacaccattacgccggtgattgcatcttccgctgacgtgtccaatcaagaagtcagctagttgaccgaattacccctaaacctccttttgctttttctatctcagagtcagagcagtcccatgtc

SEQ ID NO: 4719 - DNA, 2554 bp, Artificial Sequence
  P8618 (opLexA::G2831, G2831 is from A. thaliana)
caacaaaacttttgtccaagaagaagacatgacaactgaagatcagacaatttcaagtagtggaggatatgtccaaagctcatcaacaactgatcatgttgatcatcatcatcatgatcaacatgaatccctcaatcctcctcttgtcaagaagaagagaaacctccctggaaatcctggtaacaattaattaagtttaatagagatcacaaaataattcaaccctaatcaacatttttttttctgtttgctgaaaagtcatgttcttttttttttcgatcttgatctacaaacatgcatgctttctactgtttagatctttcacatgatcaaatatgtatccagaatttgattgttatatttcgttctctatagatccagaagctgaggtcatagctctatctccaaagacacttatggccacaaatcgtttcctctgcgagatatgtggaaaagggtttcaaagagaccagaatctacagcttcaccgtcgaggacacaacctcccatggaagctaaagcagaggacgagcaaagaagtaaggaaacgagtgtatgtatgtccagaaaagagttgcgtccaccaccatccgacgagggcacttggtgatcttaccggcattaagaaacatttttgtcggaaacatggcgagaaaaagtggaagtgtgagaaatgcgccaagagatatgcagtccaatctgactggaaggctcattccaagacttgtgggactagagaatatagatgcgactgtggtacaattttctccaggtacttagtgtatatctacacacgtacgtactaatagatgatctttacatttcctcatcacggtatcatatatttttagtggcgtaacaaatattttgatcacctagctgtaagcgcatatcatgtttaattgcattatatatagattcaaatatgattttaacttcttaaccagtaaagttaatcatgtttgaatatattagaatataggaagaatatatatatacttatatacatatcttaaaactcatactaaacctagctagagcttatattttaccgggtgaatactatgatgaaaaacaaaaaaaaaacgaatctgttacctcaactaacactactgtaccactggaccacacaaacaaatttcgttttaccacgttgtttgtaagtaaataagatttttttttttttttttgtgaaacaatttgtaagtaaataagatacatgttttttgttggaagtagtagctcatgtagggtctaaaacaaaataatttggagttacttttgtatagatattgccatattggtcattctctgagcatacgtgctgcttgatttcttgaataagacagtttcttggattgacatattttggttaaagtaagatatacaactttatttatctttttttccttaattgctatctatattactatatacatacatattaaacacaagcataaattagcgagtgtgtatagacgatattgatcttattggtgtgtataatttggtcaacaggagagacagcttcattacacatagagcgttctgtgacgctttagcagaagaaaccgctaggctaaacgcagcctcgcatctcaaaagctttgccgcaaccgctggtagtaatctaaactatcattatctcatggggacacttatcccatcaccatcactaccacaaccaccgtcgtttccgttcggaccaccgcaaccgcaacatcatcaccaccaccaattcccaatcacaaccaacaacttcgatcatcaagacgtcatgaaaccagcgtctacgctctctttatggtcgggaggaaatattaatcatcatcagcaagtgaccatcgaggaccgtatggcgccgcagccgcattcaccgcaagaggattacaattgggttttcggaaacgcgaataatcacggcgagttaataacgacgagcgattcactcattactcatgacaataatattaatatcgtccagagtaaggaaaacgctaacggggcaacttctctttccgtgccttctctttttagcagcgttgaccaaattacccaagacgcaaacgctgcttctgtggctgttgcaaatatgtcggcgactgcgttactccaaaaagctgctcagatgggagcgacttcttctacgtcaccaacgacgacgattactaccgaccaatcagcgtatcttcagagttttgcatcgaagagtaatcagattgtagaagatggtggcagcgacaggttctttgcttcgtttggatcgaacagtgtcgagttaatgagtaataataataacggtcttcacgagatcgggaaccctagaaacggcgttacggtcgtttcggggatgggtgaattacagaattacccttggaagcgtagaagagttgatattgggaatgcgggaggaggagggcaaactcgggattttcttggggttggtgtacaaacaatatgccattcttcctctatcaatggatggatttgaaacactctttaatggatttttctaccttatttatgagtgaacttaattatcaaagctgatttc

SEQ ID NO: 4720 - DNA, 2228 bp, Artificial Sequence
  P8620 (opLexA::G2918, G2918 is from A. thaliana)
gaagttcaatttatttcgtcttccggaaatcaatccttttggtggctgtaaggtttaatgggcattgaaggtgtatcaacgtatttgaaatctggaaatatggacacaatttctgctccgccaggttttgtatctcaaacatcgtttgtgctgaggaatgtaccccgagacaaagaaagtcccaggtccgtgtcgagacaagagcagacaactggattcggcacagatgataaagatagttgcaatatgtttcttaaaagccgaccgtggatagtgcatggtcacacaattcccagctcagaggccttaaggccgaaaaaaactgaggtacggagaagacggcccctcaaagtgtctgagaccaaagtccttgaggaagctcctgtgttcaacccaaccgaagaggaattcagggacacactctcatatatatcaagcttgcgtgacagagctgagccgtatggaatctgttgtgttgttcctccaccttcatggaaacctccatgtcttctcaaggagaaacaaatatgggaggcttctacatttttccctcaagttcagctctttggaattcagaccgagaaccgaaagattaaaaaggaggttgatgcagatagtaatgatgctgcatctgaaggggttcagttatgtagagtagaacgtggtcctgggtatactttgaagtcctttaaaaactttgcagatacatacaagaagagtcattttggcatgaaggatgaggttttgggttcagagaactcatctccatcacttaaaccaaatgagctaattgtggcagacattgaaaaagagtacagacaaattgttgagagtccacttattgaaattggggtgctttatggcaatgatttagacactgcaacgtttggaagtggatttcccttatctgcaccatctgaatctagcaaatattcatcaggttggaatctgaacagtacggctaagcttcctggttctcttctatcattagaagactgcgaatcagtttgtgttcctcgtctaagtgtaggaatgtgcttgtcttcccagttctggaaatctgagaaggagagactctactctctctgctatttgcatgtgggcgctcctagagtgtggtattccgtagcaggatgtcatcgatcaaagtttaaggctgccatgaaaagcttcatccttgagatgtcaggagaacagccaaagaagagtcataatcctgtgatgatgatgtctccatatcaattgagcgtggagggtataccagtgacccgctgtgtccagcaccctggccagtatgttattatatttccagggtcgtattactctgcctttgactgtggcttcaactgtttggagaaagcaaactttgctccccttgattggttgccccatggggatattgctgttcaggtgaatcaagagatgagtaaaacgtcgctgatatcgtatgataagctattatttagtgctgcaagggaagctgtaaaatgtcttaaggaatatgggttgtcgaagaaaaacacagcatgttacacgagatggaatgattcttgtgggacggatgggttgttctccaacataatcaagtcacggatcaaactggagaaaaatagacgtgaatttcttatcagttcactagaatcgcaaaggatggacaagagttatgatgctgtgaacaaaagggaatgctgtgtatgtcttggggatttgtatctttccgcggttaactgttcatgctctgctaatcgttactcgtgtctgaaccacatgaggaagctctgtgcatgtccgtgtgacagaaagagttttctctataggtacactatggatgagttgaatcttctcgttgaagccctggaaggtaaaaagctcagctctatgttcagatgggcaggcatagatcaaaaattctgtgcttctccagccaccacaagttcaaaacccgaagaagacaaaggcaaggaaacagatgaggttacaccctgtaatatcacgaggaaagatgtcgcagctggaactaaggaccagacaagagtgaaggcgagatctttggctgatatactgaatgttaaagatggaaacaatgatgcaaaggagactttagaatcttgttctaagaaatcaaacaggccatgcgataacgattcctctgaggccaacgcgccaaagaaacagaagcagtgatgaataatgaaggagattgtagtttagtcacaaaatgcaagacg

SEQ ID NO: 4721 - DNA, 847 bp, Artificial Sequence
  P8621 (opLexA::G3037, G3037 is from A. thaliana)
ccaaacacaaaggatactcataagaaagcaatggacatttctgcgcagagatttgccatgaacggaagaagcatgagactccctcccgggtttcggttcgatcccgatgatgaagatcttgtgttcgagtatctcgccaagaaggtcctccaccgtccaatggacttcgatctccctgagctccgttcttgcaatgttgatccatgggacttgctaggtttgctacaaactcttctctctaataattactataccatatcacgtcaaatgtattgaaaaatgtggtttagtgaatgttgtacgtacacttttgttgtaggagagaagaacaaggaagtgtattacttcgtgaagaaggaagagcgagagaggaagggaagagagacgttatccggttattgggaagagtgtgaagaagaggaagtaatggaggctggtggtcgtgattgtattcatttagaaggaaggagaaagacatttgctttctttattggaaaaaaacctcgagggacaataactccatggatcatgtacgagttccgacttctttcctctagagctacaaggtggtcatcgtcccctctacctcgggtgagtcactcattggacttttatctttttctataacatatatttttgttgtaagtaatagtttagagctaactatatcaatgttttgggttttaaagggtgaggtaggaaaatggagggcggtgaaagtcgtagtgaaggaagagaatgatgaagagatggtggaggatgagcacgagtctgacgagtctgatggcgaggaagttattcaaagccggtgacgaccgaggttgatgccataaatatatgtacttgg

SEQ ID NO: 4722 - DNA, 1019 bp, Artificial Sequence
  P8625 (opLexA::G2837, G2837 is from A. thaliana)
ctgtcataaccgccatggttcagagaaaactttatataagggctaattcaatgtcgttttgaaacatcaatccctagactaaagtgcgaaaatagtatgagtaatccgaacccagagaaaacgaaagtggatgttactgaggaagagaaagaggaatctgatgagcaatggagcgatgaagaaaccaatatgagagaaattgttctcggcctccctgctttgaatatcagcagtagaatatttggagagagtagtagtgtcgttgaggaagatgcagaaaaagcgcgtttgaatgagcaagcggttcttgcggcggggttgattttggctgcggcagaggaagcggttatgaaaggaatgaatgagggaagtgggagtggtgggaagaaaaagagtagaccaaggatatctacgcaaaccgatgacgaaggggatggtttgggtgaaggagaagcgaaaaagccgaagaagaaagcaaaggaattgactcatccaccgaaaggaccaccggtttgtcatatctgtggaagaggtttcggttcgtggaaggcagtgtttgggcatatgagggctcatagagatagaaactatcaagggtttcttcctcctcctacattctctgcgggggctgaaaggtttgtgattcccgggctaagatctgcttttactattgccactgtcggaggaggaagttctggtggtgtagcggtaggaggaagaagttccggtgatttttctggcagtggtggtggtgatgcgccaggatctgaaggtgggagaggttcaggtattgatttgaatgtggaacctgtggagcaagtagaggaagcgactgaatctggatgtattgccaagttcgatcttaataaatctccaccaaaagatgaagaggaagaggacaaacccaagtgaaagattttttcatactatttaataatttactataacacatagtatagttattattttcatatttcatatttgatatatttatctaacacattatgttgattctttga

SEQ ID NO: 4723 - DNA, 2806 bp, Artificial Sequence
  P8627 (opLexA::G1148, G1148 is from A. thaliana)
gcagattattttcccctggaaggatggagacatcttcatctctgccactgtcacccataagtatagaaccagaacagcccagccatcgagattatgacatcacaactagacgtggggttggaaccacaggcaacccaatagaattgtgcaccaatcactttaatgtttctgtgagacagccggatgtagtattttaccagtacactgttagtatcaccacagaaaacggtgatgctgttgatgggacaggaataagcagaaagcttatggaccaactattcaagacttactcttctgatcttgatggtaaaaggttggcatatgatggagagaagactttatatactgttggtcctctaccacagaacgaatttgactttctagtcatcgtggaagggtcattttcaaaacgtgattgtggtgtctctgatggtggtagttcttccggtacttgcaagcgatcaaaacgttctttcttgccaagaagttacaaggttcagatacattatgctgcagaaataccgttgaagactgttcttggcactcagagaggagcttatacaccagataagagtgctcaggatgcacttagagtgcttgacattgtactgaggcagcaagcagctgaaaggggatgccttttggtcagacaggcatttttccatagcgatgggcaccccatgaaagttggaggaggtgttataggtattcgaggtttacattcgagctttcgtccaactcatggaggactctcgcttaacattgatgtgtcaacaacaatgatcttagaacctggtccagttattgaattcctgaaagccaatcagagtgttgagacaccacggcaaatcgactggattaaggctgcgaaaatgcttaaacatatgagggttaaggcaacacaccgtaacatggaatttaaaattataggtctaagttcgaaaccgtgcaatcagcaactgttttcaatgaagattaaagatggtgaacgtgaggtacctattagagagattactgtgtatgactatttcaagcaaacctacacagagcctatttcttctgcgtactttccatgccttgatgttggcaagccagatcggcccaactatcttccactggagttttgtaatcttgtatctctgcaacgttatacaaaaccattgtcagggaggcaaagagttttacttgttgaaagttcaagacaaaaacctctagagagaattaaaacactcaatgatgcaatgcatacctactgctatgacaaggacccatttttggctggatgtggcatctccattgaaaaagaaatgactcaagttgaaggccgtgttctcaagcccccaatgctgaagtttggcaagaatgaagattttcaaccttgcaacggacggtggaactttaacaacaagatgcttctagaaccaagagctattaaaagctgggctatcgtcaacttttcttttccatgcgacagtagtcacatttcccgtgagcttataagctgtggcatgaggaaaggcattgaaattgatcgaccttttgcactagttgaagaggatccacagtacaaaaaagcaggtcctgttgaaagggtagaaaaaatgattgcaacgatgaagttaaaatttccagatcctcctcattttatcctctgtattctgccagaacggaaaacttctgatatctatggtccctggaagaagatatgcctcactgaagaagggatccacacacaatgcatctgcccaatcaagatcagtgaccaatatctcaccaatgtacttctgaagataaattcgaagcttggaggcatcaattctctgttgggaatagagtactcttacaacattccattgataaacaaaattcccaccttgattttgggtatggatgtatctcatgggcctccaggtcgggcagatgttccttcagtagcagcggttgttggttcaaaatgctggcccttaatctcaaggtatagggcagctgtaagaactcagtcaccacgtctggagatgattgattcgctcttccaacctatcgagaacactgagaaaggagataacggtatcatgaacgaattatttgtagagttctatcggacaagcagggcacggaaacctaagcagattatcattttcagggatggtgtgagtgaatcacagttcgagcaagtcttgaagatcgaagtggaccaaattataaaggcgtatcaacgtcttggtgaatctgatgtgccaaaattcactgtcattgtggctcagaagaaccaccacaccaagttgtttcaagctaagggtcctgaaaatgttcctgcaggaactgtcgtggacaccaagatcgtacacccgacaaactacgatttttacatgtgtgctcatgcaggaaaaataggaacttcaagaccggctcattaccatgtattacttgatgagattggtttctcccccgatgacttgcagaatctcatccattctctctcctatgtcaaccaacgtagcacaactgcaacttcgatcgtggctccagtacgatacgctcatcttgcagcagctcaagttgcgcaattcacaaagtttgaaggtatatcggaggacgggaaagttccagagcttccacgtctgcacgagaatgtcgaaggcaacatgttcttctgctgagtacatataagtagttctgcttcctccctagtctaaacccaaaccctcctctttagaggaagtttatcattttgcatatatgcaatcatcaccgtacagtttcattagaagtaagaagaaagatcctcgcgtagattaagaggctc

SEQ ID NO: 4724 - DNA, 2568 bp, Artificial Sequence
  P8628 (opLexA::G1341, G1341 is from A. thaliana)
ttcagacagagagtgagtacttgaagaaatgggttgttgtcagtcaagaatagatagcaaagagatagtgtctcgttgtaaagcaaggaagagatacttgaaacatcttgttaaagctagacaaactctctctgtttctcacgcgctttatctccgttctctacgcgccgttggctcttcccttgttcacttctcttccaaagagactcctcttcacctccaccacaaccctccgtctccttctcctcctcctccaccgccgccgcgccctcctcctcctcctctaagccctggctctgaaaccaccacatggaccaccaccactacttcctctgttcttcctcctcctccgccgccaccacctcctcctcctccgccttcttctacatgggacttctgggatccgtttataccgccgcctccttcttcctctgaggaagaatgggaggaagagacaaccaccgcgacaagaaccgcaacaggaactggctctgatgctgctgtgacgacggctccgacgacagctactcctcaagcttcgtctgttgtgagtggattctctaaagatacaatgacgacgacgacgactggaagtgagctagcagttgtggtgtcgaggaatggtaaagatctaatggagattattaaagaagtcgatgaatatttccttaaagctgcagattctggtgcacctctctcttctctccttgaaatctcaacctctatcactgacttttctggtcattccaaatcaggtaacaacaatcaagctcttgtcttctcttctttgattgattttgattagtgttttgtgtttgtttcttcagggaaaatgtacagtagtagtaactacgaatgtaatctgaatccgacgtcgttttggacaaggggatttgctccttctaagttgagtgaatacagaaacgcaggaggagtaattggaggaaattgcattgttggtagccattcatctacagtggacagactctatgcttgggagaagaaactttatcaagaggtcaaggtattcactttttgacttcatttcattcataaagttgcaatctttgaacaaaacaattaatctttgatgtatcttcatatgttaagttttgtggaaagagtttgaaaatgttgtttatattcagtttgaagtttgaatattgaaattgcttgcttagatttcatccaaatatggataaatgttttgtttttgggaatttggttgattcatgtgggcattaaaggcttgtggtgggtccaagcgtgagcagatagtgtaagagacccacgtgtgtacttaattctgatgaataatgtgttatgtacactggcacaaatatcttgccaagtagtgagtgagtgtttgttgttttttgaatgtgggttttgttgcagtatgcagagagcataaagatggatcatgagaagaaagtggagcaagtgaggaggcttgagatgaagagagctgagtatgtcaagactgagaaggctaagaaagacgtcgagaagttagaatctcagctctcagtatcttcacaagccatccaaagcgcctctaacgagatcatcaagctcagagagaccgagctttaccctcagcttgtcgagcttgttaaagggtttgttttgtgcattcccattgcttcattaacctaaagtatcttatgttggtcaatgtgaacaaggttcttgtatgaatgtaatgtaggctaatgtgtatgtggaggagtatgtacgagagccaccaggttcaaacccatattgtgcagcagcttaagtaccttaacaccatcccctccactgaaccaacatctgagcttcaccgacaatcaactcttcagcttgagctcgaggtccaacaatggcatcactctttctgcaacttggtcaaggcccaacgtgactacatacaatctctcacgggctggctcaggttaagtctgttccagttcagcaagaatccacttgttaggagtagctacgagtcaaagatctacagcttctgcgaggaatggcatttagctattgacaggatccctgataaagtagcatctgaagggatcaaaagctttctgacagcagtccatggaattgtggctcaacaagccgacgagcataagcaaaagaagagaacagaatccatgttaaaagatttcgagaagaaatcggcttcgctgagagcgcttgagagcaagtatagtccatactcggtacctgagagtaggaaaaagaacccggtgatagagaagagagtaaaggttgagatgctaaaaggaaaagcagaagaagagaaaagtaagcatgagaagtcagtgagtgtgactagagccatgactctaaataacttgcagatgggtttccctcatgtctttcaggcaatggttgggttttcaagtgtgtgtatgcaagcctttgagtctgtgtacaaccaagctaagagcatcggtgaggatcaagaggaggttaagaggttgcttccttaaagagagaaagacaaattgttttaccatttgctctctgtttttgcttgatccaagctaatcttttggttgaatgttaggttga

SEQ ID NO: 4725 - DNA, 1660 bp, Artificial Sequence
  P8636 (opLexA::G2697, G2697 is from A. thaliana)
tgtctctctgcaaactattaccaaccagataatttagatatggaagctactcagaaacatatgattcaagaaggatcttcaatgttttaccatcaaccatcttcagtcaaacaaatggacctttctgttcagacatttgattcttactgcacacttgaatcctcttcaggcaccaagtctcatccttgtcttaacaacaaaaacaactcttcttcaaccacaagcttttcctctaatgaaagtcccatttctcaagccaacaacaacaacttatcaaggtttaacaatcattcccctgaagaaaacaataactctcccttgagcggttcttcagcgacaaacaccaacgagacagagcttagtctcatgcttaaagatttggagactgcaatgatggagcctgatgtagacaacagctataacaatcaaggcgggtttggacagcagcatggagttgtttcttcagctatgtatagatctatggagatgatctctaggggagatttaaaaggagtgctctatgaatgcgcaaaagctgttgaaaactatgatttggaaatgactgattggttgatctctcagttacagcaaatggtttctgtttctggtgagcctgttcagcgcttaggagcttatatgcttgaaggtctcgttgctaggttagcttcttcgggtagctccatctataaagcattgagatgcaaagacccaacgggtcctgagcttcttacttatatgcatatcttgtatgaagcctgcccttatttcaaattcggttatgaatctgctaatggagctatagctgaagctgtgaagaacgaaagttttgtgcacattatcgatttccagatttctcaaggtggtcaatgggtgagtttgatccgtgctcttggtgctagacctggtggacctccgaacgttaggataacgggaattgatgatccgagatcatcgtttgctcgtcaaggaggacttgagttagttggacaaagacttgggaagctagctgaaatgtgcggtgttccgtttgagttccatggagctgctttatgctgcacggaagtcgaaatcgagaagctaggagttagaaatggagaagcgctcgcggttaacttcccgcttgttcttcaccacatgcctgatgagagtgtaactgtggagaatcacagagatagattgttgagattggtcaaacacttgtcaccaaacgttgtgactctggttgagcaagaagcgaatacaaacactgcgccgtttcttccccggtttgtcgagacaatgaaccattacttggcagttttcgaatcaatagatgtgaaactcgctagagatcacaaggaaaggatcaatgttgagcagcattgtttggctagagaggttgtgaatcttatagcttgtgaaggtgttgaaagagaagagaggcacgagccactagggaaatggaggtctcggtttcacatggcgggatttaaaccgtatcctttgagctcgtatgtgaacgcaacaatcaaaggattgcttgagagttattcagagaagtatacacttgaagaaagagatggagcattgtatttaggatggaagaatcaacctcttatcacttcttgtgcttggaggtaactaataaaaaccttgttcggtttcagaagagattagaaac

SEQ ID NO: 4726 - DNA, 2353 bp, Artificial Sequence
  P8637 (opLexA::G2742, G2742 is from A. thaliana)
tttcgaatgggtaggtgtggaagaagcaacgacggagtaattggtggagtaagaccatacgtacgatctccggtgcctcgtctgagatggacgccggagcttcaccggagtttcgttcacgccgttgatttgctcggcggtcaatatagtcagtctatttaaccaatctcttttttttggtattttttttagatatctttaagttcggtttttgtagcttttacttgggcagttatataaaatcgcaatatataccaatattcattatcgccatagtccagtttttaaatgttttgtatttttgtgtttgaatgaaacagaagcaactccaaaacttgttctgaagataatggatgtcaagggactaaccatatcacacgtcaagagccatctccaggtcaaagaaaatgctaaaaaaatacttttttaatactatttattgtcttgtactgtttattcgtatacatcacactgctctttccacctttatcttttattaatttgaatatttttaaaacgttttttcattgttttgattatactgcagatgtataggggatccagaatcactcttcttggaaaaccaggtaatgagttctacatattttgttgtttatatgaggaggcatcaacgaattacactctcaaacgtcatagtttcaagattaggacatttcttttcatatacccaccattcacataaaatctgtaataatgcataaattgaaatctcactcccaccattgtcagaaatattcaaataatgtaaagtatttattaaaacaaggatagagagattaacaaaaaaaaatgaaaaagaatttggttatagacttataggtaaataagtgcttcttttaatttattgccaaaaacaaaaatactcctaccaaagagtgaagagaatattcatcatggtcataaattaattaatgtttttataatatattttttgggggacagaagagagttcttcaccatcttcaagaagaagaagaagacaagacaatgaagaagatcatcttcatgacaacttgtctgtacacgcaaggaatgattgtcttttgggttttcactcttttaactttaggtaaaaaaaaaaattatttccttggcaaaaaacggaaagggaatattaatttgtttctgacaagtgttttaattttattccagaaaataggtatgttatcatacagttttgtttgaatatgaattgtcgaatttaaagattttttttttttttttgggggagaagagagcagacttcagcgactgataatgatgacgatgactttcttaacatcatgaacatggagagaacgaagacatttgcaggcaatggcgagtccatcaaatttcagtctcatcactctctcgaggtattaaatatattcaattttatcatatggtttcataaatagccgttgcgaaaagttgatatcaataataaaaatatttaagactcagataaacactcactaaaccactgaacattgttatggtatgggtcaacactagggtagcatggggctcggtactgaaaattttcagatagagattttattgtcacaataaattcttaagtagtaagcactaatataattcattagtaaaataatttataatttggataaacaactaacccattgtatgggtaaaagagttgataaaatcattagtaaaataaaatcaccacctatatttgaaggagtacataattgttttgattaggttaattcattgattttagatatactataatctatagacaattagaattgttgaatccgttgattaatgtagaagaattagtagatttattacaaatactaatcttatgttctcacggacattctcaaatttatatattgaccaagaagagtataacctatagtctctaatttataagagcttattatgtctttggaatttaggctgagaacacgaagaacatttggaaaaacacatggcgagaaaacgaacacgaagaagaagaagagttatcgctgtctctgtcgttgaatcatcctcataaccatcaacaaagatggaaaagcaatgcttcatcatcactcagtgaaacaagcgaagcagtctcatcttcttctggtccattcatcttcagagattgttttgcttcttcgaagattgatcttaatcttaatctctccttttctctactccatagctgaagctttgttcagctttgttcctttgttctaaattttagcgtagtgaacatttagattgtttttaaaccaccttaaaagttcctaatcttttagttaggcctcttgatttgtgattgtgatgtttttttttttggctgtctacaatgtcacaattacatcgg

SEQ ID NO: 4727 - DNA, 1680 bp, Artificial Sequence
  P8640 (opLexA::G3063, G3063 is from A. thaliana)
aagtcgactctttgaaacatgccggttgatttagataattcctctacagtttccggcgatgcaagcgtctcatcgaccggaaaccaaaatctaactcctaaatccgtcgggaagaagaaacggaatcttcctggaatgcctgatccagacgctgaagtgatagctttgtcacctaaaacacttatggcaacgaatcgattcgtttgcgaaatctgtaacaaaggttttcaacgtgaccagaatcttcagcttcatcgtcgtggtcacaatcttccatggaaacttcgacagagatcgactaaagaagtgaggaagaaggtttatgtttgtcctgtttctggctgtgttcatcatgacccttcacgtgctcttggagatcttactggaatcaagaaacacttttgtcggaaacacggcgagaagaaatggaagtgtgagaaatgttctaagaagtatgctgttcaatcagattggaaagctcattcgaagatttgtggcaccaaggagtataaatgcgattgtggaactctgttttctaggagagatagctttataacgcatagagccttttgtgatgccttggctgaagagagtgcgaagaatcatactcaaagcaagaaactttatccagaaactgtcactaggaagaatcctgaaattgagcaaaaatctccagcagctgttgagtcttctccgtcattaccgccttcttctccgccatcggttgctatagctccggcaccggctatttcggttgagactgagtctgtcaaaatcatatcttcctctgttttgccgattcagaattctccagaatctcaagaaaacaacaatcatcctgaagtcattattgaggaagcttcaagaacgatcgggttcaatgttagctcatcggatctaagcaatgatcacagtaacaacaatggtggatacgcaggtttgtttgtatcatcaacagcttcgcctagtttatatgcttcctcaaccgcttctccaagtctattcgcaccatcgtcctccatggaacccatctctctctgtctctcgacgaacccttctttgttcggaccaacaatacgagatccgccacatttcctaactcctctccctcctcaaccggcaatgtcagctactgcattgctccaaaaagctgcacaaatgggttccacgggatcaggaggttcgttgcttcgcgggttaggcatagtttcaactacttcttcatctatggaactcagcaatcatgatgcattgtcattagctcctggtcttggacttggactaccttgtagcagcggtggtagcggatcgggtctaaaagagctcatgatggggaattcatcggtgtttggtccgaaacagacgacactagactttcttggattaggaagagctgttggtaatggtggtaataccggaggtggattgtctgctctgttaacttctataggtggtggaggtggaatcgatctgtttggatcaggggagttttcaggcaaagacattggaagaagttcgtaagagagacaaaaggcatgaacgtagtagaccagtgtagtatatagttcatcaagtttgtttcaggttttagatgttttggtatcttgttttagtgaaagctttagttttattcccaagtgggttttctctcaagtacataaatctcctagcaacaacaac

SEQ ID NO: 4728 - DNA, 1415 bp, Artificial Sequence
  P8643 (opLexA::G2620, G2620 is from A. thaliana)
ttcgatttctctgatgaattaggaagaaatttgatccaaaaatggatgggaattttccacaaggaggtgtagttcgtagtggagcttcatcttatggaggatttgatttacaaggttctatgagagttcatcaccaagactccatgaatcagcagcatcgacacaatcctaattctagaccacttcatgaaggtcttccctttactatggttacaggtcaaacctgtgatcatcatcagaatcagaacatgtctatgtctgagcaacagaaagctgaaagagagaagaattcagtgagtgatgatgatgaaccaagtttcacagaggaaggtggtgatggtgttcataatgaagctaatagatcaactaaaggatctccatggcaacgagtgaaatggactgataagatggtgaagttgttgattactgctgtttcttatataggagatgattcgagtatagatagtagtagtagaagaaagtttgctgttttgcagaagaaagggaagtggaaatctgtttctaaagttatggctgagagaggttatcatgtttcgccgcagcaatgtgaggataagttcaatgatttgaataaacggtataagaagcttaatgatatgcttggtagaggaacatcttgtcaagttgttgagaatcctgcgcttttggattcgattggttacttgaatgataaagagaaggatgatgttaggaagattatgagttctaaacatcttttttatgaagagatgtgttcgtatcataatgggaataggttgcatttgcctcatgaccttgctttgcagcgttcgttacagttggcgcttagaagcagagatgatcatgataatgatgattctaggaaacatcaaatggaggatcttgatgatgaggatcatgatggtgatggtgatgaacatgatgagtatgaggagcaacattatgcgtatggagattgtagggtaaatcattatggaggtggtggtggtcctttgaagaagataagaccaagccttagccatgaagatggagatcatccgagtcatgtgaattctctggagtgtaataaagtctctttacctcaaataccgttttctcaagctgatgtgaatcaaggtggggcggagagtggaagagcaggttcggtgcagaagcagtggatggagtcgcggactctccagctagaagagcagaagcttcagatccaagttgaattgctggaattggagaaacagagattcaggtggcagaggtttagcaagaaaagggatcaagaactcgagagaatgagaatggagaatgaaaggatgaaacttgagaatgatcggatgggattggagttgaaacaaagggaattgggtgttgaattataacggaattggcttcacttctcttgattggtatatagctttgct

SEQ ID NO: 4729 - DNA, 3094 bp, Artificial Sequence
  P8647 (opLexA::G2577, G2577 is from A. thaliana)
tcatctatcacaaggagtagttagaatattatatgaactcgatgaataactggttaggcttctctctctctcctcatgatcaaaatcatcaccgtacggatgttgactcctccaccaccagaaccgccgtagatgttgccggagggtactgttttgatctggccgctccctccgatgaatcttctgccgttcaaacatcttttctttctcctttcggtgtcaccctcgaagctttcaccagagacaataatagtcactcccgaggtttgtgttttaaaaatatttattttatctttgtttttgttattttttccccttcttccaatgcatagaacaaagaccaagactcacgcacgtagccctatttttgtttttcattgtttatcgatttcatctcttttgagaatttccatgagtggggtttagtgtttgttcacatgatcacatctcatgaatttaaacttagtaaaacatgaaactagacatttattttgtacccttttatccttataaaatgaaaattccatttcgtatattatagatcggtgatgaatcaaacccaacgttggggatcgctttgttttttgtctatagattgggacatcaatggtggtgcatgcaataacattaacaataacgaacaaaatggaccaaagcttgagaatttcctcggccgcaccaccacgatttacaataccaacgagaccgttgtagatggaaatggcgattgtggaggaggagacggtggtggtggcggctcactaggcctttcgatgataaaaacatggctgagtaatcattcggttgctaatgctaatcatcaagacaatggtaacggtgcacgaggcttgtccctctctatgaattcatctactagtgatagcaacaactacaacaacaatgatgatgtcgtccaagagaagactattgttgatgtcgtagaaactacaccgaagaaaactattgagagttttggacaaaggacgtctatataccgcggtgttacaaggttaatttcattcatctatgtatatttttattgtgcttaaattgtgattttcttggtattgtttgggacattctaatggttcggttgagagagagtgcaacggaatgtctctcaatgtatattaaagagaaacattaattagtgtacatgggtttatatatacaataatacgtcatatatatggtatgctcttgatcatagtatataatgtttgaatttaatgtcaggcatcggtggacaggtagatacgaggcacatttatgggacaatagttgcaaaagagaaggccagactcgcaaaggaagacaaggtactatatatataaagctaattttttaattttcatttaccatttattttcaaactaatttaggttttcttttcatgtgtttcatcaaaatttgcacctgatggctctcttttcagtttatctgggtaagttcttgattttaagctataaattaataatagatgactattaaatctattctaagcaaaatataattgttgtgttatctgatcctacaggaggttatgacaaagaagaaaaagcagctagggcttacgatttagccgcactaaagtattggggaaccaccactactactaacttccccgtatgttaattaatcaataatatatacataaattcctaacttctaaccaattttagtctgaataatgccaatctcttaaactagtattatcttactattaactgtcatgtttatattgttacatttgttacaataaaaattagtaatgttggttggatataatattcagttgagtgaatatgagaaagaggtagaagagatgaagcacatgacgaggcaagagtatgttgcctctctgcgcaggtacagaatgaaactcttgaatttattgcattttagaaacccatcacgtatatatttattaaaatatatcgtaacattgaataaatcattatttggaaagatataagaaacatgtaaatatgcaggaaaagtagtggtttctctcgtggtgcatcgatttatcgaggagtaacaaggtacgtataatccatctagatatggaacgaatacagtgtttcattattttttttgatgtatacataataattgtcatacaatactattaatctaatctaattaatatttcctttaaaatggttccaaaaggcatcaccaacatggaaggtggcaagctaggatcggaagagtcgccggtaacaaagacctctacttgggaactttcggtacattttccaataaaatctatatactataagatattaaatatacacaaatatatctaagtgaatcatacaaattatgtaggcacacaggaagaggctgctgaggcttatgacattgcagccattaaattcagaggattaagcgcagtgactaacttcgacatgaacagatacaatgttaaagcaatcctcgagagcccgagtctacctattggtagttctgcgaaacgtctcaaggacgttaataatccggttccagctatgatgattagtaataacgtttcagagagtgcaaataatgttagcggttggcaaaacactgcgtttcagcatcatcagggaatggatttgagcttattgcagcaacagcaggagaggtacgttggttattacaatggaggaaacttgtctaccgagagtactagggtttgtttcaaacaagaggaggaacaacaacacttcttgagaaactcgccgagtcacatgactaatgttgatcatcatagctcgacctctgatgattctgttaccgtttgtggaaatgttgttagttatggtggttatcaaggattcgcaatccctgttggaacatcggttaattacgatccctttactgctgctgagattgcttacaacgcaagaaatcattattactatgctcagcatcagcaacaacagcagattcagcagtcgccgggaggagattttccggtggcgatttcgaataaccatagctctaacatgtactttcacggggaaggtggtggagaaggggctccaacgttttcagtttggaacgacacttagaaaaataagtaaaagatcttttagttgtttgcttt

SEQ ID NO: 4730 - DNA, 906 bp, Artificial Sequence
  P8652 (opLexA::G145, G145 is from A. thaliana)
aagaaaatgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcagaacttagtagccagcaggagtatctcaagcttaaggagcgttatgacgccttacagagaacccaaaggaatctgttgggagaagatcttggacctctaagtacaaaggagcttgagtcacttgagagacagcttgattcttccttgaagcagatcagagctctcaggacacagtttatgcttgaccagctcaacgatcttcagagtaaggaacgcatgctgactgagacaaataaaactctaagactaaggttagctgatgggtatcagatgccactccagctgaaccctaaccaagaagaggttgatcactacggtcgtcatcatcatcaacaacaacaacactcccaagctttcttccagcctttggaatgtgaacccattcttcagatcgggtatcaggggcaacaagatggaatgggagcaggaccaagtgtgaataattacatgttgggttggttaccttatgacaccaactctatttgaatctttctcacttaatcaatccctctcttttttttttgacatttttaagatgatgtttctattttattacctctctcatgttttctgtcttgtgtgcatgtgtgtgtgtaatgtttatgcccttctattattcaatgatttctcgac

SEQ ID NO: 4731 - DNA, 2435 bp, Artificial Sequence; identical to SEQ ID NO: 807
  P8655 (opLexA::G2754, G2754 is from A. thaliana)

SEQ ID NO: 4732 - DNA, 877 bp, Artificial Sequence
  P8656 (opLexA::G2929, G2929 is from A. thaliana)
gtactcatagatatcaaattccaatggattgtgttccttcattgtttatgcctgattcaacctacgaagatggattactattttctgattcttttcttctttctccgtttatatcataccaaaacaatgatgttttccattcgatcacaaacaaaattggtggaagcaataagaaacgaagtttgtgtgatataacatatggtgcgaatgaagccaacaaaaatgatgatgatcgagagagcaagaagatgaaacatagagacattgaaaggcaaagaagacaagaagtttcatctcttttcaaaagactaagaactctcttgccatttcaatatatccagggtaaacgctcgacatcagatcacatcgtgcaggcagtgaactacatcaaagacttacaaatcaaaatcaaagaactcaacgaaaagagaaatcgggtaaaaaaagtcatatcggccacaactactactcattcagctatagaggaatgcaccagtagtttatcatcatcagcagcatcaacactatcatcaagctgctcatgtgtaggagacaaacacattactgttgtggtcacaccttgtttagttggtgttgagatcatcataagttgttgtctcggacgaaacaagtcttgtctctcgagtgttcttcaaatgttagctcaagaacaaaggttcagtgtagttagttgcctctcagctagacggcaacagagattcatgcacaccattgtttcgcaggtggaggatggcaaacagatcaatattttggagcttaaggataaaataatgactatgtagccccatgtacaagaagaaaattagttactatgacaaatgaaaatattacgtggtttgaaattggaattttactg

SEQ ID NO: 4733 - DNA, 1856 bp, Artificial Sequence
  P8660 (opLexA::G2802, G2802 is from A. thaliana)
ctccaactctcgggatatgatcgaaagagctttgttattattatctttacaacttcacgcagacgcataagagagagagttgatcaaagatattcgagattgagatgaacaagagtaatcctgctggttcggtgactggttcggatataatagacgccaagatcgaagaacatcaactttgtggatccaagaagtgtcctagctgcggccacaagctcgaaggcaaaccagtcatttgtaaatgttttttaaagaaaaaaaaaagaaaaagaggaaaagaatcaatgaagaacatcaagaatgatgctctctgttttattctatcgcttgcagcaattcaaaatccaaattttaaagcgtctatatacgagtctttatttgtatagttgtatatacttatattctcttgttctttttctttatattaattaagtttttgttttcccctctttttagcaggattgggttggtttaccagcaggagtgaaatttgacccaacggatcaagaattgatagaacatttagaagcgaaagtgttagctaaagacttcaaatctcaccctctcattgacgaattcatcccaaccattgaaggcgaagacggcatttgctacactcatcccgagaaacttcctggagtgactagagatggtttaagccgacacttctttcatagaccatcaaaggcgtacacgacgggaacaagaaagcgaagaaagattcaaacagaatgtgacaataatttgcaaggaagtagtagctccggtgagacgaggtggcataagaccggtaagacaagaccggttatggtaaacggtaagcaaaaaggttgtaagaagattttggttttgtataccaattttggtaagaatcgaaaaccggagaaaaccaattgggtaatgcatcaatatcatttggggacacatgaggaagagaaagaaggagaacttgttgtgtctaagatcttttatcaaactcagcctaggcaatgcaactggtcgtcttctacatcgagcttgaacgctataggtggtggcggcggtgaagcgagtagcggcggaggcggcggagagtatcatatgaggagagatagtgggactactagtggtgggagttgttcttcgtctagagaaattattaatgttaatcctccgaatcgatccgatgaaataggcggcgttggtggtggcgttatggccgtagcagctgcggctgcggcggttgcagctgggcttccgagttatgcaatggatcagctcagctttgttccgtttatgaaaagctttgatgaggtggcgaggagggaaactcctcagactgggcacgctacatgtgaggatgtaatggcagaacaacatcgtcatcgtcatcaaccatcatcatcaacatcacatcatatggctcatgatcatcaccatcatcatcatcaacaacaacaacaacggcatcatgcattcaacataagccagcctacacatccgatatcaaccattatttctccatctacttcgcttcaccatgcctccattaatattcttgacgataatccttatcatgttcatagaatcttgctccccaatgaaaattaccagacacaacagcaactacgtcaagaaggagaagaagaacataatgatgggaagatgggaggaaggtcagcttccggattggaagaactcataatgggctgcacttcttctaccactcatcatgatgtaaaagatgggtcatcatcaatggggaaccaacaagaagcagaatggttgaagtactcaacgttttggccagcccctgactcttctgacaaccaagatcatcatgggtaattgtgccattttccagtctgatgatcttg

SEQ ID NO: 4734 - DNA, 1149 bp, Artificial Sequence
  P8662 (opLexA::G2632, G2632 is from A. thaliana)
agatcgtttcatcgtccaagcggaagaagcgtctccttcaatcaccgtggacacctccgagactgtctccgattgaatgggaattgaagacatgcattcaaaatctgacagtggtgggaacaaggttgattcagaggttcatggtacagtatcgtcgtcgataaatagtttaaacccttggcatcgtgctgctgctgcttgcaatgcaaattctagtgtggaagctggagataaatcttctaagtcaatagcattagcattggaatcaaacggttccaaatcaccatccaatagagataatactgttaacaaggaatcacaagtcacaacgtctccacaatcagctggagattatagtgataaaaaccaagaatctctgcatcatggcatcacacaacctcctcctcaccctcaacttgttggccacacagttgtaacttcccaatatagatatattgttcttatcatttcctttgggaaaattttagctatggttgcttacaatttagttttttcccggttatgaatcatgcagggatgggcatcctcaaatccataccaggatccatattatgcaggagtgatgggagcctatggacatcatcccctggggtttgttccatatggtgggatgcctcattcaagaatgccactgccgcctgagatggcacaagaaccagttttcgtgaatgctaaacagtaccaggcgattctgaggcgaaggcaggcacgcgccaaggcagagctagagaagaagctaataaaatccagaaagccttatctacatgaatctcggcatcaacatgctatgaggaggccaaggggtactggaggacggtttgcaaagaaaaccaacaccgaagcttcaaagcgtaaagctgaagaaaagagcaatggtcatgttactcagtccccgtcatcatctaattctgatcaaggtgaagcttggaatggtgactatagaacacctcagggagatgagatgcagagctcagcttataagagaagggaagaaggagagtgttcagggcagcaatggaacagcctttcctcaaaccatccttctcaagctcgtctagccattaaatgacctcacaaggcggcaattcattcttggctttctctttgttggcttattcggtagcagcc

SEQ ID NO: 4735 - DNA, 1109 bp, Artificial Sequence
  P8666 (opLexA::G3040, G3040 is from A. thaliana)
ctagttcttcttcgaatctatacgatcgatatgaagattcttccggttggatcacggttttgtccgacggatctagggttggtgaggctttatcttcgaaacaaggtggagagaaatcagagcagtttcataacaactatggacatccaccaagactacccttggcttcttcctcacgtaaacaatcctttgttcaataacaacgagtggtactactttgttccgcttactgaacgaggtggcaagatattaagcgtacaccggaaggtagccgcaagaggaggaagcgaaggcggcacttggagaagcaacgatgggaaaaaagagatcaaggacggacacatgcaaaagggtgatgggttacgagcagtctttcacgtaccacaggagagtgcatggaaagcttgtcaagaccgattgacagaagatggagtattctcttcactagagtgatgacctccaaaaggttgtcttgtgtcggatccgatacaagaaagaggcgaacgtcaacgagtttggactcgttaaccatcaggctcatcagactcaggtggcggagaacaccaacaacatcttacggaaccaagtagtgtaagaagaggatgctttaaccggttttgctgatcagcttgagatgatgctagagggacaagaagaccgtgagcagaaagaagaggctgatttaaccggttttgctgatagccttgagacgatgctagagggacaagaagatcatgagcagccagaagatgctgatttaaccggttttgctgatagccttgagacgatgctagagggacatgaagatcgtgagcagccagaagaggctgaattaaccggttttgctaatgatgaccttgagacgatgatgctagatggagaataatctcgcgaagttactcaacaacaacaacaacaacaacaacaacaacaacgtcaagaagattgtgacgttactcaagagcaagaaaaagatgatgtgatggtactgataaacaatcctaatgatgccctcgcattggggaattatgagattattgatctaactagggttgataaatgatacgacacaaaccagagaggatagaattatattttagtgggttgag

SEQ ID NO: 4736 - DNA, 748 bp, Artificial Sequence
  P8668 (opLexA::G715, G715 is from A. thaliana)
ccgaccaatggataccaacaaccagcaaccacctccctccgccgccggaatccctcctccaccacctggaaccaccatctccgccgcaggaggaggagcttcttaccaccaccttctccaacaacaacaacaacagctccaactattctggacctaccaacgccaagagatcgaacaagttaacgatttcaaaaaccatcagcttccactagctaggataaaaaagatcatgaaagccgatgaagatgttcgtatgatctccgcagaagcaccgattctcttcgcgaaagcttgtgagcttttcattctcgagctcacgatcagatcttggcttcacgctgaggagaataaacgtcgtacgcttcagaaaaacgatatcgctgctgcgattactaggactgatatcttcgatttccttgttgatattgttcctagagatgagattaaggacgaagccgcagtcctcggtggtggaatggtggtggctcctaccgcgagcggcgtgccttactattatccgccgatgggacaaccagctggtcctggagggatgatgattgggagaccagctatggatccgaatggtgtttatgtccagcctccgtctcaggcgtggcagagtgtttggcagacttcgacggggacgggagatgatgtctcttatggtagtggtggaagttccggtcaagggaatctcgacggccaaggttaagctcagagtattccagatgatgcttgacctgcttga

SEQ ID NO: 4737 - DNA, 1980 bp, Artificial Sequence
  P8669 (opLexA::G934, G934 is from A. thaliana)
gtataccgatctttagatacgagcttatggaaagtggcaacgttgtgaatgcacaacctgaattatcaggcataattgatggatccaagagctatgtttacgagcagttatggaaactctgtgcgggacctttgtgtgatattccaaaacttggagaaaaggtttattactttcctcaaggtcacatagagcttgtgagttctctctctctctctctccctctcttttctttctctctccatctcttctctctctctcttctctctctctctgttgagacatctacaagagaagagttgaatgagttacaaccaatttgtgatcttccttctaagcttcaatgtcgtgttattgctattcatcttaaggtggaaaacaatagtgatgagacttatgctgagatcactttgatgccagatacaactcaagttgtaatccctactcagaatgaaaatcaatttagaccattagttaattcctttacgaaggttttaacggcctcagatacaagcgctcatggtggattctttgtaccgaaaaaacatgccattgaatgtctcccttcgctggatatgtctcaacctttacctgcacaagaacttcttgctatagatctccatggtaatcaatggagattcaaccacaactatagaggtacaccgcaaagacatttgttaacaactggttggaatgcattcacaacatcaaaaaaattggttgcaggggatgtcatcgtattcgttaggggagagactggagagttacgagttggtatcagacgagcaagacatcaacaagggaatataccttcatcaatagtatcaatagattgtatgagacatggggtagttgcttccgcaaagcatgcttttgataaccaatgtatgttcactgtggtttacaagccaaggtcaagtaaatttattgtcagttacgacaaattcttggacgctgtgaacaataagttcaatgtcggttcaagatttacaatgcggttagagggtgatgatttctctgaaagaagatgttttgggacaattattggagttagtgatttctctcctcattggaaatgttcagagtggcgcagcttagaagtgcagtgggatgaatttacatcatttccgggacctaaaaaagtgtcaccctgggacatcgaacatttaatgcctgcaataaatgttccgcgatcatttttgctcaagaacaagcgtttacgagaagttaatgaaatcggttcttcatcatcacatctcttacctcctatattgacacaaggacaagaaaatgaacaactaagtgttgcctctccgatgaatatttctcttcgttatcgtgatgcaactgaagatgctatgaatccttctaaattgctaatgagctaccctgtccaaccaatgcccaaactaaattacaataaccaaatggttacagaaatggaagaaaatataacaaccaagacaggcactaattttaggctgtttggagtcactctggacactcctccggtgatcaaagatcccattgaagaaattggctcggagatttcgaaacttactgaaggaaaaaagtttggtctaagccaaactttaagatcaccaacagagatccaaaacaagcagttcagttctagtagaacttgtaccaaagttcaaatgcaaggtgtaacaataggaagagctgtggatttaagtgttcttaatggatatgatcagctaatactagaattggagaagctctttgatatcaaaggtcaattgcaaactcgcaaccaatgggaaatagctttcacagatagtgacgaagataagatgcttgttggagacgatccatggcctgaattctgcaacatggtgaagaagatattcattcaaaagaggaggtaaaaaatttgaagtccaggaagagtctctcaagttgaattaagaatcaaaacatatgtaataaaaaggggtcgaaaatgttactggtgtcttgttc

SEQ ID NO: 4738 - DNA, 648 bp, Artificial Sequence
  P8673 (opLexA::G1797, G1797 is from A. thaliana)
actgaaatggtgagaggaaagatcgaaatcaagaagattgagaacgtgacaagtagacaagtcacgttttcgaagcgaaggagtggtctctttaagaaggctcatgagctttctgttctatgtgatgctcaagtggcagctatgatcttctctcagaaaggaagattatatgaattcgctagctccgatatcaggaacacgataaagcgatacgctgagtacaagagagagtattttgttgcagaaactcatcctatagagcaatacgtgcaggggctaaagaaggaaatggtgacaatggtgaaaaagattgaagtgcttgaagtccataaccggaagatgatgggacaaagtttggattcttgttcggtaaaagaactttcagagatagccacacagatagagaaaagccttcatatggttagattaagaaaggctaagttatatgaagatgagctacagaaactaaaagccaaggagagggaactcaaggacgagagagtcaggctttctctaaaggttggagaaagaccaatggggatgccgtcgggaagcaaagagaaagaggatgttgaaactgatctatttattggatttctgaagaaccgaccataaaatcgtccttggtcattaaacgtcatttctagc

SEQ ID NO: 4739 - DNA, 1368 bp, Artificial Sequence
  P8674 (opLexA::G3032, G3032 is from A. thaliana)
gagggtaaatttgtgattccatctgcaaattattcctcctatatatatatagaacgtgatgaatcaaatttcttaagttgcaagccatgactaatcttgatgagtttcttgaagagctaagttctattgaatcacattctcagaaaatcgtgaagatagatgagcatttaaaaaagttggatgaagagacgaaagaagatgaagatgaagatgcggcgaagataattcaagatcggagtaccgcgagagaagcagaaattgctctacttatggatctccgtcagaactttcttccaccaccatcgatgtcatcctcctctcttcaaccaccgtcatcgtcaactctcgcaccatcgtcatcatcctctcttcaaccacccgcaccgttgatagacttctttcggtcatcagtgtcatactctcatcaaccaccgtcatcttcaactctcgcaacatcatcgtcaccgtctcttcaaccaccgtcgatgtcatcctcctctcttcaaccacccgcatctttgagggaattctttacgtcgtcagtgtcatactctcatcagccatcttcatcttcaactctcgcaacatcttcgttctttccgtcgtcaatgccatactctgttcgacctcccgattcgtctgatcgaccatctttgagggaattctttccgtcgtcaccatcatcctctattcagccacccgaatcatcatcatctaagcgagcacggcttagtaacatctttccgtcacctttatcctcctctccgtcaccgtttgttaacccgtttctccgtccgcaggcccaagaaccaacaataccaaatttcataaacccaataccacagatctctccaggcctacctgctctattcccaaaccctaaccctaatcctaaccctaacccaatcccaaacccaatccgaaacccagacttggtgtggacaaataggcttcaactagtgtttgatgacgcagttgtcagacttgggggattattcagtgcaacacccaaagccataaacgaactaatttctgaagagggtctcactggtgaccagatccgtagccacttacaagtcttgcgggatcgtcaaaaggctattgcagacaaattagccttggagtgaagaaaatattgaagatgagagataggattaaatagaaagagtgatagtatagaacgtttctttttcttttgttgttaatcttgcatattacaaacaattactatatcataatagaatttatgttaatgttggagttattaaaaaaaaaaaagttaaccataataacattcttactgtacgcatgagtgatcatttatcacaatctattagagcaaccccaatgggtgggatgatgacagtc

SEQ ID NO: 4740 - DNA, 971 bp, Artificial Sequence
  P8676 (opLexA::G3090, G3090 is from A. thaliana)
aaatccacagaaatggttagagaaggtgaagaagaagaagagatgatgatgatgatggcaacgaaacctgcatggcttgaaggtttaatggcggagactttcttctcaagctgtggaatccacgaaactcgccgtaaaagtgaaaagaacgttttttgcttactctgttgtctcagtgtttgtcctcactgtctcccttctcatcgctctcatcctcttcttcaggtgagacgatacgtataccacgacgtcgttcggttgagtgatcttgagaagctcatagattgttcatatgttcagccatatacaattaatggagccaaagtgatattcttaaaccaaagacaacaatcacgagctaaggtttcttcaaatgtttgcttcacttgtgatagaatccttcaagaaccattccacttttgttccctctcttgcaaggtggattatttatcatatcaaggagatgatttatcaagcattctctatagaattgatgaatcagattttacgttcgagggtttgagaatggacggacatgatcagctcggagagatatcgacgatggaggatggggaggatatactggtaatttcagatgaatctgagcaaggtaacaatagtcataagaaagagaagaagaagagcaagaagaagaagccagagagcaattacttgcctgggatggttctttcatcacttggtaatagaagaaaaggtgctcctcatagggctcctttttcataattataaaccaatataaccataggcaaaaatcatatatatattttatataaataagcattccatatttatatatgtagcgtgttttatttattaggtatatcttgtaacgggtacgataaaataagtagtactctttaatcacgaaaatgtgtttacttttgtggggtttttttttcttgcttttgtgggtagtgtcaaattagtttcttacttgtattcgttgatga

SEQ ID NO: 4741 - DNA, 1283 bp, Artificial Sequence
  P8680 (opLexA::G3007, G3007 is from A. thaliana)
gatataaacttagctcccagaaagttctaaacttgatacttgaaagcaatccatccagaaagggaaaaaaaacatggctggttcgagaaaagtgaatgatttgttggaggaaaataagggaaatgtggacacaattacagggtctttatccactcaaaagggagaggataaggagaatgtgtcgccggagaaagtctctacctctgtggaaactcggaaactagatcgagctttgaagtctcaatcgatgaagggtaactctgggtttccaacggaagttacaaatttcaaatctttctcaactggtggtcgaacagctctgaagcagtcatcactgcaagcgtgtatgcagaagaacagtgaggttgataagagtagtttcggaatgaaaacttggactagtgttgattcagagcattcaagttcgttgaaagtgtgggagttttcggattctgaagctgcccctgcttcctcttggtctactttgcccaacagggctttgttgtgcaagacactacctttggatgtgggaagatgcacttgtctgattgtgaaagaacaatcacctgaaggcttgagccacggatctgtatattcactttatacacatgaaggtcgggggcgtaaagaccggaagttagcagttgcttaccatagccgacgtaatgggaaatctatatttagggtggcacagaatgttaagggattgctgtgcagttcggatgaaagttatgtcggttccatgacggctaatctcttgggttccaagtactacatatgggacaagggagttcgagttggttctgtaggtaaaatggtgaagccgcttctttcggttgtaatattcacacccaccataacaacttggacagggagctacagaagaatgagaactttgctaccaaagcagcagccaatgcagaaaaacaacaataagcaggttcaacaagctagtaaactaccgcttgattggcttgagaataaggaaaaaattcagaagctatgctcaaggataccacattacaacaaaatctccaagcagcatgagttagacttcagagacagaggaagaacaggactgagaatacagagctcggtgaagaactttcagctaacactcacggagactccaaggcagacaattcttcaaatggggagagttgacaaagcaagatatgtaatcgacttcaggtatccattctcaggctaccaagcattctgcatttgcttggcttctattgattccaagctttgttgtactgtttgatcattaataaacggac

SEQ ID NO: 4742 - DNA, 1429 bp, Artificial Sequence
  P8681 (opLexA::G2809, G2809 is from A. thaliana)
gtaacaaataaactaaagatccctttattcataaacaaaagaatatatatatcattcactttctcattgtcttgttcatatggtaaaaaaaaaaaaggaaaaggagaaaagcaaagaaatagaggagatggatagagagatccaaaacggtgcgtatagtgggagagtgatgactgaggagcagatggagattctccgtaagcagatcgccgtttacgccgttatttgtgaccaactcgtcctcctccacaactccctctcttcttaccatccactctcatcaggtacacttctctctgtttttgttcctgattaacaacaatcacttttctatgtatttgatttttttacaagagaccatttgatgagcttctttgtatacggtagaagaagtgtgtaagacgaaagtgtttaaacgcagcgttttttgcgatgcaaacgttgtttccattaatacacttgacccattgagactttagtgtaaaaatgtgaaaattgtgtttgcgtttggtatacaactaacgaaatccaaggctttttttttcccagtgttcgatgcataactttgaatcaaatttcataatgttttagacattcgaagacagtttacctaccgcttagatatcgatttatcattgctaaagatatttgttaatatagtttatgatttgcttagatcgaacaattcaatatattattaatgtttattttctctagacgtaagctgatttgagggttatcatgtcgtggccgatttttaagaagcttgagttattagtgctttgtggttttgataatacatattttgtacatggaagaaacttaagggtcacgtcacttatttttttataatgattgagtgtaaaaaaggagtgaggccaatggttggcggatactttgatccgatgggggcatcgtcaagttctcataggatatcgactaggcatcggtggactccgacttcaacacagcttcagatacttgagagcatttacgacgaaggaagtggaacaccgaatcgacggaggattagagagatcgcgacggagctgtctgaacatggacagatcacggagacaaatgtctacaattggtttcaaaaccggcgagctcggtccaaacgaaagcagcctcaaacgacgacagctaatggtcaggctgacgatgtggcggtgacaacggaggaaaggaggagttgtggagattcagggggattagagtcttatgagcatatactcttcccaagtcctgacttaggtaaaaagatcatttgagtttttaaacatttggttaggtttattttttatttttggtttgagtttgcattttttttttgtggtttcagggattgagcatttgttgagtatagggaaatttatggagacttaaaattcgtatagacttcgatgaagaagatctctaatctatt

SEQ ID NO: 4743 - DNA, 1201 bp, Artificial Sequence
  P8685 (opLexA::G2979, G2979 is from A. thaliana)
ttgctaagacaaatatccgaatctcagaaatttctcgtcctctttctctgttttttgtttctggggaaaatgtcttctgcgattgttgtttctcaagatgcggaatcgcttggtctgcaaatttatagccgcaaggagaaatctcttggggttctcgtctccaatttcctgagactgtataaccgagacgatgtggatctcattgggctcgatgatgccgctgggcaattaggagttgaaaggcggcgtatctatgatgtggtcaatatattggagagtattgggattgtggcaagaagagggaagaatcaatactcgtggaaaggttttggagagattcctcgttctctagatgaactcaaggaagaagggatgagagagaggttaggttactcaagttcaaacaattcagacaaggtttcaaatggttgtgaaagagaagaacctttaactttaacacctgatgatcaggagaactcatcatcctctaaaatggaccaaaagaaggaaaaatctctctggcttctcgcacagaattttgtgaagatgtttctatgttcctgatgatgatctcatcacacttgatagtgctgcaaaagccttgctgagcgactctccagattcagtccatatgcgaactaaagttagaagactttacgacattgcaaatgtatttgcctcgatgaatttaatcgagaagactcatataccagtgactaggaaaccagcatataggtggttagggtccaaaagcatagctgaaagaggattaagcttatttaattccggagaaccgaagcgggtatttggaacagagatcacaaacttgagggcaaagagaaacaaaacatattgttcatcaatccgcaagcaaattggatataagaaacatgacgaggaaaacacagagcaggaatcgaaaccagctgcaagtaaatatgtgtttggcccgttctccccaataggagcatctaagacgaacaacgacaaagtcggaaagggaaggttactagagatcgaggcccttgcttctacctaccaaccacagtattgcaatcaagaaataactggtcttcttgggcatttcacggaggcatggaagaaatggtatgcagaggttgatcggaataaataacattactgaggtcacatgttttctctgggtacatgagagcacataactcatccaacatatagcttt

SEQ ID NO: 4744 - DNA, 1278 bp, Artificial Sequence
  P8686 (opLexA::G2980, G2980 is from A. thaliana)
tgtctctctttctcccgcaggtcaccgagaaaatatcttttgttgtctccacccaccccacccaggttatggattctctcgctctcgctccccaggtttacagccgcaaggacaaatctctcggcgttcttgtcgccaatttcttgacactgtataatcgtcccgatgttgatctatttgggctcgatgatgccgccgcgaaattaggagttgaacgtcggcgtatttatgatgtggtcaatatattggagagtattgggcttgttgcaagaagtgggaagaatcagtattcgtggaaaggttttggagctgttcctcgtgctctatctgaactcaaagaagagggaatgaaagagaagtttgcgatcgtcccttttgtggccaagtcagagatggtcgtttatgagaaagaaggagaagaatctttcatgttatctcctgatgatcaagagttctcaccatctcccagacctgacaacaggaaggagagaactctctggctacttgcacagaactttgtgaagctgtttttatgctctgatgatgatctggtaacatttgatagcgctacaaaagcattgctgaatgagtctcaggatatgaatatgagaaagaaagttagacgcctttacgacattgcaaatgtgttttcctcaatgaagctaatcgagaagactcatgtcccagagactaagaagccggcatataggtggttgggatctaaaaccatatttgaaaacagattcattgatggttctgcaagcttatgtgatcgtaatgtgcctaaaaagcgggcatttgggaccgaactcacaaacgttaacgcaaagagaaacaaatcaggttgttctaaagaagacagcaagcgtaatggaaatcaaaacacaagcattgttatcaagcaagaacaatgtgatgatgtgaaaccggacgtgaagaattttgcctctggatcatccactcctgcaggcacttctgagagtaacgatatgggaaacaacattaggccaagaggtagacttggagttatcgaagccctttctactctttaccaaccatcatattgcaatcctgagttacttggtctttttgcgcattacaacgagacatttaggtcatatcaagaagagtttggtcgggagaaatgacttaatcatcaggtagattaacttgcggggcgtaacttcaattctctaatcacaagccaaatttcttttgctcatttgcgttaaactacagaaaaactcttacaatagagattattacatgcaaatcgaa

SEQ ID NO: 4745 - DNA, 1633 bp, Artificial Sequence; identical to SEQ ID NO: 861
  P8690 (opLexA::G2855, G2855 is from A. thaliana)

SEQ ID NO: 4746 - DNA, 1283 bp, Artificial Sequence
  P8692 (opLexA::G1990, G1990 is from A. thaliana)
ccgattgatcaattccaatattacgtcctttttttcttgaatctctctatatactcaatggaagcagctgcggaggctgtatcagccgctagggagcaatcattgatccttaaagggaaacggactaagcggcaacgtcctcagtccccaatccctttctctatcattcctcctatgtcttcgcatgaaccggatgctgaagaagagtctactagtcttgtttccaaggagaagagtctcaatgatgaaatcaacaacaataacatcaagaataataacaatactttgatcaatggtgttacatcttcatcttctgcctcttcatcttccaacaacaatgccacattaaaggccacggctgacgaagaagatcaagatatggctaattgtttgatcctcctcgcccaaggtcactctcttccccacctccaaccgcaaccgcacccccaacaacaaacaagacagcttatgatgagttaccaagattccggtaacaacaacaacaatgcgtatagatctagcagcaggaggtttctagagacatcttcatctaacgggaccacaacgaacggtggtggaggcagagccggttactatgtttaccagtgcaaaacatgtgaccggacttttccgtctttccaagctcttggtgggcatagagccagccacaagaagcctaaagccgctatgggtcttcactctaaccatgaccacaagaagtctaactacgatgacgccgtttctctccatctcaacaacgttctcaccacaactcctaacaacaatagtaaccatagatcgcttgtggtatacggcaaaggtagtaataataaggtccatgaatgtgggatatgtggagccgaattcacatccgggcaagcattaggtggtcacatgagacgccatagaggtgcagtggtagccgcagcagccgcctctaccgccaccgtatcggttgcggccattccggctactgcaaacacggctttgtcattgtcgccaatgtcgtttgatcagatgtcggagggtccaattcaggctcccgttaagagagcgaggagcgcggttgtgtcgttagatttagatctgaatctacctgccccggaagatgagaatcgggtcaacggattaagctttgcttcaaagcaagaacacgaacaagaacatgaacaaacacaacagaagaaacagagagaagaacaaaagtctcttgtcttgtcttctgctcctacattggtggattgccattactaaaatcaaaattcattaatacctaatcaaac

SEQ ID NO: 4747 - DNA, 2361 bp, Artificial Sequence
  P8694 (opLexA::G2334, G2334 is from A. thaliana)
gcaaccaacacatttctctgtctgtctctctttctctctctctcactcactctctctttgttccatggacttgcaactgaaacaatggagaagtcagcagcagaatgagtcagaagaacaaggctctgctgcaactaagatatcaaactttttctttgatcagattcagtcccaaactgctacttctgctgctgcggctcctcttcctctctttgtccctgaacccacttcttcctcttctttctcttgcttctctcctgactcttctaattcttcttcttcttccaggttcctcagtaagttgttttaaaaggacaagacttattcactctaatgttgaagttgtttttgctgatatttaatctgacgtttctatgttacatatatatgtagagatgggaaacttcttcagctgggcacagtggcaagaacttgagctacaagcactgatctatagatacatgttggctggtgcttctgttcctcaagagcttctcttacctattaagaaaagtctcctccatcaatctcctatgcatttccttcaccatcctcttcaacatagttttcctcatcaccaaccttcttgtcagtctctctctcctctctattgtttatgcttctcttatccttgaaatagtctttctttgtaaaaaagattccctttgttttggtgttggagttatatttccaagatctaaaataagtataaggctgctctgcaaccttgcaaggagttaaaaccctatgtgtatgataagcctatttctagaagatctattagcaacatagatagaatcagacaagtacatttcgtaaccaatgtcttgagtgagatttatgtttgttgttactaatgaacaacacacacttaataaaaaacagggtattggggaagaggagcaatggatcctgagccagggaggtgtaagagaactgacggcaagaaatggagatgttcaagggatgttgtagcgggccacaagtattgtgaccgccacattcaccgtggaagaaaccgttcaagaaagcctgtggaaaccgccacaaccaccatcacaacgacagccacaacaaccgcatcttcttttgtcttaggtgaggagcttggtcatggaccaaacaacaaccacttcttctcctctggttcatctcaacctctccaccttagtcatcaacaaaggtacaataaaaaaacacaaacactctgtttaattaaagtcattagtagatttggttaattacaaatattgttgttagggaaatagtgatttcactgtgaagtaatgctgtgaagaaaggggtaatgttggcaatagggtgacaagagagacttatcatacatactttgtgataaaaacattattctttcttttgttgagagataatgataacagttggatttgatagaatctaattttatttactagttgggtgagacttttcaatcatagaaatagaaaagagagagaaagttaaagagatatgtatacttatgttgtatttgaaataatgacatggtaggacctcagtgaaagctgaccaaacctgcatagaagccaaacaaaataaagctctcagattctgcaaccacttcctcttattaacacacacatttgactgattaaattatttctctaaccattttgttgaattgatcagtctacttattattgttcaaatgttggatctttttgttgacaatgtttatgtttatgtttattcctctctgtcacagttgttcttcagagatgaaacaagaaagcaacaacaacaagaggccatatgaagctaacagtggattcagcaatggaagatcagacgatggtcacatcttgaggcatttctttgacgattggccacgatcatcagactctacctccagtccaatgagctcatccacttgtcatctttcaatctccatgcccggtaacaacacgtcctcagatgtttctctaaaactttccacaggcaatgaagaagaagaagagaacatgagaaataacaacaatgagagggagcaaatgaattggtggagcaatggagggaatcaccacaacaatatgggaggaccattagctgaggctttgaggtcagcttcttcgacgtcaagtgttcttcatcagatgggaatctctactcaagtttttcattaaagaaaagtgtttgtaatctttttggtttgtgctctttgaatctttattttctgcagaaaataatctttgaatttgtcttcttttggaattgtgagttctgcttttggaattgttttgttccttactctgctattatatttatgtttaaagcttgacaattttgtataagcaatgaaactaatatgatcctctgcctgcaagtaag

SEQ ID NO: 4748 - DNA, 2139 bp, Artificial Sequence
  P8695 (opLexA::G268, G268 is from A. thaliana)
cgctgatccttcacacgcaagctaatgaagcctctcactaatggcgatctgttcaaatccccaactctgatcaagatctccgccttagttttcgtcaccgtcgctttcttctacttaggcaagcattggtccgacgatggctaccaacagctcgtcttcttctcctcttccacttccggtagctcgatcccggaggtctccgtttcaccgaatagtaacagagtctttaatttatcagcgataattcctactaaccatacccagattgaaatccccgccacaatacgacaacaacctccgtcggtggtggcggacacggagaaggttaaggtggaagctaatcctcctcctcctccacctccttctccttcacctcctcctccgcctggtccggttaagagctttgggatagttgatgcgaacggtgtgatgtctgacgattttgaggtgggtgaggttgagagtgatacagtggaagattgggggaatcagactgagatcgttgaggcgaaaagcgacggtgattctaaggctagggttagaattaagaaatttgggatgtgtcctgagagtatgagagagtatataccttgtttggataatactgatgtgataaagaagcttaaatcgacagagcgaggtgagagattcgagcgtcattgtcctgagaaaggtaaaggcttgaattgcttagttccacctcctaaaggttaccgtcagccgattccatggcctaaaagccgtgacgaggtatggtttagcaatgttcctcatactcggcttgttgaagacaaaggaggtcagaactggatttcacgagacaagaacaagttcaagtttcctggaggtggtacacagtttattcatggggctgatcagtacttggaccagatgtctaagatggtttctgatattacgtttggcaagcatattagggttgctatggatgttggttgtggtgtggcgagttttggtgcttatctattgtctcgtgatgtcatgacaatgtctgttgcaccaaaagatgtccatgagaaccaaattcaatttgctcttgagcgtggtgtgcctgctatggcggcagcatttgcgacaaggcgtttgttatatccaagccaagcttttgatcttattcattgttcaagatgtagaatcaactggactcgtgatgatggaattttgctccttgagatcaatagaatgctgcgcgctggaggatattttgcttgggctgcacagcctgtttataagcatgaacccgctttggaagaacaatggacagaaatgctgaatcttactattagcctctgctggaaattggtaaagaaggaaggatacgttgcaatctggcagaagcctttcaacaacgactgctatttgagtcgtgaggctgggactaaacctcctctttgtgatgaatcagatgatcccgataatgtttggtacacaaatctgaaaccttgcatcagtcgcatacctgagaaagggtacggaggaaacgtccccttatggcctgcccgtctgcatactccacctgataggctgcagacgataaaatttgattcctacattgctaggaaagagctattcaaggcagaatcaaaatattggaatgaaataattgggggctatgttcgcgccttaaaatggaaaaagatgaaactaagaaatgttttggacatgagagcaggctttggcggatttgcagctgcactaaatgatcataaactcgattgctgggttctaagcgtggttcctgtcagtgggcctaacacattgcctgtcatttatgaccgtggactgttaggagtgatgcacgattggtgtgaaccatttgatacatacccacggacatatgacttcttacatgcctctggactcttctcgatcgagagaaaaagatgtgagatgtcaaccatattgttagagatggaccggatattaagacccggtggaagagcatacattagggattcaattgatgttatggatgaaattcaagaaatcacaaaggccatgggttggcatacttctctgcgtgacacatccgagggtcctcacgcaagttacaggattctaacatgcgagaagcgtctccttcgagcttaataccacacaagttactgcactagtcaacac

SEQ ID NO: 4749 - DNA, 3112 bp, Artificial Sequence
  P8702 (opLexA::G2910, G2910 is from A. thaliana)
agggttcttcttcatcggatcatcggccgtatctgaaaccggagatggccggcgttgattccggcaagcttatcggctctgagattcatggattccatactttacaagatctagatatacaaacaatgttagatgaagcatacagtaggtggctccgtcctaatgagatccatgctcttctctgtaaccataaattcttcaccatcaacgtcaagcctgtgaacttacccaaaagtggtacgattgtgttgtttgatcgtaagatgttgaggaactttagaaaggatggtcataactggaaaaagaaaaaggatggaaagacaattaaggaagctcatgaacatctaaaagttggtaatgaggaaaggattcatgtttattatgcccacggtgaggatacccctacatttgtgcgaaggtgttactggttattggataagtctcaggagcacatagttcttgtccactatcgcgagacacatgaggttcatgcagctccagcaacacctgggaactcgtactcaagttcgatcactgaccacttatctcctaaaattgtagctgaagataccagttctggtgtccataatacttgtaatacaggttttgaagtgcggagcaacagtctgggttctagaaatcatgagattaggcttcatgagatcaacacacttgattgggatgagcttctagtacctgcagatattagcaaccaatctcatccaaccgaagaagatatgctatacttcacagaacagctccaaactgcacccaggggatctgtaaagcaaggaaatcaccttgcaggctacaacggatcagtagatataccatcattcccgggtcttgaagatcctgtatatcaaaataataactcatgtggtgcaggagaattttctagtcagcattcgcactgtggagtagatccaaatctacagagaagggatttcagtgcaacagttactgatcaaccaggtgatgctttgcttaataacggttatggaagtcaggatagttttggaaggtgggtgaacaacttcattagtgactctcctggttccgtcgatgatccttcccttgaagctgtatatacacctgggcaggattcatctactcctcctactgtatttcattcccactctgacataccggagcaagtattcaacataactgatgtttcacctgcctgggcgtattcgacagagaaaacaaagattcttgtaactgggttctttcacgacagcttccaacatttgggaagatcaaacctcatctgcatatgtggagagttgcgtgtccccgccgaatttctccagatgggggtttatcgttgcttccttcctcctcaatctcctggggtggtgaacctttatcttagtgtcgatggaaacaaaccgatcagccaattgttcagcttcgaacaccgctcagttcagtttatcgaaaaagccatccctcaagacgaccagctatacaagtgggaagaatttgagttccaagtcagacttgctcatcttctgttcacttcttcgaacaaaatcagcgttttaactagtaaaatatcacctgaaaaccttcttgaggctaagaaactcgccagcaggacttcgcatctcttaaatagttgggcttatttaatgaagtcaattcaggcaaatgaggtaccgtttgatcaagcgagggaccatctctttgagcttactctgaaaaataggctgaaagagtggcttttggagaaggtcatcgaaaaccgcaacactaaggaatatgactctaaagggcttggagtgatccacctctgtgccgtcctaggatacacttggtcaatccttctcttctcctgggcaaatatatcgttggatttccgtgataagcagggttggactgctcttcattgggcagcatactatggaagggagaaaatggtggctgctcttctatctgcgggggcaaggccaaacctggtgacagaccctactaaggaattcctcggcggctgcacggcagctgatctggcacaacagaaaggttatgacggtttagcagcttttcttgctgagaaatgtcttgtagcacagttcaaggacatgcaaacggctggaaacattagtggcaaccttgaaaccatcaaggcagagaagtcgtcaaatccagggaatgcaaatgaagaggagcaaagcctgaaggacactctagcggcatacagaactgctgcagaggcagcggcgcggattcagggagcgttcagggagcacgagctgaaagttaggtcaagcgcagttaggtttgctagcaaggaagaagaagccaaaaacataatagccgcgatgaagattcagcacgcgtttcgcaatttcgaggttcgtaggaagattgcagccgctgctcggattcagtataggttccaaacatggaaaatgaggcgggaatttctgaacatgcgaaagaaggcaattaggatccaggctgcgtttagaggtttccaagtaagaagacagtaccagaaaataacatggtcagtgggagttcttgagaaggcaattctgagatggagactgaagagaaaaggattcagaggccttcaggtaagtcaacctgacgagaaggaagggagtgaggcggtggaggatttctacaagacaagccagaaacaagcggaggaacggcttgagaggtcagtggttaaagtccaggccatgttccggtccaagaaggctcagcaagattacagaaggatgaaactggctcatgaagaagctcagctggagtatgatgggatgcaagaacttgatcaaatggctacggaggagagctgaatggaataatagaggaggagtgggtgtgttgtgttgtggaggaactgtaaatttgtgcaaatgacgaggggcaatttcgaccttttaagaagcggttttcagaaaagtttcaaagggtgttgtggtaaattgatcctggagctgggaaatttccatagagcgtcttgtcgttagtttttctttttgtttggtggatagtcttgtattgcgttatgtgacttgtgagatttgacgctaaaaagctaaaacgttttttagtttgtctaaaagttctcctgcttactgtctttcttctg

SEQ ID NO: 4750 - DNA, 2509 bp, Artificial Sequence
  P8720 (opLexA::G2556, G2556 is from A. thaliana)
gaattcaagggagagttcttgtcgggggactattttaagttttaaaaaggggtgttttttagtggtgaaggggaaggtttagatgggttataccttgcaacagatactgaggagcatctgctccaacacggattggaactacgccgtgttctggaaacttaatcaccactcgccaatggttcttactttggaggatgtgtactgtgttaatcatgagcgcggtttgatgccggaaagcttgcatggagggcgccatgctcatgaccctcttgggttagctgtggctaagatgtcatatcatgtacactctcttggggaagggattgtaggacaagtagcaatctctggacaacatcaatggatcttctctgaatatttgaatgactctcattcgacacttcaggttcacaacggttgggagagtcaaatttctgctggaattaagacaattcttatagtagctgttggttcttgcggagttgtgcagcttggctctttgtgtaaagttgaagaagacccggctttggtgactcatatcaggcatttatttttggcacttacggatccactagcagaccatgcatcaaatttaatgcaatgtgatattaacagtccatcggatcggccaaaaataccttccaaatgcttacatgaggcatcccctgatttctcaggagaatttgacaaagctatggatatggaagggttaaatattgtatctcaaaacacaagtaatagaagtaacgaccttccatacaatttcactccaacatattttcacatggagaggactgctcaagtaattggtgggcttgaagcagtccaaccttccatgtttggaagcaatgattgtgttacaagtggtttttcagttggtgtggttgatactaaacacaagaatcaagtggatataagtgatatgagtaaggtgatttatgatgaggaaacaggtggataccgatactcaagagaattagatcccaatttccaacactactcgaggaatcatgtgcgtaatagtggaggcacatctgctttagctatggagagtgataggctaaaagcaggttcatcatatccacaacttgattcaactgtacttactgcgttgaaaacagataaagattattctcgtcgaaatgaggttttccaaccatctgagagccaaggaagtatatttgtgaaagatacagaacataggcaggaggaaaaaagtgagtcaagtcagttggatgctttaactgcatctttgtgttctttttctggcagtgagctgttagaggcattagggccagcgttcagtaaaacaagcactgattatggggagctagcaaagtttgaatctgctgcagctataagacgaacaaatgatatgagccatagtcacctgacatttgaatccagctccgagaatcttctagatgccgttgttgctagtatgagtaatggtgatggtaatgtcaggcgtgaaatatcttcaagcaggtcaacacagtcattgcttacaactgctgaaatggcacaggcagaaccttttggtcataataagcaaaatattgttagcacagttgatagtgtgattagccagccgcctctagcagatgggcttatccaacagaatccatcaaatatctgcggagcattttcttccattgggttttcatcaacatgtctcagttcatccagcgaccagtttccgacgtccctggaaattcccaagaagaacaaaaagagagctaaacctggtgaaagttctcggcctcgtccaagggacaggcaacttattcaggatcgtatcaaagaactaagggagcttgtgcctaatggatctaagtgcagtattgattccttgctagagtgcacgatcaagcacatgctcttcctgcagagtgtctctcagcatgctgacaagctcactaaaagtgcaagttcaaagatgcaacacaaggataccggcaccctaggaatatcaagcactgaacaaggttcgagctgggcagtggagattggaggccatctgcaagtgtgctcaatcatggtggagaatctggacaaagaaggagtgatgcttattgagatgctatgcgaagaatgtagccactttctcgagatagcgaacgtgataaggagcttggaactcatcatcctcagaggcaccactgagaaacaaggcgagaaaacatggatatgttttgtagtggagggacaaaacaacaaagtaatgcacaggatggacatcctgtggtctcttgtgcaaatatttcaacccaaggctacaaacaggtagcaacaacgaaacccgtcacatcatgcagactcggcttcatgtatcaacaactacaaggattgaaaagcatgatgagaacagagaagaaaacgctgtgtatgtttatagtgtttgtgtgtgtgtgatactattatcttggaataggtataaaaagtctaaaggtgtgccatttttgtttggaattgttatcatgaacacttctcagattgaattaatgccaca

SEQ ID NO: 4751 - DNA, 1101 bp, Artificial Sequence
  P8722 (opLexA::G2586, G2586 is from A. thaliana)
accaacttcaaacacaaaaaaatgttctccaacatcgatcaaacagctgtggcagcactcctccgtggccaaggatgcgctaacagtctcaagaggctcctcgaaaaccacaagttaagctcagattcaacagagccgctcatctacaccatactcaattctttctcacttgctctctcttttgtggacccgcctagtcttctaccacacaatgagtcttctcttcaaaacatgacaagtcatgttcttcagagatcatcaaagaagtaagttaccaacaaaaagctaaacactcattgcatatgttacgaacaaagttcatgagtttctagctaactcaaaataaagttaaatagcaattgttttttcatgttacttttatgtctcgtataatttttgatatgcaattatgtcttctatatttttaagcatttctccaatacatcattgtagaaaatattatggagcagaagatttagagtattacagagacgaatccccgactccacgccccgatgacggcttcacctggaggaaatatggacaaaaaactatcaaaacctcaccgtaccaaaggttagtcaattaggttacctagaaaaacagagcaagttctctgttcttacaaaaagaaagtaaattctcttctttattctttgaaatacatgtaaataaaagtgctatattcacaggtgttactatcggtgtacctatgcaaaagaccaaaactgcaatgctagaaagcgggtgcagatgatccaagataaccctccagtgtacagaactacttatttgggaaaacatgtgtgtaaagctgttgcagttcatgatgatacatatggttctgaaatgataaaattcgaccaagttgtatctgaatcggttatgcctcaactcgcaacaattgacgaacaagcaattaccatggaggacgaagccatagaccatatcatgaaccaagaatgtgatattaatgatttttctgtggatgatgacccattttgggctagtcaatttcctccattttcatcggaagacattatgttttttgacaatattgctaatcttgattagaaccctttccaagttttttttaatgtt

SEQ ID NO: 4752 - DNA, 1089 bp, Artificial Sequence; identical to SEQ ID NO: 813
  P8725 (opLexA::G2774, G2774 is from A. thaliana)

SEQ ID NO: 4753 - DNA, 1881 bp, Artificial Sequence
  P8728 (opLexA::G2550, G2550 is from A. thaliana)
catcaatcggatgaaactcacttaaacaacaaaacactttcgatttattatccaatggctgtgtattaccctaatagtgtcggcatgcaatctctttaccaagaatccatttacctcaacgaacaacaacaacaacaacaacaagcttcttcttcctctgctgcatctttctccgagattgtttccggtgatgttcgaaacaacgagatggtatttatcccaccaacaagcgacgtagccgtcaacggaaacgtaacggtgtcaagtaacgatctaagctttcacggtggaggactttctttaagtcttggtaatcagatccagtcagctgtctctgtttctccgtttcagtatcattaccagaatctttcgaaccaattgagttacaataatcttaatccttctactatgtctgatgagaatgggaagagcttgagtgttcatcagcatcactctgatcaaattttaccttcctctgtttacaacaacaatggtaataatggtgttggattctacaacaattaccgttacgagacatcagggtttgtgagtagtgtactgagatctcgttaccttaaaccaacacaacaattgcttgatgaagttgttagtgtaaggaaagatttgaaattggggaataagaagatgaagaatgataaaggtcaagactttcacaatgggtctagtgataacattacagaagatgataaatctcaatcgcaggagttgtctccttcagaacgtcaggagctacagagcaagaagagcaagcttttaacaatggtggatgaggtaagactaaatcaaatttgaatactttaaagtgagagagagactttggagttttgagttttgaaaacatttttgcaggtagataaaaggtataaccaataccatcatcaaatggaagctttagcatcgtctttcgagatggtaacaggtcttggagcagctaagccttacacatccgtagctctgaatagaatctctcgccatttccgctgtttacgcgacgcgataaaagaacagattcaggtgatcagagggaagcttggggagagagagacttctgatgaacaaggagagaggataccgcgtcttaggtacttagatcaacggttgagacaacagagagctttgcatcaacaacttggaatggttagaccagcttggagaccacaaagaggcttacctgaaaactctgtctctatacttcgagcttggctctttgagcatttccttcatccgtaagtttgttgtttgtaagacactttctttctgctcctcattgcttcattgataaccatttcaatcgtttttgtagatatcctaaagaatcagagaaaatcatgctttcaaagcagacaggactatcgaaaaaccaggttcttattggctcaatctttggtcttgcttttatatgagtggtattctgattcttggcaatttaggttgcaaattggtttattaacgcgagagttcgactatggaaaccaatgattgaagagatgtataaagaagagtttggagaatcagcagagttactctctaactctaatcaagacaccaaaaaaatgcaggaaacatctcagctcaaacacgaagactcttcgtcttcgcaacaacagaatcagggaaacaacaacaacaacatcccatatacatctgatgcagaacaaaacctagtctttgcagatcctaaaccagaccgtgctactactggagattacgacagcttgatgaactatcatgggtttggtattgatgattacaatcgttacgttggccttggaaaccaacaagatggcagatattctaatccccatcaattacacgactttgttgtctaaaagattcctgagcttttcacaagcttaagat

SEQ ID NO: 4754 - DNA, 1129 bp, Artificial Sequence
  P8730 (opLexA::G413, G413 is from A. thaliana)
cgatgagatgacagaaggtggagaatattctccggcgatgatgtcagcagagccattcttgaccatgaagaagatgaagaagagcaaccacaacaagaacaatcagagaaggtttagcgacgagcagatcaagtcactggagatgatgtttgagtctgagacaaggcttgagccaaggaagaaggttcaattagctagagagctagggttgcagccgaggcaagtggctatatggtttcagaacaagagggctcgttggaaatccaagcagctcgagactgagtacaacattctcagacaaaactacgacaacttggcttctcagttcgagtccttaaagaaagaaaaacaagctttagtctctgagttgcagaggctaaaagaggcgacgcaaaagaagacacaggaggaggaaaggcagtgtagtggagatcaagcggtggttgctctaagcagcacacatcatgaatcagaaaacgaagagaaccggaggcgtaaaccggaagaggttagaccggagatggagatgaaagatgataagggtcatcatggggttatgtgtgatcatcatgattatgaagatgatgataatggttatagtaacaacatcaagagagagtattttggtgggtttgaggaagaaccagatcacttaatgaacattgttgaaccagctgatagttgtttgacatcatctgatgattggagaggtttcaaatcagatactactactctcttggaccaatccagcaacaattacccttggcgggatttttggtcatgaaaacaataaactctaaacaagaagatgaaacagattgagactaaagattggatatatacatattcaaatcgaaatttaccggtctacatcgcatgaaccgagccacggatatagagatattcggtccagcaaatgactcgtttctcagcgagaattttgcaggattttgagctgaaattgtatggttttgtctgtataaatgatgtgtttagaaagacgtatattctcagttcgtgtttgtaattctgtttttaagtagtaagtactcgtcatgctttgtagctaagtagtaagtttaagactaaatttggatgaataaaaatcaaaagcaggagaaatcataaa

SEQ ID NO: 4755 - DNA, 1102 bp, Artificial Sequence
  P8731 (opLexA::G2792, G2792 is from A. thaliana)
gtatcttctcataatcatctatggagtcttgccttcttgcctggtagaagcttaggagatcaaatgatggatcatcatcatcacatagcatcaagaaattcatcaacaacatcagaattaccatcattcgagccagcgtgccataacggtaatggtaacggttggatctatgacccaaatcaagttaggtacgatcaaagtagtgaccaacggctgtcaaagttgacggatcttgtaggcaagcactggtcaattgcaccaccgaataatcccgacatgaaccataaccttcatcatcacttcgatcatgatcattctcaaaacgacgacatttctatgtacagacaagccttggaggtgaaaaatgaggaagatctttgttacaataatggctcaagtggtggtggttccttgttccatgatcctatagaaagttctagaagtttccttgatataaggttaagtaggccattaacggatattaatccgtcatttaagccatgctttaaggccttaaacgtatccgagtttaacaagaaagaacatcaaacggcatctctggcagcagtgagactgggaacaacaaacgctggaaaaaagaagagatgtgaagaaatttccgatgaggtttcaaagaaggccaagtgcagtgagggctctacactttcgccagagaaggaactacccaaagccaaacttcgagacaagatcacgactctacagcaaattgtgtctccctttggaaagactgatactgcttctgtgcttcaagaggccatcacttacataaatttttatcaagagcaagttaagctgctaagcactccttatatgaagaattcatcaatgaaggatccatgggggggatgggacagagaagatcacaacaaaaggggaccgaagcatcttgatctaaggagtagagggctttgtttggttcctatttcatataccccaatcgcataccgcgataacagtgcaactgactactggaatcccacgtatagaggttctttgtatcgttagtgactagtatagcaaaaagtgtgtagagagaaagatttgattaaattatggtagtggtaaaccattccaaacatcg

SEQ ID NO: 4756 - DNA, 1397 bp, Artificial Sequence
  P8733 (opLexA::G3102, G3102 is from A. thaliana)
aatcagctctggacgttgttgattgtatttgaacaagaatgtgtaggcagaattgtcgcgcgaaatcctcaccggaggaagtgatttcaactgatgagaatctcttgatatattgtaaacctgttcgactatataacatctttcaccttcgctctctaggcaacccatcgtttctgccaagatgcttgaactacaaaattggggcaaagcgcaaaagaaagtcaagatctactgggatggtagttttcaactataaggattgtaataatacattacaaagaactgaagttagggaggattgttcttgtccattttgctctatgctatgtggtagcttcaaggggctgcaatttcatttgaattcatctcatgatttatttgaatttgagttcaagcttttggaagaataccagacagttaatgtttctgtaaaacttaattccttcatatttgaggaagaaggaagtgatgatgataaatttgagcccttctctctctgctcgaaacctcgtaagcgtagacaaagaggtggcagaaataacaccaggagacttaaagtatgctttttaccgttggattcacccagtttagctaatggcacagaaaatggaattgccctgctgaatgatggaaaccgtggtttaggatatcccgaggcaacagagcttgctggacaatttgagatgactagcaacattccaccagccatagcccactcttctctggacgctggtgctaaagttatattaacaaccgaagctgtggtccctgctactaagacaagaaagttatctgctgagcgatcagaggctagaagccacctacttcttcagaaacgccaattctatcattctcacagagtccagccaatggcgcttgagcaagtaatgtctgatcgggatagcgaggatgaagtcgatgacgatgttgcagattttgaagatcgccagatgcttgatgactttgtggatgtgaataaagatgaaaagcaattcatgcatctttggaactcgtttgtaagaaaacaaagggttatagcagatggtcatatctcttgggcatgtgaagtattttcaagattttacgagaaagagttgcactgttactcatcactcttctggtgttggagattgtttttgattaaactatggaaccatggacttgtcgactcagccaccatcaacaactgcaataccatcctcgagaattgccgtaatacctcagtcactaacaacaacaacaacagtgtggatcatcccagtgactcaaacaccaacaacaataacattgtggatcatccgaatgacataaaaaacaagaacaatgttgacaacaaggacaataacagcagagacaagtaattaaataggaaacactccggtttagatgataccgac

SEQ ID NO: 4757 - DNA, 2525 bp, Artificial Sequence
  P8734 (opLexA::G707, G707 is from A. thaliana)
tctcatccatggcggatttcttctatcttcattaaatatttccctctttattaaaatctcatgaatttcaacggttttctcgacgacggtgctggagcctcaaagctactctctgatgctccgtacaacaaccacttctctttctccgccgtagacaccatgctcggaagcgccgccattgctccttctcagtctcttcctttctcttcttcaggcctctctctcggactccaaacaaatggagaaatgagtagaaacggagagattatggagtcaaacgtaagtcgtaagagtagtagaggagaagatgtagaaagcagatctgaaagtgataacgctgaagctgtctccggtgacgatttagatacctccgatagacctttaaagaagaagaaacgttaccatcgtcacactcctaaacaaattcaagacctcgaatcggtttttaaagagtgtgcacatccagacgagaagcaacgtcttgatcttagccgtcgacttaacttagatcctcgtcaagtcaagttctggttccagaatcgtcgtactcagatgaagactcaaatcgaacgacatgagaatgctttgttgaggcaagagaacgataagcttcgagctgagaatatgtctgtacgcgaagctatgagaaaccctatgtgtggtaattgcggcggacctgccgttatcggtgagatctcaatggaagagcaacatctgagaattgaaaactctcgtctcaaagatgagttagaccgagtctgtgccttaaccggtaagtttcttggccggtctaatggttcacatcatataccggactcagcacttgttctcggcgttggtgttggttctggtggatgtaatgttggtggtggtttcactctctcttctccgctgttgcctcaagcttctcctagatttgagatttctaatggaaccggttctggtttggtggctacggttaaccgtcaacaaccggttagtgttagtgattttgatcagagatcgaggtatttggatttagctcttgcggctatggatgagcttgtgaagatggctcagacacgtgagccgctctgggttcgaagctcggattctggttttgaagtgctgaaccaggaagagtacgacacaagtttctctcggtgtgttggaccaaaacaagatgggtttgtctcagaagcttctaaagaagctggaactgttatcatcaatagcttagcgctcgttgaaaccttaatggactcggaacggtgggcggaaatgtttcctagtatggtctcaagaacttcaaccacagagattatctctagtggcatgggagggcgaaatggtgcacttcacctgatgcacgcagagcttcaactgctgtctccactcgtgccggttagacaagtgtcgttcttgcggttctgtaaacagcacgcggaaggtgtttgggcagtcgtggatgtctcaattgattccattagagaaggttcttcttcgagctgtagaagattaccatccggttgcctcgtacaagacatggccaatggctactcaaaggtaacatggatcgagcacacggagtatgacgaaaaccacatccaccgtttataccgcccattactcaggtgcggtctagcgtttggtgcgcatcgatggatggctgcattacaacgtcaatgcgaatgcctcacgattctcatgtcctccactgtttccacttccactaatccatcccctataaactgcaatgggagaaaaagcatgctaaagctagcgaagaggatgactgataatttctgtggaggggtttgtgcttcgtcgttacagaaatggagcaaactcaacgttggcaacgtcgacgaagacgttaggataatgactaggaagagtgtaaacaatcctggcgagccgcctgggataattctaaatgcggcgacgtcagtttggatgccggtatctccgaggcggttgtttgacttccttggaaacgaacggcttagatcggaatgggatatcttatccaacggtggaccaatgaaagagatggcccatatagctaaaggccatgaccgttccaactccgtctccctcctccgtgccagcgcgataaatgcgaatcagagtagtatgctgatattacaagagacaagcatagacgctgcaggagcggttgtcgtgtacgcgcctgttgatatcccagcaatgcaagctgtgatgaacggtggagattctgcttacgtggcactccttccttcaggattcgccattctccctaacggtcaggctggtacgcaacgctgcgccgcagaggaacgtaacagtattggtaacggtgggtgcatggaggaaggagggtcgttactaacggtggcgtttcagatactggtgaatagtttgcctacggctaagctaacggtggaatctgtggagacggttaataatttgatatcgtgcaccgttcagaagattaaagctgctcttcattgtgatagcacctgatcatcgagatcagacgatggaggagattgagtcaagaa

SEQ ID NO: 4758 - DNA, 855 bp, Artificial Sequence
  P8735 (opLexA::G2616, G2616 is from A. thaliana)
ggagagaggagaaggcaaagtggtgaaagaggagatggagcaagagagcctaaacggtaggtatggtagtagagtaatgacggatgaacaaatggagactcttcgtaagcaaatcgccatttacgccgttctttgcgaccagctcgtcttcctccacaactctctctcttctgtccctcttctttcatcaggtacgtacactactccataattgtatttggaagaaacttaagggtcacgtaactgaatttgtatggtaatgattatgagaaaatacaataggaatgaatccaatgagaggtgagtattttgatccaatggtggcatcgtcaagcgctcatggaatgtcgactcggcctcgatggactcctacgacaacgcaacttcagattcttgagaacatttacaaggaaggcagtggaacaccaaatccgcggaggattaaagagatcacgatggaactgtctgaacatggacaaatcatggagaaaaatgtataccattggtttcaaaaccgacgagctcggtccaaacgaaagcaacctccgacaacgacaattacctcgagtcaggcggatgatgcggccgtgacaacaactgaggagagagggaggtgtggagatgattctggagggtttgagtcttatgagcatatactgttcccgagtcctgatttaggtaacctcttactatatgatatttatgtgtctatgcatcgtattttggtttaattgagtcagagatgaaaaaatgtggtgaactttttgtggtttcagggattgagcatttgttgaatagggacaagtttatagactgagtgaaacaaagatgatgaactctccaacctctctgttt

SEQ ID NO: 4759 - DNA, 1525 bp, Artificial Sequence
  P8738 (opLexA::G2902, G2902 is from A. thaliana)
taataaacccagaggctccactaatcgtcaaaatcccaaattccaaaatctccatttctctctcgctctcgctcaatctctcttcacaatgtcgacagtttcttcagatcctgctcatgcgaagaaatcgagaaacagtagaaaagcgttaaagcaaaagaatgagatcgtcgagtcatcaccggtctcagacaaggggaaagaaacgaagtcgtttgagaaagatctgatggagatgcaagcgatgttggagaagatgaagatcgagaaggagaaaactgaggatttgttgaaggagaaggacgagatcttgaggaagaaggaagttgaacaggaaaaacttaagacggagctgaagaaactgcagaagatgaaggaattcaagcctaacatgacttttgcttttagtcaatctttggcacaaactgaagaagaaaagaagggaaagaagaagaagaaggattgtgctgaaacaaagagaccatcaacaccatatattttgtggtgtaaggataattggaacgaagtgaagaaacagaatcctgaagctgatttcaaggagacttcgaacattctgggtgctaagtggaaggggattagtgctgaagagaagaagccttatgaggagaagtatcaggcggataaggaagcttatcttcaggttattacaaaggagaagcgtgagagggaagcaatgaagcttcttgatgatgagcagaagcagaaaactgcaatggaattgcttgatcagtatcttcactttgttcaggaagctgaacatgacaacaagaaaaaggccaagaagataaaggatcccctgaagcctaaacaaccaatatctgcttacctgatctatgcaaacgagaggagagctgctttaaaaggagaaaacaaaagcgttattgaggtcgctaagatggctggagaagagtggaagaacttgtcggaagaaaaaaaggctccttatgatcagatggcgaaaaagaacaaggagatatatctgcaagaaatggaaggatataaaagaacaaaggaagaagaagcaatgagccagaagaaagaagaagaagaattcatgaaactccataaacaagaagctctccaacttctcaagaagaaggagaaaaccgacaatatcataaagaagacgaaagagacggcgaagaacaagaaaaagaacgagaatgttgatcctaacaaacccaaaaagcctacttcttcatactttctcttctgcaaagacgcaagaaagagtgtgttagaagaacatcctgggatcaacaactcaactgttactgctcacatttcattgaaatggatggaacttggtgaagaggagaaacaagtttacaatagcaaagctgctgagttaatggaagcttacaagaaagaagtggaagagtacaataagaccaagacttcgtcgtagagaaagaaaaattagagaatgttcaagtttgctcatattgaacatctctacttatgcaaaatgactctgctacttaaatcgctaggcgctaatcgg

SEQ ID NO: 4760 - DNA, 2830 bp, Artificial Sequence
  P8741 (opLexA::G2804, G2804 is from A. thaliana)
cgtgaagcaattaccatcatatcggcaaattttgctttccgtttgtgatttttttttattttcttgaaagtaaacagttaaagagatacatataagtatataacatgtttttccggcgaaattcacagcctttccggcgagctacatcatgctcagtcacactcgaccctcaggtaaactctaaagatcttcttcctatctagttgctatcactggctctatctaaactttgtctaacattttcggaaaaacagtctatttccccacaataactatgacatcatgccagatagagcccgaactatgactacaatccagttgtccccgaaaagatacttttcgatctatatctccccaaaatcgatagtttttatctatttccccatatatttgggtttaatcggtttgctgaccaaacccaataaaaattcactcaacccgataccaaaccactttatatgtcaagcctctttaaaaaaaaaagaaaaaaaataataataataaaaaaaagaaataacaaaattgttgtcgtcttgttttctccattcttccccataaaattccagattatgcttatttgaaaaaatagtttatctctctctttgattgttacgatgggtgttagatttattttgaatccacatacaaatttgtcgtaactaattaagagatattcaacaaagcattttaaacgcattctaattgttaataacgttaacatcgacattgacctgaaaactggaatcgttactaagaatatggctaagaaagagaagatcgaggtgagcttccacaggaattttacaattcacaaaagaacaacccaattaaacaaaatcaacatctcaattattaaataagttttatccaaattctattactgttctttcaattgctcatcttaaaatcaatctgggaattacaaaaaccagaaaacaatcaacacaaaccatcaagtcgacaatggctgattcagcgttatcaatcttctacaaaatgaagcaagtgatttcaatgggtggaataatgtgggaaggtctcaattcgagtttaatcaaagtcgatgaagctttgcttaagcagcagatccgagtggagatgaggaataaaaagaaaaggggaaaaactggaaaatatatctatagccaccatcaccggagccgacatcaccatcaccattgaaaggaagaagaacgtcatcgtgttgttattgtttcataataattcaattaattaattaatttatttatttagtgatactcggttagattaggtttattctggtttagtgttttcattagttagttataaaaatagtaaaccgaacaaaatcaatggctgtgggtaaataggtgaaaactatgcttatgggatagatataggttttgaactatagattcatagagatatagattgagaagtatcttttcggggccatctggatcgtcttcataaatcgggctctatctggcatgatgtcatagttctcgtggagaaatagaccgttttcaacattttcttctaatcaacactatttctaatttaacatgaaaatggtataagtttttcaaaaatagatttgtttcacattttctgtaatcaacgtttatttctttgttaacttgtgtttggagtaatttacactctagcttacattattccacaattttaaagtttgttagctaaacatgaaacttttccttttccaaatctcaatttgataaatctaaatcaaatccgatattatctgaatcccatattatttcaatttcgataaattttataaaccgtcttattacattcttataaataagagacattcttatcagataacttgtctccgtccatatgtattgtttacttagttgaattctttagtttattaagggattaacatatatatctatatatatttttgaaacagaggaattcgagaagggtaacgataaagaatggtttattataacggagaggaacaaagttgatcaaggtttaagccaaacaaagagagttggtaatggtgcgaaaaggcagaaacgtgttgacactaacggaggatattggcacgcaacagtggctgcccaaaagatcaacgctggagatggtgtcgttggcaacaaaaggccacttgcatactacgataggaaaccatcagaagacgtcaaaactgattggttaatgcaagaatactctcttgatcacaacaacgacaaggtaagtatgtcttggttcccaagttatttaggttttcaagttttggattctgttttgagtcttgtttttgttgtgcgtctaggattacactttgtgcaagatttatcttactccacaagcaacaaagaagttggagaagagaagaagaagcagaagaaaggagaacctgtggaagcatcggaagggcagcagccttgtaatgccgagtatcatcaaccgctagcacctctagattcttgccaaccgcagcctcatgatttggctgagcagctggatttgcatcaaccagaacagttgcagctgcaacagcctcatgatattgtgtatcaaccacagtattgtttacttccagaacaacatcagctgcagccttttcctgataacttttctgagttgaacagctttcaacagcaaccagtgatgatcccagacgatttagaagatttcttggctgaattaatggagccacattcactggatggagatgaagaatccaacaattatgggttttttgaaggcttatttgacacagaaggaattaatgataaaacattacactaactgatctcagtctgtaaactttgtatactaatgatgatgtgttagtataaagctg

SEQ ID NO: 4761 - DNA, 1724 bp, Artificial Sequence
  P8743 (opLexA::G2739, G2739 is from A. thaliana)
tctctctgggccttactcaatcaccaccaaataacagacaaaaaaacgccttcatcgccggcgaaagtgagtcggagaatggcgtatatgtgcaccgacagcggaaacttaatggctatagcacaacaactcatcaaacagaagcagcaacaacaatcacaacatcaacaacaagaagaacaagaacaagaacccaacccctggcccaatccatccttcgggtttactcttcccggttcgggtttctccgacccgtttcaagtaaccaacgacccaggttttcactttccacacctggagcatcatcaaaacgcagccgtcgcttccgaggagtttgactccgacgagtggatggagagtttgatcaacggtggagatgcgtcacaaaccaatccagacttcccaatctacggccatgatccattcgtctcattcccgagtcgactcagtgctccttcatatctcaaccgagtcaacaaagatgactcagcgagtcaacaactccctccgccaccagcttccaccgctatatggtctccatctccgccatcaccacaacatcctcctcctcccccgccgcagccggattttgatctaaaccagccgatttttaaagctatccacgattatgcacgtaaaccggaaactaaaccggacacactaattcggatcaaagaatccgtgtccgaatcaggcgacccgatacaacgagtcgggtattacttcgcagaagctctgtctcataaagaaacagagtctccgtcgtcatcgtcgtcgtcatccctagaagatttcattctctcatacaaaaccttaaacgacgcatgtccatattcaaagttcgctcatttaacagcgaatcaagcaattctcgaagctacgaatcaatcaaacaacattcacatagtcgatttcgggatttttcaaggtattcaatggtctgctctgttacaagctttagcgacccgttcttctggtaaacccacccggatccggatttcgggtatacccgctccgtctctaggagactcaccgggaccgtctctgatcgctacgggaaaccgtctccgtgatttcgcggcgattttggatctcaatttcgagttttatccggttctgactccgattcaattactaaacgggtcaagttttcgggttgacccggatgaggttttggttgtgaattttatgcttgagctttataagcttctagatgaaacagcgacgactgttggtacggcgctccggttagctagatcgttaaacccgaggattgtgacgcttggagaatacgaagtcagtttaaaccgggttgaatttgctaaccgggttaagaactctctccggttttattccgcggtttttgaatcgcttgaaccgaatttggatcgagattcgaaagaaaggctgagagtggagagagtgttgttcggtaggaggattatggatttggtccgatcagatgatgataataataaaccgggaacccggtttgggttaatggaggagaaagaacaatggagagtgttgatggagaaagctggatttgagccggttaaaccgagtaattacgcggttagccaagcgaagctgctactatggaactacaattatagtacattgtattcacttgttgaatcggagccaggtttcatctccttggcttggaacaatgtgcctctcctcaccgtttcctcttggcgttgactacttggtccgataag

SEQ ID NO: 4762 - DNA, 2222 bp, Artificial Sequence
  P8937 (opLexA::G385, G385 is from A. thaliana)
gcttctagggtttgctttcagtttccggagtataagaaaagatgttcgagccaaatatgctgcttgcggctatgaacaacgcagacagcaataaccacaactacaaccacgaagacaacaataatgaaggatttcttcgggacgatgaattcgacagtccgaatactaaatcgggaagtgagaatcaagaaggaggatcaggaaacgaccaagatcctcttcatcctaacaagaagaaacgatatcatcgacacacccaacttcagatccaggagatggaagcgttcttcaaagagtgtcctcacccagatgacaagcaaaggaaacagctaagccgtgaattgaatttggaacctcttcaggtcaaattctggttccaaaacaaacgtacccaaatgaagaatcatcacgagcggcatgagaactcacatcttcgggcggagaacgaaaagcttcgaaacgacaacctaagatatcgagaggctcttgcaaatgcttcgtgtcctaattgtggtggtccaacagctatcggagaaatgtcattcgacgaacaccaactccgtctcgaaaatgctcgattaagggaagagatcgaccgtatatccgcaatcgcagctaaatacgtaggcaagccagtctcaaactatccacttatgtctcctcctcctcttcctccacgtccactagaactcgccatgggaaatattggaggagaagcttatggaaacaatccaaacgatctccttaagtccatcactgcaccaacagaatctgacaaacctgtcatcatcgacttatccgtggctgcaatggaagagctcatgaggatggttcaagtagacgagcctctgtggaagagtttggctttagacgaagaagaatatgcaaggacctttcctagagggatcggacctagaccggctggatatagatcagaagcttcgcgagaaagcgcggttgtgatcatgaatcatgttaacatcgttgagattctcatggatgtgaatcaatggtcgacgattttcgcggggatggtttctagagcaatgacattagcggttttatcgacaggagttgcaggaaactataatggagctcttcaagtgatgagcgcagagtttcaagttccatctccattagtcccaacacgtgaaacctatttcgcacgttactgtaaacaacaaggagatggttcgtgggcggttgtcgatatttcgttggatagtctccaaccaaatcccccggctagatgcaggcggcgagcttcaggatgtttgattcaagaattgccaaatggatattctaaggtgacttgggtggagcatgtggaagttgatgacagaggagttcataacttatacaaacacatggttagtactggtcatgccttcggtgctaaacgctgggtagccattcttgaccgccaatgcgagcggttagctagtgtcatggctacaaacatttcctctggagaagttggcgtgataaccaaccaagaagggaggaggagtatgctgaaattggcagagcggatggttataagcttttgtgcaggagtgagtgcttcaaccgctcacacgtggactacattgtccggtacaggagctgaagatgttagagtgatgactaggaagagtgtggatgatccaggaaggtctcctggtattgttcttagtgcagccacttctttttggatccctgttcctccaaagcgagtctttgacttcctcagagacgagaattcaagaaatgagtgggatattctgtctaatggaggagttgtgcaagaaatggcacatattgctaacgggagggataccggaaactgtgtttctcttcttcgggtaaatagtgcaaactctagccagagcaatatgctgatcctacaagagagctgcattgatcctacagcttcctttgtgatctatgctccagtcgatattgtagctatgaacatagtgcttaatggaggtgatccagactatgtggctctgcttccatcaggttttgctattcttcctgatggtaatgccaatagtggagcccctggaggagatggagggtcgctcttgactgttgcttttcagattctggttgactcagttcctacggctaagctgtctcttggctctgttgcaactgtcaataatctaatagcttgcactgttgagagaatcaaagcttcaatgtcttgtgagactgcttgaaaaccatccattagg

SEQ ID NO: 4763 - DNA, 1193 bp, Artificial Sequence
  P8941 (opLexA::G920, G920 is from A. thaliana)
aaaaaatctattttcttctctttccactatattacaacatttcttcattctcaaatcatcatactaaaaacctaaaaaaagttacatattcattgtatctttgtgagaaaaaaatggattcgaatagtaacaacacgaaatccataaagagaaaagttgtcgaccaacttgtcgaaggctatgaattcgctactcagcttcagcttctcctttctcatcaacactctaaccagtaccacatcgatgagacccgtcttgtttccgggtcgggttcagtttccggtggtccagatcccgttgatgagctcatgtctaagatcttgggatctttccataaaactatatcggttcttgattcttttgatcccgtcgccgtctctgtccccatcgccgtcgagggttcatggaatgcttcatgtggggatgattcggcgactccggtgagttgcaacggtggagattccggtgagagtaagaagaagagattaggggttggtaagggtaaaagaggatgctacactagaaagacgagatcacatacaaggatcgtggaagctaaaagttctgaagacagatatgcttggaggaaatatggacaaaaggagattcttaataccacattcccaagaagttactttagatgcacacacaagccaacgcaaggatgcaaagcaacaaagcaagttcagaaacaggatcaagattctgagatgttccaaatcacatacattggctaccacacatgcactgccaatgaccaaacgcacgcgaagaccgagccttttgatcaagaaatcattatggattcggaaaagacattggctgctagcactgctcagaaccatgtcaatgctatggtgcaagagcaagagaacaacaccagcagtgtgacagcaatagacgcaggcatggttaaggaggaacaaaataacaatggtgatcagagtaaagattattatgagggctcttcgacaggtgaggacttgtcattggtttggcaagagacgatgatgtttgatgatcatcaaaatcactactattgtggtgaaaccagtactacttctcatcaatttggtttcatcgacaacgatgatcagttttcctccttcttcgactcatattgtgctgattatgaaagaacaagtgctatgtgaacatccaaatctggaatgatgaatcagcactaggtcttc

SEQ ID NO: 4764 - DNA, 1613 bp, Artificial Sequence; identical to SEQ ID NO: 745
  P8948 (opLexA::G264, G264 is from A. thaliana)

SEQ ID NO: 4765 - DNA, 2324 bp, Artificial Sequence
  P8953 (opLexA::G819, G819 is from A. thaliana)
tatagaccaacgaagaagaagacgaagaagcagtctctcaaacttcttctccagatccgaatctcactctcatttctccgatctctctatttgaatgacctacaatttcgcatctcttttgatcttgatctctgtttctctccttctactgaatctcttgttttgagtaatcactaatatacacaacggcggcgatgagggggagatcagaaggagggaagaaaaagccggtgattgtgttactctgcgttgcatcagtagtgcttgtttttgtatatctcttctttggttcctctaaccataaagctattgagtatgggaggaaacttggtttgggtggtgatgatgatgatagtactaagaaagatgacacttctagctctttttatgtagaagatgtagtagggaatggtttcactcccagaagctttcctgtgtgtgatgatcgacactcggagcttattccttgcttagataggaatcttatataccaaatgagattgaagcttgatttgtctttgatggagcattatgaacgtcactgtcctcctcctgaaaggaggtttaattgcttgattcctcctcgtccagggtataagattccaatcaagtggccgaaaagcagagacgaagtttggaaagtgaacattcctcatactcacttagcgcatgagaagtctgaccaaaactggagggttgttaaaggagagaaaatcaatttccctggtggaggcacacattttcattatggtgctgataagtatattgcatcaatggcaaatatgcttaattttccgaacaatgttttgaacaatgggggaaggctgaggacatttcttgatgttggctgtggtgttgctagctttggaggttatcttcttgcatcagaaattatgacgatgtctttggcacctaatgatgttcatcagaaccaaatccaatttgctcttgagagagggattcctgcatacctcggcgttctagggaccaagaggctcccatacccaagcagatcctttgaacttgctcactgttcacgttgtcgtatcgattggcttcaaagagatggtattcttcttctcgagctagacagggtgctaagacctggtggctattttgcatattcatctccagaagcatatgcacaagatgaagaggacctcagaatatggagagaaatgagtgctcttgtgggccgtatgtgttggacgatagctgcaaaaaggaatcaaactgtaatttggcaaaaacctttgacaaatgattgttatttgggaagagaacctggaacccagcctcctctttgcaattctgacagtgaccctgatgctgtgtatggtgtaaacatggaagcatgcattactcaatacagtgaccatgaccacaaaaccaagggaagtggattggctccatggccagctcgattaacctctcctcctcctcggctagctgactttggctattccactgacatttttgagaaggatacagaaacttggaggcagagagtagatacttattgggatctcttgagtcctaaaattcaatcagacactgtaaggaacataatggacatgaaagcaagcatgggttcctttgctgctgctctgaaagaaaaagatgtttgggttatgaatgttgttcctgaagacggaccaaacacgcttaaactaatatacgacagaggcctgatgggtgctgttcatagctggtgtgaagcgttctcgacttacccgaggacttacgatttactccatgcctgggacatcatatctgatatcaagaagagaggttgcagcgcagaagatttgctgttggagatggatcgtatacttcgtccaagcggtttcatactcataagggacaaacaatccgtagtcgaccttgtgaagaagtatctcaaggctttgcattgggaagcagttgaaaccaagacagcctcggaatcagaccaagactcggacaatgtgatactcattgtccagaagaaactgtggttgacaagtgaaagcctcagagatttggagtgattacgatgatgatgatgatgaggccaaaaactgcctccaacatgaaaaaacaaaacaacattcacaagagatttctttcttgggagaatctaatcgaaaacatacaacgaagaaaattcgttttatagcggcaatttaacgttcttttctcttaaatctttctttctttacatattcatataatgtttgtatggttcgttagagaggactaaagtttcttatcaatttaaactctttttgttgcaatttatgtattaaatcattgtttaatagattgatgattattcattacta

SEQ ID NO: 4766 - DNA, 1205 bp, Artificial Sequence
  P9029 (opLexA::G2579, G2579 is from A. thaliana)
acttactcatcataagatatctttaaccaaaaccctaaaagaaacctcctttcaaaaaaaccatttcttcatcatcatgtcaacctccaaaaccctagaccataataaaccatttgaaacatcccaaacgcaaatgggttttgctctgatccaccaaaacacatccgccaacacaaccaccaccaccacaaccggcgagagacgaggccggagatcaaagcaagcggagccagggaggttcctaggagtccggagacgtccatggggtcgttacgcagccgagataagagatccaaccaccaaagaacgtcactggctaggcactttcgacacagctcacgaagctgctcttgcctacgatagagctgctctttcaatgagaggtactcaagctcgaaccaacttcgtctacactccaactgatgtccacaccatcctcacaaaccctaatctccactctctcattgtctctccttacaataacaaccaatctttcttaccaaactcttctccacagtttgtcatcgatcatcatcctcattatcaaaactatcatcaaccacaacaacctaaacacactctcccccaaactgtcttacccgcggcttctttcaaaacgccagttcgtcatcaaagcgtggatattcaagcgtttggtaatagtcctcaaaactcatcttctaacggctcgttatcttcttcactagacgaagaaaacaacttcttcttctctttaacaagcgaagaacataataagtccaataacaactcgggttacttggattgcattgtcccaaaccactgccttaaaccacctccggaggccaccaccacccaaaatcaagccggagctagtttcacaactccggtagcaagcaaagcctctgaaccatatggagggtttagtaatagctacttcgaagatggtgagatgatgatgatgaatcatcatgagtttggttcgtgtgatctctctgccatgatcacgaactatggtgctgctgccgcttcaatgtcaatggaagattacgggatgatggagccgcaagatttatcttcttcttctatcgctgcttttggagatgtcgttgcagacactacaggcttctactcagtcttttagaacattctatattatatatgttttttatatatgcaataatattattagtatttacgttattcgatggtcgtttgattgttgt

SEQ ID NO: 4767 - DNA, 1376 bp, Artificial Sequence
  P9030 (opLexA::G2394, G2394 is from A. thaliana)
gcggttgtgtgttacgagagctagagttgaatttgctttggtcaacacaatggggacttgtggttgctgacttttgtgattttcagttttctacttggatttagatggatgtttcttccattgtgcgaaatacaaccctaactgatcaagatcctttgttaatggaccacggtaaccgcgagcacatcgttgacattacaagcaatgacgaggaggactcttcatcaagatcttctctcgatgagcttactcctcaaggtaactcacatcaaggtgaagagacagtattatcatcatcaaatgctacacaacaacacccaactcatccatctcctcctcagcaaagaccaacttcttctaggagaggagataacgggaatggtcgccgtactaggagtccattgaattctggcctctggatctcagttgagttagttgtcactgtcgctcagattgttgcagccattgtagttatggttctggctaaagatgaacatcctgaagcgccattatttacttgggttattggatatacttgtggctgtctagccactctccctattctctattggcgttttcgcacttataatcgagctacagggcaagactcttcacaacgtgctacctcttctcaaggcaatagtgagtccacaccatatacagcagtctcagttgctcaagcagcagatgaagaaaatagcactggcgtgagtgcagcacctagaaacaatcaagttggggaaagcttaagaacaaggctcaacgggctagtggaccacttcaagatggcgattgattgtttctttgcggtgtggtttgttgtggggaatgtatggatatttggaggtcactcatctccttctgattctcctaaactgtacaggttatgcatagcgttccttactttcagttgcattggatatgcaatgccattcatactatgtgcaaccatatgttgttgtttgccttgcttaatctcggttctcggatttcgagagaacttctcacaaactagaggagccactgccgaggccatcaacgcattgcctgtctacaggttcaaatcaaaaagtagaaatgatttggagttttcagaagaaggtgaaggtggatttcttctcttggggtctcagaagaaacgtcttatatcaggcgaggatgccagctgttgcatctgcttgactagatatggagacgacgaacaagttagagagctgccatgctcacatgtcttccatgtagactgtgtagacaaatggcttaaaatcaatgcgacttgccctctctgcaaaaatgaggttggagaaagcagcagtgcttcctcatagacaaaagctgagttgatcgcaactgtttggaatttgggatccatagtc

SEQ ID NO: 4768 - DNA, 1146 bp, Artificial Sequence
  P9039 (opLexA::G2704, G2704 is from A. thaliana)
gagcatcttaaatctcttgatcggttttcgaagatgtatcaccaaaatctgatttcatcgaccccaaaccaaaattctaatcctcacgattgggatattcaaaatcctttattttccatacatccttcagctgaaataccctcaaaatatccctttatgggtatcacttcttgcccaaacaccaatgtttttgaggaatttcaatataaaataaccaacgatcaaaactttccaacgacctataacaccccattccctgtaatatctgaaggtatatcatacaatatgcatgatgttcaagagaatactatgtgtggttatactgctcacaatcaagggcttatcattggttgtcacgagccagttcttgttcatgccgtggttgagtctcagcaatttaatgtcccacagtcagaggatatcaatttagtatctcagagtgagagggtcacagaagataaggtaatgttcaaaaccgatcataagaagaaagacattattggcaaagggcaatggactcctactgaagacgagttgttggtgagaatggtgaaaagtaaaggaacgaaaaactggacatcaatcgcaaaaatgttccaaggacgagtaggaaaacaatgtcgagagaggtggcataaccatcttcgaccaaacatcaagaaaaatgattggagtgaagaagaagatcaaatacttattgaagtccacaagatagttggcaacaaatggaccgaaattgctaaaagacttcctggacgaagtgaaaatattgttaaaaatcattggaatgctacaaaacgtcgactacactccgtaaggactaagagaagtgatgctttttcccctcgcaacaatgcccttgaaaattacataaggtctatcacaatcaacaacaatgcccttatgaacagagaagttgattctataactgcaaactcggaaattgatagtaccagatgtgagaatattgttgacgaggtgatgaatctgaatctgcacgctacaacgtccgtttatgttccggagcaagcagtgttgacatggggttatgattttacaaaatgttatgaacccatggatgatacatggatgctcatgaatggttggaattaatttctggtgtaggagattgctttgctaaagatg

SEQ ID NO: 4769 - DNA, 1273 bp, Artificial Sequence
  P9044 (opLexA::G2212, G2212 is from A. thaliana)
gtaaaattttaacctacttttcttggagccttttcacttaatgacaaacgcttcaagtacataaaaccttggattcttctgcagatttttcacactaaaaaaggaaaaaaagaaaaatatattaataaaacttttttatgttaaaatcttgggcttctgcttttgcgactcttggtcttcttcggacatggcacattccttaacctcactcgccgttttccagagcgtcatccgcaaagagatggtgaggagtttgcatgtctatgaatcggtggagattgagagagagttctggttcaagagcaaaagctgttatgtagagaagaaagcgaagcctctgtttcgttcggaagatttccggcgaccggagatctcggaagggtcggtttttggcacgtggcgttgtatctttgtgttccggtttaatcactcgcttcctcggtttcctactcttctctgtctttccagaaatcccaaactggaggacatccctaatttagccaacgagctcaagtttatctccgagttaaaaccatcaaagatttatgaagaagaacaatgcagtagcagtacagagggatattataactctgatctgcctaaaccacgaaagctcgttctgaaacaagatcttaactgccttcctgattcagaaaccgaatccgaggaatctgtaaacgaaaaaaccgaacattcggaatttgaaaacgataaaactgaacagtcggaatcagatgctaagactgagattttgaagaagaagaagaggacaccatcgagacatgttgctgaactatccttagaagagctttcaaaatactttgacctcactatcgtggaagcttctcggaatctcaaggtcggtctcactgttttgaaaaagaaatgcagagagtttgggattccacggtggcctcataggaagatcaaatctctcgactgtctcatccacgatcttcagagggaagcagagaagcagcaggaaaagaatgaagcagcagcaatggcggtagctaagaaacaggagaaactggagacagagaagagaaatatagtgaagagaccattcatggagatagggatagaaaccaaaaaattcagacaagaaaacttcaagaaaagacacagggcttctagagccaagaagaatcaagaatctcttgtcacttcctcttccacttaaagactttaggtcctttaacagtaacatcggatatattagttagttaggggtttctgtgaagcgttttggtatttagaaatgttagttacg

SEQ ID NO: 4770 - DNA, 1146 bp, Artificial Sequence
  P9046 (opLexA::G246, G246 is from A. thaliana)
tctttacatggcaaggtttaagaaacattcaacaactattctataactcacacattttaatacgataaacagagaaatatcacacaacaatacattatgtatctgtttatgtataaatgtaacatagttttggaggagactcatgtttttcaaaataccccttgtgatgtttcattgcagaggccatttaatgggtttggagaaaacaatgcattaccattgagaaagatgcatcaagaggagaagaagaagaaacataggggtggacactggacactttcagaggatctcaaactcaaagagcttgtggcggtttttggtcctcagaactggaaattcattggagagaagatggaaccaagaacaagtaaaatattgttttttttttctttcgtacttactctatttttggacatgaaagttgaatctttttttcttgtttttctatgtgtttgaaggtctaagttgtagacaaaggtggtttaaccagctcgatccgaagattaacaaaagaaatttcactgatgaggaagaagagaagctgcttagagctcacatattatatggtaacaaatggtctaagatcgctaagcttttcaatcgaagaacagaccatgctgttaagaatcattggcacagtctcatgaatagaatcattaggaagcaatcagcttctgacataagatctttcgataacatccagaattatcaaacctccaactttcttcctggtttgtgtctccttaatactaaacaatagatttaaaacaccacacagcaatatgggttcaattctgagttcttgatgtttatttttcttattgtgtggtttacaggtagtgtaagtcatgaaagtactaacctcaatgctcaatatctccaagaaaagaattattcttcatgcatgccattgcaacactcatgtcatcatcatcacttctctaccttccctgcaaattccttggccttattcacacctcatgtctccatctctcaaccatcatcatcatcgttactatcatcatcagaagcagaagatataatgactacaaaaaccccgaggtatatagattttctcggggtaggagattcttgaagaaactacttaagaacttcctaactgtaaccttaattccaatgatgagg

SEQ ID NO: 4771 - DNA, 2114 bp, Artificial Sequence
  P9057 (opLexA::G1553, G1553 is from A. thaliana)
gtcgtgtctcgtcgttaaagaaacgagagtttttcagctctttacttaccttttcttcttacccttctttcatgactcttcttctttgatgggttaataatgctttgagcttgatgatttcgattttagtttcctgttagtgtttgttttcttctgtaaagcttggattttttttggtttcttcgatggcgaatgtggaagctgatttcagaacatcagggtctaatgatgatgaattgtacacggagctatggaaagcttgtgcagggccacttgtggaagttcctcgttatggtgaaagagttttctacttccctcaaggtcacatggaacaattggttgcttcgactaatcaaggagttgttgatcaagagataccagtgtttaatcttcctccaaagatactttgtcgtgttcttagtgttacgttaaaagcagaacatgagaccgatgaggtttacgctcagatcacattacaaccagaagaagatcaaagtgaaccaacaagtcttgacccacctttagtagaaccagctaaaccaacggttgattcttttgtgaagattctaacagcttcagatacaagcacacatggtggattctctgttcttcgtaaacacgccactgagtgtttaccttcacttgatatgacacaacctacaccgactcaagaacttgtagctagagatcttcacggctatgaatggaggtttaagcatatatttagagggcaaccgaggaggcatttacttacaaccggttggagtacatttgtaacctcgaaaagacttgtagctggagatgcatttgtgttcttgaggggtgaaaccggggatttacgggttggtgtgaggcgtttagctaagcagcaaagcacgatgcccgcatccgttatttcgagtcagagtatgcgtttgggagttcttgctacagcttctcatgctgttaccacaacaactatatttgttgtcttctataaaccaaggataagccagtttataattagtgtgaacaagtatatgatggcgatgaagaacgggttttctctcggtatgcggtataggatgagattcgaaggagaagagtctcctgagagaatatttacaggtaccattattggcagtggagatctatcttctcaatggccagcttccaaatggaggtcattgcagatccaatgggacgagccatcttctatacagagaccaaacaaggtctcaccgtgggagatcgagcctttctcaccatccgcgcttacaccaacccctactcaacaacaatcaaagtccaaacggtccagaccaatctcagaaatcacagggagtcctgtagcttctagtttcttgagtagtttctcgcagagccacgagtctaatccatcggtcaaactgttgtttcaagatccagcaaccgagagaaactcaaacaaatcagtgttttcaagtggattacaatgcaagataaccgaggctccggtcacaagtagttgtaggttattcggattcgatctcacgagcaagcctgcttctgctacaattcctcatgacaagcagctaataagtgtggattcaaatatatctgattctaccaccaagtgtcaagatcctaactcttcaaactcaccaaaagagcagaaacaacaaacatccacaagaagccgaatcaaggtgcaaatgcaaggaacagcggttggacgcgcggttgatttaacattgttgagatcatacgatgaactaataaaagagctagagaaaatgtttgagattgaaggagaacttagtcctaaagacaaatgggctatcgtgtttacagacgatgaaggagataggatgcttgtaggagatgatccatggaatgagttctgtaaaatggcaaagaagttattcatatatccgagtgatgaggtcaagaaaatgaggtcgaagtcgttgttgggtgataaaggtacgatcgtaaatcttgaatcagatcagaggacagttcacgtttaactatcaagttgttgatttcttactttcttggagactctctcaagtctcaccaagtccgagagttaggtggtttttttttttttggttttttttttggcgttaggtgggtttgttatttacttg

SEQ ID NO: 4772 - DNA, 505 bp, Artificial Sequence
  P9059 (opLexA::G3006, G3006 is from A. thaliana)
attgatagctcgtctataaataatgctcttgctcttcctctctatgctaaaatctcgaaaccctaattattctaagattctaatttgtgaagtttgtgaggttttagggatgggttacaatttctacatgagagtgtatgaggttgttgatgatgcttcaacggatgcaatcatatcgtggagcgaaagcaacaacagtttcattatctggaatgttggagagttttacagaaggattctgcctaaatatgtagacttgggcacaaacctctcacggtttttctccaaccttcgttctcatgggttcaaaatagttaaaggaagaactggagtattggaatttggacatgaagattttatcagagataaactggagcttatgaagaagatggttagcgataaacgtaaagcaaggaaagctgctaaatccaaagcaaggaaagctagagttcaagtcgagtttctcttccaacacttgcaaatttgatcgtccattaaatcagtc

SEQ ID NO: 4773 - DNA, 1016 bp, Artificial Sequence; identical to SEQ ID NO: 815
  P9060 (opLexA::G2779, G2779 is from A. thaliana)

SEQ ID NO: 4774 - DNA, 1388 bp, Artificial Sequence
  P9076 (opLexA::G204, G204 is from A. thaliana)
gaagaaattcaaatattgataactgtggatgggtgcaccaaagcagaagtggacaccggaagaagaagcagctcttaaagctggagttcttaagcatgggactgggaagtggcgtaccatactctcggatactgagtttagtttaatccttaagtctcgctctaatgttgatcttaaggtaatacaatataatatgctttttggaggttgtgatcgcgtgtttcggactaatcttgatagttcaaggcataacaggacaaatggagaaatataagcgtgacagctttatggggttcaaggaagaaggctaaacttgcgcttaagaggactccaccaggtactaaacaggatgataacaacacagctcttaccattgtggctttgactaatgatgatgaacgtgcaaaaccaacttcccccggaggttctggtggtggatcaccacgcacttgtgcttctaagagatcaattacaaggtttggttccctgacttatgcaccacataacgattttcttgagttcataaagatttgatcttgcgctattgtctgtttttgtagtttggataagatcatctttgaggcaattaccaacttgagggaactacgcggttctgacagaacatcaatctttctgtatatagaggtatttctaccattgggattacatgtttggttggggtttgttgcatacttacttagtagctgttaaatttcaggagaatttcaagactccaccgaatatgaaaaggcatgtcgcagtacgattaaagcatttatcatcgaatggaacattagttaaggtaaacacacaacttttgattcaagattcatgatcactaacacttcattactctcagaattttcaaaaatacttacttggtgatttctcactttcagataaagcacaagtacaggttttcttctaattttattcccgcaggtgcaagacagaaggctcctcaactctttctggaaggaaacaacaagaaagacccaacaaaacccgaggagaacggtgccaacagtctcactaaattccgagtagacggtgaattatatatgataaaaggcatgacagctcaagaagctgcagaggctgcagcaagagcagttgcagaggcagaatttgctatcacagaggctgaacaagcagcaaaagaggcagaaagagcagaagcagaagctgaagctgctcagatatttgcaaaggcagccatgaaagctttgaagttcaggatccgtaatcatccttggtgaaacagaaagaaatagccatcatggggaagttctgtaacaaagcaagccataaaatatatatacttagtgggtttactggtttcttaagagtgccgatcttgaatcaggcgatatctcatcacctgcaga

SEQ ID NO: 4775 - DNA, 934 bp, Artificial Sequence
  P9079 (opLexA::G443, G443 is from A. thaliana)
ctagacaaccacaagaacacaaaacacacaaaaacaaagaggttctttctttgaagaagaaatggaaaaagttgatgtttatgatgagcttgttaacctaaaggcaacagagctgagattgggattaccagggacagaagaaactgtttcttgtggaaaaagcaacaaaagagttttacctgaagctactgagaaagagattgaatccactggaaaaactgaaaccgcttctcctccaaaggctcagattgttggatggccaccagttagatcttacagaaagaacaatgttcagacaaagaagagtgaatctgaaggtcaaggaaactatgtgaaagtaagtatggatggtgctccatatctaaggaagatagatctaacgatgtataaacaatatccagagttgatgaaatcacttgaaaacatgtttaaattctctgtgggagaatattttgagagagaaggatataaaggctcagactttgtacctacttatgaagacaaagatggtgattggatgcttgttggtgatgttccttgggagatgtttgtttcgtcttgtaagaggctaaggatcatgaaaggatctgaagttaaaggtttaggttgtggtggtctttaacaaacctaattgagagataaagatcaaagagaaagattcaaaaacagagttttttgttctgtttcttgaaacagagtaaatatagctctgaaactgctcgggttcttggggagagatgtttcatacaatcatactttgtgaatgtttacctcatcggtaaaaagagagatgcttaaaatggtcttaagcataaaagtgtgagaaagatctaaatctaaactttagctgtaactctgtctccattaaagagaaaggttttgtggtattagaaagatctaatctgaagattatctttgtgtttttcacttttta

SEQ ID NO: 4776 - DNA, 697 bp, Artificial Sequence; identical to SEQ ID NO: 1085
  P9081 (opLexA::G451, G451 is from A. thaliana)

SEQ ID NO: 4777 - DNA, 863 bp, Artificial Sequence; identical to SEQ ID NO: 1281
  P9089 (opLexA::G902, G902 is from A. thaliana)

SEQ ID NO: 4778 - DNA, 858 bp, Artificial Sequence
  P9092 (opLexA::G43, G43 is from A. thaliana)
ctcctgtcttgtctaaagaaaaaagagagaggaagaaatggagacttttgaggaaagctctgatttggatgttatacagaaacatctatttgaagacttgatgatccctgatggtttcattgaagattttgtctttgatgatactgcttttgtctccggactctggtctctagaaccctttaacccagttccgaaactggaacctagttcacctgttcttgatccagattcctatgtccaagagattctgcaaatggaagcagaatcatcatcatcatcatcaacaacaacgtcacctgaggttgagactgtctcaaaccggaaaaaaacaaagaggtttgaagaaacgagacattacagaggcgtgagaaggaggccatgggggaaatttgcagcagagattcgagatccggcaaagaaaggatccaggatttggttaggcacttttgagagtgatattgatgctgcaagggcttacgactatgcagcttttaagctcaggggaagaaaagctgttctcaactttcctttggatgccggaaagtatgatgctccggtcaattcatgccgaaaaaggaggagaaccgatgtaccacagcctcaaggaacaacaacaagtacttcatcatcgtcatcaaactaatgggggaatagtgatgtttaattagtatatataggttaatatcttaagtatgtgaagcatcatgtatagagccaagaacctgttagactagtgtactgaaaagaactcttgcaaaatatgtactaaagagttcctgtaacaatggaacttctgcgttttctcttgtcttaaagagcttaaggttctagaaacaaagttcttgtcctttcggttta

SEQ ID NO: 4779 - DNA, 1236 bp, Artificial Sequence
  P9098 (opLexA::G519, G519 is from A. thaliana)
cacaaagatcctccgattcgaaggtttataaaaactcaaaatcgaatcttatccacaagaaaacaacaaggtacttttccaaaaatgaaggcggagttgaatttgccggcgggattccgatttcatccgacggacgaagagcttgtcaagttctatctttgccggagatgtgcgtcagaaccgattaacgttccggttatcgcagagattgacttgtacaaattcaatccatgggagcttccagaaatggcgttgtacggtgagaaagaatggtacttcttctcgcatagagaccggaaatacccaaacgggtcgagaccaaaccgggcagctggaaccggttattggaaagcgactggagctgataaaccgatcggaaaaccgaagacgttagggattaagaaagcactcgtcttctacgcaggaaaagctccgaaagggattaaaacgaattggattatgcacgagtatcgtctcgctaatgtcgatcgatctgcttctaccaacaagaagaacaacttaagacttgatgattgggttttgtgtcggatatacaataagaaaggaacaatggagaagtatttaccggcggcggctgagaaaccgacggaaaagatgagtacgtcggactcaagatgctcaagtcacgtgatttcaccggacgtcacgtgttctgataactgggaggttgagagtgagcccaaatggattaatctggaagacgcgttagaggcatttaatgatgacacgtccatgtttagttccattggtttgttgcaaaatgacgcctttgttcctcagtttcagtaccagtcctccgatttcgtcgattcgtttcaggacccgttcgagcagaaaccgttcttgaattggaattttgctcctcaagggtaaaaataatcggcaaaaagttgaagcttttcagagtcttcgatcaccggcattgtgtcggatcctgacccggagaccaagtcgggtcatacgattacataatcgggttattgagatttccacatttggatttccgagactaaccaacttaacggattctggggtaattggggggttttgcacaggtgaatcacactgagtcagcaagtttcgattttttggttttgttttgtaatgattgattaaatgtctaaagatatcacgaagtagattcagaagaactgtaaaagcaattgtgaccacccgttatgaatcataaatatattcaatgaagcatgagcttat

SEQ ID NO: 4780 - DNA, 843 bp, Artificial Sequence
  P9103 (opLexA::G595, G595 is from A. thaliana)
gtttgagcgcatcgcaaactcgaaggcgcgactgtgagagagaagaatggcgtcgtcatcatcgagaggagagatggagaagatgggaatcgatcagctaaaagctttgaaggagcaagcagatctggaagtgaatcttcttcaagatagtctcaacaacatccgtacagctaccgttcgtctcgatgccgccgccgcagctctcaacgatctctctcttcgacctcaaggtaagaagatgcttgtaccactgactgcttctctatacgtgcctgggacacttgatgaagctgataaggttttagttgatattggcactggttacttcattgagaaaacaatggatgatggaaaagattattgtcagaggaagatcaacttgctcaaatccaactttgatcaactttttgaggtcgcagcgaaaaagaaaagcgtggcagatgaagctggaatggtcttgcaggccaaagttaaacagttaacagctgcaaccacgtcgtgaaaattattccttctctagtgctttttgctattgagactattttgagattgcaaatgattttgtctgatcagttatgttttgactcttttgatctcaatcggcttgtgtttagtgtgctagaagaatttgtgctgtaattttaagtaatcagtagtgactatgagaaagaaaagacgtgttaactagttatttctcataaaacgtgagaaaagagacaaaagcgatgatgttattggaggcaaaaacgatgatgttattgttgggggtagaaagagacaactgaatcaatgaactttaaatacaacttgttttgttgttttaagaaaagggatctttccgca

SEQ ID NO: 4781 - DNA, 1201 bp, Artificial Sequence
  P9105 (opLexA::G869, G869 is from A. thaliana)
cgcttaagacccaaaaggacttgttctagtgttgaagtctttgggggttttcacataaagcagcaaaagttttcttttttcatagttcgctgagagttttgagttttgataccaaaaaagttttgaccttttagagtgattttttgttctttctgttttctgggtatttttgaggagtgggtttaacaatggttgcgattagaaaggaacagtctttgagtggtgttagtagcgagattaagaagagagctaagagaaacactctatcgtcccttcctcaagaaacccaacctttgaggaaagtccgtattattgtgaatgatccttatgctactgatgattcctctagtgatgaggaagagcttaaggttcctaagccaaggaaaatgaaacgtatcgttcgtgagattaactttccttctatggaagtttctgaacagccttctgagagttcttctcaggacagtactaaaactgatggcaagatagctgtgtcagcttctcctgctgttcctaggaagaagcctgttggtgttaggcaaaggaaatgggggaaatgggctgctgagattagagatcctattaagaaaactaggacttggttgggtacttttgatactcttgaagaagctgctaaagcttatgatgctaagaagcttgagtttgatgctattgttgctggaaatgtgtccactactaaacgtgatgtttcttcatctgagactagccaatgctctcgttcttcacctgttgttcctgttgagcaagatgacacttctgcatcagctctcacttgtgtcaacaaccctgatgacgtctcgaccgttgctccaactgctccaactccaaatgttcctgctggtggaaacaaggaaacgttgttcgatttcgactttactaatctacagatccctgattttggtttcttggcagaggagcaacaagacctagacttcgattgtttcctcgcggatgatcagtttgatgatttcggcttgcttgatgacattcaaggattcgaagataacggtccaagtgcgttaccagatttcgactttgcggatgttgaagatcttcagctagctgactctagtttcggtttccttgatcaacttgctcctatcaacatctcttgcccattaaaaagttttgcagcttcataggatcttgcttagtaatgttaagtgagaagagtgttttg

SEQ ID NO: 4782 - DNA, 945 bp, Artificial Sequence
  P9107 (opLexA::G929, G929 is from A. thaliana)
ggagagacctttaacaattttctgagggtaagatccagagattgattgaatcagcttactattttatataattcagtttgttgttcctcagacttgtaactaggacagtcttctcatgaatcatgacttcttcagtacatgagctctctgataacaatgaaagtcatgcgaagaaagaacgtccagattcccaaacccgaccacaggttccttcaggacgaagttcggaatctattgatacaaactctgtctactcagagcccatggcacatggattatacccgtatccagatccttactacagaagcgtctttgcacagcaagcgtatcttccacatccctatcctggggtccaattgcagttaatgggaatgcagcagccaggagttccattgcaatgtgatgcagtcgaggaacctgtttttgttaacgcaaagcaataccatggtatactcaggcgcaggcaatcccgggcaaaacttgaggcacgaaatagagccatcaaagcaaaaaagccatacatgcatgaatctcggcatttacatgcgataagacggccaagaggatgtggtggccggtttctcaatgccaagaaggaaaatggagaccacaaggaggaggaggaggcaacctctgatgagaacacttcagaagcaagttccagcctcaggtccgagaaattagctatggctacttctggtcctaatggtagatcttgaggaaggtttctgcacaaccacaagtttagtttctattttgggtggatgttctcagggcatcatcgtctttagtgtttttggatacgctgtgtacaggttatttgctagggtaaactttgttttagcgattagaaataaaactaagcaaagaaatgaaaagtgtgattggaagtattgttgtaccaaattgatattctttgccaatgaactcatgttttggaaagta

SEQ ID NO: 4783 - DNA, 1182 bp, Artificial Sequence
  P9109 (opLexA::G1014, G1014 is from A. thaliana)
atcactgaaacccaaagagatccaccatttgttcttttttccttcacacagagaactgttttcttccacacttcctttttactaggcagtgttaaccaattgagagagaaaaatgatggttgatgaaaatgtggaaaccaaggcctctactttagtggcaagtgttgatcatgggtttggatccgggtcgggtcatgatcatcatgggttatcggcgtctgtgcctcttcttggtgttaactggaagaagagaaggatgcctagacagagacgatcttcttcttcctttaaccttctctctttccctcctcctatgcctcctatttcccacgtgccaactcctctccccgcacgtaaaattgacccaagaaagctaagattcctcttccaaaaggaactcaagaacagtgacgtcagctctctccgacgtatgatactcccgaagaaagccgcggaggctcacttgccggcacttgaatgcaaggaagggattcctataagaatggaagatttggacggttttcacgtttggaccttcaagtataggtactggccaaacaacaatagcagaatgtacgtgctagaaaacacaggcgattttgtgaatgctcatggtctgcagctaggtgacttcatcatggtttaccaagatctctactcaaacaattacgttatacaagcaagaaaagcatcggaagaagaagaagtagacgtaatcaatcttgaagaagacgacgtttacacaaacttaacaaggatcgaaaacactgtggttaacgatcttctcctccaagattttaatcatcacaacaacaacaacaacaacaacagcaacagcaacagcaacaaatgttcttactattatccagtcatagatgatgtcaccacaaacacagagtcttttgtctacgacacgacggctcttacctccaacgatactcctctcgattttttgggtggacatacgacgactactaataattattactccaagttcggaacattcgatggtttgggctccgttgagaatatctctctcgatgacttctactagataatcaatcgatgggctcatggtattcttgatggtgatcagctatttaatatccttataatatatataagaattaaatgcaatttgcatatatattatcaagtgttgtaatataacattacagttta

SEQ ID NO: 4784 - DNA, 1496 bp, Artificial Sequence
  P9114 (opLexA::G1293, G1293 is from A. thaliana)
gagaatccaagaaccaatcaattttttattttataaaaagatgagcaatcttgaagaatctttgagatctctatcgttggatttcctgaacctactaatccgttgtatcctcgccgcacggagtcttttcttccgcaaattcttttgtgggacagactcaccacaacctgtcacaggtatagacccgacccaacatgggtccgtacccgctagcccaacaagaggctccacggccccagctggaattataccagtgaactcagtcggttatgaggtttttctgttgctacttcagtttctttatagcggacaagtctccatcgtgccgcagaaacacgagcctagacctaattgtggcgagagaggatgttggcacactcattgctcagccgccgttgatcttgctcttgatactctcgccgcctctcgttacttcggcgtcgagcagctcgcattgctcacccagaaacaattggcaagcatggtggagaaagcctctatcgaagatgtgatgaaagttttaatagcatcaagaaagcaagacatgcatcaattatggaccacctgctctcacttagttgctaaatcaggtctcccaccagagattcttgccaagcatctccctattgacgtcgtcaccaaaatagaagagcttcgtcttaaatcttctatagctcgccgttctctaatgcctcacaaccaccaccatgatctcagcgtggctcaagacctagaagatcaaaagattagaaggatgagacgagctttggattcatcagacgtggaactagtgaagctgatggtaatgggagaaggactcaatcttgatgagtcgttagcattgcattacgctgttgaaagctgtagtagagaagttgtgaaggctttgcttgagcttggagctgccgatgtgaattatccggcgggtccggcagggaaaacacctttgcacatcgcggctgagatggtctctccagacatggtggctgttctgttagaccaccatgctgatcctaatgtgaggacagttggtggaatcacgcctcttgatatccttagaacattaacttcggatttcttgttcaagggggcagttcctggattgactcacattgaaccgaataaacttaggctttgcctcgagcttgttcaatccgctgcaatggtgatatctcgagaagaaggaaacaatagcaacaaccaaaacaatgataacaataccgggatttaccctcatatgaatgaggagcacaatagtggaagcagtggagggagcaataacaatttggattcaagattggtttatctcaatcttggagcaggtacgggtcagatgggtccaggtcgagatcaaggggatgaccataacagtcagagggaaggtatgagtcggcatcatcatcatcatcaagacccatctacaatgtatcatcaccatcatcaacatcacttctagttctctatattggtctctatatctcaaccatataagactc

SEQ ID NO: 4785 - DNA, 1279 bp, Artificial Sequence
  P9116 (opLexA::G1435, G1435 is from A. thaliana)
gtgaaacatggggaaggaagttatggtgagcgattacggtgacgacgacggagaagacgccggcggcggcgatgaatataggattccggaatgggaaattggtttacccaacggagatgatttgactccgttatctcaatatctagtcccgtcgattctcgcgttagctttcagcatgatcccagaacgaagccgtacaattcacgacgtcaatcgcgcgtcgcaaatcacgctctcttcgttgagaagcagtaccaatgcttcgtctgtgatggaggaggtcgtggatcgagttgaatcgagtgttccaggatcagatccgaagaaacagaagaaatcggatggtggtgaagcagcggcggtggaggattccacggcggaggaaggagactccgggcctgaagacgcgtctgggaagacatcgaaacgaccgcgtttagtgtggacaccgcagctacacaagagatttgtggacgttgtggctcatctagggattaaaaacgcagtgccgaagacgattatgcagctgatgaacgtggaaggacttactcgtgagaacgttgcgtctcatttgcagaaatataggctttaccttaaacggattcaaggattgacgacggaagaagatccttattcgtcgtcggatcagctcttctcttcaacgccggttcctccacagagctttcaagacggcggaggaagtaacggaaagttgggggttccggttccggttccgtcgatggtgcctattccaggctatgggaatcaaatgggtatgcaaggatattatcaacagtatagtaaccatggcaatgaatcaaaccaatatatgatgcagcagaataagtttggaacaatggtgacatatccttctgttggtggtggtgacgtgaatgacaagtaaatggatcttaaaggtctataatttgctctacagagagatactggttcttggcttatggtttattttcccacttcatgaggttgttgtgacttttaattctccatgttttccacacaagtctttattgcctttgtatagaaaatgatttcgagaaaatcactgggaagcttggtattgttggaggatgaagccttctatgaatgatttagtttcctactgtctccattctttatgaggtaataaagccttcttttgctcatcgcttgtagtcttcttaaattcaagacagcgtcacatgtttgttcggttatgttaattgtttctttctttggataatgaagatagcatcaggtctcatgtctcctcactttgata

SEQ ID NO: 4786 - DNA, 1513 bp, Artificial Sequence
  P9119 (opLexA::G232, G232 is from A. thaliana)
catcaacataagagagagagaagaaaaaaagaattacaattaataagaacaagatcaagaatcaagaatcaagaaaatgggaagagcaccgtgttgtgataaggccaacgtgaagaaagggccttggtctcctgaggaagacgccaaactcaaagattacatcgagaatagtggcacaggaggcaactggattgctttgcctcagaaaattggtatgtattacttaaaactcacttttgatttaaaattggcactgagagtttccaaatagtactttgagaccgtggtcgtgttaaatttgtgtgttgatgatatttatttacatggtataggtttaaggagatgtgggaagagttgcaggctaaggtggctcaactatttgagaccaaacatcaaacatggtggcttctccgaggaagaagacaacatcatttgtaacctctatgttactattggtagcaggtactatatacttacatatatatcatcatatgcatggatgaatattattaattgacacacttattcttgacttagagactcactatgtatctttgtttaattctaggtggtctataattgctgcacaattgccgggaagaaccgacaacgatatcaaaaactattggaacacgaggctgaagaagaagcttctgaacaaacaaaggaaagagttccaagaagcgcgaatgaagcaagagatggtgatgatgaaaaggcaacaacaaggacaaggacaaggtcaaagtaatggtagtacggatctttatcttaacaacatgtttggatcatcaccatggccattactaccacaacttcctcctccacatcatcaaatacctcttggaatgatggaaccaacaagctgtaactactaccaaacgacaccgtcttgtaacctagaacaaaagccattgatcacactcaagaacatggtcaagattgaagaagaacaggaaaggacaaaccctgatcatcatcatcaagattctgtcacaaacccttttgatttctctttctctcagcttttgttagatcccaattactatctgggatcaggagggggaggagaaggagattttgctatcatgagcagcagcacaaactcaccattaccaaacacaagtagtgatcaacatccaagtcaacagcaagagattcttcaatggtttgggagcagtaactttcagacagaagcaatcaacgatatgttcataaacaacaacaacaacatagtgaatcttgagaccatcgagaacacaaaagtctatggagacgcctcagtagccggagccgctgtccgagcagctttgggcggagggacaacgagtacatcggcggatcaaagtacaataagttgggaggatataacttctctagttaattccgaagatgcaagttacttcaatgcgccaaatcatgtgtaacattttgtttaaaactttatttgtacttaaatacataaagaggggttttctattttgtataaatctgtgtctttagggagtggtag

SEQ ID NO: 4787 - DNA, 969 bp, Artificial Sequence
  P9121 (opLexA::G242, G242 is from A. thaliana)
cactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcggtaataaatgggcgacgattgctcgtcttctcaacggtcgtacggacaacgccgtgaagaatcactggaactcgacgctcaagaggaaatgcggcggttacgaccatcggggttacgatggttcggaggatcatcggccggttaagagatcggtgagtgcgggatctccacctgttgttactgggctttacatgagcccaggaagcccaactggatctgatgtcagtgattcaagtactatcccgatattaccttccgttgagcttttcaagcctgtgcctagacctggtgctgttgtgctaccgcttcctatcgaaacgtcgtcttcttccgatgatccaccgacttcgttaagcttgtcacttcctggtgccgacgtaagcgaggagtcaaaccgtagccacgagtcaacgaatatcaacaacaccacttcgagccgccacaaccacaacaatacggtgtcgtttatgccgtttagtggtgggtttagaggtgcgattgaggaaatggggaagtcttttcccggtaacggaggcgagtttatggcggtggtgcaagagatgattaaggcggaagtgaggagttacatgacggagatgcaacggaacaatggtggcggattcgtcggaggattcattgataatggcatgattccgatgagtcaaattggagttgggagaatcgagtagac

SEQ ID NO: 4788 - DNA, 1345 bp, Artificial Sequence
  P9123 (opLexA::G210, G210 is from A. thaliana)
ctacagttgtgttctgatagtgatgatcatgatcatcacatgaataagtagaagatatctcttaccttctccttcttctaataagatcagagttttggttcttatttctttgctctcaaaacaatgggtagatcaccgtgttgtgacaaattgggtttgaagaaaggaccttggacaccagaggaggatcagaaacttttagcttatattgaagaacatggtcatggaagttggcgttcattgcctgagaaagctggttagtgaatctttccacattttgtgctctataatcaaaactttctctcatatttattcctttctcttctcaggtctccatcgatgcggaaagagttgtagactaagatggactaactacctaagacctgacatcaaaagaggcaaattcaacttacaagaagaacaaaccattatccaactccatgctctgttaggaaacaggtctggtccttcttgcaacaaaacaaaacaatcacaaatcttttcctaaagttttcatgattctttttttgtttgtatatagatggtcagcgattgctactcatttgccaaagagaacagacaacgagatcaagaactattggaacactcatttgaagaaacggttagtgaaaatggggattgatccagtgactcataaacccaaaaacgagactcctttatcttctcttggtctatccaagaacgcagctatacttagccacactgctcaatgggaaagtgcaaggcttgaagctgaagcaagactagctagagaatcaaagcttcttcatttacaacattaccaaaccaaaacatcatctcaacctcatcatcatcatggattcactcacaagtcattgttacctaattggacaacaaaaccacacgaaggtaaaccaaagaaacacactaagtctccgcaaaatttaaactttggaactttgtttgagttttgtaagacaatgcagatcaacaacagcttgaatctccgacatctacagtgtcattctctgagatgaaggaatcaatcccggcgaagatagagtttgtcggatcatcaactggtgtgactctgatgaaagaacctgaacacgattggatcaattcaacgatgcacgagtttgaaactacgcagatgggagaaggaatcgaagaagggttcacgggtctcttgctcggtggtgattcaatcgaccggagtttctccggcgataaaaacgagacggccggcgagagtagtggtggtgactgcaactactatgaggacaacaagaactacttggacagcatttttaactttgtagatccttcaccgtcggattcaccgatgttctgaatctaaggg

SEQ ID NO: 4789 - DNA, 1067 bp, Artificial Sequence
  P9125 (opLexA::G225, G225 is from A. thaliana)
gctactattaatccttcccctcgtgaggaaatcatttcttcttgtttctcgagatttattctctttctctctctctttctctgtgtgtttcgtgtcttcagattagttcgatgtttcgttcagacaaggcggaaaaaatggataaacgacgacggagacagagcaaagccaaggcttcttgttccgaaggtctgatttctctttgtttctctctatatctttttgatcggtttgagtctgattttgtatgtttgtttcgcagaggtgagtagtatcgaatgggaagctgtgaagatgtcagaagaagaagaagatctcatttctcggatgtataaactcgttggcgacaggttagagactctttctctctcgatccatcttgttgctttctcttttttttggtctttcatgttttgtcgaatctgcttagattttgatctcaaagtcggtcgtttatttatgcattttcttggtttttctattatattattgggtctaacttaccgagctgtcaatgactgtgttcagcctgatttttgatcttgttattattctctgttttttgttttagttgttcaaatagcaaaacctaatcaagatttcgttttcagtttctttttttatatatgattctttagcaaaacatattcttaatttatgtcagaactcactttggctagtttggttcaattttgattacagcatgtttgtatgaagtcaaagtgtaaattacgattttggttcggttccatagaattttaaccgaattacaaactttatgcggtttttatcggaataaaaggtatttggttaagtgtaagttcctcaacactgactgttagcctatcctacgtggcgcgtaggtgggagttgatcgccggaaggatcccgggacggacgccggaggagatagagagatattggcttatgaaacacggcgtcgtttttgccaacagacgaagagacttttttaggaaatgattttttttgtttggattaaaagaaaattttcctctccttaattcacaagacaagaaaaaaaggaaatgtacctgtccttgaattac

SEQ ID NO: 4790 - DNA, 1546 bp, Artificial Sequence
  P9131 (opLexA::G26, G26 is from A. thaliana)
catagatgcagagaatagacatctttgctggttctttggcttgtacccaaacccatctttgacttcaaaaataaaataaaaataatcataattgacatcatcggataatgcatagcgggaagagacctctatcaccagaatcaatggccggaaatagagaagagaaaaaagagttgtgttgttgctcaactttgtcggaatctgatgtgtctgattttgtctctgaactcactggtcaacccatcccatcatccattgatgatcaatcttcgtcgcttactcttcaaggtaatttcatcagatcctttttccaataattttaattgctatactttataactcgagtgattgtcttttccattggtgattctctttacacataggaatgatttaatcttggattttgcaattggtaatcctttagtggctgcagcatggccttgatcaaatagagatataatttcatgtatggccacaatgcattagttcaatttactatatgatttttttaatgaatgttcatggttagattttcttgaaaaaacctgtcggctttattggttggacaaaattgatcatatttggctttcggacaaatatgattggcaaggcttggttgcaatggtcgtattttggttgagataactagccagagagagttttaggattgtaacatggggaaaacgtatttaaaatgatcaaacttaatttatatcctaattatatcattggtgtgatacataagtatatatatagttaattaccaattacgagagagaggaatgtataaatgtaggtttggcctaatatatagatttcataagtagatgtagaagaggggaataaaagttgatgtagaatgatcatatcatatgattcaaacgccctttaataatctttacgaaatgcctctacaccgatagtatacgttatattcatagacatgcacgtcacatttaagtcaccattttcatgacaagagtgaacttacaattttcatcatttttctacagaaaaaagtaactcgaggcaacgaaactacagaggcgtgaggcaaagaccgtggggaaaatgggcggctgagattcgtgacccgaacaaggcagctcgtgtgtggcttgggacgttcgacactgcagaagaagccgccttagcgtatgataaagctgcatttgagtttagaggtcacaaggccaagcttaacttccccgagcatattcgtgtcaaccctactcaactctatccatcgcccgctacttcccatgatcgcattatcgtgacaccacctagtccacctccaccaattgctcctgacatacttcttgatcaatatggccactttcaatctcgaagtagtgattccagtgccaacttgtccatgaatatgctgtcttcttcgtcttcatctttgaatcatcaagggctaagaccaaatttggaggatggtgaaaacgtgaagaacattagtatccacaaacgacgaaaataacatgttaatggcataaatatctcttcgtccaagttatcaaacgcattgacctccggc

SEQ ID NO: 4791 - DNA, 1712 bp, Artificial Sequence
  P9134 (opLexA::G216, G216 is from A. thaliana)
cataagtcataacgaacggttttgttttgaaaaaaaggtgagtcagcgaaaagggtaaaatagtaatttcttagcccacttaactttgcagttaggcttagcagagagaggtacagatagaggaccccggttggtttcatttttttgaaatttcaattttatttccgatgaacggagaaatctctcgtccgccggagctaatatcgtcccggaatccttgcaagagttttgaaaatgcaatacacaaagcagttgaggcagagctcgccgagctagcgaaaagcgacgcgaacggcggcggaaagagtaaagtgaaaggaccttggttgccggagcaagatgaggctctcacgaggcttgtgaaaatgtgtgggccgaggaactggaatctaatctcccgtggaatcccaggtcgctctggtaaatcttgccgattacgttggtgtaatcagctcgatcctatcctcaaacgaaaacctttctctggtaaaacacgattctcgatcttctttttgattctccttgattccagattcctgctttggtcgatttctctggatttctctttatctatgtctagtgttagctattgttgattcaggatctttgttgtggtacttgattcatatgattttctcagtagtgctaatgagaagcggtgttttagcttatttttgaaaaatttgtgagagatttgtagattggtctgttttgctggtgattttactggatatgaacttttcttcagaatcagattcttatgtatatggagatggtttaataggttttagcattctcttggattcaagatgtttatgttgtaattctttagagatgtggtttttgatgattagtgtgtgagttatgtgttttcacatgtttgtataatgtttttatgaaaatgatttgaaatgcagatgaggaggagcatatgataatgtctgcacaggcggttcttgggaacaaatggtctgtgattgctaaactcttacctgggagaacagataatgccattaagaatcattggaactctaatcttagacgtaaaccagcagaacaatggaagattcctctattgatgtctaatacagagatagtatatcaactgtatccatcaatggtcagaaggatatcaaacgcatcccccaaagaacatctacctcaagaagaagaaaccggtgtattaagtgatgataaaatggatgatgaagcaaaggagcctcctcgggagcaaaatagtaaaactggtgtttatcgtccagtggctcgaatgggtgctttcagtgtctgtaaaccaggatacatggctccatgtgagggacctttggttcaagcatcaagacctgactcattggctggtaaatttcttcagtctctttgttatgatcctattatcccttcaaaatgcggtcacggttgctgcaaccatcaagacagcacaacactgtcatcatcgtcggtgctgggatcagagtttgtggattatgaggaacattcttctgcagagttagataaagaattgatctctatatcaaatgacctgaacaatactgcttggattaggagtgggaaggaagctgaacagagtttgaaggctgatgatcagtttcgtcgtgagtatgctcactcgaaatttagtggaatggtaaacaatggtgtatcaagtcagatggtgagacaagatttaagggctttgagctaacgttagagac

SEQ ID NO: 4792 - DNA, 870 bp, Artificial Sequence
  P9136 (opLexA::G241, G241 is from A. thaliana)
ccaagaagctcaccaatgcttttgaattctcccacatgtcttttgacaattttagtataaatactcaaaccccttagtcagtcattctcatgttcatcaacagcatttgatctcaagctcataggaatttgatctccacattatatcttgatcatcaccacaagaaaaacatttcaacttcttttatcagcaatcacaaaacaaagagatgggaagagctccatgctgtgagaagatggggttgaagagaggaccatggacacctgaagaagatcaaatcttggtctcttttatcctcaaccatggacatagtaactggcgagccctccctaagcaagctggtatgtaaaaattataatatcaaatttcttaattttgatcaaatttcttacattaattattggtaattattatttacaggtcttttgagatgtggaaaaagctgtagacttaggtggatgaactatttaaagcctgatattaaacgtggcaatttcaccaaagaagaggaagatgctatcatcagcttacaccaaatacttggcaataggtattttacttcaacatataagtatataaccgacacacaagttttattttgttttcttactatatataaatcaccaaaagaaagtaactttattacacacgtctaggtcgcactactattcttttaactacacaatgatcggctctttaattacttttgtattgatgttcttcgttttccttttggtatcatctttagatggtcagcgattgcagcaaaactgcctggaagaaccgataacgagatcaagaacgtatggcacactcacttgaagaagagactcgaagatttatcaaccagctaaacctaagaccatcaac

SEQ ID NO: 4793 - DNA, 1760 bp, Artificial Sequence
  P9137 (opLexA::G206, G206 is from A. thaliana)
cacacttagccatcgtacacttactagttacttccaacatttggcttcctttgctttcacgaatagaaaccttagcttcttccatttcttctttctctcctcgtttaaattagtttttgacaaggaagaaaaagatggggagaagaccatgctgtgagaagataggattgaagaaagggccatggagtgctgaagaagatcgaatcttgatcaattatattagtctccatggccatcccaattggagagctctccctaaactagccggtaaataagccattttatatttgctatttgccatatgtatatattagtaacaaaataattttgtacctagctagcatgtgtattattgttctatagtatatagtagtgtatatttgttgtgtaaagttaataatggtgtttgtgaaatgattagggctacttcggtgcggaaaaagttgcaggcttcgttggattaattatttgagaccagacatcaaacgtggcaatttcactcctcatgaagaagatactatcatcagcttacatcaactcttaggcaacaggtttctcctccttttccattttctgtttttttacttcttcctttgattatatgcgaaattttagattttttggtcctatattctttgaaaccagaaattaaacaagaatttgagaaatcactcacaaatttttctttatttttaatctttgagaagtcaaatcacaagtttttttctttcttttaaagtaagtcaatgcaatttctgtttagtccataactccatatatattacagtgaaaatgatataatgttcatttgtagatgaaggattttgggacatcaaattgtgaaaagtatcattattttggaagtttagtttgttttaactgtggagactagctagctagattacttcacaattttctctttgtatatgtgttgcttttgtcaatatgcgaaattttatatctttgtggggcagagaactgagaagattccaacccgtgattgcctttgtccattaaataatttcaattttttactttcctctaattatactttttattcactagtagacaaagataggcactgtgatcagtgtaagacatgtgcaaattcttttaaccatacgcatgaacttcaataactttccttttgttttactcgctctttgttctcataacaatgtagacgacgtattatgatgattgatgagtcattcatgtgacatttgttttgagtagatggtctgcgatagctgcaaaattgcctggacgaacagacaacgaaattaaaaatgtttggcacactcatttaaagaaaagactccaccacagtcaagatcaaaacaacaaggaagatttcgtctctactacagctgcggagatgccaacctctccgcaacaacaatctagtagtagtgccgacatttcagcaattacaacattgggaaacaacaatgacatctccaatagcaacaaagactccgcgacgtcatccgaagatgttcttgcaattatagatgagagcttttggtcagaagtggtattgatggactgtgacatttcaggaaatgagaagaatgagaaaaagatagagaattgggagggctcactagatagaaacgataagggatataaccatgacatggagttttggtttgaccatctcactagtagtagttgtataattggagaaatgtccgacatttctgagttttgatttgttttagttaaagacttatatatcttcctttgtgacccacatg

SEQ ID NO: 4794 - DNA, 1487 bp, Artificial Sequence
  P9141 (opLexA::G409, G409 is from A. thaliana)
ctcagaactcagaagtagttgttgttttatttctgttgatcaaaaatggaatccaattcgtttttcttcgatccatctgcttcacacggcaacagcatgttcttccttgggaatctcaatcccgtcgtccaaggttcttttctcactctcttaatcttatttcatcatcttggaacacattacttttcggtgaatttcccctgtttttgtgtataaaacgttaggaacacacatacacacacatgagaaccaatttgaatatgaatacctcattcgattattgacagcagttgttcgtttgaatttgtgaaggaggaggagcaagatcgatgatgaacatggaggaaacttcgaagcgaaggcccttctttagctcccctgaggatctctacgacgatgacttttacgacgaccagttgcctgaaaagaagcgtcgcctcactaccgaacaagtagattctctcactatccacaataataattaacgatccactattcaaaaacaagtttgatagattctcattatattatggtaaaaggtgcatctgctggagaaaagcttcgagacagagaacaagctagagcctgaacgcaagactcagcttgccaagaagcttggtctacagccaaggcaagtggctgtctggtttcagaatcgccgagctcgttggaaaacaaaacagcttgagagagactacgatcttctcaagtccacttacgaccaacttctttctaactacgactccatcgtcatggacaacgataagctcagatccgaggtacttatacatgggactattatttatctcaacaagattacaaattgaatgatttaccttaattggtccaaaggagaaaaataaaaaaagcatcaagtgaaaagagaatatgcttttcctatttttcaacacaagctgatagagagaatccatcatcatatatatataaattagaggagagactagaaaaagaaagaaaattggggaatcaaatcaatcaacgagtttaattatctttttatgggaggaggttgcttgtgttgaccgttgtgattaaagttagaatctttccaacccgacaggttacttccctgaccgaaaagcttcagggcaaacaagagacagctaatgaaccacctggtcaagtgcccgaaccaaaccaacttgatccggtttacattaatgcggcagcaatcaaaaccgaggaccggttaagttcagggagcgttgggagcgcggtactagacgacgacgcacctcaactactagacagctgtgactcttacttcccaagcatcgtacccatccaagacaacagcaacgccagtgatcatgacaatgaccggagctgtttcgccgacgtctttgtgcccaccacttcaccgtcgcacgatcatcacggtgaatcattggctttctggggatggccttagaaaaccactctgataataaatgtgtgtttatttaagttcaagagtcatcttcttg

SEQ ID NO: 4795 - DNA, 1599 bp, Artificial Sequence
  P9142 (opLexA::G411, G411 is from A. thaliana)
gatggcctttcctcaacatggcttcatgtttcagcaactccatgaagacaatgctcatcacttaccttccccaacctctctcccctcttgtcctcctcatctcttctatggtaagtacctctctccctcttaccaaaatttgattacaaatttatcaattttccgtttgatgtttggtcactttggaattcactgcgttattaccttgaaatcccaagttaccaaaagaagcaataattggtaatttttgttgtctttgttttggtgtaggaggaggaggaaactacatgatgaacagatcaatgtcgttcacgggagtatcagatcatcatcatctaactcaaaaaagcccgacaacaacgaacaacatgaatgatcaagaccaggtaggcgaggaagacaacctatcagacgatgggtcacatatgatgttaggagagaagaagaagaggctgaatttagagcaagttagggcattagagaagagcttcgagctagggaacaagctggagccagagaggaagatgcagcttgctaaggctttaggattgcagcctaggcagattgcaatatggtttcagaacaggagagctaggtggaagacaaagcagctcgagagagactatgattctctcaaaaaacagttcgatgttttgaaatcggacaatgattctcttcttgcccacaacaagaaactacatgctgaggtatataatatacacacaaattctactaatcgttgaacatcgcgttagtttttaagcgctaatcttatcgaaacgattttcgattagattgataagaaatgtttttacaaatcactaattaatatgaatattatatgtacgaattcttcgtggtctatacgatgaaaaaataatgtgtattgatatatagctcgtagaattatagctaatgaattattattatcattaatcaagcatatacaaaaggaaaaccttcatggattaacacgtagtgtgagatcttagaatagctttaagatatagtatatagtatgatatcatttgcaattagattaatgataggctcttgatccaacgcaaagatgtttgtcaaaagacattaattataaattcttttctattttcaaataaagattcttacattttaaattagtaaacttcccatgtgctcgtggagttgacattacgataatttatgttatttaacaaattaataaatttatatgtgaataaatctctccactaacgtgtgataatattgctacataaaacagttagtggcattgaagaaacacgaccgtaaagaatcagcaaagatcaagagagaattcgcagaagcttcatggagcaacaatggaagcacagaaaataatcataacaataatagttcagacgctaatcatgtgagcatgatcaaagatcttttcccttcttcgatccgatccgcgaccgcgaccacgacctctacccatattgatcatcagattgttcaagatcaagatcaagggttttgcaatatgttcaatggtattgatgaaacgacgtcggctagttattgggcatggcctgaccagcagcaacaacatcacaatcatcatcagttcaattgatc

SEQ ID NO: 4796 - DNA, 4528 bp, Artificial Sequence
  P9145 (opLexA::G392, G392 is from A. thaliana)
tataccaaaagaaatcagtactttcaagaatacataactttttaggttgtgttaaataatatttgcttttgtaataaaggaacaaaattaaatagagagatcggagaggatcaaagatgggaggaggaagcaataatagtcacaatatggacaacgggaagtacgtgaggtacactcctgaacaagtggaagctctggagagactctacaatgactgtcctaaaccgagctctatgcgccgccaacagctaatccgcgaatgtcctatcctctccaacatcgagcctaaacagataaaagtctggttccagaaccgcaggttcaatttcttcttaattctcatcatttcttgacacccaagaaactttctaggtttataactcttggcgctgtgagtttatacaggtgtagagaaaaacagcgaaaagaggcgtcacgacttcaagctgtgaataggaagctaacggcaatgaacaagcttttgatggaagagaatgaccgcttgcaaaagcaagtgtctcacttggtttatgagaacagctattttcgccaacatcctcaaaacgtagatagattaatttatttgattcattcacattaattagttgacacataagttaaggaattgaaatagtctgtcgctctcagcaggggaatttggctaccacagatactagctgtgagtcagtggtgacgagtggtcaacaccacttgacccctcaacatcagcctcgtgatgctagtcctgctgggtaagttagaaccaacaattcttggctttaaataacatgacacacttttgagtcagtttttgttctctgccaccatttaaagcttctatatatctttgttaaatcaatgaatctctttgagtgtatctccagattattgtccattgcggatgaaactttaacagagttcatttccaaggcgactggaaccgctgtcgagtgggtccaaatgcctgggatgaaggtaattctcataagtctatctcgtcttcttttatctatgattcaatcattttcacttccttactgactaatttcatctgcagcctggtccggattccataggaatcgttgctatttctcatggatgcacgggaatcgctgctcgtgcttgcggccttgtgggtcttgatcccacaagggtaagtactattctcacttctttctaataggtacatcctcatagatcaaccaagaacataaatcacatttctgttttgtttttttcgcaggtcgcggagatcctaaaggataagccttgttggttgcgtgattgcagatctctggatatagttaacgtactatccactgcaaatggtggaacccttgaactaatctacatgcaggtattgatgatcaagaaccctaaagatgattttatcttcagcacaaaccaaataatcgaatcacacaaaactaaattttcctctctttctttctcatgaaagctttatgcgccgacaacactggcaccagctcgtgacttctggatgctacgttacacatctgtaatggaagacgggagccttgtggtaattatcctcttaacatcgatgctttgtttctcttttgatcattcgatgatactaatttaagatgttattgcagatatgcgaacgatcactgaacaatacacaaaacgggccaagtatgcctccgtctcctcatttcgttagggcagagattttaccaagtggttacctcattagaccttgcgaaggaggtggatccattcttcacattgtcgatcatttcgatcttgaggtagcctcacaagttttatcatttttttcttcttacacaagaaacctaattcttggtctaaaactgaagtgtttcctctgttttcacaattcgttctttatctctagtcattattatatactttttggtgccaatgatatatattcaaataacctggttgaaatcgtttgtagccatggagtgtgccagaagttcttcgttctctctatgagtcctccactttactcgcccaaagaactacaatggccgtaagattcctaattaaagacacattgtttttcatgtatttgaaaagaaaaaaactgtgtgtaaataacttatggtgtttgcaggctctgcgctatttgaggcaaatatctcaagagatttcacaacctaacgtaacaggttggggaagaagaccagcggctcttagagcacttagccaaaggcttagcaagtaattagagcttctcacacttcaaaaacacttttaaaaaaacattacgtcttctaaaacctaaaattgtttttgttaatgtcagaggattcaacgaagcagtgaatgggttcagcgatgaaggatggtccatcctagagagtgatggtatcgatgatgtcactcttcttgtgaactcctctcccacaaagatgatgatgacttcaagtctcccatttgccaatggctacacttctatgcctagcgcggtcttatgtgccaaagcttccatgttattacaagtaattaagctcatcaaatctcaaagtgagattctcaatttactccctttcatccatcactaatattatttttgtttgtgtagaatgttccaccttcgattctgctgcggttcttgagggaacatagacaagaatgggcagacaatagcatcgatgcatattcggccgcagccatcaaagcaggcccttgtagcttaccaatccctcgcccagggagctttggtggtcaagtcattcttcctctagctcacactatagagaatgaagaggcaagtactctactaagagattctcaaagtcaaatcaatgtaactacgtttttgaataaactaagtaaactaatgcccttttatgtcctctgttttccagtttatggaagtcattaagcttgagagcttggggcactaccaagaagacatgatgatgcctgctgatatcttccttctgcaagtaagacctaattttcatttgtgccaacatgtgaaaaataaatagaacaattttttgacatctgttttgaaatgtgtttaaaatcgcaaagattgtgtggtctcatttgaaaaacacacacacatttctaaaggcaaacaccaattcaagattatatctattttgataatttttgctcattgatagactctatagcgagacgttattagtcttgttgcaactactcaattttatgattctaatatatataattttgtactgtttgatgatatagatgtgcagtggggtggatgagaacgcagttgaatcatgcgcagagcttatatttgcaccaatcgacgcatctttctctgatgatgcaccaatcattccttccggtttccgcatcattcctctagattccaaatcagtacgttcaattcatataacaatcaaaatcattaactttagttgaatcaaatactaatttataaatcgaattatgtataggaggggttgagtcctaaccgaacgctagacctagcgtcggctctagacgtagggagcagaacagccggagattcatgtggaagcagaggaaactcaaagtccgttatgactatagcgtttcagctagcttttgagatgcatatgcaagagaatgtagcctcaatggctagacagtatgtaagaagtgtgatcgcgtcggttcaacgggtcgcacttgctctctctccttcttctcatcagctaagtggcttgcgtcctccacccgcgtcacccgaagctcacactctcgctcgctggatctctcactcttatagatgttaccttggcgttgatcttctcaaacctcatggaactgatcttctcaagtctctttggcaccatcctgacgctgtcatgtgttgctcactcaaggtaattttcttacttctactcactcaagaacatcgattatgctcatacataatctataacaaggaaagtgaactggttttgatcatttcaggccttatctccggtattcacatttgcgaaccaagctggtttagacatgctggagacgacgttggtggcacttcaagatatcactctcgacaagatcttcgacaacaacaacgggaagaagactttatcctccgaattccctcagatcatgcaacaggtacgttaaaccgagtcatgcatttagttagcttaagttagaaaaaaagaaaagaaattgtgtaacggtattgatgaaatcataaatactaattagcaataataaatgtgaaggggtttatgtgtatggatggaggaatatgcatgtcgagcatgggaagagcagtaacgtacgagaaggctgttgggtggaaagtgttgaacgacgacgaagatcctcattgtatctgcttcatgttcctcaactggtcttttatatgaccttttttccatgtttttccttaattatcaaaacacagacctttttttccggagatatatttatatatactcttactcttagttaatttgtatttagttatatcatctctaattttgaaagaatttacttacttttatggtctttgcaacactctagtctctagtttgtgttagcc

SEQ ID NO: 4797 - DNA, 822 bp, Artificial Sequence; identical to SEQ ID NO: 243
  P9146 (opLexA::G1527, G1527 is from A. thaliana)

SEQ ID NO: 4798 - DNA, 1312 bp, Artificial Sequence
  P9147 (opLexA::G1517, G1517 is from A. thaliana)
cgaagcttctcctgcttatttgatacatattctctcttccagttactctacatggaaccattcgttgttaaggagaacatcgtcgcatccgcttcttcgccgatgaagaagcgacggatcgatcacactgagtcagctgatggttctgcgattaacgcttctaactctagtagcatcggtggtaacgatacggtgatgaacatggcggagtttggtaacgacaactccaacaatcaggagtctcaacaagtttgcactttcttcaagaagccaacgaaaagtaaaaacataaggaaaagaaccattgacgctgatgaagaagacggagattcgaaaagcgaaagctctattttacaaaatctaaagaaagttgcaaaacccgatagcaacttgtacttttcttctggaccatctactagaacgagtggagctcctgagagacccgtttttcactacgattcatccaaggaaatccaggttcagaacgacagtggagcaacagcgacccttgaaactgaaaccgacttcaatcaagacgctcgagctatccgtgaaagagttcttaaaaaagcagaccatgcattgaaggggaataagaaaaaggcttcagatgagaagctgtacaaaggaattcatggatatacagatcacaaagctgggtttagaagagaacaaacaatctcgagcgagaaagctggaggctcacacgggcctttaagagcttctgctcacatcagagtatcggctagattcgattaccagccagacatttgcaaggattacaaggaaaccggatactgtggatatggagattcgtgtaagttcttgcatgaccgtggggattacaagccgggatggcagatagagaaagagtgggaagaggcagagaaagttaggaagagaaataaagctatgggagttgaggatgacgatgatgaggctgacaaggatagcgacgaagacgaaaatgcattgccctttgcttgcttcatttgcagggagccttttcttgatccagttgtcaccaaatgcaagcattacttctgtgagcattgtgctttaaagcatcacacgaagaacaagaaatgctttgtgtgtaaccaaccaacaatggggattttcaatgcagcacatgagatcaagaagagaatggctgaagaacggagtaaagctgaacaaggattgtgaagtccttctttcacaggacaaaaaggcaaaaactatacatttgattatttgcttgaggaaagctttttgttttgttgtactcactggcctatatactgtatattcggatgacgatggttgtttc

SEQ ID NO: 4799 - DNA, 751 bp, Artificial Sequence
  P9152 (opLexA::G154, G154 is from A. thaliana)
tatcaaacccttttagccaatcgggaaattaactaaagaagaagatatggtgaggggcaaaactcagatgaagagaatagagaatgcaacaagcagacaagtgactttctccaaaagaaggaatggtttgttgaagaaagcctttgagctctcagtgctttgtgatgctgaagtttctcttatcatcttctctcctaaaggcaaactttatgaattcgccagctccaatatgcaagataccatagatcgttatctgaggcatactaaggatcgagtcagcaccaaaccggtttctgaagaaaatatgcagcatttgaaatatgaagcagcaaacatgatgaagaaaattgaacaactcgaagcttctaaacgtaaactcttgggagaaggcataggaacatgctcaatcgaggagctgcaacagattgagcaacagcttgagaaaagtgtcaaatgtattcgagcaagaaagactcaagtgtttaaggaacaaattgagcagctcaagcaaaaggagaaagctctagctgcagaaaacgagaagctctctgaaaagtggggatctcatgaaagcgaagtttggtcaaataagaatcaagaaagtactggaagaggtgatgaagagagtagcccaagttctgaagtagagacgcaattgttcattgggttaccttgttcttcaagaaagtgatctccactcaacaaaaaaaacaaaaaaacaaactaagtaaaaacaggtttagcagtactg

SEQ ID NO: 4800 - DNA, 699 bp, Artificial Sequence
  P9153 (opLexA::G1758, G1758 is from A. thaliana)
ccctcctcttagcttcaaccgccggaaaaactaaacaaccttcttggaaaaaaagagaaactaaaaatgaactatccttcaaaccctaaccctagctccacagatttcactgaatttttcaagttcgatgattttgacgatacttttgagaagatcatggaagaaatcggccgtgaggaccactcgtcgtcaccgactttgagttggagttcatcggaaaagttagtggctgcagaaatcacaagcccgcttcaaacaagcctagctacctcacctatgagctttgaaataggtgacaaagatgaaatcaaaaagaggaagagacacaaagaagatccgattattcacgtcttcaaaacgaaatcatcaattgatgaaaaggttgctttagatgatgggtataaatggaggaaatacggaaagaagccgataacgggtagtccatttccaaggcattatcacaagtgttcgagcccagattgcaacgtgaagaagaagatcgaaagagatacgaacaatccagattacatattgacaacatacgaaggtagacataaccacccaagcccttctgtagtttattgtgattcagacgactttgatcttaactctctcaacaattggtcctttcagacggcaaatacgtatagtttctctcattctgctccatattgatcgatcgtagttacaagtttgtgt

SEQ ID NO: 4801 - DNA, 1177 bp, Artificial Sequence
  P9162 (opLexA::G2343, G2343 is from A. thaliana)
taagttactatgaggagctactaatcatgggtcatcactcatgctgcaaccagcaaaaggtgaagagagggctttggtcaccggaagaagatgagaagcttattagatatatcacaactcatggctatggatgttggagtgaagtccctgaaaaagcagggcttcaaagatgtggaaaaagttgtagattgcgatggataaactatcttcgacctgatatcaggagaggaaggttctctccagaagaagagaaattgatcataagccttcatggagttgtgggaaacaggtgggctcatatagctagtcatttaccgggaagaacagataacgagattaaaaactattggaattcatggattaagaaaaagatacgaaaaccgcaccatcattacagtcgtcatcaaccgtcagtaactactgtgacattgaatgcggacactacatcgattgccactaccatcgaggcctctaccaccacaacatcgactatcgataacttacattttgacggtttcactgattctcctaaccaattaaatttcaccaatgatcaagaaactaatataaagattcaagaaacttttttctcccataaacctcctctcttcatggtagacacaacacttcctatcctagaaggaatgttctctgaaaacatcatcacaaacaataacaagaacaatgatcatgatgacacgcaaagaggaggaagagaaaatgtttgtgaacaagcatttctaacaactaacacggaagaatgggatatgaatcttcgtcagcaagagccgtttcaagttcctacactggcgtcacatgtgttcaacaactcttccaattcaaatattgacacggttataagttataatctaccggcgctaatagagggaaatgtcgataacatcgtccataatgaaaacagcaatgtccaagatggagaaatggcgtccacattcgaatgtttaaagaggcaagaactaagctatgatcaatgggacgattcacaacaatgctctaactttttcttttgggacaaccttaatataaacgtggaaggttcatctcttgttggaaaccaagacccatcaatgaatttgggatcatctgccttatcttcttctttcccttcttcgttttaaattaatgtttaaatcacagcaaataaactccgctaatt

SEQ ID NO: 4802 - DNA, 866 bp, Artificial Sequence
  P9164 (opLexA::G2422, G2422 is from A. thaliana)
ttgtgaaggcttcacacatgccatatatataaattttataaaatttgtgagataattttctattatctttgctccatgggcgaatcacccaaagggttgagaaaaggtacatggactactgaagaagatattctcttgaggcaatgcattgataagtatggagaaggcaaatggcatcgagttcctttaagaactggtctcaatcggtgccgaaagagttgtagacttagatggttgaattatttgaagccaagtattaagagaggaaaactctgctccgatgaagttgatcttgttcttcgccttcataaacttctaggaaataggtggtccttgatcgctggtagattgcctggtcggactgctaatgatgtcaagaattactggaacactcatttgagtaagaagcacgatgaacgatgctgtaagacgaagatgataaacaaaaacattacttctcatcctacttcatcggcccaaaaaatcgatgttttaaagcctcggcctcgatccttctccgataaaaatagttgcaacgatgtcaatatcttgccaaaagttgacgttgttcctttacatcttggactcaacaacaattatgtttgtgaaagtagtattacatgtaacaaagatgagcaaaaagataagcttattaatattaatctattggatggagataatatgtggtgggaaagtttactggaggcagatgtgttgggtccagaagctacggaaacagcaaagggtgtgaccttaccgcttgactttgagcaaatttgggctcggtttgatgaagagactttagaactgaattagtgttgctccccatttttgtttgcacgtgtgtatttatgtttctgtggatg

SEQ ID NO: 4803 - DNA, 1057 bp, Artificial Sequence
  P9167 (opLexA::G1923, G1923 is from A. thaliana)
acttgaatcattagaaggagatacaacaatggagaagatgatagaaccacgggacaacacaagagaatcagaagatgaggatgcgttaaagcttccagggtttaggtttcatccgacggatgaggagcttgtagggtattatctctctaaaaaagtgcttctcaaaaaaacgagcaagattgatgagatcgtcagccaaattgatatctataaatttgatccgtgggatcttccaaggtcgaggaatacagagaaggagagctacttcttttgtaagagaggaaggaaatacagaaacagcataagaccgaaccgagtgactggttccggtttctggaaagccacagggatagacaagcctgtctattccgatggatccaacaaagccgtgatcggtctaaagaagacactcgtttattacctaggaagcgccgggaaaggaaacaagacggattggatgatgcacgagtttcgtctccctacagccaatgacacaatccccggtggccctacacactctaaccctactccaacttccttgctacacgcggaagtatggacgttatgccggatatttaagagaactgtgtctagtcgaaaatacactccggactggagagaattagcaaatggcaaacgtgtgaagcagcaacaatctaattaccaagaagcttatataaattttggggacaatgaaagtagtagtagtaccaacgtgatgaacgttagggaaggcaaagggaactacgagagaagcgttttccagcttcagcaaacgccttatcaacatcaaaaccagccaattctcatggacaccacacacgttgattcgtttcaacatttctccaacgataacattcaccatgaaacctacgagacttggccggacgagcttcgatcggttgtggaatttgctttcccaccttcttttcttagttagatctctagaataattaacaactaatatgtatacatattacatattactagcttggacgtgttgtatcatcagatctctactgtatacatggatcgtgtgtatatgaatatgcacctg

SEQ ID NO: 4804 - DNA, 750 bp, Artificial Sequence
  P9174 (opLexA::G2582, G2582 is from A. thaliana)
gaaaaaagtacgagctgcatggatccgtgacgataggatgaggagggcaagcctcaagaggaggttaacggggcttatcaaaaaagtgaatgaactgtccattctgtgcgatatgcgcgctagtgtggtcgttttcaatcgagaagaagaacaattgacggcgtggccatctcccgaggcagctaattcactcatcgacaacttttattctctaaccgaccatgaaaggaccatgaaggccgttgatccggagtcatacgtccagaccgttatcgaaaagattgagaagaaacgagccgatactcggaaggttatcacggagtttgagatggacgaactcatgttccaagtccaaaatggtcgtgaacttgctgatctctccccaaccgaggctgataaactaataccatatgcggataagaaacttatgtggttgagtaaacggatgggttctacgggggtcgacgccctgagggcttcgaatgttgcgtctgggtcaggtggaaatgggttaaacatgatggaaactggaagaagtttctattatgttgataaatgggtcttcgttgatccacaagtccaaaacccttgtgatgttgagactcatttacccacaatggtcagtggcttagacctaaacatggaaccatctgatgaagacttggggacctataaaggagagagcagcatggccggtggtgctgaagacgatgccgaatgaagctgccgtcaaagttgacatgacaactt

SEQ ID NO: 4805 - DNA, 1319 bp, Artificial Sequence
  P9176 (opLexA::G2656, G2656 is from A. thaliana)
tacaactcttctgatgttgactttgtacggtcaagaaaggtcaccggagaactccaccacaagtacgaccgatgcttccgatcgccgggatgagacgccgtcgtcggagatagtcgtgagagatattcacgcgatgacgacgacgacagagcttactcggccacaacaaaggggatcaggaggaggatacttgtctccgtcgaggtctattgcttttagcgacggaactacttcttccggtgagaatttcaccaccgtgagcagagagttcaacgctctagtcatcgccggatcttccatggacaacaacagtaacggaactaaccaatcaggtggtcatcgtgacgtcatacgtgatgaaagaaacgagctgactaggatcggcgaaaacgatgacgttggtgatcatggtcaggtgcctgaggaggattcaaatccatgggcgattgtaccggacgattacaacaaccgggacggttcagagaataatattgtgttggcgtcatcaggtggtcagaaccggatggtgacgactgcttcggtgcagagggtgaagagagaagaggtggaagcaaagataacggcgtggcaaacggcgaaggtggctaagattaataataggtttaagagacaagacgccgttattaacggttggttgaatgagcaggttcatagagctaactcttggatgaagaaaatcgaggtgactcatttttttctattttacgaatatcttagttagatccgatcgattaagagaacaagatgacttataacatgcttttcttgaaactgtttgcttttacatgtataacaaaataatttagaaaaactatgtaacgttttcaaattgcaaacgataaacgtggacaagcgttttttacaaattataaaatgcatattttatccaaccaaaaaaaaaaaatcaaaatgtaagaattatgggtttatttgaaaaaaaagcagaaacacaaataaacgatagatccttgaatggtggtgatatatcaaatatttgaaatgtgataaagctatccaaaagactgactaaatagacgtcgatgttgtctttggaataatagattatgcgattgatacatatatgtggatgcagaggaaactggaagataggagagcgaaggcgatggagaaaacacaaaacaaagtggcaaaagctcagaggaaggcggaggagaggagagccacggcggaaggtaaacgagggacggaggttgcgagggttcttgaagttgctaatctcatgagagccgttggacgacctccggccaaacgatcattcttctctctttcctagctaa

SEQ ID NO: 4806 - DNA, 772 bp, Artificial Sequence
  P9177 (opLexA::G2661, G2661 is from A. thaliana)
catatcatgtaacagttataaaccacgacaatcacaatggatgatttcaatcttcgtagcgaaaaccctaattcatcatccaccacttcctcatcctcttcctctttccaccgtcacaagagcgaaaccggaaacacaaaacggtcaaggtcaacgtccacgttatcgacggaccctcagagcgtggcggctcgcgacagacggcaccgaattagcgaccgtttcaagattttacaaagcatggtccctggtggtgcgaagatggacactgtatctatgcttgacgaagccattagctacgtcaagttcttgaaggctcagatctggtatcaccaaaacatgcttctcttcataaacgaccacgaaactacatcatcttgtacttactctcccggcgctggagaatttggaccgaaactctttggttatgatgacgattatgcccctataatggacacatattcacaaggcgtgccacttacggttgcggactcgaagtatacgccgtggtttggttcggttgatgatgagcaagaacgtgactcgtcctagtcgttgccatatatgcaacattatgtgatttacatatccagaatctaccgtcttccttattctcgcaatacttagtaactatagtttaaggattatattatatgcgtctactatatatatctgagtgtatctaatttagagattgtaatatacatgagtatgagactaattaacctatagtatttgtattgacgtatggataatcacttggaaacacgaa

SEQ ID NO: 4807 - DNA, 1082 bp, Artificial Sequence
  P9179 (opLexA::G2931, G2931 is from A. thaliana)
ggcatgaattttccagattcttcattgttcacaccaaattttgcttatgaaaatgatttagatttctctagtttgatcactccttcaacgcgtgtatcattccaagaacctaaaccatgtaatccagtcattcatagtgcagggattgagaacgatggaagacaaaactgtgagacgaccatgacattaagcgaaatcatgaaaggagacgatgagccgaagaacaagagagctaaacataaagagcttgagagacaaagaaggcaagaaaacacatctctattcaagattctaagatatttattgccatctcaatacataaaggtaagtaacattttcaaatttttcttatacaaattctgtctcatctcatgaagtcaaaaaatttctatagattatatagaagatccccttagtctaatcacggtaattaattaacaattgtgtaaatagggtaaacgttcctcggcagatcacgttctagaagcagtgaattacatcaaagacttacagaagaagatcaaagaggtcagcgaaaaaagagatagaatcaagagatctattactcatccatcatcaagaggagaattttcaataagatcattagcatcatcaacttgttcttgtgttggagacacgaacattgctgttgtggttaggccttgtttgatcggactagagatcgtagtaagttgttgtaacagacacgaatcttgtctatcaagtgttcttcaactcctggctcaagagcaatgctttaatattgttagttgcatctcaactagactacaccaaggattcatacacaccattgcttctgaggtaattatctataatctatcttcgatctgatttatgaagaaagagggagttaatctttatattttatgtgatgagagataaatattaatattttgggaaatttcttaaacttgtgtaggtcgaggagggaatagaggtttatttctcagagcttcaagaaaagataatcaaaattggaacctcaagagtcactactcgctagtcagagtttattaaacctaaaaattttatgaatttacgtcctaattaagatatatatc

SEQ ID NO: 4808 - DNA, 1055 bp, Artificial Sequence
  P9180 (opLexA::G2936, G2936 is from A. thaliana)
ctagctatatattcttctcacacataacataagtggacaaaaaaaatgtgtaccttaacgccaatgtttccaagtaagcagcaagaatggtactctgcttcaacaatggagtatccatggctgcagtctcaagttcattccttttcacctactctccattttccttccttccttcatcctttagatgattccaagagccataacatcaatcttcatcatatgagtcttagtcacagcaataatactaacagtaacaataacaattatcaagaagaagatcgaggagcggtggttttggagaagaaactgaatcacaacgcaagcgaacgagaccgccgtagaaaacttaacgccttgtactcttcacttcgtgctctcttgcctctttctgatcaaaaggtttgtgcttttaaacctaatctaaaatatcggatcaagattaggttttgtaatcttgaaatggatatatgaatactaaagaaacccttttgatctgcagaggaagctgagcattcctatgacggtagcgagagtagtgaaatacataccagagcagaagcaagaacttcaacgtttgtctcggagaaaagaagagctcttgaagaggatctcgagaaaaactcaccaagagcagctgagaaacaaagcaatgatggactcaatagattcttcttcctctcaacggatcgcagcaaattggctcactgacacagagattgctgtccagattgctacgtcgaaatggacatctgtttcagacatgttgcttaggttagaagaaaacgggcttaatgtcataagcgtctcttcttccgtttcttccaccgcaaggatcttctacactctacatcttcaggtacttgtctaaagatatcagaaggtcatgttcttcttacatggaactcattaagagaaactaaaatctattgttttattcttctttttgtgcagatgagaggagattgcaaagtgagactggaggaactcatcaatggtatgctcttgggattacgccaatcataatgagcgatatgaagtgtttaaaagagtgaatg

SEQ ID NO: 4809 - DNA, 900 bp, Artificial Sequence
  P9190 (opLexA::G2723, G2723 is from A. thaliana)
gtttccctatatatatctcatatattcccaaaagaatttaaataaaatggcctctagttctatgagctcgagctcttcttggacgtctaagcaaaacaagatgttcgagagggctttagccgtttacgataaagacactcccgaccgttggcaaaacgtggctaaagcagttggaagtaaatctgcagaggaagttaaacgtcactacgacatcctcgttgaagatctcatgaacatcgaacaagacttagtacctttgcctaaatacaaaaccgtcgatgttggaagtaaatctagaggcatcgatgattttgatttgaggtgaaatctttttgtccttaccaaatcttttagagtttgtggtcgtttttgtgatttctatagtgatttagtagaaacatatgtttagttcaaataatttcaaaatctgattatataaatgagttcttttggtagtagtatattaaaactagtgatgaacgttggactatataataataataatataggtataataataagaaacatgcaaccacacgcaccatcccttctatttccggcattctcattaaaaggaaaggagtcacatgaaatctaatcctgtttgtgcaccatcacatgcacattgtcctcaacttttgaatcttatatgaatgatataatgttatatatgtatatatctagctaattctatattattcgaatacgattaaatataacggtatatattaatgcaaaagtgattctgatttttcactggtcggtgatcaacaaaagtggtatcttagtgtcaagttatattaattaatctattgttttttgacaggttaatgaagaatatgagaatccagtgaagttgttacatgatgtgaagattgctatatgtctaaggattcaaag

SEQ ID NO: 4810 - DNA, 1254 bp, Artificial Sequence
  P9194 (opLexA::G3034, G3034 is from A. thaliana)
gcttaaaggtctctttcatggagctgtttcctgctcagcccgatttatccttacaaataagtccaccaaacagtaaaccatcatcgacatggcagagaagaagatcaacaacagatcaagaagatcatgaagaactcgatttagggttttggagaagagctcttgattcaagaacatcttctctcgtctctaattccacctcaaaaacaatcaatcatccattccaagacctctcgctctctaacatctctcatcatcaacaacaacaacaacatcatcatccacaacttctccctaattgcaacagctctaacatcttgacctctttccaatttccgacacagcagcaacaacaacacttacaagggtttcttgctcacgaccttaatactcacttaagaccaataagaggaataccactttaccacaaccctcctccacatcatcatcctcaccgtccgccaccgccatgtttccctttcgacccgtcgtctctaataccctcttcctccacttcctcgccggctctaaccggaaacaacaatagctttaatactagtagcgttagtaaccctaattaccacaatcatcatcaccagactctaaacagagccagattcatgccaagattcccagctaaacgaagcatgagagctcctaggatgcgatggaccaccactcttcatgcccggttcgttcacgccgttgaattactcggtggccatgaaagagcaacacctaaatcagttcttgagctcatggatgtcaaagatctaaccttggctcatgttaagtcccatttacagatgtacagaacagtgaagacaaccgacaaagcagcagcttcgtcaggacaatctgatgtctatgaaaatggatcatcaggagataataactcagacgactggatgttcgatatgaatagaaaatcgagagatagcgaggaattgacgaatcctctagagaaatcaaatggtctatggaccaattcttccggagaagcacgtttgcatgggaagttaatcgataatgttgcagaaattatgctaccttctgagaaggaactagatggaaagtgctcaagttatgagagaatatcatcagaagagatgagctcatcaagcatctcgggaacaagccctttcaagccaaatcttgagtttactctgggtcgatctcactaaatttattgttgtagctaggtagtaattaattagtatcaattaacttatattttggctactgactagtttc

SEQ ID NO: 4811 - DNA, 1663 bp, Artificial Sequence
  P9195 (opLexA::G309, G309 is from A. thaliana)
cttcaattattatgacactcccgtgttcctaatcttttctcttattcttctctttcttctcatcttacaaaatcttgcaaatcaattttaatgaagagagagcacaaccaccgtgaatcatccgccggagaaggtgggagttcatcaatgacgacggtgattaaagaagaagctgccggagttgacgagcttttggttgttttaggttacaaagttcgatcatccgacatggctgacgtggcacacaagcttgaacagttagagatggttcttggtgatggaatctcgaatctttctgatgaaactgttcattacaatccttctgatctctctggttgggtcgaaagcatgctctcggatcttgacccgacccggattcaagaaaagcctgactcagagtacgatcttagagctattcctggctctgcagtgtatccacgtgacgagcacgtgactcgtcggagcaagaggacgagaattgaatcggagttatcctctacgcgctctgtggtggttttggattctcaagaaactggagtgcgtttagtccacgcgctattagcttgtgctgaagctgttcaacagaacaatttgaagttagccgacgcgctcgtgaagcacgtggggttactcgcgtcctctcaagctggtgctatgaggaaagtcgcgacttacttcgctgaagggcttgcgagaaggatttaccgtatttaccctcgagacgatgtcgcgttgtcttcgttttcggacactcttcagattcatttctatgagtcttgtccgtatctcaagtttgcgcattttacggcgaatcaagcgatacttgaggtttttgctacggcggagaaggttcatgttattgatttaggacttaaccatggtttacaatggccggctttgattcaagctcttgctttacgtcctaatggtccaccggattttcggttaaccgggatcggttattcgttaaccgatattcaagaagttggttggaaacttggtcagcttgcgagtactattggtgtcaatttcgaattcaagagcattgctttaaacaatttgtctgatcttaaaccggaaatgctagacattagacccggtttagaatcagtggcggttaactcggtcttcgagcttcatcgcctcttagctcatcccggttccatcgataagtttttatcgacaatcaaatcaatccgaccggatataatgactgtggtcgagcaagaagcaaaccataacggtaccgtatttctcgatcggttcacggaatcgctacattactattcgagcttattcgactcgctcgagggcccgccaagccaagaccgagtgatgtcggagttattcctaggacggcagatactaaaccttgtggcatgcgaaggagaagaccgggtagagaggcatgagactttaaatcagtggagaaaccggttcggtttaggaggatttaaaccggttagtatcggttcgaacgcgtataagcaagcaagcatgttgttggcactttatgccggggctgatgggtataatgtggaagagaatgaaggttgtttgttgcttggatggcaaacgcgaccgcttattgcaacatctgcgtggcgaatcaatcgtgtggaataaaaataaataatgggaaaagtgaaaatgtgctatatac

SEQ ID NO: 4812 - DNA, 2632 bp, Artificial Sequence
  P9218 (opLexA::G15, G15 is from A. thaliana)
ggtgtgttcgttgtgtaaccaatgattgggttttagcttactacttcgagagattataagaaagaaagagtgaagatacattatagaaagaagagaagcagaaaccaaaaaaagaaaccatgaagtctttttgtgataatgatgataataatcatagcaacacgactaatttgttagggttctcattgtcttcaaatatgatgaaaatgggaggtagaggaggtagagaagctatttactcatcttcaacttcttcagctgcaacttcttcttcttctgttccacctcaacttgttgttggtgacaacactagcaactttggtgtttgctatggatctaacccaaatggaggaatctattctcacatgtctgtgatgccactcagatctgatggttctctttgcttaatggaagctctcaacagatcttctcactcgaatcaccatcaaggtcagtagtagtaatgttggagtttttagttttcttggtgttgatgttgttgtgtcttgtttgatgggaacatgtttggttttagggatttatgttttattttttatactaaggacattttctgttttttttggttgttatttagattcatctccaaaggtggaggatttctttgggacccatcacaacaacacaagtcacaaagaagccatggatcttagcttagatagtttattctacaacaccactcatgagcccaacacgactacaaactttcaagagttctttagcttccctcaaaccagaaaccatgaggaagaaactagaaattacgggaatgaccctagtttgacacatggagggtcttttaatgtaggggtatatggggaatttcaacagtcactgagcttatccatgagccctgggtcacaatctagctgcatcactggctctcaccaccaccaacaaaaccaaaaccaaaaccaccaaagccaaaaccaccagcagatctctgaagctcttgtggagacaagcgttgggtttgagacgacgacaatggcggctgcgaagaagaagaggggacaagaggatgttgtagttgttggtcagaaacagattgttcatagaaaatctatcgatacttttggacaacgaacttctcaataccgaggcgttacaaggttgtttttttattttataatattaaactttgtttgactttcgttagtaatgttacatatacttacttaaaaggttatgtgaaacagacatagatggactggtagatatgaagctcatctatgggacaatagtttcaagaaggaaggtcacagtagaaaaggaagacaaggtctagtgcttttttatttaattatcattaagctaaacatagaaactttttaagtagtttatgatttaacgtattactgacatttgagttttattttcttgttttctctatgtgtgataatgatttgatgatcttcttctcagtttatctgggtaagtacacacttcaatcttcatggattcatgatttccccctcaaatttctcgggaaaataatgatggattttgacttctttatttttgtttgattaaatctttattaggaggttatgatatggaggagaaagctgctcgagcatatgatcttgctgcactcaagtactggggtccctctactcacaccaatttctctgtaaatcatcttttctaaactttatgtctctttgaccttgttgtatgatttatttatataatatgataatggatatttgaaggcggagaattatcagaaagagattgaagacatgaagaacatgactagacaagaatatgttgcacatttgagaaggaagagcagtggtttctctaggggtgcttccatctatagaggagtcacaaggtccttttaaattacatttatataactttatataatacatagtttaataatgtgaatattgactttgtgtgagttttttgtactagacatcaccagcatggaaggtggcaagcacggattggtagagtcgctggaaacaaagatctctaccttggaacttttggtaattcatcatgccgatgattttgattgttaaaacttaacattttcaattgcttgtgtcttacgaaatcttttgacactatcataggaacccaagaagaagctgcagaagcttacgatgtagcagcaattaagttccgtggcacaaatgctgtgactaactttgatatcacgaggtacgatgttgatcgtatcatgtctagtaacacactcttgtctggagagttagcgcgaaggaacaacaacagcattgtcgtcaggaatactgaagaccaaaccgctctaaatgctgttgtggaaggtggttccaacaaagaagtcagtactcccgagagactcttgagttttccggcgattttcgcgttgcctcaagttaatcaaaagatgttcggatcaaatatgggcggaaatatgagtccttggacatcaaaccctaatgctgagcttaagaccgtcgctcttactttgcctcagatgccggttttcgctgcttgggctgattcttgatcaacttcaatgactaactctggttttcttggtttagttgctaagtgttttggtttatctccggttttatccggtttgaactacaattcggtttagtttcgtcgg

SEQ ID NO: 4813 - DNA, 1917 bp, Artificial Sequence; identical to SEQ ID NO: 875
  P9228 (opLexA::G2891, G2891 is from A. thaliana)

SEQ ID NO: 4814 - DNA, 1209 bp, Artificial Sequence
  P9243 (opLexA::G2640, G2640 is from A. thaliana)
gttatgggtggtggttgttgtcttggtgaatggcggggtttttctcgctagacggtggtggaggaggaggcggaggtggaggtaacaaccaagaagatcaccggagcaacacaaatcctcctccgcctgtatcagaagcttggctctggtatagaaaccctaacgttaacgcaaacgcaaacacaaacgttaacgcaaacgctccttcttcgtcaaacgctgctttaggaacacttgagttatggcaaaaccacaatcagcaagagatcatgtttcagcatcagcaacatcagcaaaggttggatctttactcttccgccgcaggtttaggtgttggaccaagtaatcataaccaattcgatatctccggcgaaacttcaaccgccggcgccggaagagctgcggcgatgatgatgattcgtagtggtggtagcggaggaggaagtggtggtgtgagctgtcaagactgtgggaatcaagcgaagaaagattgttctcacatgaggtgtagaacttgttgtaaaagccgtggcttcgagtgttctactcacgtgagaagcacgtgggtccctgctgctaaacgccgtgagagacaacagcaattagctacggtccagcctcaaactcagctgcctcgcggtgagagcgttcctaaacgccaccgtgaaaatttaccggcaacttcatcgtctcttgtctgcactcgcataccttctcattcagggctagaagttggcaatttcccggcggaggtgagttcatcggcggtgtttaggtgcgtgcgtgtgagctcagtagaagatggagaagaagagtttgcttaccaaacagctgtaagcattggtggtcacattttcaaaggcattttatacgacctcggtcctggaagtagtggtggcggaggctacaacgttgttgccgccggtgagagctcctctggtggtggtggagctcaacagctgaatctcataacagctggctctgtaaccgttgctaccgcttcttcctctactccaaacctcggtggtattggcagctcatcagccgcggcagccacgtacattgatccagccgctctttatccaactccgatcaatacattcatggccggtacacaattctttcccaacccaagatcatgaggaaaatctgacataaaagcaacataactcttttgaattcttagaatagaattagggtttataaacg

SEQ ID NO: 4815 - DNA, 912 bp, Artificial Sequence
  P9248 (opLexA::G653, G653 is from A. thaliana)
tcttcatcttcatcttcacgcagcgacttctttgattctctctttttattctcagctccaatttcaacctgcatttctctcttctcaattttgggtttctttttttgatatctcatttgatcagatcgacgaagagaggaagaaggtttgagctgagagatctttggaggtagaaagaagatctcaaaaacgatgtcgtttacaggaactcagcagaaatgcagggcgtgcgagaagacagtgtaccctgtggagcttctctcagctgatggaatctcttatcacaaggcttgcttcaaatgctctcactgcaaaagcagacttcaactgagcaattattcatcaatggaaggagtggtgtattgtaggcctcattttgagcagcttttcaaggagtctggtagtttcagcaagaactttcagtcacctgcaaagccattgactgataagccaaccccggagctgaataggacacctagtcgacttgctggtatgttctctggaacgcaagacaaatgcgctacttgcactaaaaccgtgtatcctatcgaaaaggtaactgtggaaagccagtgttaccataaatcttgcttcaagtgttctcatggaggctgtccgatatctccatcgaactatgcagctctagagggaatattgtactgcaagcaccatttcgctcagcttttcaaggagaaaggaagttacaatcatctcatcaaatctgcttccatcaaacgtgctactgctgctgctaccgcagctgctgcagctgtagcagccgttcccgaatcttgaattcaaattctctttatttttgtgtatgtgctgtgttgtttacatgtattcgatatgattcatgttctttgtcttccataattgaaccaggcataaaattctcccagttttctctga

SEQ ID NO: 4816 - DNA, 1612 bp, Artificial Sequence
  P9251 (opLexA::G20, G20 is from A. thaliana)
tttacttctactgtatcaagaagctccgttttgcttagccatagtgcgtctagggtttggttggtgggaagaaggttccgatcatggcgtcggtgtcgtcgtcggatcaaggacctaagacagaagcaggatgtagcggcggaggaggaggagagagctcggagacagtggcggcgagtgatcagatgttgttgtatagaggttttaagaaggcgaagaaggagagaggttgtacagctaaggagcgtattagtaaaatgcctccgtgcactgctgggaaaaggagttccatataccggggagtcaccagacatagatggacaggtcgttatgaagctcacctttgggataagagtacctggaaccaaaaccagaacaagaagggaaaacaagtttatctaggagcatatgatgatgaagaggctgctgctagagcttacgaccttgctgccttaaaatattggggtcctgggacacttataaattttccggtgactgattataccagggatttagaagaaatgcaaaatctctcaagggaagaataccttgcatctttacgtagatatccctttggcagaaaaagcagcggtttctctaggggaatagcgaaatatcgtggacttcaaagccgatgggacgcatcagccagtcgtatgcctggacctgaatacttcagtaacattcattacggggcaggtgatgatcgtggaacagaaggtgactttctaggtagcttttgtctggaaagaaagattgatctaacaggatacataaagtggtggggagccaacaagaaccgtcaaccagaatcttcatcaaaagcatcagaggatgcaaacgtcgaagatgctggtactgagcttaaaacactggaacacacatcccatgcaacagaaccatacaaggcgccaaaccttggcgtcctttgtggaactcagagaaaagaaaaagaaatatcatcaccatcaagctcttctgctttaagcatcttgtctcagtcgcctgccttcaagagcctagaggagaaagtgttgaagatccaagaaagctgcaataatgaaaacgatgagaatgcaaaccgtaacatcatcaatatggagaagaataacggcaaggcaatagagaaaccagttgtgagtcatggagttgctttaggcggtgctgctgctttgtctcttcagaaaagcatgtacccacttacctctctcttaacggctccattgctcaccaactacaatacattggatcctcttgcagaccctattctctggacaccatttcttccttcaggatcctctcttacttcagaggtgacaaagacagagaccagctgttccacgtacagctacctcccacaagagaaatgagccgttccctttagactttatgtatgtcagattctccttttttgagatgaattcgtcgacttgacatctctttgtctcttttatggagaaaaagttgggaaaagtgtgacaatggtctgaagcaggaatgtacaggttttgttagtggttgtgtttttttttttccagtgtggaatatagaatcatgatattttgtgtaaaacagaaaaaagttatcattatagtatagaagtttgctctta

SEQ ID NO: 4817 - DNA, 822 bp, Artificial Sequence
  P9254 (opLexA::G787, G787 is from A. thaliana)
aagctcacagttcgagagagacaagagaccaacgaaacgaactagagacagtttgattcgaaaatcttgtcggaaaatggaggatatcgtcgaccaagaattaagcaattactgggaacctagctccttcctccaaaacgaagacttcgaatacgacagaagctggcctttggaagaagccatttctgggtcgtatgattcgagttcgccggatggagctgcttcgtcgccggcttctaagaatattgtgtcggagagaaacagaagacagaaacttaaccagagactcttcgctcttcgatcagttgttcccaatatcactaagatggataaagcctcaataatcaaagatgctattagttacatagaaggattacaatatgaagaaaagaagctcgaagctgagatcagagaacttgaatctacaccaaagagtagccttagtttcagcaaagattttgatcgtgatttacttgttcctgtcacatccaagaagatgaagcagcttgattctggttcttccacttctctcatcgaagttctcgaattgaaggtaacattcatgggagagaggacaatggtggtgagtgtaacatgtaataagaggacagatacaatggtgaaactgtgtgaagtctttgagtcattgaatctcaaaatcctcacttccaatctcacctctttctctggcatgatcttccacactgtctttattgaggcggatgaagaagaacaagaggtgttgcggttaaaaatagaaacaggaataggagcttataatgaaactcaaagccctactttgagcatcgactctctttacta

SEQ ID NO: 4818 - DNA, 998 bp, Artificial Sequence
  P9257 (opLexA::G1352, G1352 is from A. thaliana)
cgcgattaaaaactctcaacttttctctcaaatttctgatcctttgatccaacagttagaagaagattcatctgatcatggccctcgaagcgatgaacactccaacttcttctttcaccagaatcgaaacgaaagaagatttgatgaacgacgccgttttcattgagccgtggcttaaacgcaaacgctccaaacgtcagcgttctcacagcccttcttcgtcttcttcctcaccgcctcgatctcgacccaaatcccagaatcaagatcttacggaagaagagtatctcgctctttgtctcctcatgctcgctaaagatcaaccgtcgcaaacgcgatttcatcaacagtcgcaatcgttaacgccgccgccagaatcaaagaaccttccgtacaagtgtaacgtctgtgaaaaagcgtttccttcctatcaggctttaggcggtcacaaagcaagtcaccgaatcaaaccaccaaccgtaatctcaacaaccgccgatgattcaacagctccgaccatctccatcgtcgccggagaaaaacatccgattgctgcctccggaaagatccacgagtgttcaatctgtcataaagtgtttccgacgggtcaagctttaggcggtcacaaacgttgtcactacgaaggcaacctcggcggcggaggaggaggaggaagcaaatcaatcagtcacagtggaagcgtgtcgagcacggtatcggaagaaaggagccaccgtggattcatcgatctaaacctaccggcgttacctgaactcagccttcatcacaatccaatcgtcgacgaagagatcttgagtccgttgaccggtaaaaaaccgcttttgttgaccgatcacgaccaagtcatcaagaaagaagatttatctttaaaaatctaatactcgactattaattcttgtgtgatttttttcgttacaaccatagtttcattttcatttttttagttacaaatttttaattgttctgatttggattga

SEQ ID NO: 4819 - DNA, 1341 bp, Artificial Sequence
  P9266 (opLexA::G1487, G1487 is from A. thaliana)
cacataaccatctcttcttgacccttttctttaatctttaatctctttcttcttcttcttcttcttcttcttctcgccaccgctccttcctccctccttctctctgtatcagtttttttctcgataggaaaatggaacaagccgcgttgaagagcagcgtcaggaaagagatggctctcaaaacgacttctccggtttacgaagagtttcttgccgtcaccaccgctcaaaatggcttttccgtcgacgatttctctgtagacgacttgcttgacttgtcaaacgatgacgtttttgccgacgaagaaactgacctcaaggctcaacatgagatggtccgtgtttcctctgaggaacccaacgacgacggagacgctcttcgccggagcagcgatttctccggctgtgacgactttggttctctccctacaagcgaactctctcttccggcggatgatttagcgaaccttgagtggctctctcatttcgtggaggactccttcacggaatattcgggtccaaacctcaccggaaccccgactgagaaaccggcgtggttaacgggtgaccggaaacatcctgtgactgcagtcacggaagagacctgtttcaaatcccctgttccggctaaagcccgtagcagacgtaaccgcaatggcctcaaggtctggtcgcttggttcgtcgtcctcctcgggtccttcctcgtccggttcgacctcctcctcctcttcgggtccttccagcccgtggttctccggcgctgagctgctcgagcctgtggtcacgtcagagaggccaccgtttcccaagaagcataagaaaaggtcagccgagtctgttttctccggtgagctgcagcagctgcaacctcagcgaaagtgcagccactgcggcgttcagaaaactccgcagtggagagccgggccaatgggagccaagaccctgtgcaatgcgtgcggtgtccggtacaagtcgggtaggttgctaccggaatacagacccgcttgtagcccgacattctcgagtgagctgcactcgaaccaccaccggaaagtcatagagatgaggcggaagaaggagccaaccagtgacaacgaaaccggtttaaaccagctggttcagtccccacaagctgtaccaagtttttgaagaaatagggccttaattagagcagagatttaggatccgaaccggttcagttgttagccccaagttagtttctcattgacttgtttctttgtatattactttcattatttttagcatttactttttttttgttacagtagtttgatttttcatgctaggagtatccgtaagttcttagtaactgattagg

SEQ ID NO: 4820 - DNA, 1028 bp, Artificial Sequence
  P9267 (opLexA::G1488, G1488 is from A. thaliana)
acaactctttagttttaatcaacgaaacttatggaagatgaagcacatgaattcttccacacatctgattttgccgttgatgaccttttagttgatttctctaacgatgatgacgaagaaaacgatgttgttgctgattccaccactaccaccaccataaccgacagctctaacttctccgctgctgatcttcccagtttccacggtgatgttcaagacggcactagcttctccggtgacctttgtataccttctgatgatttggctgatgagttagagtggctttcgaacattgtggatgaatcattgtcgcctgaagatgtacacaagctcgagctaatatccggttttaagagtcgaccggacccgaaatccgataccggaagcccggaaaacccgaatagcagcagtccgatttttactaccgacgtttctgtaccggccaaagctagaagcaaacgctcacgcgccgctgcgtgtaattgggcctcacgtgggcttctcaaggaaacgttttacgacagtcctttcaccggagaaaccattctctctagccaacaacacttgtctccgccaacctcgccgcctttgttgatggctccgctagggaaaaagcaagccgttgatggaggacaccgacggaagaaggatgtttcttcaccggagtctggtggcgcagaggagagacggtgtctccactgcgccacggataagactccgcaatggcggacaggcccaatgggcccgaagacgttgtgcaacgcttgcggtgttaggtacaaatcgggacgtttagtgccggagtatcggcccgcggcgagtccgacgtttgtgctggcgaaacactcaaattctcatcggaaagttatggagctccggcgacagaaggagatgagtagggcccatcatgagttcatacatcaccatcacggtacggacactgccatgattttcgacgtttcatcggacggtgatgattacttgatccaccacaacgttggcccagatttcagacagcttatttgatt

SEQ ID NO: 4821 - DNA, 3518 bp, Artificial Sequence
  P9268 (opLexA::G1382, G1382 is from A. thaliana)
ctctcatttcgccatagctgagagcttcttctactttcccttagcttcttttttccttcatttttgttctacccttgcgaatctctgaaatgaaccctcaagctaatgaccggaaggagtttcagggagattgttcggcgacgggagatctcacggcaaagcacgattcagctggaggaaacggaggtggaggtgctaggtataagctgatgtcaccggccaagcttccgatctcgaggtcgactgatatcacgattcctcctgggttgagtccgacttcgtttttggaatctcctgttttcatctccaacatcaaggtttaagcagctactttactatctctttcttcttcttcttcttcgattttggtaaatgcaatcacagtttcacctcatttttgttgtcgatttgagaaattaggttttctgatttcatatttttaagacctaaaggatttttcatgaaattggattgtgccattttgaaactgagtttggaattggaattgattcataacattgacattttgtcccacttgttcggtttctcgttgcttcaatttcgatttggatcactgttcatgttagtggggaatttctggtaatttggtggagatgctctctgcttgctcactaggaaaaacattggacttgggtttccatttttgtttcttagtccattacaagtgattaaaaaactatgatttgtttgcttacgttagggactttggccaagattctgattctttgtgctactatactctgcattggtttgcatttgtgtccgttcagattgttctttcgaataaaccttttttttttatcatgttctattggtgctggatactttatttatatcctcttgctctttgtcgtttcttcttcatactgtctagtgtctatcttccatgtgtttggtgcttctcttttctttttccattctttgtacatttaggtttcggttagctgcgtctgtgtggggattccttttacttatatgagctattgaatgattctgttggtgagaaaatgtactttactcgcatgttcaccatttagatctatagagtattcgttttgttcaattaagttatgaataataggttatatgctatgtgctcaattttattttgcatctcttagttatatcttcttatcccttgattgaacaagatattgtttttgtttttagaagactgttttttttaaaacatcatgtttattgatagatcaggttcatgttttacaaaatctgatatgtattgttttattcatgccattaataatatgccactttctttaactttcagccagaaccttcccctactactggttctttgttcaagcctcgaccagtgcacatttctgctagctcaagttcttatacaggcagggggttccatcagaacacctttactgagcagaagtccagtgaatttgagttcagacctcctgcatcaaatatggtattgtccaaaacaatgctgtttgttatgctttgcatgtaatgtactgttcagatagtcgacgacatatgaaccccgaacagtggctgacctaatttttctgcacgaagtctatttattcagcgcttggattgcttgtaaatctcaaaatctttcgcctttgcatacatataataccatgccagccttaaattgtttcataaggagccttgtatccaaaagctcacagtttataagttacttgtatattgttgggggatgactttgtctaaacatctttattgatttcaaggtatatgcagagcttggcaagattagaagtgagccaccagtacattttcaaggccagggccatggatcctcacactcaccttcttcgatcagtgatgctgcaggttcctcaagtgagctaagccggccaactcctccttgtcagatgacaccaacgagctcagatattccggctggatctgatcaagaggaatcaatccagacttcccaaaatgactccagaggaagcactccatccatcttggctgatgatggttataactggagaaaatatggtcaaaagcatgtcaaagggagtgaatttccccggagctattataaatgtacacatcctaattgtgaagtgaaaaagttatttgaaagatctcatgatgggcagatcaccgatattatatacaagggtacacatgaccatcctaaacctcaacctggtcgccgaaactctggtggtatggctgcacaagaagaaaggctagacaagtatccttcttcaactggccgagatggtaatcataactaaaacttgagacaaatatgcacttactcccttggcaatatctataactttttccttctactcttatgtctgcatacagagaagggatctggcgtctacaacttgtctaaccccaatgaacaaactggtaaccctgaagtacctcctatctcagcatctgacgatggtggagaagcggcagcgtcaaataggaataaagatgagccggacgatgatgatccattctcaaaacggaggtattagagtttaacaaaggattcaggtgcttgatttgaatctgtgatttgacatgattaaaactttattttaactttatgtaggaggatggagggtgcgatggaaataactccactagtgaaacccatccgggagcctcgggttgttgttcaaactctgagtgaggttgacattctggatgatggttatagatggcgcaaatatgggcagaaagtcgtaagggggaacccaaatcccaggtttgtacagcattaaagcttttaacaccccaaaaaattccttgcttttttctcgaatgaacatacataaacataacttgcgagttcaaaatggtagctagaacagtttagtccttgtcttcaggacctagttatttgacatgtgcataaagtgttgcttcttttaggaatttggtttggaatatggaagatagtgatcttaacagactcaacatgtgcgcaatggagatattatgtttcatgatgttcctcggccttttgtaggagctactacaaatgcacagctcatggatgcccagtgagaaaacacgtggagagagcatcacatgatccaaaagctgtaataacaacatacgaaggcaaacacgatcatgatgttcccacttcaaagtctagcagcaatcacgaaatccagcctcggttcagaccagatgaaacagacaccatcagcctcaatcttggtgttggaatctcatctgatggacctaaccacgcttccaacgaacatcagcaccagaatcaacaacttgtcaaccaaactcacccaaatggagtcaatttcaggtttgttcatgctagtcccatgtcatcctactatgctagcttaaatagcggtatgaatcagtacggccagagagaaacaaagaacgagactcaaaatggtgacatctcgtccttgaacaattcatcttacccatatccgcccaacatggggagagtacaatcgggtccgtaaaacaaaaagtaagcaacattatgtacgggatct

SEQ ID NO: 4822 - DNA, 3119 bp, Artificial Sequence
  P9272 (opLexA::G2674, G2674 is from A. thaliana)
tatgttcttctctccattgttggttttgtctttcttgttttttttttgtttctctataacttagattattgactatttaatttggttgcagagagggaaaatgaatggcgatcttgaagttgatatgtctagaggagatttcaatccaagtttttttcttggaaagcttaaagacgatgagtttgagagtagatcattgagtgatgatagctttgatgcaatgtctggtgatgaggataaacaagaacaacgccctaagaagaagaagaggaagacaaagtatcatagacacacttcttaccagattcaagaactcgaatcgtaagaagtttctggtttttaaaagaatctaaactttttcatattcatcaagtggtttttgaatgtttgatattttctgagtgtagtttcttcaaagagtgtcctcatcctaatgagaagcaaaggttggaacttggcaaaaaacttactttggagagtaagcaaattaagttttggtttcagaacagaagaacacaaatgaaggtactttatctgaaaagttatggttttgatagtagagttatgatttttatgggaatgttgtggtttttatattgaccagacgcaactagagcggcatgagaatgtgattctcaaacaagagaatgaaaaactgcggctagaaaacagtttccttaaagagtcaatgagaggctctctatgtattgattgtggtggagcagttatacctggtgaggtttcttttgagcagcaccaacttaggattgagaatgctaagcttaaggaagagcttgataggatttgtgctttagcaaatagattcattggtgggtctatttcacttgagcagccttcaaatggtgggattggctcacagcatttgcctataggacattgtgtcagtggtggaacttcactgatgtttatggatcttgccatggaagccatggatgagttgttgaagttagcagaattggaaacttctttatggagttcaaagagtgagaaaggatcgatgaaccatttccctggttcaagagaaactggtttagtacttatcaatagcttggctctagtcgagactcttatggacacggtatgctatactctctaataaccggtattttatcgatatatgcacactctactaaacgtctcatctttgttattggtttgttacagaacaaatgggcagaaatgtttgagtgcatagtcgcggttgcatcaacccttgaagtgatatccaacggtagtgatggatcaagaaacggctctattctattggtatgttactcaagaaccataaagattatatattttggcgacatttgctaattcaatgagtcctttgtttggaacagatgcaagcagagtttcaagtgatgtctccattagttccaatcaaacaaaagaagtttcttagatattgcaagcaacatggagatggtttatgggcggtcgtcgatgtttcttatgatataaacagaggaaatgagaacttgaagtcttatggtggctctaaaatgtttccttcaggatgcattatacaagacataggcaacggctgctccaaggtaacttctctttctttgttaggacaattttttatgtcttggatctgcgtgatgttttattgaattgtttatagttgagagtttggtcagtcttgtaaactaattacaaaggagtcgacaattagcctgagaacctgaagccttttgtgtataaaactataaaagattcttctatttctttgttaatacatatcaaagggttcacttttcaaggtagaggttgcttcttgtctgagctagttctaggctatcataaataatttatacaaaaatatcttgttttgtttacttatatcgatggaaacttacatattggattagatgaatctgatatgtacatttcttcgtaaaatgagttgttacttatagtcacaactattatttactcaatgtcacatatttggtttaacacaaataatttcaacaggtgacatggatagaacattcagagtacgaagagagtcacacccactcactttaccaaccgttgctcagttcttcggttgggttaggcgcaaccaaatggcttgcgactctgcagaggcaatgcgagagcttcacaatgcttttgtcttctgaagatcacacaggttttggctcgttctctttctttttctctcagcatttgaatcttgaaatgttgcaatttgaacgagagatattattcaagaatgttttacgataggtttgtcacatgctggaacaaagagtatactaaagctagcgcagcgtatgaagctcaacttttactcgggaataactgcttcgtgcattcacaaatgggagaagcttcttgctgagaacgtgggacaggacacaaggatactgacaaggaagagtcttgagccgtctggtattgtcctgagcgctgcgacatctctgtggctaccagtgactcagcagagactctttgagtttctgtgtgatggtaaatgcagaaaccagtgggatattttgtctaatggtgcttcaatggaaaacacacttctcgtcccaaaaggacaacaggaaggaagctgcgtctctcttcttcgtgctgctgtgagtttataatctattctgaatctctctattcattaaactccaaaaagatctctgttcttggttactgattagatcgatttgcaggggaatgatcaaaatgagagtagtatgctcatcttgcaagagacatggaatgacgtttctggtgcactggtggtttacgcgcctgttgatattccatctatgaatactgtaatgagcggtggagattcagcttatgtggcgcttcttccatcggggttctcgatattgcctgacggatcatcatcatcgtctgatcagttcgataccgatggcggtttggtgaatcaagaaagcaaaggatgtctcctgactgtaggatttcagatcttagtgaacagcctaccgactgcaaaactcaacgtggaatctgttgaaactgttaacaacctcatcgcttgcaccattcacaagatcagagccgctcttcgtatacctgcttagctaaagttgtaggacctaatcttgtttgtatgt

SEQ ID NO: 4823 - DNA, 1101 bp, Artificial Sequence
  P9274 (opLexA::G2437, G2437 is from A. thaliana)
gttcaattgtcatcttcatcgtttccgtcgtgttatttggtgtttctcgtttgggtctttcgaacatctttcattcttctctttttggtgttgctccccacgaacaggtagattgatgaaaagcaaccatggatgacctacatggaagcaatgctcgaatgcacattagagaagctcaagatccaatgcatgtgcaatttgaacatcatgctttgcatcacatccacaatggaagcggtatggttgatgaccaggctgatgatggcaatgctggtgggatgagtgagggtgtggaaacagacattccttctcaccctggaaatgtaactgacaatcgtggtgaagtggtcgaccgtggtagtgaacaaggagatcagttaacattgtcttttcagggccaagtctacgtttttgacagtgtcttgcctgagaaggttcaagctgtgcttctattattgggtggtcgtgaattacctcaggcagcccctcctggcctaggatcacctcatcagaacaacagagtatcgagtttacctggtactcctcaaaggtttagtattccgcagcgattagcttctttggtcagatttcgagagaaacggaaaggaaggaattttgataagaagattcggtatacagtccgcaaggaggtagctttgaggatgcaacgcaataaaggtcagttcacatctgccaagtcaaacaatgatgaagctgcatctgctggatctagctgggggtcgaatcaaacctgggccatagaaagtagtgaggctcagcatcaagagatctcatgtcggcactgtggaattggcgagaagtcaactccaatgatgcgacgtggacctgccgggccaagaacactttgcaatgcatgtggacttatgtgggcaaacaagggtgcttttagggacttatccaaagcctctcctcaaacagcccagaatcttcctttaaataagaatgaagatgcaaatcttgagactgatcatcaaataatgataacagtggccaatgacataagcaactcacagtgaggacatgttggctcttgccattacaagcaagagaaagatcccaacagagtttgaatcgcctcag

SEQ ID NO: 4824 - DNA, 1009 bp, Solanum lycopersicum
  P5284 LEAF-SPECIFIC RBCS3 PROM. DRIVER CONSTRUCT
aaatggagtaatatggataatcaacgcaactatatagagaaaaaataatagcgctaccatatacgaaaaatagtaaaaaattataataatgattcagaataaattattaataactaaaaagcgtaaagaaataaattagagaataagtgatacaaaattggatgttaatggatacttcttataattgcttaaaaggaatacaagatgggaaataatgtgttattattattgatgtataaagaatttgtacaatttttgtatcaataaagttccaaaaataatctttaaaaaataaaagtacccttttatgaactttttatcaaataaatgaaatccaatattagcaaaacattgatattattactaaatatttgttaaattaaaaaatatgtcattttattttttaacagatattttttaaagtaaatgttataaattacgaaaaagggattaatgagtatcaaaacagcctaaatgggaggagacaataacagaaatttgctgtagtaaggtggcttaagtcatcatttaatttgatattataaaaattctaattagtttatagtctttcttttcctcttttgtttgtcttgtatgctaaaaaaggtatattatatctataaattatgtagcataatgaccacatctggcatcatctttacacaattcacctaaatatctcaagcgaagttttgccaaaactgaagaaaagatttgaacaacctatcaagtaacaaaaatcccaaacaatatagtcatctatattaaatcttttcaattgaagaaattgtcaaagacacatacctctatgagttttttcatcaatttttttttcttttttaaactgtatttttaaaaaaatattgaataaaacatgtcctattcattagtttgggaactttaagataaggagtgtgtaatttcagaggctattaattttgaaatgtcaagagccacataatccaatggttatggttgctcttagatgaggttattgctttaggtgaaa

SEQ ID NO: 4825 - DNA, 1183 bp, Arabidopsis thaliana
  P5287 EPIDERMAL AND VASCULAR-SPECIFIC LTP1 PROM. DRIVER CONSTRUCT
gatatgaccaaaatgattaacttgcattacagttgggaagtatcaagtaaacaacattttgtttttgtttgatatcgggaatctcaaaaccaaagtccacactagtttttggactatataatgataaaagtcagatatctactaatactagttgatcagtatattcgaaaacatgactttccaaatgtaagttatttactttttttttgctattataattaagatcaataaaaatgtctaagttttaaatctttatcattatatccaaacaatcataatcttattgttaatctctcatcaacacacagtttttaaaataaattaattaccctttgcatgataccgaagagaaacgaattcgttcaaataattttataacaggaaataaaatagataaccgaaataaacgatagaatgatttcttagtactaactcttaacaacagttttatttaaatgacttttgtaaaaaaaacaaagttaacttatacacgtacacgtgtcgaaaatattattgacaatggatagcatgattcttattagagtcatgtaaaagataaacacatgcaaatatatatatgaataatatgttgttaagataaactagacgattagaatatatagcacatctatagtttgtaaaataactatttctcaactagacttaagtcttcgaaatacataaataaacaaaactataaaaattcagaaaaaaacatgagagtacgttagtaaaatgtatttttttggtaaaataatcacttttcatcaggtcttttgtaaagcagttttcatgttagataaacgagattttaattttttttaaaaaaagaagtaaactaactatgttcctatctacacacctataattttgaacaattacaaaacaacaatgaaatgcaaagaagacgtagggcactgtcacactacaatacgattaataaatgtattttggtcgaattaataactttccatacgataaagttgaattaacatgtcaaacaaaagagatgagtggtcctatacatagttaggaattaggaacctctaaattaaatgagtacaaccaccaactactccttccctctataatctatcgcattcacaccacataacatatacgtacctactctatataacactcactccccaaactctcttcatcatccatcactacacacatc

SEQ ID NO: 4826 - DNA, 1176 bp, Arabidopsis thaliana
  P5288 EPIDERMAL-SPECIFIC CUT1 PROM. DRIVER CONSTRUCT
tgtgaattatattttactcttcgatatcggttgttgacgattaaccatgcaaaaaagaaacattaattgcgaatgtaaataacaaaacatgtaactcttgtagatatacatgtatcgacatttaaacccgaatatatatgtatacctataatttctctgattttcacgctacctgccacgtacatgggtgataggtccaaactcacaagtaaaagtttacgtacagtgaattcgtctttttgggtataaacgtacatttaatttacacgtaagaaaggattaccaattctttcatttatggtaccagacagagttaaggcaaacaagagaaacatatagagttttgatatgttttcttggataaatattaaattgatgcaatatttagggatggacacaaggtaatatatgccttttaaggtatatgtgctatatgaatcgtttcgcatgggtactaaaattatttgtccttactttatataaacaaattccaacaaaatcaagtttttgctaaaactagtttatttgcgggttatttaattacctatcatattacttgtaatatcattcgtatgttaacgggtaaaccaaaccaaaccggatattgaactattaaaaatcttgtaaatttgacacaaactaatgaatatctaaattatgttactgctatgataacgaccatttttgtttttgagaaccataatataaattacaggtacgtgacaagtactaagtatttatatccacctttagtcacagtaccaatattgcgcctaccgggcaacgtgaacgtgatcatcaaatcaaagtagttaccaaacgctttgatctcgataaaactaaaagctgacacgtcttgctgtttcttaatttatttctcttacaacgacaattttgagaaatatgaaatttttatatcgaaagggaacagtccttatcatttgctcccatcacttgcttttgtctagttacaactggaaatcgaagagaagtattacaaaaacatttttctcgtcatttataaaaaaatgacaaaaaattaaatagagagcaaagcaagagcgttgggtgacgttggtctcttcattaactcctctcatctaccccttcctctgttcgcctttatatccttcaccttccctctctcatcttcattaactcatcttcaaaaatacc

SEQ ID NO: 4827 - DNA, 2244 bp, Arabidopsis thaliana
  P5290 VASCULAR-SPECIFIC SUC2 PROM. DRIVER CONSTRUCT
aactaggggtgcataatgatggaacaaagcacaaatcttttaacgcaaactaactacaaccttcttttggggtccccatccccgaccctaatgttttggaattaataaaactacaatcacttaccaaaaaataaaagttcaaggccactataatttctcatatgaacctacatttataaataaaatctggtttcatattaatttcacacaccaagttactttctattattaactgttataatggaccatgaaatcatttgcatatgaactgcaatgatacataatccactttgttttgtgggagacatttaccagatttcggtaaattggtattcccccttttatgtgattggtcattgatcattgttagtggccagacatttgaactcccgtttttttgtctataagaattcggaaacatatagtatcctttgaaaacggagaaacaaataacaatgtggacaaactagatataatttcaacacaagactatgggaatgattttacccactaattataatccgatcacaaggtttcaacgaactagttttccagatatcaaccaaatttactttggaattaaactaacttaaaactaattggttgttcgtaaatggtgctttttttttttgcggatgttagtaaagggttttatgtattttatattattagttatctgttttcagtgttatgttgtctcatccataaagtttatatgttttttctttgctctataacttatatatatatatgagtttacagttatatttatacatttcagatacttgatcggcattttttttggtaaaaaatatatgcatgaaaaactcaagtgtttcttttttaaggaatttttaaatggtgattatatgaatataatcatatgtatatccgtatatatatgtagccagatagttaattatttgggggatatttgaattattaatgttataatattctttcttttgactcgtctggttaaattaaagaacaaaaaaaacacatacttttactgttttaaaaggttaaattaacataatttattgattacaagtgtcaagtccatgacattgcatgtaggttcgagacttcagagataacggaagagatcgataattgtgatcgtaacatccagatatgtatgtttaattttcatttagatgtggatcagagaagataagtcaaactgtcttcataatttaagacaacctcttttaatattttcccaaaacatgttttatgtaactactttgcttatgtgattgcctgaggatactattattctctgtctttattctcttcacaccacatttaaatagtttaagagcatagaaattaattattttcaaaaaggtgattatatgcatgcaaaatagcacaccatttatgtttatattttcaaattatttaatacatttcaatatttcataagtgtgattttttttttttttgtcaatttcataagtgtgatttgtcatttgtattaaacaattgtatcgcgcagtacaaataaacagtgggagaggtgaaaatgcagttataaaactgtccaataatttactaacacatttaaatatctaaaaagagtgtttcaaaaaaaattcttttgaaataagaaaagtgatagatatttttacgctttcgtctgaaaataaaacaataatagtttattagaaaaatgttatcaccgaaaattattctagtgccactcgctcggatcgaaattcgaaagttatattctttctctttacctaatataaaaatcacaagaaaaatcaatccgaatatatctatcaacatagtatatgcccttacatattgtttctgacttttctctatccgaatttctcgcttcatggtttttttttaacatattctcatttaattttcattactattatataactaaaagatggaaataaaataaagtgtctttgagaatcgaacgtccatatcagtaagatagtttgtgtgaaggtaaaatctaaaagatttaagttccaaaaacagaaaataatatattacgctaaaaaagaagaaaataattaaatacaaaacagaaaaaaataatatacgacagacacgtgtcacgaagataccctacgctatagacacagctctgttttctcttttctatgcctcaaggctctcttaacttcactgtctcctcttcggataatcctatccttctcttcctataaatacctctccactcttcctcttcctccaccactacaaccacca

SEQ ID NO: 4828 - DNA, 1326 bp, Solanum lycopersicum
  P5297 FRUIT-SPECIFIC POLYGALACTURONASE (PG, HIGH EXPRESSION) PROM. DRIVER CONSTRUCT
accaatgcgctatatattaatcaacttgataatataaaaaaaatttcaattcgaaaagggcctaaaatattctcaaagtattcgaaatggtacaaaactaccatccgtccacctattgactccaaaataaaattattatccacctttgagtttaaaattgactacttatataacaattctaaatttaaactattttaatacttttaaaaatacatggcgttcaaatatttaatataatttaatttatgaatatcatttataaaccaaccaactaccaactcattaatcattaaatcccacccaaattctactatcaaaattgtcctaaacactactaaaacaagacgaaattgttcgagtccgaatcgaagcaccaatctaatttaggttgagccgcatatttaggaggacactttcaatagtatttttttcaagcatgaatttgaaatttaagattaatggtaaagaagtagtacatcccgaattaattcatgccttttttaaatataattatataaatatttatgatttgttttaaatattaaaacttgaatatattatttttttaaaaattatctattaagtaccatcacataattgagacgaaggaataattaagatgaacatagtgtttaattagtaatggatgggtagtaaatttatttataaattatatcaataagttaaattataacaaatatttgagcgccatgtattttaaaaaatattaaatagtttgaatttaaaaccgttagataaatggtcaattttgaacccaaaagtggatgagaagggtattttagagccaatagggggatgagaaggatattttgaagccaatatgtgatggatgaaggataattttgtatcatttctaatactttaaagatattttaggtcattttcccttctttagtttatagactatagtgttagttcatcgaatatcatctattatttccgtcttaaattattttttattttataaattttttaaaaataaattattttttccatttaactttgattgtaattaatttttaaaaattaccaacatataaataaaattaatatttaacaaagaattgtaacataatatttttttaattattcaaaataaatatttttaaacatcatataaaagaaatacgacaaaaaaattgagacgggagaagacaagccagacaaaaatgtccaagaaactctttcgtctaaatatctctcatccaaactaatataatacccattataattaaccatattgaccaactcaaaccccttaaaatctataaatagacaaacccttcccatacctcttatcataaa

SEQ ID NO: 4829 - DNA, 1242 bp, Solanum lycopersicum
  P5303 FRUIT-SPECIFIC PHYTOENE DESATURASE (PD, MODERATE EXPRESSION) PROM. DRIVER CONSTRUCT
acgtgtaatagctaccatacaagagaagtaactcgcactgtccatgtcttatgtggctcgactcagaaagcattcagggggattgataaccaccctccaaaccaactgaaccattgtgaataaccacccttcaaatcaaccgagtcctcgtgaaggacaaatatgtggttttatatacattaaattttgtttttacatgcttcctcttacttctttagttttcttgaccatatcttgcgtttttcccttctgtaattgacacttttcttcaaaccatccagcaatgtggaagcttgacgattttccttcagagtagaaattgaaaagaatcaactaaaaaggatagtccttcgatttgatttccggcttaaaaataaactaataagaatgagagagcgaataatagaatattttgaaattttaaagatattcaactatgttaaattgcgttataaatttcttaaattagtagcacctaatagtttagttctcaaaagtcaaaactactacataatgtgctcatttttcacattaaaatgcctacatgatgtaaaagtaaaactcgtagcattctacgtgttttactcaactcaaacatcctgttcattttaataaacgtacgatgagcttctctctccaattttcttttcttttttttttttaaaaaaatatttttttttatatcaatccaaatgggctccaatttatcataaattaggtagaaacttagatattaaagaaagaaaagggtttatctcgcaagtgtggctatggtgggacgtgtcaaattttggattgtagccaaacatgagatttgatttaaagggaattggccaaatcaccgaaagcaggcatcttcatcataaattagtttgtttatttatacagaattatacgcttttactagttatagcattcggtatctttttctgggtaactgccaaaccaccacaaatttcaagtttccatttaactcttcaacttcaacccaaccaaatttatttgcttaattgtgcagaaccactccctatatcttctaggtgctttcattcgttccgaggtaagaaaagatttttgtttctttgaatgctttatgccactcgtttaacttctgaggtttgtggatcttttaggcgactttttttttttttgtatgtaaaatttgtttcataaatgcttctcaacataaatcttgacaaagagaaggaattttaccaagtatttaggttcagaaatggataa

SEQ ID NO: 4830 - DNA, 922 bp, Solanum lycopersicum
  P5310 ROOT-SPECIFIC RSI1 PROM. DRIVER CONSTRUCT
caatcaactaaatggacttttcttgtgcattggtcccatttttacgccctaatattcgcttacttgcttttttgtattttatttattttagttttaattttatctacctccaaattgatagaaataattacacttatagtccttttgaaaaattataattatagcattcaagtaaataaaaatacgtatttttagtcactttgtaatgtataattttgagttgaaaatgtatcaaaagtaaatttatattcttaagatatggataaagtttacatatacattatccgtttcataccctatttatagtattacattgcataagttattgtagatcttgatcgaaagtatgtgatattaatactatttttagaattatgttattctcagttatggagtgatatttaaaatcaatatagtatatcgataatcagatagtttaattcttattttctccatccaatttatataatgatattataatcaattttacgaatgagatggatattttgaaatttttagtttaaaataaattttaaattttttgtgggtctataaattatctaattaagaggtaaaatagaaagtttgaaattaattattacttactaaatatataaatatgtcattttttcttaaactgatttagaagaaaagagtgtcatatacatggacagaacgaatataatttgataattaaatttgtaaagattcatagttaatagggatcaaaattgcacgtatccattactataaggtcatatttgcttcataaaaatcatcaggatcaaaaatcagaatttatattatatttgagggactaaaaatgctaatatcacaaattaaaattagtctataaatattcacactttactcttctaattccatcaaatatttccatttatcttctcttcttcttaaatat

SEQ ID NO: 4831 - DNA, 2365 bp, Arabidopsis thaliana
  P5311 ROOT-SPECIFIC ARSK1 PROM. DRIVER CONSTRUCT
ggcgagtgatggtatatttattggttgggcttaaatatatttcagatgcaaaaccatattgaatcaataaattataaatacatagcttccctaaccacttaaaccaccagctacaaaaccaataaacccgatcaatcattatgttttcataggatttcctgaacatacattaaattatttttcattttcttggtgctcttttctgtcttattcacgttttaatggacataatcggtttcatattgtaaatctctttaacctaacgaacaatttaatgaccctagtaataggataagaaggtcgtgaaaaatgaacgagaaaaaacccaccaaaacactatataagaaagaccgaaaaagtaaaaagggtgagccataaaccaaaaaccttaccagatgttgtcaaagaacaaaaatcatcatccatgattaacctacgcttcactactaagacaaggcgattgtgtcccggttgaaaaggttgtaaaacagtttgaggatgctacaaaagtggatgttaagtatgaagcggctaaggttttggatttggtctaggagcacattggttaagcaatatcttcggtggagattgagtttttagagatagtagatactaattcatctatggagacatgcaaattcatcaaaatgcttggatgaattagaaaaactaggtggagaatacagtaaaaaaattcaaaaagtgcatattgtttggacaacattaatatgtacaaatagtttacatttaaatgtattattttactaattaagtacatataaagttgctaaactaaactaatataatttttgcataagtaaatttatcgttaaaagttttctttctagccactaaacaacaatacaaaatcgcccaagtcacccattaattaatttagaagtgaaaaacaaaatcttaattatatggacgatcttgtctaccatatttcaagggctacaggcctacagccgccgaataaatcttaccagccttaaaccagaacaacggcaaataagttcatgtggcggctggtgatgattcacaatttccccgacagttctatgataatgaaactatataattattgtacgtacatacatgcatgcgacgaacaacacttcaatttaattgttagtattaaattacatttatagtgaagtatgttgggacgattagacggatacaatgcacttatgttctccggaaaatgaatcatttgtgttcagagcatgactccaagagtcaaaaaagttattaaatttatttgaatttaaaacttaaaaatagtgtaatttttaaccacccgctgccgcaaacgttggcggaagaatacgcggtgttaaacaatttttgtgatcgttgtcaaacatttgtaaccgcaatctctactgcacaatctgttacgtttacaatttacaagttagtatagaagaacgttcgtacctgaagaccaaccgacctttagttattgaataaatgattatttagttaagagtaacaaaatcaatggttcaaatttgtttctcttccttacttcttaaattttaatcatggaagaaacaaagtcaacggacatccaattatggcctaatcatctcattctcctttcaacaaggcgaatcaaatcttctttatacgtaatatttatttgccagcctgaaatgtataccaaatcatttttaaattaattgcctaaattattagaacaaaaactattagtaaataactaattagtcttatgaaactagaaatcgagatagtggaatatagagagacaccattaaattcacaaaatcatttttaaattacctaaattattacaacaaaaactattagacagaactaagtctataatgaaacgagagatcgtatttggaatgtagagcgagagacaattttcaattcattgaatatataagcaaaattatatagcccgtagactttggtgagatgaagtctaagtacaaacaactgaatgaatttataatcaataatattgattatattgtgattagaaaaagaaaacaacttgcgttatttttcaatattattgtgaggattaatgtgaacatggaatcgtgtttctcctgaaaaaaatatcagcatagagcttagaacaatataaatatatccaccaaaaataacttcaacatttttatacaactaatacaaaaaaaaaaaagcaaactttttgtatatataaataaatttgaaaactcaaaggtcggtcagtacgaataagacacaacaactactataaattagaggactttgaagacaagtaggttaactagaacatccttaatttctaaacctacgcactctacaaaagattcatcaaaaggagtaaaagactaactttctc

SEQ ID NO: 4832 - DNA, 4361 bp, Arabidopsis thaliana
  P5318 APICAL MERISTEM-SPECIFIC STM PROM. DRIVER CONSTRUCT
agaatgtagcaatacaaatatatgacggtaccgttatccatcaccattatatgtatatatgtataatttgataaatattcactttgtgtttcgtcgtttgcttaataaacagctcatttccatggtattgagtcttctatatgcgagagaatcagattcccgctgggataacaaaagaacaaggtactgaaaaaaatagacaaaacttttttttaaattatataagctataaaagaaaagagtatagagagagattagccctactgtttaagagggagagagtagggtcattagggctttagagagagaagacattcggactgtccccacttgcttttctgtagaataacattatttaaatcttatttttaattaaatattacaactaaaagaagaaaccaacttttaaaataaatgcagattatatgctctgacttggactaaataaaacttgcaagtaacagtttcaagtccttttgttttagaactttttctttcgtagaagtgataaatgattgccctagacctgatagattctctaaaattctacgtattacagcataagttacctcctttatttgactattagaccatccatattggtgggcttttagcaaatgttcttaacaataattttataatttattttaatgttaagaggtttgataattttttttttttaagagtgtattttgtttattaaaatgtgttttgtttcttatataagaaccaaatcttaactattttaccaattaaacattaaatttaaattttaatatctctaagaattatattaagagccaatatagatgcttttaaaaccattggttgaataaataaatctaaccttcttaattatttctgtgtgaatattttctaaattttcattttaatttagcacaatataatccatgttctaaaaagaacaattaacataatatttacaaacctaaaaagattataaaacacaattttattttttacagcttataatgttttaaagttcaggtttattttttaaaagttcaggtttattacattaggtttgacttgtaatcatcatttatcacaacgatcaaactattattacaatcacaatagtagacaaaatttaggatatatatatatatatataattatgtataaactatgaacatttaaagtgagatttttcaaaataatatataaattcaaatagaaatagactatttggttcttaaatgagagacccccgaaaaaatctttttttttttctcatcaagctgtttacatttttagatataaaatcatattctttatagtttagaatatgaattaaatagttttatatgttattaacttatcataagatatgcgtgaggttggccaaaaactcatcaattaaccaaataagaaaagtaaaattgtattttgctttgctaaaaatgtaaatatttcattgaaaaatgaaaaaggtttaggtaatacaattaagtaaatcctacaattttggttccatggcaaaagaataaaattgtattgctttggtaaaagttgatccaactaatatattcagtagaaactgcaaaactgaagaaataagtttgtttagtagaattgctttcggttatgtaatgaatatacatccaaaatggctttttagtaatgatgtcttttcatactctttccaatccctactactttcagattatttgtcctactattatagagatatacgttcgttttcaataatatgaaaagtgatatatatttaaatagtgtgatatatatataagttttgcaagtgcatcacttcccaaaatcgcataaatcattaatcatattgtcgaaaacagtataataacttcttaaacgaaaacgcagcgcaattaaaaataacaactagagataattgacaaaacattgattaatatttacctataagttaattattgtatttaaaatttatttaaagttcataaggaaaacatatgcaaaaatatttatatctaatattttgctatgttatccttttttttttttacgttatcctaattttgtttatcctaatttgttgtggttaaaatcttattattgataaaaagagaacttttttttttgtcatcataaaaaagagaacttattacttcgattttaaaattctatgagcgtaggagacaaagaaaaaaaaaataaaaaaaaaaagaagagaaaaatcacttcttttcttctttttagtccagatccaacatattttggataactaaatgaagattttttaaaaaaatatattttagggtatatataaatcataatttgaagcaaatgaaataaaatccagtttggtaatatataaatatgatttgatgggttccttgtaatctctctctatctattagtttctcagttatcttttctttgccagaaatggcagtgaaggcagtggctgaggagagagttttttttcttctttcatggggaaagtaaaactttgccttgaagatttctctcttcaatatttttctaagacttttgatttcaacgaatcactgtccttaacctaaaagcaagaaaaattagctttatactggtctttacttttttttaacatatttatttttatatagtttacttataaacatagacatacgagtatgggaatatatagtatatccaacttctaaataatatttcgaatagtgataacaaaattagcaatacatacggctagtgaaatgttgatcgaataaacggcactgatgtaatgtacttatcaattttgataattttaattgtattgtttttctttttttcccacagtattgaactagacaattaaatttaaagtaaaattatacatttctttcgttgtgtattaaagtaacatgcataatatcattttccttcgtacaatcctccaaattgacaattgatgaattactttgtcaatcgtaaatgaatttttctcaagtctgtatactattttcagggataaacaggtacaggtgtcccatgcttattctcttgatagtaacatgtgtcctatgttgagtcaattctacgttcgaagaagtgctaacaattgttaatagcctcgtatattattctaattaaaatgcctcgatagatttggttagtggtctgaatgtgattggttattttttcaagtggcaagaggtctaccatctaatattacaatcaatcgaccaaaaaggtcgagaacatgataatggtggcaaatacaaatggttcattgttgtctaatataacaagccatcagttgtcactttttaaaaacaatacagaatacaagatactttttttttaaggtaaaatgtgtgtttaatattttcgtttatataacaaataaacagttacatgttttactctatgattatatttatgacatttttcttcttcttaacaacatttttttcccataagaacatttacaatagtattaaaactttgattgcaatcaaatgttagatcacttattataaaattactaagactgctatcttttcctattgacaaaagcgaatccaatatatgttactgaaacaaatgcgtaaattatactatatggagatctatcggttaattattgagagaatctaagaaagtttttgagtacaacagtcctaataatatcttcacataccatataatatacatatatacatatacacaaatgtactttttaaaccaacatcagcatacgtatatcccatcaggaaacttagacttttgggaattcatggtatgaaaaccaaaaccaaatgacaacattcgatttgatactcccgacccatggtaaagaaataacaaattccaatatatctttcactggactttccgaggcacattccggttttctccatttcaagaaattgtcaaaaataaattgagatccggtttattacctcaaaaaagaagaagagaaattacaacattaatttccgaaaaggcataaatgagaaatcatatttcagcagaagaacacaaaagagttaagaacccacagatcacacaacctctgtccatgtctgctttttacacttttttaaaataagtttctcctaaaaagttatttcctatttataataatttccttagatttatcttcctggtctctcttctgctgcttccctctcccccataactatcactatttagaattttcaatgtggaaaaggaagctgattgttgaagcataaatcccgggagaccacttttgcattttcaaataattaaattaaaccatagatacacacacacagttacttactcttttagggtttcccaataaatttatagtactttaatgtgtttcatgatattgatgataaatgctagctgtatttacaatgggggctcct

SEQ ID NO: 4833 - DNA, 4801 bp, Arabidopsis thaliana
  P5319 EMERGENT PRIMORDIA-SPECIFIC AS1 PROM.
ggaccgtgtaatgggccattgggccaagttttcttgatataaaatctgaaatactactaaattacaatttttcttaaactcgatttcataattcatgtgggactcagttctccgcgtcttatgacttaagagttaagagtaaagacaattgattgtagtttgcattattaaggttgtgattttaaaggctatattggcccaggcaaagtggttatgaaagttaaaaggtattattaaatgtcgttatggactagctaaagaaaagagatggatatagaaacggatttgccagtttgtgaggttacgtactcgttactttctattgcatttttgtgtgtcattgtgcttgtgatttctttagtatatgtttttctttttgtcaaactctttagtacatgttatgctttattttcttgtttagcattgttattgttattttgatccatgttcttttacttaatgtgtagagtgttcacgtacgactctttatgatcgctatactaatatactatgaaactcgaatgagaacatgcatgtcataaatcaataaaacataacatacgacacttaacctaaatcatacattcattgattcatactatcatgatcctcatcacattagtatcatttgtctttatttattacttagctacttcgttatcttattatatctttacctgttctgctggtcatttgccataaacaccaagtacaagcaactctttagtccaatatcagaccaaattaacaaacatttccccaatccaaaacggaaatttaattataattagcatttaaataggttcgattacaaaaaaaaatcaacaaaggaacaagtcaatttcataatggtttgtcaattgtcacacaacgaaatggctagccggatcaagcatgcatgatccaaatttcaacatttccatgataacctgaattataacgtctacataaaccatatttaaataaataggatggtcgaaagatatcattaaaagaacgattcaatattctttattgttcaattgatacacatgttattctccttaaccagttatgaacatgtcctacaagtttcttgacccaaactcataatttcatataccataatcccaagttaagttttttttttttggggatcaaaatctcaagttaagttaagttcaattatttagctgtaatgctcggaaaaaagatcggatgaatatccaattggttcaatatataccccaatccggccaatctccctatctttatagcttaattattagagaatggtcaattcacgccatcagaaccagtttcatatcttcatgaaccaaaacgcctacaaccctattattcaagaaatcactataattgtccaagtaaaaccattaattaaccgagtcgatttttctatggtcctataggcatgttgttactcaaactactgattaattaataagaagttgtagtttgaaaaagaatctagctgaaaaatactcctactctaagaatttaagttagaataaaacatattaatacaaatataaaaatttagttattaaaaaagcgctactaccaagacgtcctaaagaaaaactagctttgtcttctaaaagaaaacctagcttaactacccaaaaaaatctagttttacaaacactaaagacaaattttatttttcaacaaatttaccaattaaagaaaattccatgtaggaatgtatccaaattgaaaatatccctacatattttgtaggaaaaaaggtttttataaatattaaaaaaacgagaaaaagaaaagagaaaagagaaaaaaaaaagccggagagaatggagcacatgaggtaaaaggcaagagatggcagagagaagatcagagaagggatctgcctcaatttgacaactcatatgtcatgtcatttccctcactactattattttcctatttcaaaaacacctttctctgataccatcaccttttaccttctctttttttttactgtctttgctctgtttcacattcccttctatatatacagtatagtatattttatccttcttttattgttttgcttactaaaagtttttttcctccggaatcaaaattctaaaatgtatatcatgttaggtcgcgagggccatgcaatattatgaactatgcatgatgattaatgtctgtggatccatcacaaatattattgaaggttgatcagagactatggaccaaaatggtccgaatcgcctgataataaaaaactattcatttttattttttattttttttattaaacatgtgattaatgatagatcttacgattcgcaactgggaaacatgcactaactcaaacttaaaacacacaatactaaaagttctattaaattttgaatgtaaagagaaatatattaggcaatcaaacggtcaagtaaatcatacacatcgataatttatttttttatccttcaaagcaggcccatccaaggcccaccactattctcatatcaacatacttttcttgttttggttaaatcaacctaccatgttggctgttctctccgctcctctgtgtaagatcacaccaacaccactgcataatttcttgtattattttgagacttgagagtaaactgattgacaaaaaaaaaaaaaaaaaaaaaaaattgagagtaaactagtttcttgaatattgattttttcagcttaatttgttggggaaagatattactactattgctgtaaaaaaaaaaaaaaaaaaaaaagatattattactatatttgtagtgattttattttgaaaattctcttcacttttttgtagttaacattctaattttgtgaaaagaacttttaatgtcaggtcatgtctcttaaaaagtttgcatgatgaaatgatttacaaattacaatagaaaatggaaaccattgcaaactaaatttttatcaaaaaaaatcgaaaataaaatgtattgacttagtaatgctgtgtctgctacgattaactattacacataatgcaacactgaattatccaaatacattattagaataatagtattacagtatcactattacaacaacaatgtcaacaataatcttattataataatatataaatagaccttagtgacatcatattatatagaaaacatgtggttgcctaatttgtataagctagatacttgggggtgatgagtgactagttgatgcaatgataaaagagtgaaagttttgtctgcctgattatagacgtcggagaaatactaaaatacgctatgaagattttggcgcatggtagcagaaaaaaaaaacggagggtgtgagtgagtagtggtagtcggatgtgatggaacaaagaaaagtatttttggtagggttatgggagagagaaggggaccattattacacacttacatgctttccccaaaagataccattcccattttctgacacgtgtccccctcatccccaattactcatacgtcaaatccaatttttagcctaaaagttttttttatttgtttagccaaatctattttactaattaaagttttcaaatggcaaatagaaagatcttctaaggttttataaaattacttgattatttctagttttgctcattttttaaataaaatttctcttttttttcttgcaacattattgattttttttttgatagggagtaacattagtgatgttctatctcttctcattgcaaaaactttattttctcatctctatttgatcatcattgcgaaatcttccattttcaacaaatacttttccatgttaatatgctgtttcaaaatataagtgtttggaaaataaatcaacaagtttaaatgttaactatttttatgctattataattatttttcttatgggtaagtggaaattaatgttactcaaattggacataaaattctattgtttgagtgaaggagtttataaatggagcattattttcttgaatggttagtttttcttctatcattttgacaagtaaatgacttttcagccactaaagtacaacactttttcatttaaatttaaagcatcccctacattagattgtcattttatttctcataatgttatagaaaaatgaattttgagatcccaatgtagtaaatatatataaaaaaaggtttaatattgtcaatgacaaacaacgaacttatggaatttcaacttttcacctccacgcgcctctgtcagagttttttttttccccacttgtgatgtaaaaaggggaaaacgtctgtgtctcagtcggtaaactttttctctctttttttttttaaagattttattttaattatgccgtctctgtggtctaatcgtgtacgtcgtctggttttaaaagcctctctcactttggtcttttcgttttctctcttccattttctccaactatataaaaaaaaaaaagtgagagagagagcaaatctgtgtgatggaagttgctcttgagtttgggattatttatcttttcaatatcatttggtaagcatttttattttgttttatagtaataattttaactctcttatcttcttaataagtctttgcttaatagtgttttggggtcagcattaatttcccctgtttggtttccagaatataggttgtatagtgtgataataacaaattattccaagttttgcttcaaacattgtcaaagtttttgtcattttcatttcttgaaacggaaatttttcagactttgtaatttctaattcgaaaattcgacagatcttgtagatttgtttcgatcttttagagttttgaattggagagatttatgaaacgggttgatttt

SEQ ID NO: 4834 - DNA, 1109 bp, Brassica napus
  P5324 FRUIT VASCULAR TISSUE AND COLUMELLA, SEED AND ENDOSPERM SPECIFIC CRUCIFERIN PROM. DRIVER CONSTRUCT
ctacacgttttgaaaagttaacctgttggttaaatggttagctatgactctcgcaacaaacccaacccttaagatgatgatggtttaacatttgacaacatagttaagactgtgtctatataatagtcaacaaattcagattgtagtattatggagtcaacatatttcgagatcaaaaacattcaaaacgtaaatctatcgacgtctcacatagttttgttatgaagctgatgaaaaaagttggaagacatagttttgcaaacatcatttgttgctaacgtataaacgttggtttgattaaatgtaataggataaggatatccgtttgttcatataattgagttaaattatattttggttattataatatgttaagttgaaaataaataggtccaacaaccttgtttaaatagattttttaggagtgattcccttttaatagtatagattatactctcttcctaatcgaccttccgtggggtaaagtggtcaattatattctttatggatgagcttgattgagaatgggtttatgggttatgacaagggcatgtacaaatgtcactgcctcttgacatgcaaccgaacagttggcgactcaagtcgcagaagatacaacggaccaaaccctccgagtgtcgccgcgtctgttatgtgtcacctttttgtctcctttccttaaaaattggtaactcatttttcaaaaaaagaagaggatagttttggctgtatctcctaaactattcgatcacaacgccagatattttaatactggatactagtgatgtaatttgatttgttaattgtcaaaaagtagattctcctatctcgtttttagttcaattattatatggttaaatgaatttaagtcgattagaaatgattagttaatcaaccagagttgctctataagtctatactgataacatgaaccattttctaaaaatgagatagatacatttgaattttgtcgtggtttggagtatgcggagatagtcgtacgcgcatgaacatcatgagacacttgcttcagctcacagagtgacgtgtaaagaccatagacccacgacttcatgcaaacccattcctacgtggcacaaaccttcatg

SEQ ID NO: 4835 - DNA, 3446 bp, Arabidopsis thaliana
  P5326 FLORAL MERISTEM, STRESS INDUCIBLE-SPECIFIC AP1 PROM. DRIVER
cacggaccttggatctgaagttatgaacaataacatatttggcaaaacaaagaaaaaagaaacaacaatactaacatattttggtaaaagaacattgagaagtctcaaaaattaacttcttcttattttgtttcctaataagaccgtttgcttcatttcaagttcttaggaaataatttcatgtaacgtgtatgtagatatgtttatgtacagataaagagagatctgaaaatgatatatagagcttttgtggtgataagtgcaacaagcaggatatatatatcgaacgtggtggttagaagatagcgtcaaaatagatgctagctgctgcgtatacatcatattcatatcatatgtacttctcttttgtgatttctcatgtgattgaacatactacataaatcttgatagatttataaaaatgcaacaaattgttgtttatataagaaaaataaaacactgatatgatatttcattagttattatcaaatttgcaatataatgtttaacatccaagatttgttttacataatcgttacggttactaaagtttaatttatgatgttttaaaacaaattgagactaaatttctaaaagaaacatatacgtacatgtgtgtagctgcgtatatatatagaatggtggggctaaaagctaatgatgtgtacattaattggacatttgatgtggctggattggacccaacttgctctttgatagagacctaactaagacaattttgctcttcattcatttctcccgtatacataattgaattaactgtacataatgtttcacaacaagcgatctagctatatatttcaaaataacagagactgatattttaatctggtcttctaagctctaacgtcaaattaaaaaaaaaatccgatcttctaattaattagaagaaatcaattatagaacctctctctttaatttcatttatttaaaactgcttggaaatttaattattcactaaagactcactattctccttaatttatgataatttgtagatcatatgttcagtttttatttatttgccattcgaatgttgagttttaattaaaccaatatgttaatattcgaattaaaaaaacttacctataattcacttatttaaaaacataaaataataataattgcatcaccgtgatacaaagcaacctcacaagtcacaactctcgtgactacaaagatcactcattaaacaaaccttcctgccttctttttttctacttgggcacctcgaccgatcgaagactattcttgggatctgcttcaaaaacgactatatgttctaaatccacttcgtatgatgacgaacatttggtttactactgaagatagagattacgtccttctaattagaagtaattaattattttagtatttggaagctaatggtggagatgtaaccgtatcttagtggatcgagatattgtatataaaatatgtatgctacatcgaataataaactgaaagagagtaaaaagggatatttaatgggaagaaaagaagggtggagatgtaacaaaggcgaagataatggatattcttgggatgttgtcttcaaggccacgagcttagattcttttagttttgctcaatttgttaagtttctacttttccttttgttgcttactacttttgctcatgatctccatatacatatcatacatatatatagtatactatctttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagctcttctttatatctctcttgtagtttcttattgggggtctttgt

SEQ ID NO: 4836 - DNA, 1839 bp, Artificial Sequence
  P5486 HEMAGGLUTININ (HA) EPITOPE C-TERMINAL TAG, 35S, 35S promoter is from the Cauliflower mosaic virus
atggaagcgttaacggccaggcaacaagaggtgtttgatctcatccgtgatcacatcagccagacaggtatgccgccgacgcgtgcggaaatcgcgcagcgtttggggttccgttccccaaacgcggctgaagaacatctgaaggcgctggcacgcaaaggcgttattgaaattgtttccggcgcatcacgcgggattcgtctgttgcaagaagaggaagaagggttgccgctggtaggtcgtgtggctgccggtgaaccacttctggcgcaacagcatattgaaggtcattatcaggtcgatccttccttattcaagccgaatgctgatttcctgctgcgcgtcagcgggatgtcgatgaaagatatcggcattatggatggtgacttgctggcagtgcataaaactcaggatgtacgtaacggtcaggtcgttgtcgcacgtattgatgacgaggttaccgttaagcgcctgaaaaaacagggcaataaagtcgaactgttgccagaaaatagcgagtttaaaccaattgtcgtagatcttcgtcagcagagcttcaccattgaagggctggcggttggggttattcgcaacggcgactggctggaattccccaattttaatcaaagtgggaatattgctgatagcgcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagctgctgctgctgaggatcctgaagctcgaaaaacaaagaaaaaaatcaaagggattcagcaagccactgcaggagtctcacaagacacttcggaaaatcctaacaaaacaatagttcctgcagcattaccacagctcacccctaccttggtgtcactgctggaggtgattgaacccgaggtgttgtatgcaggatatgatagctctgttccagattcagcatggagaattatgaccacactcaacatgttaggtgggcgtcaagtgattgcagcagtgaaatgggcaaaggcgataccaggcttcagaaacttacacctggatgaccaaatgaccctgctacagtactcatggatgtttctcatggcatttgccctgggttggagatcatacagacaatcaagtggaaacctgctctgctttgctcctgatctgattattaatgagcagagaatgtctctaccctgcatgtatgaccaatgtaaacacatgctgtttgtctcctctgaattacaaagattgcaggtatcctatgaagagtatctctgtatgaaaaccttactgcttctctcctcagttcctaaggaaggtctgaagagccaagagttatttgatgagattcgaatgacttatatcaaagagctaggaaaagccatcgtcaaaagggaagggaactccagtcagaactggcaacggttttaccaactgacaaagcttctggactccatgcatgaggtggttgagaatctccttacctactgcttccagacatttttggataagaccatgagtattgaattcccagagatgttagctgaaatcatcactaatcagataccaaaatattcaaatggaaataccaaaaagcttctgtttcatcaaaaatga

SEQ ID NO: 4837 - DNA, 4276 bp, Cauliflower mosaic virus
  P6506 CONST. 35S PROM. DRIVER CONSTRUCT
catgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcggcggccgcaagacccttcctctatataaggaagttcatttcatttggagaggacacgctcgagtataagagctcatttttacaacaattaccaacaacaacaaacaacaaacaacattacaattacatttacaattaccatggaagcgttaacggccaggcaacaagaggtgtttgatctcatccgtgatcacatcagccagacaggtatgccgccgacgcgtgcggaaatcgcgcagcgtttggggttccgttccccaaacgcggctgaagaacatctgaaggcgctggcacgcaaaggcgttattgaaattgtttccggcgcatcacgcgggattcgtctgttgcaggaagaggaagaagggttgccgctggtaggtcgtgtggctgccggtgaaccacttctggcgcaacagcatattgaaggtcattatcaggtcgatccttccttattcaagccgaatgctgatttcctgctgcgcgtcagcgggatgtcgatgaaagatatcggcattatggatggtgacttgctggcagtgcataaaactcaggatgtacgtaacggtcaggtcgttgtcgcacgtattgatgacgaagttaccgttaagcgcctgaaaaaacagggcaataaagtcgaactgttgccagaaaatagcgagtttaaaccaattgtcgtagatcttcgtcagcagagcttcaccattgaagggctggcggttggggttattcgcaacggcgactggctggaattccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagctagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatctagaacatatccatatctaatcttacctcgactgctgtatataaaaccagtggttatatgtccagtactgctgtatataaaaccagtggttatatgtacagtacgtcgatcgatcgacgactgctgtatataaaaccagtggttatatgtacagtactgctgtatataaaaccagtggttatatgtacagtacgtcgaggggatgatcaagacccttcctctatataaggaagttcatttcatttggagaggacacgctcgagtataagagctcatttttacaacaattaccaacaacaacaaacaacaaacaacattacaattacatttacaattaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctagctagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatcgacctgca

SEQ ID NO: 4838 - DNA, 1510 bp, Arabidopsis thaliana
  P9002 STRESS INDUCIBLE RD29A PROM. DRIVER CONSTRUCT
ggttgctatggtagggactatggggttttcggattccggtggaagtgagtggggaggcagtggcggaggtaagggagttcaagattctggaactgaagatttggggttttgcttttgaatgtttgcgtttttgtatgatgcctctgtttgtgaactttgatgtattttatctttgtgtgaaaaagagattgggttaataaaatatttgcttttttggataagaaactcttttagcggcccattaataaaggttacaaatgcaaaatcatgttagcgtcagatatttaattattcgaagatgattgtgatagatttaaaattatcctagtcaaaaagaaagagtaggttgagcagaaacagtgacatctgttgtttgtaccatacaaattagtttagattattggttaacatgttaaatggctatgcatgtgacatttagaccttatcggaattaatttgtagaattattaattaagatgttgattagttcaaacaaaaattttatattaaaaaatgtaaacgaatattttgtatgttcagtgaaagtaaaacaaattaaattaacaagaaacttatagaagaaaatttttactatttaagagaaagaaaaaaatctatcatttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttccttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagttttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctat

SEQ ID NO: 4839 - DNA, 1302 bp, Oryza sativa
  Predicted polypeptide sequence is orthologous to G1006, G22, G28
gacaattccgctagtccgagtcaaaacaaaatcaaattcaaattcacgggataattcaaagatgctgcttaatcaggcgtcgagagaggtggccgcgctggacagcatccggcaccacctcctggaggaggaggaggagacgccggcgacggcgccggcgccgacgcggcggccggtgtactgccggagctcaagcttcggcagcctcgtggccgaccagtggagcgagtcgctgccgttccggcccaacgacgccgaggacatggtcgtgtacggcgccctccgcgacgccttctcctccggctggctccccgacggctcattcgccgccgtcaagccggagtcgcaggactcctacgacgggtcctccatcggcagcttcctcgcgtcgtcgtcgtccgaggcggggacgcccggggaggtgacgtcgacggaggcgacggtgacgccggggatcagggagggcgagggcgaggccgtggcggtggcgtcgagggggaagcactaccgcggggtgaggcagcggccgtggggcaagttcgcggcggagatcagggacccggccaagaacggcgcgcgcgtgtggctcggcacgttcgactccgccgaggaggccgccgtggcgtacgaccgcgccgcctaccgcatgcgcggctcacgcgcgctcctcaacttcccgctccgcatcggctccgagatcgccgccgcggccgccgccgccgccgcgggcaacaagcggccatatcccgacccggcgagctccggctcttcttccccttcatcctcttcctcctcgtcgtcgtcttcctcctccgggtcaccgaagcggaggaagagaggcgaggccgcggccgcgtccatggccatggcactggttccaccaccgccaccaccggcgcaggcaccggtgcagctcgccctcccggcccagccatggttcgccgccggtccgatccagcagctggtgagctaagtggcgatgtggtagtggtagtggtgatttagccatcttgtgcgactgtgcgtgatcgattgctgcttgatgggtcgagcaagttcagaacagagcatcactctctgcagaatagaagaagttcatgaacagagcaatgcactgctccaagaaatgtgacgagttccaggcaatcacgccattgttcttggatgattgcgcagcaccagaaaaaagggaaaaaaaagattgtttgtgaaatgtggtgaggttttgtaagacttgcacaaaatttgagaaaaagaaaaagatcaatacatataaaatcttactagaaaaaagactttccc

SEQ ID NO: 4840 - DNA, 957 bp, Oryza sativa; identical to SEQ ID NO: 2173
  Predicted polypeptide sequence is orthologous to G1006, G22, G28

SEQ ID NO: 4841 - DNA, 810 bp, Oryza sativa
  Predicted polypeptide sequence is orthologous to G1006, G22, G28
cggccgaatcctttgtgaccacgcgtcgcacactgcaaactactctctcggtctctccatccatccacctctctcgatcgtctcatgagctagcgcgccccgcgcgtacagccccgcatgtctctctccttggggtttagcgccggcgccggcgtcggtgccgatcgcctcgccgccgcgcccgcgctccaggccgccggtgctctgccgccacgcgtggacgtgtctctgtcgctggcgcgcgcggccaacgggcagccgtcgtcgtacctcccgctcaacgagaacgactcgctggacatggtcctcttcgacgtcctccgcgaggcctccgcggtggcggcgctgtcgtcgtcgtcgtcgtcgtcgccggagctgggcgcgcggacgacggcgccggtggtcgccggccaccccgccgggcgcaagggtggcggcggcggaggcggaggcaggggagcggcggcgaggggcggcgccgctggcgggcggcactaccgcggtgtgaggcggcggccgtgggggaagtacgccgcggagatccgtgacccgacgcggcacggcgcgcggctgtggctcggcaccttcggcacggccgaggaggccgccgcggcgtacgaccgcgccgcgttccgcatgcggggcgccaaggcgctgctcaactttcccgacggattgtgccggtgaacgggcccggttcgaggccagcggggcccggaagcaggtcggatgaacgaaggtaaatgcgtaaataacttgagaaccattggactgtacaggcgtagaaaggggtcaaaccaggttattgga

SEQ ID NO: 4842 - DNA, 291 bp, Oryza sativa
  misc_feature (2)..(2): n is a, c, g, or t
  misc_feature (4)..(4): n is a, c, g, or t
  misc_feature (15)..(16): n is a, c, g, or t
  misc_feature (37)..(37): n is a, c, g, or t
  misc_feature (54)..(54): n is a, c, g, or t
  misc_feature (69)..(69): n is a, c, g, or t
  misc_feature (75)..(75): n is a, c, g, or t
  misc_feature (95)..(95): n is a, c, g, or t
  misc_feature (104)..(104): n is a, c, g, or t
  misc_feature (107)..(107): n is a, c, g, or t
  misc_feature (110)..(110): n is a, c, g, or t
  misc_feature (114)..(114): n is a, c, g, or t
  misc_feature (116)..(116): n is a, c, g, or t
  misc_feature (127)..(127): n is a, c, g, or t
  misc_feature (130)..(130): n is a, c, g, or t
  misc_feature (189)..(189): n is a, c, g, or t
  misc_feature (200)..(200): n is a, c, g, or t
  misc_feature (206)..(206): n is a, c, g, or t
  misc_feature (217)..(217): n is a, c, g, or t
  misc_feature (220)..(220): n is a, c, g, or t
  misc_feature (237)..(237): n is a, c, g, or t
  Predicted polypeptide sequence is orthologous to G1033
angnacggttcgccnntttataaaccaaattccccancggcggttcgttcttgncgatcccgagggctngagatnaaggcgaggtcgaggtccancaattgcgnctncanggtntnggtgaggaagnccnaggcggagaaggacccgaacaagccgaagaggccaccgagcgcgttcttcgtgttcatngagcagttcangaaggncttcaaggagnagnaccccaacgtcaagcangtcttggtgatttgcaaggcttgtggtgacaagtggaagtccatgacttatgct

SEQ ID NO: 4843 - DNA, 730 bp, Oryza sativa
  Predicted polypeptide sequence is orthologous to G1033
aattcccctctcctcttcgctctcatctccgcttccagccagccactgcaaccctaaccctccgcaaagccctaccccccttccgccaccatgggcaaggccgacgccgacgccgagttcaaggccgccggcaagcgcaagaaggccggaggcgccggcaagcccaagcgcggcctcaccccgttcttcgccttcctggctgagttcaggccgcagtacatggagaagcacccaaacaccaagggcgtcgcagcggtgaccaaggctgccggggagaagtggcgcgctatgtcggacgaggttagcagatgctggcagttgttgtactagcacgctttattatgcttctgtgcggggattcccgcaactgatatttgcacgtccaataagctgattacacttgtcgcatatcatgtgaaaaagcatattatatgcagttttctgagcttttagcagttattattagttatgacctgacgctttataaccacaaattatgccattcttcttcagtacacgtgctgtacagtggctttattgtctgttgcaacatgtatcgatccttagcatgcctgtgcagcaaagctatctagagtgctagctagactcatccatggtccatggatcacatcaagctcttacaggtaatgggtggagattctatacagctgtgaggttctttgagccatgtttttgggagaatgcactataggaaataaaatcacttgac

SEQ ID NO: 4844 - DNA, 957 bp, Oryza sativa
  Predicted polypeptide sequence is orthologous to G1033
atcggccattatggccggggagaagtgggcgctatgtcggacgaggagaaagcgcaatatgggggcaagaagccagatggcgagagcaagccgccggcaagcgcaagaaggccggaggcgccggcaagcccaagcgcggcctcaccccgttcttcgccttcctggctgagttcaggccgcagtacatggagaagcacccaaacaccaagggcgtcgcagcggtgaccaaggctgccggggagaagtggcgcgctatgtcggacgaggagaaagcgcaatatgggggcaagaagccagatggcgagagcaagcccgcggccgctagcaagaagaaggagagcactagctctaagaaggctaaaactgatggtgcggaacaggagggagaaggttctgacaagtcgaagtctgatgttgaggatgatgagaatgatggcagtggcgaggacgagtagtagtaaatagcttagagagctgcagctatgcaaatcggtgttcactgcttagggctttagctttgctatgttactgttatccttgttatgtcctgttgtaaggaaaacgtgcgaatgaaggtactcctgtgacgtggaatgctggaggtgactctgtttaactagtagcgaaaaaatggcgaatatgttgactggtttctttgagaactcggaggtttttaactatttggtataccggcttgtaataagcggaatgggtttacaaacaacctacgctgtaacaagttgcggctggcgagcattacatgcacactctttcggcgaagcacgggaatgccacggggttaccggggcaacggggggtgaggcactaagcggccccgcatacgagtccacggtcgtatggacactaggtcgcgccgcagcacaggtggcggatgtgaccgaggagtacgtgagacgtggacgtgcaagatgtgaagttagtgtggtgatacacacg

SEQ ID NO: 4845 - DNA, 1041 bp, Oryza sativa
  Predicted polypeptide sequence is orthologous to G1033
agagtgtactgggtcggtcggaatcctgggtgaccacgcgtcgccacgcgtcgcacgaacgcttcgccgcttgataaccaaatccccaccaccaccaccgccgcttcgttctcgccgatccggagggctcgagatgaaggcgaggtcgaggtccagcaatggcgactccaggctctcggtgaggaagaccaaggcggagaaggacccgaacaagccgaagaggccaccgagcgcgttcttcgtgttcatggagcagttcaggaaggactacaaggagaagcaccccaacgtcaagcaggtctcggtgattggcaaggctggtggtgacaagtggaagtccatgactgatgctgacaaggctcctttcgtgaccaaggctgagaagctcaaggctgagtacaccaagaagattgacgcctacaacaacaagcaggcaggaggcccggctacctcaggcgactctgacaagtccaagtccgaggtgaacgacgaggacgagggcagcggtgacgagtgatcgatggagctcccgcctccacagggctgcaggtagtagggaaagttctctcgagtcggcctaaccaaagtggacgttgctggttgctgctccttgctagtgttcggatgttgctgcctttagctttttagtcttagaggtctcatcctgtagcttagctctcatgtggtgtcctcgctctcttcggcacttgaccaccatcttgtcgtctgttttgtctcactgtctgtaatctaagtgagtactcgtatctgttgctgttttaaatctcagatctcagtagatggtgccatctgtgttagttgctgaagaggaaacggaacatattaccagtctcttgcttcctgtgtagacaagatagaagataacacaaagaaagagtgagaatacagttaccaaaagacaacaatggggggccggtcaaaaggtcccaggttacgaagcgtttattggaggtatagagcctctaaaggggaccgaaattacgatcaggggcgcggtttaaaaggtgtgatgtgaaaccg

SEQ ID NO: 4846 - DNA, 1124 bp, Oryza sativa
  misc_feature (840)..(840): n is a, c, g, or t
  misc_feature (853)..(853): n is a, c, g, or t
  misc_feature (988)..(989): n is a, c, g, or t
  misc_feature (991)..(991): n is a, c, g, or t
  Predicted polypeptide sequence is orthologous to G1033
ctgaggtacggtcggaatccgggtcgaccacgcgtcgccacgcgtcgcgcctctcctcctccgctgcacccccgcaaaaaccctagcgcaccgacttcgcgatctccgcgccgcagccatgaagggcaagcgcgacgcctccaagaagggcgagggcaggctcaaggccgccggcggcgccgggaagcggaagaaggccgccgctagcggcaagccgaagcgcccgccgtctgctttcttcgtcttcatgtctgagttcaggcaggagtaccaggcagcgcatcctgacaacaagagtgtcgccgccgtgagcaaggctgcaggggagaagtggcgagctatgtctgagcaagagaaggcaccttatgtggacaaggctggccaaaagaagcaggactacgagaagaccaaggccaacttcgataagaaggagagcacaagctcaaagaaagctaagacccatgatgatggagaaggctctgacaagtccaagtctgaggtcgacgatgaccaggatggtggtagcgatgaggaaaatgaggacgatgaagagtaaatagtgtatccgggggcatgaggtagcaaactgtgtcttaggtcccctattagctttactagtttgctatcttcgaccctaagatgttgggaataggcgtgcgtgggtgtgaagggggaccggttagaattatggtactcagaatgttttcttacagtggattagcaaagaaaaagcctgaatgccggctgctgttctggtgctttctttggctaaccctggttccgaacttggtttcttggctaactattaccatcgattaacacaaaaaaggggggcgatcnaggtccactaatnagcggtgaggacctgagctctttagagggccactactacgggccgcgcaacagctgggaacagttcacctttgtggaactctcggctgaaaacagcccacatgggggctctttgttgttgcttctatctctaagnnanagatgaaagagcaaagcgatgaaatgagactactacgatcacgattctataaacgtgtagatcagtcattaacctagctatgagagcatctacacttgctagtcacatcagtatacgatacatcacactcatc

SEQ ID NO: 4847 - DNA, 1221 bp, Oryza sativa
  Predicted polypeptide sequence is orthologous to G1033
cactcagaaaccaatctaatacagtgtgctgaggtacggtcggaatcctgggtcgaccacgcgtacggtgggtagttacctatctcccctacttcctcctctcctttccctcctctcttcccccctctcacaattagagagagagcgccagactctccccaggattccgccatgaagggggccaaatccaatggcgccgccaagcccgacgccaagttggctgtgaagagtaagggcgcggagaagcccgccgccaagggcaggaaggggaaggccggcaaggaccccaacaagcccaagagggctccctccgctttcttcgtttttatggaggagttccgtaaggagttcaaggagaagaaccccaagaataaatctgtcgctgctgtaggaaaagcagccggtgataggtggacatccctgaccgaagcggaccaggctccctatgtagccaaggacaacaagctcaaggccgagtacaacaaggccattgctgcctacaacaagggcgagagcactgccaagaaggcacccgccacagacgaagaggacgacgaccaggaggactctgacacgtacaagtccgaggtcaatgatgacgatgacgacgagggccacgaacaggatgagacgaataccagtgagcctcccatcgccaccatggccaccccacaccctatgccggacggagtcctaaggaccctaccctcaatcacccctcgctcataacatatccgcttcaatcatcttcaataaaactttactcactcaacgaagccccttttacccataattatacaaacaaacatcacaccaaaactaccaaacatacatacaacacaaaacatccataacacacaccacaacacacacaccatcacactacccacactcacaaaaaccaaaccacacaaccaaaacccaacacacaaaaaactaaccacaaaacaaaacaacactcccacacaaaccactcaaaacatatcaaatccttaataaatccatcacctcaacgaaaccacccaagaaacaacaaataaatgaataacatacagacaaagaaacaacacccaaaaaaacaaaccaccacaaccatcacaagatacaataacacacataacatatcactaaacacctacacaaatccaacaacataaattacaataccataaaactatataaaccacacacccctacacgaaagctcaaaacagacgaaca

SEQ ID NO: 4848 - DNA, 269 bp, Oryza sativa
  misc_feature (246)..(246): n is a, c, g, or t
  Predicted polypeptide sequence is orthologous to G1048
gagcagccggagggatgctctgtcatgtgatcgaacagctgccgtacgtgcctcggaaatcggaataattaaacgcgttaattacttatgtctggtagtggtatttttttcttaattaaatcatgtaattttattaattgtctatattactacacatgtaatttgttgtgtgtatacagtatatacatgtatgtaatttgttgtctatatatttgacatgtatatatattttgctcaacgcagttnccagctaaaaaaaaaaaaaaaaa

SEQ ID NO: 4849 - DNA, 1128 bp, Oryza sativa
  Predicted polypeptide sequence is orthologous to G1048
gagagacaaaaatatctccatcgcgatctccatggatgtagagttcttcgccgacctcgacctcgacgcgctcctcgcctccttctcctcctccgccgccgccgccggctccggcgtctcgggcctcttcgccccgtcaccgccgcacgatgcggaggcggggtcgccggagtcggtgagctcccggcggcccagcccttcccgggaggcggcgctgtcggaggtcgagaggttcctgatggaggagggccccgcggcggaggagggggtcggcgcggaggatttcttcgacgcgctgctcgtcgacggcggggaggaggaggaggaagaagaggggaaggggagtgaggcggggggaagcacggatggggattccgggaaggagaatgaggtggctaccccggacgcggagaaggaggatgtggaggcggaggtggatggcgatgatcccatgagcaagaagaagaggaggcagatgagaaatagggattctgccatgaaatcgagggagaggaagaagatgtatgttaaggacctagagactaagagcaagtatctagaggccgagtgtcgtcgcctcagctacgcgcttcagtgctgcgcagctgagaacatggcgctgcgccagagcttgttgaaggataggcctgtcggtgccgccacagccatgcaggagtctgccgtactcacggaaaccctgccgctggtttccctgctttggctcgtgagcatcgtgtgcctactcccggtgcccggtctacccaaccgaaacccggtggctcgaagcagcgccggaagagatctcgcgacggtaaccggaaagaagacaagcagtgaacaacagctagaagaaacattactactccatgggaggcgttggaagggctcgagggcgaggatcaagctagataccggaccgttccgtttagcagcagctgcttgctaggctgccgcttccttgcaaagttgtttccagtctgtattgtagctagcaaatcaaattggcgtgtctatcgcctgtcgtgctgccgcttatccatggactatctttttccttttttggttccctccccccttgtttttataatatcctcctatgcataatgcattatccaggtagttttgaag

SEQ ID NO: 4850 - DNA, 1656 bp, Oryza sativa
  Predicted polypeptide sequence is orthologous to G1053
atccgatcacacacacaccatagccaaaaaaaacacaatcactcgaccaaaccacacctagctactacaaagctagtgatcataagctaaccttaattagctttaattagccaagaagagacaaagagcaagatcgatcatgtaccaccaccaccatggcggccatggcgaggtggcgagcctccacctcctctcgcctccaaaccctcccttcttcggcgccgccgcgcaccaccaccaccaccaccacggcctcatcaacatggcgctgccgcctcaggcctacttcgtccccgccgcgccgccgccgccgttccaagaagccactgctgcgctcgccgccggcgacgacgccaccgccgcgttggcggtgtttgagctggagcgcatcctggaagaagcggccgccgcgggcggcggcggcggcaatggctcaccgagctcgggctccgacgggtgctgctacggcctgcagggcgtggctccggcggcggaggaggagcggcggcggcggcggatggtgtcgaaccgggagtcggcgcggcggtcgcggatgcgcaagcagcggcagctcagcgagctgtgggcgcaggtcgagcacctccgcggcgccaaccgccgcctcctcgacgagctcaaccacgcattgaggggctgcgccgacgtccgccgcgagaactcccgcctccgggacgagaaggccgagctcgccggcaagctccagctgctgctcccgcggcagccggcgccggagaagaacgccgccgacgaccagagtagctgctcctcggagccatgcaagaacagcactacgactaccgctgctgaatgaattatattattcattattattattattatccaccaaattttcacttgagaggataataatattaacaataatatgtttatcaataagaaaacgtgtataactaaacaaggataattactggggatggaggcatgcatgcatgcatgcgccatgagatcgatttttctgtttcgaggaggtttttgctgtgtatttttacaactaattatatacttatacctgcggttaaattaacatggatcaatggatcatatatattatttctatttacaagttgcaaaactgcagttaatagaacactagtaagacaaaatgatggggtagaagaggcatgtacaactctaaaagtagtagactacttgtcaaaacgttgtgcaactatgaagttaaaaaaaatagtgcctttcatgtaatgatgtcacggggttcaactaacttgtaatggattatgctttgggattgctaatggatggcatactttcttgatgttaagttacccataataacccaactgctgctgctctgttctgtagttcattagctattttacctagttgtatcaaacaaggttctggatgtgtatcaaacaattttggtactcctatatgaatgttcccatcaagatctgaaccacatattcctattcattgagatgcttatcgaataggattccaaagaatcttaaggacgagcccggcaacatgtgccacgaaacaaatctaggcttttgtcaatacataaacgtgagtgttcatcaaaacaaacgagcaaattcaaaaacatagcatatatatatatatataagacaaaaaaaaaataaatat

SEQ ID NO: 4851 - DNA, 1961 bp, Oryza sativa
  Predicted polypeptide sequence is orthologous to G1062
gcacctctgcatctctgccatctccttccccaccccaccgccattgccgccgcggcgatgctgccgcggtttcacggcgccatgtggatgcaggacgacggcggcggcgaccaagaacacgggcaggcggcgccgcctgggcaggagcagcaccaccacgaccagcatctcatggcgttggcggccgcggccgcgggcggcgccgggttcggcgcggcgcaggcgccggcgccgctgctcgatgaggactggtacttcgacgcggcgggtggtggtggtggtggcgcgcatgggtccatgatgctgggtttgtcgtccgtccatggcgggattggggcggggacgtctggtggtgggcatgggcagcagttctcgctgctcaacatgggcgccgcggccgcgccgttcgacgtctccgggttcgacctcgggatcgcctgcggcggcgttggcggcggcggcgacgtggtgtcgtttcttggcggcgggaacgcgtcgaacaccgcgctgctccccgtcgggaacgcggggttcctcggcacgttcggcgggttcggcaccgcggcgtcccaaacgccggagttcggcgggctcgccgggttcgacatgttcgacgcgggcgccgtgaacaccgggggcagctcctcctcctcgtcggcggcggcggcggcggcgtccgcctcggcgcacgtgagcaacaccgcgccgttctccgggcgcggcaaggcggcggtgctgcggccgctggatatcgtcccgcccgtgggcgcgcagccgacgctgttccagaagcgcgcgctccgccgcaacgccggcgaggacgacgacgacaagaagcgcaaggccgccgcgggcgcgggcgcgggcgcgctgtccgccgacggcgccgacatggtgctcgacgacggcgacgacgacggcctcagcatcgacgcgtcgggcggcctcaactacgactccgaggacgccaggggcggcgaggacagcggcgccaagaaggagtcgaacgccaacagcacggtcaccggcgacgggaaggggaagaagaaggggatgccggccaagaacctcatggcggagcgccgccgccggaagaagctcaacgaccgcctctacatgctccgctccgtcgtgcccaagatcagcaagatggacagggcttccattctcggcgacgcgattgagtacctgaaggagctgctgcagaagatcaatgatcttcagaatgagctcgagtcgtcccccgcgacgtcgtcattgcctccaacacccacaagcttccatcccctgacaccgacgctgcccacattgccgtcccgcatcaaggaagagatctgcccaagtgcattgccaagccccactggacaacagccaagggttgaggttaggctgagggaaggccgggctgtcaatatccacatgttctgtgctcggaggcccggtctactgctctctgccatgagggccgtcgaaggccttggtctcgatgtccagcaagctgtaatcagttgcttcaatggctttacgttggatatttttaaggctgagcaatgcaaggacggccctgggctgttgcctgaagaaatcaaggccgttctgatgcaatccgccgggctccataccatgatctaggacaggagagctcaatcaaactccaaaggacagagtagctcaggaattgacaaagtaccggtgtttcctggtcatgtggcattttcgacagaaggaagttcctctttttagtagttttagacctgctcagggcttgctgaaccagtttatcttctagtatttagagtccccaaaaaaaataatgtcagtagtctcttggtgctttaacattgtgttttgaaaccttctgcctgttttttttacttcccggtacatgttttcgtcttgtgtaagtctgaagatgaattcctatcaattaacaggcaaagaaacaggatcattccaagaac

SEQ ID NO: 4852 - DNA, 1493 bp, Oryza sativa
  Predicted polypeptide sequence is orthologous to G1062
gggactcctcttctcttctcttctcttctcagagcgctgcgaggttgccatggacgaggcggaggcggcggcggcggcggcgaagatggacgagctggcgggaggaggaggaggaggcggcggcgactggtcgtacctcgcggcggacgcgctggcggcggcgtcgttcacggcgttcccgttccaccaccaccaccaccaccaccaccgcgacgtgctctcggcgtcgaccccgtcgtcgctgctcctcaacatggacgcggccaccgccgcggccatgttcgacttccaggcggccttcccgtcgtcctccgtcccgccgccgccgcccacgacgacggcggcgctcccgccgttccacgacttcgcctcctccaacccgttcgacgacgcgccgcccccgttcctcgcgccgccggggcagaagctcgggttcctggggccccccggcggcgcgttcggcggcgggatggggtgggacgacgacgacgagatcgagcagagcgtggacgcctcgtccatgggtgtctcggcctcgctggagaatgccgcgcccgtggcggccggaggaggcggcggcggtggcggcggcggtgggaggggcaagaagaaggggatgccggccaagaacctcatggcggagcggcggcgcaggaagaagctcaacgaccgcctctacatgctgcgctccgtggtgcccaagatcagcaagatggacagagcttctatccttggtgatgcaattgagtacttgaaggagctcctgcagaggattaacgatcttcacaatgaacttgagtctgctcctagctcttcgcttactggaccatcatcggctagcttccacccatcaacacccacattgcagacgtttcctggccgcgttaaggaggaactttgcccaacctcatttccaagccctagtggtcaacaagccacggtcgaagttaggatgagggaaggtcatgcagtcaatatccacatgttctgcgcacgcaggcccggcattctgatgtccacattgagggctctcgacagccttggcctcgggatcgagcaggcggtcatcagctgtttcaatgggtttgcaatggatgttttccgcgccgagcaatgcagggatggtcctggactcgggcctgaagaaattaagaccgtgctcctgcactctgctggccttcagaacgcaatgtaatcagcaagtcagaaagcagtcaagaccaatgcactgggatttgatcagtgatcatttgcatcagatgatctggtttatcaaaaagttatagtaagtatggcatatatgctgtttatctaggagaactgatgagatgaggctcgccatctagagacatgtgtgatgatgatgatgtaactgggtttctttctttctgttgtcgtttttttttctgaatgttgtttgtgatgtaataggatctttgtccattgaaaccatgtccattatcatgatgagaatatgaacccagtgtcttttg

SEQ ID NO: 4853 - DNA, 1368 bp, Oryza sativa
  Predicted polypeptide sequence is orthologous to G1067, G2156
ataccagtagcagctaattaagtgggtgggttcgcttgcttgctttgcttttgcttggagacgggagcgacgctggcttcagcgattggcgtggagaagctagattgttggtgcgactttccgaccgcgaaaatagtagggctggcaaaccggtggccggccggcgatccggccgaggggatggggagcatcgacggccactcgctgcagcagcatcaggggtactcccacggcggcggcgcgggagggagcaacgaggaggaggaggcgtcgccgccgcccggcggtggctcggctacggggtcggcgggccgccggccgagggggaggccgccgggctccaagaacaagccgaagccgcccgtcgtggtgacgcgggagagccccaacgcgatgcgttcccacgtgctggagatcgccagcggcgccgacatcgtcgaggccatcgcgggcttctcccgccgcaggcagcgcggcgtctccgtgctcagcgggagcggcgccgtcaccaacgtcacgctccggcagcccgcggggactggggccgccgccgtcgcgctgcgggggaggttcgagatattgtccatgtctggcgccttcctcccggcgccggcgccgccaggggccacggggctcgccgtgtacctcgccggcgggcaggggcaggtggtgggtgggagcgtcatgggggagctgatcgcgtcgggccccgtcatggtgatcgcggccacgttcggcaacgccacgtacgagaggctgccgctggaccaggaaggcgaggagggcgccgtgctgtccgggtcggagggcgccgccgcgcagatggagcagcagagcagcggaggcgccgtcgtgcccccgccgatgtacgccgccgtccagcagacgccgccgcacgacatgttcgggcagtgggggcatgcagcggtggctcggccgccgccgacatcgttctagcactggcaccggttaatcaatgtctctctacctagctagttagccttccacttctttccctagttgtttgagtaggttaattaatcatttaccatgttaattaatgtgctatgtaatgcataagtactcgtgtgatcttatcgttccattttcttcagagtttgaagaatgtaaaattactgtgcgtatcaagatcggcagtggttgctcacttgctccttcactagctatctgctcgatcataagctcttgcatcttgttcttcgcaagcaccaattcacgcttgtgtcaattgcttggtcattttgcatactttggactactcgatcactacaaaatatttcttgagttttactccctgcatgcactgctcaatgcgtgattatgcctgaatacactaattgttttgtt

SEQ ID NO: 4854 - DNA, 1011 bp, Oryza sativa
  Predicted polypeptide sequence is orthologous to G1067, G2156
atggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgccgcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggacccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctga

SEQ ID NO: 4855 - DNA, 1291 bp, Oryza sativa
  Predicted polypeptide sequence is orthologous to G1076
cacacaaaccctaaacaaacacacacacacacacacacacacacacactctctctctcttctcctctcttctcctattatcatcatcatcatcatcatcatcatcacttgcatatcgaattattaataatatcgatggcaggccttgatttgggcaccagctacctccaccaccaccaatcactgcatctccgccacgacgatggcggcgccggctccgacgacggcggccacgacgacctctcgccggggagcggcggtggcggcgggcccagcagcacggccggtggcgccgggatcggcggcggcgaggtcgtcgctcgccgcccccgcggccgcccgccgggctccaagaacaagcccaagccgccggtgatcatcaccagggagagcgccaacgcgctcagggcgcatatcctcgaggtagccgccggttgcgatgtgttcgaggcgctgacggcgtacgcgtgccgccggcagcgcggggtgtgcgtgctctcggcggcggggacagtggcgaacgtcacgctccggcagccgcagtcggcgcagcccgggccggcctcgccggcggtggcgacgctgcacggcaggttcgagatactctccctcgcgggctccttcctgcccccgcccgcgccgccgggcgccaccagcctcgccgcgttcctcgccggcgggcaggggcaggtcgtcggtggcagcgtcgccggcgcgctcatcgcggcggggcccgtcgtcgtcgtcgccgcgtcgttcagcaacgtggcgtacgagaggctgccgctcgaggacggcgacgaggtggtccccccggcgccggcagggagcgaccagggcggcggcggcagcggcggcatgccaccattaggcgttgatccgtcgggcggcgccgccaccggtgggctcccgttcttcaacatgccgttcgggatgccgccaatgccggtggacggccacgccggctggcctggcgccggcgtcgggaggccaccgttctcatgatggatggatccccatattccggcgagcggccggcggcgaggtggtcggcaagattgaagacatggacatggacatgtacaacaacaagtagcctttcttatctctgaatctttttctcctcttgttcgatctctgtgatgtctgtctttgtgatcttttcgtgatgttttttgtgttaacctgtatgagagtacttgtgttaattgtttcagtcaggtgtctttgctgcttcgaatgtgttgtgaggacatgcactcataaattgatcaaatcaattattattgtct

SEQ ID NO: 4856 - DNA, 916 bp, Oryza sativa
  Predicted polypeptide sequence is orthologous to G1076
ctcacttagcagaaatcctccgcctccatccctcatcgaagttggctccctcttccccgcctccatgactgccgccaccacgacgactaccgcgaccacgacgcgaggacaacgacgacgactgtcgcgaggatgacaacgacacgacgacggtgccgatgcctgtgggggtggcggcggacggaggagagctgtcatcggcatgagagagaggccggcggcagcggtgtggaacttggcacctgacacagggctgcatctgtttagttcgattttcggcgaagaggtaagtcctacgtttcgccggccctggtgaatctatcggctacgttggcgttgttcaaggctacatctgtatattcgacctcttggattgctctggttcggttgatatttttgcctaccaatttatcatgtctctgttaatctagtcttagcatatcgatttagctctatccgctgcttctcgctttagggtttctgccagtatcggctaaatcgtcttgctagattagattatcttggacatctaccaccctaaaaatcagtcaatggcttgattgtatagatattatgtttcttttcatacttagtgctgcatcagttaagtttgatatactaagccgtgcttagagccatgatccctagcctgcttcttgattacctagtgctgcatcagttaagtttgatctactaagccgtgcttagagtcatgatccctagcctgcttctttgattgcaaataagggtttcattggggtttcagccgataaggtatctggatgttgtatcagcttacaaggattacatatagattagatttagccgatgacaataaagattttattatttatctaatattgtggattttatgacatcggatcttcatcttcagccgatgaatactttaaccttc

SEQ ID NO: 4857 - DNA, 918 bp, Oryza sativa; identical to SEQ ID NO: 1805
  Predicted polypeptide sequence is orthologous to G1076

SEQ ID NO: 4858 - DNA, 456 bp, Oryza sativa
  misc_feature (388)..(388): n is a, c, g, or t
  Predicted polypeptide sequence is orthologous to G1076
ttaatttctctctctgtttgcttctctgtgcatccaaaaattttaaaaacaaggaggagtataaacaactcccccactttaaaaatcattgcttccttttccaacaccgccttttaaccctaaaaacaaaacaccacccctgttccaattcggtttttttcctctcttttttctccactttttttttagattttaaattttttttgctagagctagagaggcgctctgctgctgctacatcagtacatgagctagtggagaagcatggcaggtctcgacctcggcaccgccgcgacgcgctacgtccaccagctccaccacctccaccccgacctccagctgcagcacagctacgccaagcagcacgagccgtccgacgacgaccccnacggcagcggcggcggcggcaacagcaacggcgggccgtacggggaccatgacggcgggtcctcgtcg

SEQ ID NO: 4859 - DNA, 2575 bp, Oryza sativa
  Predicted polypeptide sequence is orthologous to G1078
atggggtgcacggcgtcgaaggtggagcaggaggacacggtgcggcggtgcaaggagcggcggcggcacatgaaggaggcggtggcgtcgcggcagcagctggcgtcggcgcacgccgactacctccgctccctccgcctcaccgccgccgcgctctcccgcttcgcgcagggccacccgtcgctcgccgtgtcgcaccacaccgcgccggtgctcctcaccacggccgcgcccgcgctggcgccgacgccgacgccgccgccgccgtcatccacggcgtcgtcctcgctcccgccaccgacgccgctgctccccaagcaccagcaggcgccgccgccgccaccgcccacgcagtcgcatcagccgcctcctcccgtggcggtgagggctccccgcggcgggccgcgtcgcctcaaggtgccgcacatcctgtccgactccagcgtcgccagcccggcgcggtcgtcgttccggaagccggtggtggggacgccgtcgtcgtcgtcggcgtgggactgggagaacttctacccgccgtcgccgccggactccgagttcttcgaccgccgcaaggccgacctcgaggaggccaaccgcctccgcgagctcgaggaggaggagaaggcccggggctacctccacccccaccacctcaaggaagaggacgaggtcgacgacgacgacgacgagagggaggaggagatgcattgcggcggatgggaggacgacgacgaccactacgcgtcgacgaccacctcggagaccagatcggaggagggggaaatggggaacagatcggagtgcggcttcgcggccagatcggagtacggcggcacggcgccgtcggagtacgccgccgcgccgctgccactgccgctgaggaggagggacgagaggtcggaggccggggactcctcctccacggtcacggcggccgccgagatgcggatggtgatccgccaccgcacgctggcggagatcgtggccgccatcgaggagtactttgtcaaggcggccgaggccggcaatggcgtctcggagctcctggaggctagccgcgcgcagctggaccgcaacttccggcagctcaaaaagacggtgtaccactcgaacagcttgctatcgtcgctgtcgtcgacatggacttcaaagccaccattggctgttcgctacaagttggacaccaatgcgttagagatggagtcaatggaagggaagagccatgggtcgacactggagcgtcttttggcctgggagaaaaagctctatcaggaggtcaaggctagagagagcgttaagattgagcacgagaagaagctttctactctgcagagcctggagtacagagggagggatagtaccaagctggataagaccaaggcctccataaacaagctgcaatcgttgatcatcgtgacttcacaggccgcaactaccacatcctcagccattgtcagggtgcgtgacaatgagcttgcaccacagcttgtcgagctttgcttcgcgctgttgagcatgtggagatcaatgaaccatttccatgagatccagaatgaaattgttcagcaagtccgtggtctggtagacaattccatggctgagtcaacatctgatcttcaccggcttgccacccgtgatcttgaggctgctgtctcagcatggcactcaaacttcaaccgtctcatcaagtatcaacgtgattatatacgtgccctctatggctggctgaagctcacactcttccaagtggacagtaatatcccacaagaggcttacacctcgctgatctctcgtgaactcaccaccttctgtgatgagtggaagcaagcactggaccggcttccagatgcttcggcttcggaggctatcaagagcttcgtgaatgttgtccatgtcatctacactaagcaggcagaggagatgaaaataaaaaagcggacagagacatattcaaaggagctggaaaagaagaccaactcacttcgagccattgagaagaagtactaccaatcctattcaatggttggccttggccttcctggcagtgggcgcgatggcattgaaagccattcgttcgatgcccgcgatcctcttgcagagaagaaaaccgagattgcccaatgtcggcggaaggtggaggacgaaatgacaaggcatgctaaggcagtggaggtaactagatcaatgacactgaacaacatccaaacaggcctgccaggaatgttccaagccatagctggtttctcaggaacagttgttgaagcccttgacgttgtctgcaggcgagctggatcggtgcggtagaagcttgcgctgccagactttccaagaaaccgttcgttaagtctttttgggtggttcagtaatttatatagggaaaatgcaatatatatagctaaaattagtgatgagaatatgggggagaaggctcccttgatgttttgccttgttgggagttggtcattttggttgtagataaatgattttactcaggattgttgatgttcttttgcttgtcctgtgaagtgcaagggaagattacattgtacaaaaaaaaaaaaaaaaaaaaaaaaaa

SEQ ID NO: 4860 - DNA, 336 bp, Oryza sativa
  Predicted polypeptide sequence is orthologous to G1078
atgacagaggcacggcggaggaaaggggacaatcaggacggcggcggcgcggggacaccatgcaacgacgcccacgcccgaagcgatgacattagcggtgacagttgtggcgtagatcaagtgaggcgcgagaggtggaagcggggagcaccgacggcagcatgcggtgcacaggccgaagttggcggtagcgtcactagttcacggggggcgacgggatgcacggcatccaaggtgcagcaggaggacacggtgcgggagtgcaaggagcagtggcgacacatgaagggtgcggtagcattgtggcagcaactcgcctcggcccacgctgactaa

SEQ ID NO: 4861 - DNA, 1767 bp, Oryza sativa
  Predicted polypeptide sequence is orthologous to G1078
atgaagcggtgcagggagaggcggcggctgatgcgggaggcggtgcggctgcggcgccacctcgcggcctcgcacgccgcgtacctccggtcgctcacccacgccgcgtccgcgctctcccgcttcgcggtcggcgagccgctcccggtgtccgaccacgccccgcccgccgtgatcgtccaccgccccgtcgtcgcgccctccacgccgccgccgctcctccgctccatcgagcagcagcagcagctgcggcggcgcgcgcaggagttggaggaggaggtcggcgctgctgttgatgatcatcttgttggcggcggggccggggtgccgtcggtcacgcgagaggaaggcggcggtgatgaggagctgaggatggtggtgaggcaccgtagcctcgcggaggtcgcggcggggttggaggagtacttcctcaaggccagcgtcgccggcgacgccgtgtcgagccacctcgaggccagcaacgacgagttcaagcgtaagccactagcaactctacttaattcgcacattcacatttactgtacatgtggccactgcctcactggccaatacaaaggtggaccgcacagcatcttgggcgcgctttgctgcctgtcggcgccgtcggttgcgcacgaccgcgtcgacagcatcaatggcgagcagaggcatagctccaacttgcagcagctgctggcctgggagaagaagctgtatcgagaggtcaaggcgagagagcggctgcaggtccagcacgacaagaagaaggcggagctgagtgaccaggagtacagcaggaagatcgacgtggacgtcctgaagctcaaggccgcgtgggagaaggcgcgcgcgcagctcacgacggcctcgcaggccgtggccgcgacctccgcgtccatcgcggagctccgcgacacgcacctggcgcgccagctgctggggctctgccacgccacgctcgacatgtggagggcgatgcggcagcaccacgaggcgcagggcctgatcgcgcagcagctgcgcgggctcagcagccggacgtccatggaccccacgacggagatccactacgagaccacgcgggcgctcgaggtcgccatgtcgtcatggtgcgccgccctgggccacctggccaagcaccagcgcgactacgtccacgcgctgcacggctggctcaagctgacgctgcaggaggcgccggccgtcgtcgacggcgccgaggcggtggcctcccccgtcgccgccgagctcgccgccttcgtcgagcggtgggggcaggcgctcgaccgcgtgcactgcgccgacgtgctcaagtcgatcaagagcttcgccggcgccgtccggtcgctgtacggtctccagagcgacgagctgcgggtagcgcggcgcgtcagccagtactcccgcgagctcgaccgcaagtcgcggatgctgcggcaggtggagaagagctactacgactcgtacgtgccgccgatgggcctctcgctgtggcaccgggggatgaggcattggggggacgacggcatgcacgcgcgcgacgcgagcaacgaggtggcgcagcggagggacgagatagcggcgtgccggaggacggtggaggacgagatgcggaagcacgccaaggccatcgacgcgacgaggtccgcggcggtgacctgtgtgcaggggaagctgcccgccgtgttccagtcgatggccgtgttctcggcgtcgctcgcgcacgcgctggaggccgtgtgccggcatggcacccatgtgcagtag

SEQ ID NO: 4862 - DNA, 617 bp, Oryza sativa
  misc_feature (517)..(517): n is a, c, g, or t
  Predicted polypeptide sequence is orthologous to G1078
tcaagagcttcgccggcgccgtccggtcgctgtacggtctccagagcgacgagctgcgggtagcgcggcgcgtcagccagtactcccgcgagctcgaccgcaagtcgcggatgctgcggcaggtggagaagagctactacgactcgtacgtgccgccgatgggcctctcgctgtggcaccgggggatgaggcattggggggacgacggcatgcacgcgcgcgacgcgagcaacgaggtggcgcagcggagggacgagatagcggcgtgccggaggacggtggaggacgagatgcggaagcacgccaaggccatcgacgcgacgaggtccgcggcggtgacctgtgtgcaggggaagctgcccgccgtgttccagtcgatggccgtgttctcggcgtcgctcgcgcacgcgctggaggccgtgtgccggcatggcacccatgtgcagtagttagctacacatagacacagttcattcgtttgagtcggccatctccatttcctttttccattttactnatctatacgaccatacagtatacactatacaccaaagatatactccgtatacacgaaaccctgctaggatgtaggaatgtataaagactaaataaaaatc

SEQ ID NO: 4863 - DNA, 559 bp, Oryza sativa
  Predicted polypeptide sequence is orthologous to G1078
ttattgagaccaagcttctggagcacagacctgagcaggacgcgaagcagcgcatggagcacctgtcggagaagaaggaaatgctgaatgtgctgaggaagagggtcgaggccgagaaagcgaagcaccacgcctgtatgcgcgatacgcacgatgttactctcaacgggttcaagatcggcctggccagcatattcgagtcgctgaccgaattctccaaggattccgtcaaactctacgaagaccttctaacgcatgccgaacccaaaggttcggaggacgctaccgagaaacggccctgcgtggaggggccatactctcagatttcagtggatgctacgtgactgtctcagtgcccccacattcagtaggagcttgttgcatttgccccagtttttggacccctagaatgtgcgtgctgatgttaacctgtagagtagtgtagtagtaccatgttggttgtgtgtggtggggcggtagggtcattcttgtgggcatctacttactgcttgtaattattcgttttagtttgatatcagagaggattgattcaaaaaaa

SEQ ID NO: 4864 - DNA, 2289 bp, Oryza sativa
  Predicted polypeptide sequence is orthologous to G1089
atggggtgcgggcagtccaagatcgaccaggaggaggcggtgtgccggtgccgggaccggaggaagctgatggccgacgccgtccaggcgcgcaacgccttcgccgccgcccactccgcctacaccgttctcctcaaaagcaccggcggcgcgctctctgacttcgcccaaggcgagacgcccgacctggtggcctctcacgcccacctcgccgcccccacccaggcggccgcttccgtctccgcgcctcctcccccgtccaccgccgccgtgctcatcgcgccctccccgccgcccccgcccttcctcgacttctcccacgccacactccagcgctcctcttctactccaaacatcccgatgcccgaccctaaggccgccaccaagacccaactcgccgctggcgcatccatccgggaagaggacgaggtggaggatgatgctgacggccatatcagaacagaaagcgaagatgatgatgacgacgacgaagacgacgatagcgatgatgaccaccatgagcacgatgatgtcctcgtggaagaaatggtacacggacagccgcagaagcgggttatgatgggcagcgtggggtcttctccagtaacgccgccacccccaccacggccgaacccatccccgccagccaccaggacaacaccaccacccccaatgcctgagcctcagatggctactacctgggattacttcttcggtccaaccaccacaccgccgcccaccctggagcaacctcctgaggagtcttggatggataagcgggagaaggagtcagtgccggagatgaaggcaccgattatgaaaccagctgttgatggatcagctgctcctatgcatgttgcggaggagcaaccaccacagacagcactggagaaggaaaaggccattgaacagcttgcggcaaaccttcctccatcgaagccacttattagaaagccgcccaaagcggcacctggccctccagcagaagttcgctaccagcatgcctcatctatgggtgcggttgaaactcggaaggggaagacgatgtcaggtactgccagtttgctgcaaattgttgctcagcttgatgattctttcctcaaggcttcagagagtgcacatgacgtgtcaaagaagcttgaggccacccgaatgcattaccactccaaccacgccgacagtcgaggcaagtttgaaactcatgccacagtacttgataggatgcttgcatgggagaagaaattgtatgatgaagtgaaggcaggggaacttatgaaaattgattatcagaagaaggtagccctacttcataaacaaaagaaacgtggtgtgaaactcgaaacccttgagaagactaaggctgctgttagccacttgcacacaaggtacatagtggatatgcaatccatggattcaaccgtctcagaaataaaccgactacgtgataaacagttatacccgaagttagtggaccttgttgatggaatggcaaacatgtggagttctatgcatcatcatcataagtggcagttggttatcatatcaggaataagaaattttgaggctccaccggttccaagagagacaactgatcagcattacaagcagacttgtgacctgcgtgacattgtcagggagtggcacatgcagtttgagaaactcatggaccatcagaaagggtacattagagcactaaatgcatggctcaagcttaacctcatccccatcgaaagcaacttgaaggagaaagtttcgtccccgcctaggctggtggaaccacctataaaagatctgctatatgcctggcatgaccagcttgaaaggcttccaattgaacttgcaaaaactgccatcaaaagttttgctgaagtcataagcaatattgtactacttcaggaagaagaagtcaatctaaggaggaggtgtgaggaaactcgcagggatctcaaccgaaaaaaagcacagtttgaagaatggcaccaaaggtacatggagagaaaggcatcacaaggcgaggatgctaataacagtgaagtggctgaagctgtgaactcagatcctgtcgccgacaggaagacggccatcgaggaagtagagattaggctgagggaagaaatggggcatcacaataggattgccaggcaggttagggagaaatcacttgccaaccttcggatgcacctgccagagctcttcagaaacatgactgattttgctggcttctgctatgaaatgtacagcaatttgagaaaatctgctgtactgcccaaagatgaagtgcaaggctga

SEQ ID NO: 4865 - DNA, 630 bp, Oryza sativa
  Predicted polypeptide sequence is orthologous to G1089
atgaagttaagcatgaaacgacccccgtacaaccgcacttctcgtatggaaacatggacgcctagagtgcatgaggatttaagttcatggatcgggtactgccaatgcgaggttatcgaaaagctttgccgtgacgcgtctcatgtgttgggacgaggctcatgtgttgggcagtcgcggagtgcgggtaaagtgtacatccactgcagtttgttggcctacctggccctaataggggagggtgccgccggctgccggctcccgcccccctcccatccgtccactgccatgctccctgccaccctccgcgcggccacgccgccagccgctgcccgccgacagccaccagcagccaccagccaccagcggcgccctccgcgccggccgccgccgtcccgcccggcctcggccgcctgggcttgctcgggtataggaggaggaggagatggggagggggaggagaggggaaggggagaaggtcggatcggatctgaggaggaggctgagagggagttgtttaatgagagggaggagagagaggaagggggagggataagatcgatactggcacgcgcgcggctcggggtggttttatttttggtccctgttgtttataccaaccgggactga

SEQ ID NO: 4866 - DNA, 2214 bp, Oryza sativa
  Predicted polypeptide sequence is orthologous to G1089
atggggtgcgcgcagtccaatgaggacggcgagggccccgtggcgcggtgccgcgagcggaagcacctcctgcgcgacgccgtcgccgcccgccacgcgctggcgggcgcgcacgcgggccacgccgccgcgctcaagaacgtcggcgccgcgctctccgactacgcctccggcgagggcgaggcccacgccggcggggctctgcggtcggggtcggctgactcttcggccgcggcggcggcgctcgtcacggcgtcctccgatggcaagcccgtgctggctatcctgccgccgccgccgcccgagcttcccccgcctcccccgcccccgccgctgcctccgcatggcgacgttgaggcggcgccgctcgcgaggtcgatgagcgcgccggacctgcacctgcagcagccgatcaagaagaagccgtccggcgaggcgcccatcatggaggaggaggacgacgagggcggcgacggcggcgacgcgggaggacggcgaggtgacgacgacgccgaactgaagccacccccgccgctcccctcgcagcgcccccctccctcccgctccccgcctcccctcccgccggagaatgaccacaaggtggacacccccggcgggttcatcagctccttgttcgactccatgccgccgcccactctggacaccgccgccgccgagccatcgtcttcggcgtcggccgagcggagagaaccaccaccccccgcgccggacgaacaccagccatcggcggcggcgagagaggtggcggagggcaagaggccggccgcggcagaggcggcgacgacgcggcgggcgatgacgcagaaggcggcgaggaaggggaaggcgaaggcggtgatgctggtggcgccgccgcagccgcagccggccaagctgggcgtcggcgacatcctccgcgccctggacgaacacttcctcaaggcgtcgcagagcgcgcacgaggtgtccaagctgctcgaggccgccaggatgcactaccactccaacttcgctgagacgcgaggatttgtggaccattctgccagagtgatgcaagtaatcacttggaatcgctcgtttaaagggatacctcaaccggaaaatgtgaggaatgaaatggacgatgacgaatgggagacacatgctaccactcttgataagctgcttgcatgggagaaaaaactataccatgaagtcaaggattttgaggttatcaggagggaatatcaacaaaagctagctgttctcaacaaaaagaagcagcgtggtgtcacttcttcctcacttgagaagaccaagtcggttgttagtcacttgcacacaaaatatgtagttgatctgcaaacaatggagtcaacagttgcagagatcaaccgtctcagagatcaacaattatacccaaaacttcttgaacttgtgaagggaatgtggcacatgtgggatgcaatgtaccttcatcacaaaacacagctcaagatcatcttggagctcaagtcgttggacatctcggtcgccccgcgggaaacaagcgagcaacaccatgaccggaccgtgcagctgtggaatgttgtacatgagtggcacactcagttcgacaagttcatgacataccagaagcagtatgtgggatccctctacacctggatcaagctgaatgtgatccccatcgacaccaacttgaagccaaattcatcacagccacatgagaccacacctcccatcaagagggtgctgcatgcttggcatgaaatcctcggaaagctccccgatgaggctgccaagaaggcgataaacacgtttgcagagatcgtaaagacaatcctggttcatcaggaagacgaactgaagctccggatgaagatcgaggataccaggagggattatgggaagaagaggaggcaattcgatgactgggcacaaaagtacatccaccaaactgcgggtatccttcctgaggacaggaaccctgacggtgcacgccccgatccgatggcggaacggaaggctgccatggaaaagttggagctttctatgaaggagctggaggagatgtatgtcaagcagtgcagggtggtcagggagaagtccctcagccttctcaggacgaatttgccggagctgttcagagttgtgtcggatttctcacttcagtcagctgggatgttcaagggcgtgtggtcgattgcacacaccaatgaccaactggatgaataa

SEQ ID NO: 4867 - DNA, 2512 bp, Oryza sativa
  Predicted polypeptide sequence is orthologous to G1133, G1137
gatttccgtccgagggggccgataagagaagccgcgccgcggcgcacgctctcgctgtctctctctctctctctctctctcgtcctcgtctcggtctcgccgtgcggctctctctcgtgagcaacagcacgcgccgcggtcggcctccccttcaattccttcggctttggcccgggcgggtgtgtgagtgctcagctcctatcgccgattcgtcgtcctcctcctcctcatcctgctcgatctggtaattctagtgttgagggtctgaggagctgaaactagcacgggtaccctggcagcatgcggtggctggctctctcggtagacatcttccgcaaagggatctccttgaacctgtactgccgggttattctgtaaattgcctccattattgctctactccaatcctgatcttctagtctctgaagtttgggattgaagatctggttgctggcattgctgtttgggtttctgtggttgcctggcaattctttcaaggagaacgggcaggagtactaatggtgtggcaaccggtggctcagacgagattccgcgtgtttaaacatgagaatggaatcgctgtgagagttatagcttgcttccagccatcccaagattgccaggccgagtacttccgccatcttcttaagcccgtgacgtagttcgactccctcccttccatttgctgttgaatagaacctgtgctgctctaagtttttctgaagcaaaagtaaagcaggagaatttcctgttcatctcaattttctggtgatcctgtttgctggttgtttcttgatgggggagaaggttaatccctggtgccattggtctaatcccccatggaccgagagctctgcaaacaatctccacccacccgatgttagcctcgacaacacaaattcagtggcgttgccaacatatctgaacagcgatggctacatttattctggagttgctgcatctatgccgtctattgcagcatcagttactgacagacctgtttcattctcttctagatttgtcacaacattggtacccagtgtaggcttatcaacagctgagacactgagaaagagacctctggttttctttcataatgtgaataataccttcactgtaggtcctctcctgagcaaggggacattggatacagttccagagctccaaggtagcaatgagaccaatgtaactgatgttggagcacaaaatactgagtgtatgcatgagaatactgaggagattgatgcactcctgtgttccgactcagatgaagggtgcttgaaagtgcaagaactcaacaacagagtcaggaaatacccaatgcagaatgacaccatgagtgtggagtcggtagcaagcgctggtgcttcccaaccagcaaagaaaagaagactaagctctggtaccgacagatctgtggttgacacagccagctcagcaaggcctgaccactccgttgatcagaaacatctcagccatgacgacgacgcacagtcgtgttgtattggtgaagtggaaagcgatcaccagtttgctctgagggaaggtgaagaagcagaaggtgatgatggccccgatgatcggaagcggagaagagagaggatccaagagactgttgctgcactcagaaagatagttcctggaggcattgccaaagatgccacagccgttcttgatgaagcgatatgctatctcaagtatctaaagctcaaggtcaagacactgggagctgtttccctctagctcctcgatcgatgacggttctgttctggttcctgaacccaatacctatccctctctccatatatacaagtaatgagctaaaactatagcagcaataaggtgaaatgaaactcagtcagttccattcggtgattctgaggactactggagtgaaagctcaatggtgctttgcttacaagggtccaatgatttgagtggttacaatgaagattcagtattgcagtatattactagtgaatcaccgaccactgcaccttcatccatccatccactgatggagagtactacctagcagcaagccggtgtcacatctttcttctgggtcagttcagtgcagtgcctcttggtaggcacctcctccctctcataaaaaaaggctctcatggcgttgatggcgcaataagtaaaacagggaggctaagctataaagatcttttttctcccctccattgtggtgtgatccaaagcaaaggaaggaaggaggaatgaatgaatgaagtccatgcaaagtgcagtgctggtggcctggtgctgcatgcgtcgatggctttttgacccccaaaggttgagagatgagatggcggggccgcgcccgaggttagttcgggctccttgtgtgtgtttgtatggtggcgtgtgtagctagcagagtgtgcgtgatggcgtcgtccctcgcgctttttctgcctttctactagtactatacatatatgctactgtatactgtactcctatgtatgaatactgcatgtgtttgtgtttgtgtttg

SEQ ID NO: 4868 - DNA, 2423 bp, Oryza sativa
  Predicted polypeptide sequence is orthologous to G1133, G1137
ctcgccgtgcggctctctctcgtgagcaacagcacgcgccgcggtcggcctccccttcaattccttcggctttggcccgggcgggtgtgtgagtgctcagctcctatcgccgattcgtcgtcctcctcctcctcatcctgctcgatctggtaattctagtgttgagggtctgaggagctgaaactagcacgggtaccctggcagcatgcggtggctggctctctcggtagacatcttccgcaaagggatctccttgaacctgtactgccgggttattctgtaaattgcctccattattgctctactccaatcctgatcttctagtctctgaagtttgggattgaagatctggttgctggcattgctgtttgggtttctgtggttgcctggcaattctttcaaggagaacgggcaggagtactaatggtgtggcaaccggtggctcagacgagattccgcgtgtttaaacatgagaatggaatcgctgtgagagttatagcttgcttccagccatcccaagattgccaggccgagtacttccgccatcttcttaagcccgtgacgtagttcgactccctcccttccatttgctgttgaatagaacctgtgctgctctaagtttttctgaagcaaaagtaaagcaggagaatttcctgttcatctcaattttctggtgaagatcctgtttgctggttgtttcttgatgggggagaaggttaatccctggtgccattggtctaatcccccatggaccgagagctctgcaaacaatctccacccacccgatgttagcctcgacaacacaaattcagtggcgttgccaacatatctgaacagcgatggctacatttattctggagttgctgcatctatgccgtctattgcagcatcagttactgacagacctgtttcattctcttctagatttgtcacaacattggtacccagtgtaggcttatcaacagctgagacactgagaaagagacctctggttttctttcataatgtgaataataccttcactgtaggtcctctcctgagcaaggggacattggatacagttccagagctccaaggtagcaatgagaccaatgtaactgatgttggagcacaaaatactgagtgtatgcatgagaatactgaggagattgatgcactcctgtgttccgactcagatgaagggtgcttgaaagtgcaagaactcaacaacagagtcaggaaatacccaatgcagaatgacaccatgagtgtggagtcggtagcaagcgctggtgcttcccaaccagcaaagaaaagaagactaagctctggtaccgacagatctgtggttgacacagccagctcagcaaggcctgaccactccgttgatcagaaacatctcagccatgacgacgacgcacagtcgtgttgtattggtgaagtggaaagcgatcaccagtttgctctgagggaaggtgaagaagcagaaggtgatgatggccccgatgatcggaagcggagaagagagaggatccaagagactgttgctgcactcagaaagatagttcctggaggcattgccaaagatgccacagccgttcttgatgaagcgatatgctatctcaagtatctaaagctcaaggtcaagacactgggagctgtttccctctagctcctcgatcgatgacggttctgttctggttcctgaacccaatacctatccctctctccatatatacaagtaatgagctaaaactatagcagcaataaggtgaaatgaaactcagtcagttccattcggtgattctgaggactactggagtgaaagctcaatggtgctttgcttacaagggtccaatgatttgagtggttacaatgaagattcagtattgcagtatattactagtgaatcaccgaccactgcaccttcatccatccatccactgatggagagtactacctagcagcaagccggtgtcacatctttcttctgggtcagttcagtgcagtgcctcttggtaggcacctcctccctctcataaaaaaaggctctcatggcgttgatggcgcaataagtaaaacagggaggctaagctataaagatcttttttctcccctccattgtggtgtgatccaaagcaaaggaaggaaggaggaatgaatgaatgaagtccatgcaaagtgcagtgctggtggcctggtgctgcatgcgtcgatggctttttgacccccaaaggttgagagatgagatggcggggccgcgcccgaggttagttcgggctccttgtgtgtgtttgtatggtggcgtgtgtagctagcagagtgtgcgtgatggcgtcgtccctcgcgctttttctgcctttctactagtactatacatatatgctactgtatactgtactcctatgtatgaatactgcatgtgtttgtgtttgtgtttgatc

SEQ ID NO: 4869 - DNA, 1245 bp, Oryza sativa
  Predicted polypeptide sequence is orthologous to G1140
ggcgccgcgcctcgcctcgcctcgcctcacctcacctcacctcaccctccgcctcgtctccttcccccctttcctctacccacgcacgccctctctcccatcccagccgtagccgcgccgtgacttgtctcgatcggcggcgaggaggagggcttccgttccctggccggtgggggaggatcaggcgggggggcggcggggagggggaggagatcggtctcggtcgatccgcgcgcggcggcgatggcgcgggagaggcgggagataaagaggatagagagcgcggcggcgcggcaggtcaccttctccaagcgccggcgcggcctgttcaagaaggccgaggagctctccgtgctctgcgacgccgacgtcgcgctcatcgtcttctcctccacggggaagctatcccacttcgcaagctccagtatgaatgaaatcatcgacaagtacaacacacattctaataatctggggaaagcagaacagccttcgctcgacttgaatttagaacatagcgagtatgcacatttgaatgagcaacttggggaagctagtctccggcttagacaaatgagaggtgaggagcttgagggattgagcattgatgaactccagcagctagagaggaacctggaagctggtctgcacagggtgatgctgacaaaggatcaacaatttatggagcagatcagtgaactccagcggaagagttcacagctggcagaggagaacatgcaactcagaaaccaggtatcccagatatcaccagctgagaagcaagttgttgatactgaaaattttgttaccgaaggacagtcctctgaatctgtgatgactgcattgcattctggaagttcacagtcgcaggataatgatgatggctcggatgtatccctgaaattagggctgccttgtggtgcatggaagtaactgaaaggaaaaaaaaagcatccttgcagatctggttggagtcgttgcggcatccaggggagaaacgcttgtgttattcccaaacccagactgcaataatataatcttgcgttggaagcgagatcagttaacctgatttatcatccttgtggctgcatgatgcgatgttccgcttgtactgttcgctaggatcttgactaaactttgagatctatgtgccgtttaattatcccatcgctattggcactccttatgcgatacatcatatatgcactttgttgctatcttaattatgatgcgtcttttgcagcgttc

SEQ ID NO: 4870 - DNA, 1218 bp, Oryza sativa
  Predicted polypeptide sequence is orthologous to G1140
gtttctctctctccttgtctctctgtgctgttgttgttgcgggtgaatctgcttggatttcgtcggagttttctgtcgcggaggaggagggggtggtggttgatcggaggggaggggggagggagatggcgagggagaggagggagatacggaggatagagagcgcggcggcgcggcaggtgacgttctcgaagcggcggcgggggctgttcaagaaggcggaggagctggcggtgctgtgcgacgccgacgtcgcgctcgtcgtcttctcctccaccggcaagctctcccagttcgccagctccaatatgaacgagatcattgacaagtatactacacattcaaagaacctggggaaaacagataagcagccttctattgatctgaatttagagcacagcaagtgtagcagtttgaatgaacaactggcagaagcaagtcttcaacttagacagatgagaggtgaggagcttgagggattgagtgtggaagagctgcagcagatggaaaagaacctcgaggcaggactgcagcgggtgctatgtacaaaggaccagcaattcatgcaagaaatcagtgagctccaacgaaagggcattcagctggcagaagagaatatgcgcctcagagaccaaatgcctcaggtgcctactgctggcttggcggttcctgatactgaaaatgttcttactgaagatggacaatcatctgaatctgtgatgactgcattaaattcgggaagctcgcaggataatgatgatggttctgatatatccctgaaactagggttgccttgaaataaaaggaccagctagagagctgagaaatgggatgacgaccaccatgaattatttgtctgtgtgcatgagtggatgaagttggaagttaaatgcatcttaagaagatcaagaagatgtcatgctatgagattaccaacaaggctgcaataatcctatcctatgttaaaaaggagatcgattgacttgtcatcctatgcctgctgatgcaatggtccggttgcttggatctttttttctcaacttgtactagtgtaccatactaccttcgtcgcacttaatttaaatgcgacatgtacgtatgtatcgttcgcttaattcgtgcaagttatgtacgtacctgtatgggaactgtatggaaacttgtgacctcggctgagacttattattggcacaattattaagctagtcattctcatcg

SEQ ID NO: 4871 - DNA, 1045 bp, Oryza sativa
  Predicted polypeptide sequence is orthologous to G1140
atggctggcggcggcggtggcgggggaaggggggagggggaggggagggcggccacggggaagagggagaggatagcaatacggaggatcgacaacctggcggcgaggcaggtgaccttctcgaagcggaggagggggctgttcaagaaggccgaggagctctccatcctctgcgacgccgaggtcgggctcgtcgtcttctccgccaccggcaagctcttccaattcgccagcaccagcatggaacagattattgaccggtacaactcgcattccaagacacttcagagagcagaaccttctcaactcgacttacaaggggaggacagcagtacttgtgccagactaaaggaggagcttgcagaaactagccttaggctgaggcagatgagaggagaggagctgcacaggctgaatgtggaacagctgcaggagctagagaagagcctcgagtccggtctaggctctgttctcaagaccaagagcaagaaaattctggatgagatcgatggactggaacgaaagaggatgcaattgatagaggagaatttaaggctgaaggagcaagtgtccaggatgtcaagaatggaggagatgcagcctgggcctgattcagaaatcgtgtacgaggaagggcagtcgtctgaatctgtcaccaatgcttcttacccgcgacctccacccgacaacgactacagctctgatacatctctcaggctcgggttgtcactcttcagctccaagtgatggctggaaactaaaactgagaggaaacagctggatggcatgcctgcatcgccaaatgatcagtgcatgcactgcaagactgcaacaaataacacagttttagattgccagatgatgatgtgtgtgtgctgagagtcactggctattatcgtacacataataacaatagaacgaacaagttcttctgttcttggatgttacctgaattctactcccatacatgttgtcaatggctctgtaatcgagtgtctgcaattccagctgaaagcaaccgattacagggaaaaaaaaaaaaaaa

SEQ ID NO: 4872 - DNA, 804 bp, Oryza sativa
  Predicted polypeptide sequence is orthologous to G1146
gggaaaaggttgtgctggtgcaagatgcgactctccagggtgtctttgatgctctgaagaaggcttgtgcttctgcatgatgtatgttaaatgtgcatatgtgaaaactactcacttaactgaatagaaagagtgtcaacttaactagtgcccttttatctgtacaactctgtcctgcaatgaaccctgtaaacggttaattaaaaaaaaaaaaaaaaaactcgaggaagcatgtttttaagatgagcaaacagtatttagcaaacgttgcccttaaaatcaatgttaaggtgggaggaagaaatacagtacttgttgatgctttgacaaggaggattccccttgtgagtgataggccaacgatcatttttggtgctgatgttacacatccccatcctggagaagattctagcccttccattgcagctgttgttgcttctcaagactggcctgaggtcaccaaatatgccggattagtgagtgcacaggcccatcgtcaggaattgatacaggatctttttaaagtatggaaagatcctcaaagaggaactgtaagtggtggaatgatcagagagcttctcatttctttcaggagggcaactggacagaaaccccagaggattatattttacagggatggtgtcagtgaaggacagttttattaggttctgttttatgagcttgttgcctttagaaaggcatgtgccattttgaagccgattataagccccccgtaaccttggggggggccaaaacctaatacacaggctggttgctatacccaaggaccacgactggggcaga

SEQ ID NO: 4873 - DNA, 3548 bp, Oryza sativa
  misc_feature (7)..(7): n is a, c, g, or t
  misc_feature (26)..(26): n is a, c, g, or t
  misc_feature (28)..(28): n is a, c, g, or t
  misc_feature (33)..(33): n is a, c, g, or t
  misc_feature (42)..(42): n is a, c, g, or t
  misc_feature (3362)..(3362): n is a, c, g, or t
  Predicted polypeptide sequence is orthologous to G1146
tttcganccctttgaacccgtttaanangaccnactataggncgaattgggtaccgggccctgcagtagttgcatcagtgacgaagggttctaatgcctttctgtcccgcctcgcattaattctttggcttggttggatgcgagagaaaaaagaggagagattttggtagaattgtaagatttttgttactactaccactcgttttcttggcttggtttggtttggtgtttgatcacgcggtggtgacattataagggcgcggttgcgcaggtgttcgaccagcgggtggcgaggtcggcggcgaggtggtggtggtgcgcacatgctcgaggtgctggacatggcgccgccccggcaccagccggcagctgggaaggcgggcggcgggcgcgggcatgggcatgggcatgggcatggtggtggtggtggtgggccggcggcgaggaagcagccgttgcagagtagcatggcgcagcccaaggcggagacggcggcggcgacggcggcggtcgcgccgccggagggagggaagaagtgcggcggcggtggcgggaggcggcgcggcgggcgcgggcgcggcggcagggcgggtgcggggccggggccggggctggcggcggcgccggccgtggtggtggcgcccgcggcgcgcgccgtcattgggccgccggtggcgagcaaggggctgtcgttctgccggcggccggggttcgggacggtgggcgcccggtgcgtcgtgaaggcgaaccacttcctcgccgagctccccgacaaggatctcacccagtacgacgtgaagatcacgccggaggtgagctcccggagcgtgaaccgggcaatcatgtcggagctggtccgcctctaccacgactccgatctcggaggtcgcctcccggcctacgacggccgcaagaacctctataccgccgggacgctcccgttcgacgcgcgcgagttcgtcgtccgcctcaccgacgacgacgacggcaccggcgtcccgccacgggagagggagtacagggtcgccatcaagttcgccgcgcgcgccgacctccaccacctccggcagttcatcgccgggcgccaggccgacgcgccgcaggaggctctccaggtgctcgacatcgtgctccgtgagcttgccaaccgcaggtatgtctcgatagggcggtcgttctactcgccggacataaggaagccgcagcggctcggcgatggcctacagtcatggtgtgggttctaccagagcatccggccgactcagatggggttgtcgcttaacattgatatgtcatctaccgcgttcatcgagccgctaccagtgatcgaattcgtggcccaaatactagggaaggatgtcatatcgaggccattgtcggatgcaaacagaatcaagatcaagaaagccttgcggggcgtgaaagttgaagtcactcaccggggaaatgtgaggcggaagtatcgcatttcagggctgacaacacaaccaactcatgaactgattttcccaatcgatgaccaaatgaacatgaaatctgtcgtacagtatttcaaggaaatgtatggcttcaccattcagcatccccatcttccctgccttcaggtgggaaaccaaaagaaggcaaactatctaccaatggaggcctgtaagattgttgagggtcagagatatacaaagaggttgaatgaaaagcagatcacatcattactcaaggttacttgccgtaggcctagagaacaggagatggatattctacagtctcaacaaaatggatatgagcaagacccttatgcaaaagaatttggaatcaacattagtgagaagctaacctcagttgaagctcgggtccttcctgcaccttggctgaaatatcatgatactgtgaaggaaaaggagtgcttgccacaagttggtcagtggaacatggtgaacaagaaagtgataaatgggtgcaaggtgaatcattgggcttgtataaatttctcaaggagtgtgcaagaaactactgctcggggattctgccaggagttggcacaaatgtgtcagatatccggcatggaattcaacagtgagcctgtgataccaatatactcagctagaccagatcaagtagagaaggcgcttaagcatgtgtataatatgtcattaaacaagctcaagggaaaagagcttgagcttcttttggccatcctccctgacaacaatggttctttatatggtgatataaaacgtatatgtgaaactgacttggggttgatatcacaatgttgcttaaccaaacatgttttcaagatcagcaagcagtacctggcaaatgtctcacttaaaatcaatgttaagatgggaggaagaaacaccgtgctgctggatgcaataagttggaggattcctttggtcagtgacataccaactattatatttggtgcagatgtcacgcatcctgaaaccggggaggactctagcccatccattgctgctgttgttgcatctcaagactggccagaagttacaaagtatgctggattggtgtgtgctcaggctcatcggcaagagctcattcaagatctttacaagacatggcatgatcctcaaagaggcaccgtaacaggaggcatgatcagggagctcttaatatccttcaggaaggccactgggcaaaagccattgagaataattttctacagggatggtgtcagtgaaggccaattctaccaagttctcctctatgagttggatgctatccgcaaggcatgtgcatctctagaaccaatttatcagcctcctgtaacattcgtggttgtccaaaagcgtcaccatacaagactcttcgcaaacaatcacaaagacagaagtagcacggacaaaagtggaaacattttgcctggaactgttgttgattcaaagatctgccacccatcagagtttgatttctacctctgtagccatgctggaattcagggaacaagtaggccagctcactaccacgtcctttgggatgagaacaatttcactgcagacgaaatgcagacattgacaaacaacctttgctacacttatgcacggtgcacacgctctgtttctgttgttccacctgcatactatgcgcatctggctgcgtttcgagcgcggttctacatggagccagagatgtcggagaaccagacgacgtcgaagagctccactgggacgaacggaacctcggtgaagccattgcctgcggtgaaggagaaggtgaagagggtgatgttctactgttgatgactgggagactacctttaactactcacatatgatgtacctaacattgtagaattttagtggtagggatttagaattagcttccttcaggaaagggagcanagcaagcatttggatcctgagcgacctcttttgaccactctgtaaagtactaagtaacgcatgtataatagttgttgtatcagtctgaaaaaaaggaagtgcactcaaaaaaaaaaaaaaaaaaaaaaaaaaaaaaaaaaaactcgagcgcgggtcgacaaggggtttcgaaaggggtttccaaag

SEQ ID NO: 4874 - DNA, 3003 bp, Oryza sativa
  Predicted polypeptide sequence is orthologous to G1146
atcgttgctcgaatatttccccgtccgctgtgcgtcgactccgactgctcgtgtgttcgcccgccgccgccgattcctatccatctcgcgagcgagcaggggcgccgtcgttcgtcctgctgcttccgccgcatccatcctgtgctaaagtttgtaccttgccttggaacattagtcatggagagtcagagaatgacctggctctacgatcgtcaccactccttgaaacataataaagctgaaagacaagccattctatcaacttatagattagcaaaacgtccaaatctctcttcagaaggtatgattggcgaaagttgcattgtgaggacaaattgtttcagtgttcatctggagtctttggatgatcagactatctatgaatatgatgtatgtgtcactcctgaggttggaatcaatcgtgctgttattagagagttggtaaaacagcagaaagattctggtttgggtggccgtcttcctgcctatgatggaaggaagaggctatacacatctggtccattgccatttgattcacatagatttcttgttctgctggatagtattgaagacagtcctgaagagtcaaggcacttgagagtgagagattttgtggtcactttaaaatttgctgcaaaaatttccttatggactttacgcaagttccgtggtgggaagccaaaccgagaaagtcgagcggccctgcgagcacttgacgttgttctaaaggaattacccactgcaaggtatacccaatttgctggttcattttactcacctaacttaggagaatgccgacaattgtgtaaggtcttggaaagctggcgtggttttcaccaaagaatacaagctactcagatgggacttcaactgaatatcgacgtgtcatcatcagtgttcatcaagcctgtacctgtggttgactatgttgcacagcttcttaacgaggacatcttattagacagaccattatgtagcactgagttcttgaagattaaggaggctctagaaggtctgaaggttcagattaatggcattttgttcaacacatatcatgtacaagaccttgtccatcaagcagcaagttttccagttaactttagtattcagtacccatctttgccttgcttgaaagtggctcattttggggagacaatatttctgccattggaggtctgtaaaattgctgagggacaatgtcaccagaaacagctcaatgcaaaacatatggctgctcttcttcaggtagctcgacagccccctaatgagcgtgactacaacattctgcagactgtgcatcagaacaaataccaggaggacccacatgctaaagagtttggcattaaaattgaggaaaaacttgtatcaattaaatctcgcatcctacctgctccttggcttaaattccatgacagtggcgagacgacagaattcttgccacaacttggcatatggaatatgatgcataagaaaatgatcaatggtgggagagtgaaaagctgggcatgtgttaacttttgctggagtgtacgggagtatgctgctaggaatttctgttatgaccttggctttatgtgccgagaatctgggatggtcttttcagttaaacctgtgcttcctctagtgattgctaaacctggatgtgtagaatctgcactcaggacacttcatgacgatgtcatggacatacttagaccacagggcagaaaacttgacctgctgattgtaatattgcctaacaacaatggatctctttatggtgatgtcaaaagaatatgtgagacagatattggactgatctctcaatgttgtcttgcaaaacatgttcttaagatgaacaagtggtatcttgcaagcgttgcccttaaaatcaatgctaagatgggcggaagaaatactgtactggttgatgctttagaaatgagactcccccatgttagggatacaccaactattgtatttggtgctcatgtcacccatccacatccaggaaaagctaatagttcttccattgctgctgttgttgcttctcaagactggcccgaggttaccaagtatgctggtttaatcagtgtgcaagcgtgccaccaggagtcaatacaaggtctttttaaagtccaggatgatccggaaagaggaaccacaactagcggaatgatcaaagagcatctcatgtctttctatcgagccactaaacggaagcccggaaggattatattttacagggatggtgtgagcaaaggacagctccctcaggctttgatgcacgaacttggtgccatcaaaatggcgtgtgcatctatgggacccgattataatccattagttacatacgtggtgctccagaagtgtcgccatacacgtctgtttgctgactactataatgcgaatactcatgattcaactgcaaacatacgggctggtactgtggttgattcaaatatttgccaaccaaatcagtttgatttctacttgtgtagccaccgcagcacgcagggaactaagcggcccaggtattatcatgttctgtgggacgagaacgacttcttggctggttctttccaagagctcacaaactacctctgctacacctccgcaacttgcacccaatccatatcagttgtggcccctgtgcactacgctcgtcttctgtcatcacgagctcgatgttacattaaaccacgctcgattggcgattcaacgagccacacctccttgccttctgaagaagatagcagcgcagcctcagagactggcagtcttcttcctataaaggataatttgaaaggggccatgtttttctgctagaactgctgccagcaagatctgctgtcattttgtacgtggtctgtacagtcccacagttcttggtagatttgactgagcagtcaaaactcattatcgttcagcgagattcaggtgtagcagctgtaggattactgataaacattgttcctgtaccgatactttagaagaaatgaattaattatatcttagaacagc

SEQ ID NO: 4875 - DNA, 3432 bp, Oryza sativa
  Predicted polypeptide sequence is orthologous to G1146
ggtcttcttccttcctcggcccggcctcgctcgctgcctgccagctgcagctgcaactctccatccatcgatcgatctcctcctactcccccgccgccgccccgtccaagacaagccaagccagccaccactccctgcatgccatggcctcacggaggccaacgcaccgccaccataccgaggctccagatcctggtggaagagggagagggagaggccgtgccgcccgatatgctcagcctcagcctcagcctcagcagcagcagcagcagcaaggacgaggatgccgtgctagaggtgcctcgccgccgccgccgccgcagcagcagcagcagcaacagccaaggtctactcctactcgtgctaccactgtcaccgtggcttcctcttcatctaccacggccaccgcatcatcaagccctctagctcccgagctgcgccaagcaataatggaagctccccgtcccagtgagctcgctcaaccctcacccactccgcctcaggaacaacctgtggatgccgctaccacgacgccgcaccatattccatcctcaagcaagtcaattaggtttcctttgcgcccggggaagggtaccattggcaccaggtgcatggtcaaggccaatcatttcttcgctcacctgcccaacaaggatcttcatcactacgatgtctccatcactccagaagttacatcacgcattgttaaccgagctgtgatcaaggagctggtaaatctgtacaaggcatcttatctgggtgggaggctgcctgcatatgatggtagaaagagcttatacacggctggcccattgccgtttacttcacaggagtttcagatcactttacttgacgacgatgatggttctggttctgagaggcgacagaggactttccgagtagtaatcaagttcgccgcacgggccgaccttcaccggcttgagttgtttttagctgggaggcacgcagaagctccacaggaggcactgcaagttcttgatattgtgctgcgagagctaccatcagcaagatatgcgccatttggacgttccttcttttcggcttacttgggtaggaggcaaccccttggtgagggattggaaagctggcgtggattttaccagagcattcggcctactcagatgggcttatcactgaatattgatatgtcagctacagctttcattgagccgttacctgttattgattttgttgcacaactattgaattctgacatccattcaaggccgctttctgatgccgaacgtgttaagatcaagaaagccttgagaggagtaaaggtggaagttacccaccgtggcaacatgaggcggaagtaccggatatctggtttgacaattcagccaactcgtgagctaacttttcctgttgatgaaggaggcacagtgaagtcagttgtacagtactttcaagagacatatggctttgccatccaacacacctaccttccatgccttacagttcagcgattaaattacctgcctatggaggtctgcaaaatagtggaaggacagagatactccaagagattaaatcagaatcagataagagctcttttggaggagacatgccaacacccacgtgatcgggagcgtgatattattaagatggttaaacataacgcttatcaggatgatccttacgcaaaagagtttggcattaagataagtgatcgtctggcatcagtagaggcacgaattttaccggctccacggcttaagtacaatgagactggtcgagagaaggattgcttaccaagagttggtcaatggaatatgatgaacaagaaaatggtaaatggtggtaaagtcagaagctggatgtgcgtcaattttgcccgtaatgtgcaggaaagtgttgttcgtgggttctgccatgaacttgctctgatgtgtcaagcctcaggaatggatttcgctccagaacctatccttccaccactaaatgcacatccagatcaagtggagcgtgctctaaaagctaggtatcatgatgcaatgaacgttcttggaccccagcgcagggaacttgatttgcttattgggatactacctgataacaatggctcgctttatggtgatttgaagcgcgtgtgtgaaatagatcttggaatagtttcacaatgctgttgcacgaagcaggtgttcaaaatgaacaaacaaattcttgcaaatcttgctctgaagataaatgtcaaggttgggggcaggaacactgtgctggtggatgctgtgtcaaggcgtattcctctggtaaccgacagacctacaattatatttggtgctgatgttacccatcctcatcctggagaggacagcagtccctcaattgctgctgttgtagcctcccaagattggcctgaggtgacaaagtatgctgggttggtttctgctcaagcccaccgacaagagctgatagaagatctatataaaatctggcaggatccacagagaggaacagttagtggtggcatgatccgtgagctgcttatatccttcaaaagatcaactggtgagaagccccagcgaataatattttacagggatggcgttagtgaaggccaattttaccaagttctactttatgaattgaatgcaatccgaaaagcatgtgcctccctggagacaaattaccaaccaaaggtgactttcattgtggttcagaaacgtcaccacacaagattatttgcacataatcacaacgatcagaactcagttgacaggagcgggaacatactccctggtacggttgtagattcaaagatccgtcatccaactgagtttgacttctacctgtgtagccatgctggcattaagggtactagtcgtccagctcattatcatgtcttgtgggatgaaaacaacttcacagctgatgcattgcagattcttaccaacaacctttgctacacctatgcaaggtgcactcgctctgtatcaattgttccacctgcttattatgctcatctggctgccttccgtgctcgtttctatatggaaccagatacatctgacagcagctctgtcgttagtgggcctggtgtacgtgggccactttctggctcatcaacatcacgtactcgggcccctggtggtgcagctgttaagccacttcctgctctgaaggatagtgtgaagagggtcatgttctactgctgaagctagggcctacatagctaaagctcttcgtttcttggcaacctgcctatgatggttgtaattatgtgtcaaaaaatcccataataatctgccagctgctatcttctccattgtactatgctggtcatgtttgccaaagttaccctatatgtatgtatattatgctattgttttttttttttttgcggggactattgttatcatgtattatgttttactgtcatgtctgtagttatgattcgaggagtttgcg

SEQ ID NO: 4876 - DNA, 3414 bp, Oryza sativa
  Predicted polypeptide sequence is orthologous to G1146
gatcaaccctctctctctctctctctctgcctcggcgacctcgcctccgcttactctcccacccagacaaaaccctctttgcctctcatggcgtcacgcggcggcgacggcctcgtcggaggagggcgcgggcccctcggtgggcgggacggtagagggcgcggcccggccggtgggcgaggcggcggaaggggaggcggccacccgcagcagcagcagcagcagcagccgggctacggccgcggcgacgggggcggccgtggtcctgcccctgctgctggtggtgtcgttggtcgaggaactggaggcggcggcggcggcgggcgcggggacggcggacgcggccgtggccgtggcggcggcggcggagatggcgttcgccctgctatggccgcggctccggcggcgtcgactcctggtccggttgctgttgctgctcggagtactcctcctcctactcccgcggtccagatccccgcggtggcgtcgtcgtcgtcagcgcagccagcggcggcggcgcagcctcctccggcagccgcggcggtttctgccctcgcgagggacgttgggaggcagctggctgtcgtggcgggcggcggccgccccgctccccccgcggcgccgccggcgcccatcccggtgtcgagcaagggcgtcgcgccaccgtcgcggccggggttcgggacggtgggggagaggatcgtggtgcgcgcgaaccatttcctcgtccgcgtctccgacaacgacatgatctacctctacgacgtgagtttgagtcccccaccaaagaccaggcgcatcaacagggtagtgatgtctgagctggccaggttgcaccgtgagtcgcatctcggtggcataagcttcgcgtacgacggaagcaaggccctgtacactgcaggaaaactgccgttcgactccatggacttcaagatcaagctgggcaaagagctcagggaaatcgagtacaaggtgacaattcgacgtgctggccaagcagatctgcaccacctgcacgagttcatcgccggccggcagagggactctcagcagcaaacgatccaagcactggacgttgtactgagggagtcaccttctctgaactatgtcatcgtttctcggtcgttctactccactatgttcggccgacaagacattggtgatgggctggaatgctggaaaggatactatcagagcctgcgcccaactcagatgggactctcattgaacatagacatatcctctaccccattcttcaaacctatcagcgtggtagaatatgtcaagaattgtctgggcacacctactaatgctaatggccctgaccctaggcggcctctttctgacattgatcgcctgaaggttaagaaagcactacggggagttcgtgttgaaacaacacaccaggggaagagcagcaagtacaagatcactacgattacatctgagccactgagtcagctgaacttttctatggatggaactacccagactgttattcagtacttctcgcagcggtacaaatacaggctgcagtacacgtcttggccctgtctgcaatccggcaacccttctaaccctatatatttgccaatggaggtatgcaccattgtagaagggcaaagatactccaagaagctcaatgacaaacaagtgactggcctcctgagagcaacatgccagcctccccagaaaagggagcagaaaatcattgagatggttcaacacaacaactacccggctgataaggtggtgagtgattttagaattaatatttccaatcagatggccactatgccagctcgcgtgctgcctgcgcccacgctgagataccatgactctggaaaggagaaaacttgtaatcccagagttgggcaatggaatatgatcaataagaaaatggttggtggagctgtggttcaaaagtggacttgcgtgaatttttcacgcatgcatattgatgccgtgcacagactatgcggcgaactagtttatacatgcaatgctattggcatggttttcaatgaaatgccagagatagaggtggggtcagctgctcctaataacatcgaagctgccctgagcaacattcacacaagggctcctcaactccagctgctcattgtgattctcccagatgttaatgggtattatggaagaattaagagggtgtgtgagactgaacttgggatagtatcccagtgcctcaagccaggccgcaagctcttgagcttagacaggcagttcctggaaaatgtctcactcaaaatcaatgtcaaggctggaggacgcaactcagttcttcagagacctcttgtacccggtgggcttgaaaacacaacaataatttttggtgccgatgtcacccatcctgcttctggagaggactcatcggcgtcgatcgcagctgtggtggcctccatggactggcctgagatcaccaagtacaaagccctcgtctctgcccagccacctcggcaggagattatacaagatctcttcaccatgactgaagttgcgcagaatgctgatgctccagcacagaaggctgaaggttcgaagaagaatttcatatgcggcggaatgttcagggagttgcttatgtcattctacagtaagaatgctaaacgtaagcctcaaaggataatattttacagggatggtgtaagtgatggacaattccttcatgttctgctctatgagatggacgcaatcaagaaggctattgcatctttggacccagcatacaggcccctggtgacatttgtggttgtccagaagaggcaccacacaaggctcttccctgaggtgcatggaaggcaagatctgacggacagaagtggaaatgttcgtccaggaaccgtggttgacactaacatttgccaccctagtgagttcgacttctacctgtgcagccatgccggaatccagggaacaagcagaccaacccactaccacgttctccatgacgagaaccgttttagtgccgatcagctgcagatgctcacttacaatttgtgttacacctacgctcgatgcacccggtctgtctctgttgtccctccagcctactacgctcacctggcagcattccgggcgaggtactacgatgagccccccgccatggacggagcttcgtcggtcggcagcggcggcaaccaggcggcggccggcggccagccaccggcggtgcgccgcctcccgcagatcaaggagaacgtcaaggacgtgatgttctactgctgatcgaatcggcgcctagcttgggttttaactacaaacattttgttggtcgctcgtcagtattcattcaggctgttagtgtactgtgctatctctgaaattgtgatggtgtcatttgggacatgttaacctgttgttgaacttgtgatctgtgatgttgatgcagctgct

SEQ ID NO: 4877 - DNA, 3636 bp, Oryza sativa
  Predicted polypeptide sequence is orthologous to G1146
aggtctgctctcctcaatcctcccccactccttgggtaaatcgttagcctagccgccacccgtactgagcgctccgccatggcgctcgtctgaacttcccctttagcgcccgccatggcctgccgccccatgtgagtaatgcggttatgtgtagcagggtagttttttcctattgctggagaagatcctccacttaaatggagaaaatcgacggggagatcgctcttttgttgctggatttctgtttattccgatctgttagactgctagtccctaaataggtgtagctttcgtttctgggcattctatttttcatggttgcggcgtcactttcatatctctttcacccatgaatcgactccgatagtgtgtgttactcgtaacctgtactactgcatttccattacatctagataatcagaaccgccactcaagtttcagtagtttggtcttgtaatggtggttctaattctgttggttgactgctctctgaaattaattttattcgtttagttattattatgtgatcttgaggtgtaggttcatgacttcatgttaagtagctccaaattattcttcattcccccctcctccccctgaaaatcttgttctgaattccaatagaaaagttattcttcctttttcccctgaaaatttcgttctgaattcccaataaaaaggttataaatttatatgcatgaagttcatcgagttgttctgaaaatcttacagttcgttatcaatacaaagactacttcaagtcaaacaagcaggattctacctgatgagctcatcaagttgcacgggttcacaactcttggtggcaaacggccagcatatgacggaagagagagtctctataccaatggttcacttccttttgaatcaaaggagtctgtggtcaaagtatttgatccagaaaagaatgctaaagaaagggcgcaaaaggaatttaagatcacaattgaaattgttggcaaaacaaacttgtaccacctccagcgctttctgctcggaaagcacaggggcatagcccaagaaatcatccatgtttttgatgttatcctcagtgataaactttctcggaatcatgtcacagggcccagatcctttctttgtactcagattggtcaccagggttacattggtgatggacttgactcttggagaggttaccatcaaagcttgcgcctgagaaagatagggatttcactcaatacggatatgtctgcagcatcctttatgcctgtgagaattatccaaattatagatgggttcctgaacataagttacacctcaagacctttgttagagcggaaccgtgtgcagctaaagaaagtattatgtcatgtttgcattgaaacaaaccaccatgatgaccaaatcggaagatataagataacagggatcacccctattcctatgagcaataacatatgtcctgttggtgaggaaggaacaacaatgactgttcttcagtacttctgtgatatggagaaaacaggtgtgcctagtgttggacattggaacatcgctgaagagaaaatcattaatggaggagctttggataattggacttctctgaatctttcacgaatgcgcccggaggaagtacaaaggttctgcagcgacctgattcagatgtgcaatgccactggaatgtccttctatccaagaccagttgtggacttccggtcatcacatcctaacaacatacagaatgctctgagggatgttcacaggccaatgcattcctatgttgattgtgatgagaatcatttttatgctgatgctcattgcaactgtaccgtgtctgtggtcccctcatcatcgaacgacaaagttgctgtggaacaggaggaattacaatttgcctcaacccctggcaacagtggacagggcaaatttcaggttggtttcctgctgaacagacagacgatactagtagatacagaaaatgacgactcagtttctgctgttatccagcaggcaattgaaaagacaaattattggccaaaggatgtgtattacacatactccatgggcatgattgacaaaaagaagatggtgaaggaatcacatctctataaaggttctctcatatttgtcaattccagaagccggggcggtggagagcctcctgctggttgcgagaggattgttgatagaatgattaaggcaaacaaaattcctctactggatcatatccatagtgtgaaggggcatgatccctgggctgaatggtttgagcgtgtgaacttaccaagatcccttttaacatcttcacaagaatggggtggtgtacttttgcaagatgcagcagctaaagttggacagatgttggctctctgtctggaaagggcccattgttctgggaaatgttttggtggctttgacatacgtgatgtctattatatagagtattaccagttgattgacattaatgcccccatgacggatttcacaagtagaagatatataaatgattggttatcgttcaataagattattgatgaccactttagatacactgatccaacctcaggttatctatcatatacactgtacgtggaagattttatgttcagaatatctttacttgaagatgtgccatctactggacgttcttggagggaaagggctgtctttttcaagaatatcagccttgaatcatcagagaggagagtccagattgttgaaggacttgtggggttttatcgtgaaagactcacttcagacagagaattattcgaggaggtattgcaggattgtggctattggaaaagacaaacaagaacggtgcctcgtatgatttctgcgttgacatattctgtaaagaatgaattgcaggactgggtacctgctaatcattactttgagaattgtgggtattcccagctttatttctgtagatgtttctttggacattatacagtaccaggaaggatcacgaagaaggaactggatacagctgtaggcatacttttgccaggtcatatcccaagggctcaaaaaagactgatggtcaactatgagaagacccaagtagatgctgcagtattgtcaccatcaggaaatactgcaaggttcagtgtgcatcatatttttggcattggttctgttggaaatgacctggctctcccacaaataaaaaaggctcttcctccctcgcaaagaaaaaggaaacaaacttgtgacaagtaagtctaactagcctactatacacatgtagctgcttctctgcaaacttcccgttggtagcagagagctctgatggcagcagcgggcaagctgtggaggtgcgttaacttcccaaagatcaaaggttcccaactgcttatatgatgagatgttggcgattcccatagagatgtggttgatgaagtttagttgaagattcccaactgcttataagacttctcttgaactggttgctggtagttttttttttgctgctcgttgtagtagattgtcagtgagcttctgtggtatgcaaggcactcagcttgacacaatgcaactatgccaagtatgttaagttcccagtagttttgttatctaacctttgttctctgtatgatatttgcctcatcagctgctctgctcaaaatgcttccttttatatttgtagttttg

SEQ ID NO: 4878 - DNA, 2503 bp, Oryza sativa
  Predicted polypeptide sequence is orthologous to G1146
gtggagctgtccggcagcaggaagttcaaggtggccatccggcacgtcgcgccggtcagcctgcaggacctgcggatggtcatggccggctgccccgccggcatcccgtcgcaggcgctgcagctgctcgacatcgtgctgcgcgacatggtgctcgccgagcgcaacgacatggggtacgttgcgtttggtcggtcttacttctcaccggggctcggatcgagggaactcgacaagggcatctttgcgtggaaggggttctaccagagttgccgggtcacgcagcagggcctttctctgaacatagacatgtcttcgactgctttcattgaacctggtcgggtgctgaattttgtagaaaaagctattggacgtcgaatcactaatgctattactgtgggatattttttgaacaattatgggaatgaattgatgaggacccttaagggtgttaaggttgaagtcactcaccgaggaaatctacgcaagaagtacagcattgctggcttcaccgagcagtctgcagatgttcagacgttcacatcatctgatggtatcaagactgtcaaggagtatttcaacaaaaaatacaatctgaagttagcttttggttatcttccatgcctgcaagttggcagcaaggagagaccgaattacctgcccatggagctttgcaatatagttcctggacaacgatacaagaacaggctcagtccgacacaggcttccaatctgattaacataaccaacgatcgtccttgtgaccgtgagagctccattcgtcagactgttagcagcaaccagtataacagtacggaacgcgcagatgagtttggcatagaagttgactcttatcctactactttaaaggctagagttttgaaagctccaatgctgaagtaccatgattctggaagggtgagagtatgcacgccagaggatggggcgtggaacatgaaagacaagaaagtagttaacggtgctacaattaaaagctgggcatgtgtcaacttgtgcgagggtttggataatcgtgttgttgaagcattctgccttcaattggtcagaacgtccaaaataactggactggactttgcgaatgtgagccttccaatattgaaagctgatcctcataatgttaaaactgatcttcctatgcgctatcaggaagcatgcagctggtcgagggataacaagattgacctcctacttgttgtaatgacagatgataaaaataatgccagcttatatggtgacgttaaaagaatctgtgaaacagaaatcggtgtattgtcacagtgttgtcgagcgaagcaagtctacaaggagaggaatgttcagtactgcgcaaatgttgctcttaagatcaatgccaaggctggaggaaggaactcggtatttcttaatgtagaagcaagtttaccggttgtttcaaagagcccaactattatatttggtgctgatgttacccatcctgggtcctttgatgaaagtaccccttccattgcttcggttgttgcttccgcagactggcctgaggtgaccaagtataattctgttgttcgtatgcaagcttctcgtaaggagattatacaagatcttgatagcattgttagggaacttctcaatgcattcaaaagggactccaagatggagccgaagcagctcattttctacagggacggcgtaagcgagggtcagttccagcaagttgtagagagcgaaataccggagatagaaaaggcttggaagtctctgtatgctggcaagccacgaattaccttcatagtggtgcagaagaggcatcatacaaggctgttccccaacaattacaatgatccacgcggcatggatgggactggaaatgttcgtccaggcacagtagttgatacagtgatctgtcaccctcgagagtttgatttcttcctgtgcagccaagccggggatcaaagggacaagccgtcctagccattaccatgtgctgcgcgacgacaacaacttcaccgcagatcagcttcagtctgtcacaaacaacctgtgctacttatatacaagctgcactcgctcggtgtctattccacctcctgtttactacgctcataagctcgcattccgcgctcgtttctacctcacccaagttcccgtcgccggtggagatccaggtgctgctaagttccagtgggtacttccagagattaaggaagaggtgaaaaagtccatgttcttttgctagtcgtccttgtgcccccctgaaactgaagcctggagccagccggcaagctctggaaatgctctgaataatcaaacttggaagaataagcacctgcccaggttgccattcgtttccatgtggcatggaggatggcatcctgaaaaggatattgtcatgtttgtgtggtttttaaacgacattgaagtttatctccggtgttactatctcagcactttggttgttttattttgttatgtctgaagatatagacacaaaacttcatttttgttt

SEQ ID NO: 4879 - DNA, 3177 bp, Oryza sativa
  Predicted polypeptide sequence is orthologous to G1146
atggcctaccgcggcggaggccgaggtggccgcggcggcgagcagcggccgccctactccggccgcggcgacgtccctggccgtggtggcggtggtggtgggggtggagccccgccgtaccgtcccgcctcgggcttcgtgtggccgccgccggggatgacgccgcggccggggcctcctcagccgcagtacccgcggccggggccgccggccgtcgtctacggcgcgccgatgccggcggcgcaccaccagggcgcgtaccagcccgggggcgtgtaccgtgcgccctccccgggggttccggtgatcggtggctacgcgcgcagcacgcccgtcaccatccgggcgcctccgccgtcgcactcgtcggctccggctccgtaccagccggcggcggccgcgccggctccctcgtcgtcctccacggcgccgtccgctacggctctggccaaggagttcgagcagaagctgttcgtgtcggagaccgcgctggcgccacccgcggcggtggcgtcggccgcggccgcgccggctggcgaggcgtcggtggagtcggacaaggatctggcaccggtgtcgaagaaggggctcgcccaccctgcgcggccggggttcggagcggccgggaagaaggtgatgatccgcgcgaaccacttcctcgtcaatgtcgccgacaacaacctcttccactacgatgtttcaatcaatcctgagtcaaaatcaagagcaacaaatagggaagtactcaatgagctcatcaagttgcacgggaagacatctcttggtggcaaattgcctgcctatgatggaagaaagagtctctatactgctggttcactcccttttgaatcggaggagtttgtggttaagctaattgatcccgaaaagaaggataaagaaagggcggagagggagtacaagatcacaattcggattgctggcagaacagacttgtaccacctccagcagtttttgcttggaagacagagggatatgccccaagaaaccattcaagttcttgatgttgtccttagggagtcaccatcttggaattatgtcacagtgtccagatccttcttctctacccagtttggtcaccggggtgacattggtgagggacttgagtgttggagaggttactatcagagcctgcgcccaacacagatgggcctttcgctgaatatagatatatctgcaacgtccttttttaagcctgtgacagtgatccaatttgtggaggagttcctgaacatacgtgacacctcaagacctttgtcagaccgggatcgtgtgaagataaagaaagcattacgtggggttcgcattgaaacaaaccaccaagaggaccaaatcagaagatacaagataacagggattacccccattcctatgagccagctgatatttcctgttgatgataatgggacaaggaagactgttgttcagtacttctgggataggtacaattacagactgaagtacgcttcttggccctgcctacagtctggcagtgattctcgccctgtatacttacctatggaggtgtgcaagattgtagaagggcagaggtactccaagaagcttaatgacaaacaagtgaccaacatccttagagcaacctgtcaacgcccccagcagagggaacagagcattcatgagatggttctccacaacaagtatacagaggataggtttgctcaggagttcggtatcaaggtctgcaatgacctagtctctgttccagcccgtgtgctgcctccacccatgttgaagtatcatgattctggaagggagaaaacttgtgcacccagtgttggacagtggaacatgattaacaagaaaatgatcaatggaggaactgtggataactggacatgtctgagtttttcacgaatgcgtcctgaggaggtacaaaggttctgtggtgacctgattcagatgtgcaatgccactggaatgtctttcaatccaagaccagtcgtggatgtccggtcaacaaatcctaacaatatagagaatgctctgagggatgttcacaggagaacatcagaactgctagccagagagggaaagggaggcctgcagcttttaattgtaattctgcctgaagttagtggttcttatgggaaaattaaaagggtctgtgagactgaccttggcattgtatctcaatgttgtttgccaaggcatgccagcaggccgaacaagcaatatttggaaaatgttgcactcaaaatcaatgtcaaggtcggagggcgcaacactgttcttgagcgagcctttatccgcaatggcataccatttgtgtcagaagtcccaacaatcatctttggcgctgatgtcacacaccctccacctggagaggactctgcatcatctattgctgcggttgtggcatctatggattggcctgaaatcaccaaataccgaggtctggtctctgctcaaccacatagacaggagataatagaagatctctttagtgttggtaaagatccagtgaaggttgtaaatggtgggatgatcagggagttgcttatcgcattccgcaagaagactggcagaaggcctgagaggataatcttctatagagatggtgtaagtgaaggtcagttcagccatgtgcttcttcatgaaatggatgccatcagaaaggcttgtgcatctttggaggagggatatctaccacctgtcacatttgtagtagttcagaaaaggcatcacacaaggcttttcccagaggttcatgggaggcgagacatgactgacaagagcggaaacatccttcctggaactgtcgtggaccgtcagatttgccatcctacagagttcgatttctacctgtgtagccatgctggcatacagggtactagcaggccaactcattaccatgtcctttacgatgagaaccattttacagccgatgcacttcagtccctgaccaacaatctttgctatacctatgcgcgatgcacccgggcagtgtctgtggtcccaccggcctactatgctcatcttgctgcattccgcgctcgctactacgtggaaggagagagttcggatggtggctcgacccctggcagcagcgggcaggctgtggcgcgagagggccctgtggaggtgcgccagcttcccaagatcaaggagaacgtcaaggacgtcatgttctactgctga

SEQ ID NO: 4880 - DNA, 3644 bp, Oryza sativa
  Predicted polypeptide sequence is orthologous to G1146
gggtagaagcagaggtaagcagggcagagagtagaaacaggagcactgcattactggtagtgggagcgtaaagctctctcctctcttcttcttcttcttcttggcgttttccctcatctccttctactagtactagtacatcaccctcccactcttcttcatcttccgcccagcgaggttcgtctggatgtgagctgaatctctccgtctgcccaagttgattgagttggtcgactgaatgggatcaaggagaccaagactgcctgggtttggtgaggactgtgagcctcgtggtggtgggagaggaggaggtggccgtggccgtggcagctactacccacaggcacagcaataccacccacaaggacatggtggccgtggaggagcaggctactaccatggtgctgctcctcaacctcgcggcgcaatggtggtgcagcaatggcgtcctgctactgctgctgctgagcatttgggccatcaacagccctacaacagcagtgtgagaccacagcactattatggtccgtctgccatagctcccgagctgctccaagcaatggatgctccacatgagcctcctgccaatgtctcctcaccagaagcagcctctccggaggcatcatcaccacggtctcttgctcttgaggtcacagagcagcttcaggacttgtctgtgcagtaccaattaagtgagagccaggaagagattgtccaacatgttcctgtgtccaccaaatcatttaaatttcctcaccgccctggaagtgggagtattggaaccagatgtttagtgaaggcgaatcacttctttgctcaactgccagacaaggatcttcatcagtatgacgtttcaatcaccccggagcttacatcacgaattcggagccgtgctgtgatggaagagttggtgagactgcacaagatgtcatacttgggaggacgtcttccagcctatgatggtaggaagagcctttacacggccggtccattgccgtttacttcaaaagaatttcgcatctctttgcttgaggaagatgatggttctggttcggagaggcgtcagaaaacatataacgtggtgattaagtttgctgcaagagctgatcttcaccgtcttgagcaatttctagctggaaggcaggcagaggctccccaggaggccttgcaagttcttgatattgtcttgcgagagttgccaacagcaagatatgcaccctttggtcgatccttcttctctcctgacctggggaggagacgatccctcggtgagggactagaaacctggcgtgggttttatcagagcattcgtcctactcaaatgggcttgtcactgaatattgatatgtcggcaactgctttctttgagccgttaccagtcatagattttgtcatacagcttttaaatactgacatccgctcgaggcccttatcagatgctgagcgtgtcaagatcaagaaggccttaagaggagtgaaggtaggagttactcaccgtggcaacatgcgccggaagtatcggatatctggtttgacatctcaggcaactcgggaactgacttttcctgttgatcaaggaggcacagtgaaatctgttgtacaatattttcaagagacatatggatttgcgatccagcatacctatcttccttgtctgcaagttggcaatcagcagcgtccaaattacctaccaatggaggtctgcaaaatagtggaaggacagaggtactccaagagactgaaccagaatcagataagggctcttttagaggagacatgtcagcgcccacacgatagggagcgtgacataattcagatggtgaatcacaactcctaccatgaagatccttatgcaaaggagtttggcattaagatcagcgagcgtctggccttggttgaggcacggattttacctgcccctcggctcaagtataatgagactggcagagagaaggattgcttgcctagagttggtcagtggaatatgatgaacaagaaaatggtaaatggtggtagagtcaggagctggatatgtgtcaattttgctcgaaatgtgcaagagagtgttgctagtggattttgtcgtgaactggcccgcatgtgccaggcctcaggaatggactttgctttggagcctgttcttccatctatgtatgcacgtcctgatcaagtggaacgagctctgaaagccaggttccatgatgcaatgaacatacttgggccacagcacaaggagctcgatttacttatcggactgcttcctgataacaatggttctctttatggtgatttgaagcgtatatgcgaaattgaccttggattggtttcccagtgctgttgcacaaagcaagtgtttaaaatgaacaaacaaatcctagcaaatcttgctctgaagataaatgcgaaggttgggggaaggaacactgtactggttgatgcagtgtcgagacgcattccgttggtaactgacaggcctactattatattcggtgctgatgtcacccatcctcaccctggcgaagatagcagcccatccattgctgctgttgtggcctcccaagattggcctgaagtgacaaagtatgctggtttagtttctgctcaatctcacagacaagagttaatagatgatctgtataacatcacgcatgatcctcatagagggcccatctgcggtggaatggtcagggaacttcttatatccttcaaaagatcaactggtcaaaagcctcaacggataatattctatagggatggtgttagtgaagggcaattttaccaggttctattgcatgagcttgatgcaatccgaaaggcttgtgcatcactcgaagcaaattaccaaccgcaggtgactttcattgtggttcagaagcgccaccacacgagattatttgcacacaaccacaatgatcagaattcagtcgacaggagtgggaacatattgcctggtactgttgttgactccaagatttgccatcctacggagtttgacttcttcttgtgcagccatgctggaatcaagggcacaagccatcccgctcattaccacgtcctgtgggatgaaaacaacttcacagctgatgcgttgcagaccctcaccaacaacctctgttacacttatgcgaggtgcacacgatccgtatctattgttccaccagcatactatgctcatctggcggcgttcagagcccgtttctacatggagtcagatagctcggacagtggttcaatggcgagtggtcgtggaggaggttcgtctacatcgcgcagcactcgtgctgcaggtggtggagccgtcaggccccttcctgcactcaaggacagcgtcaagaatgtcatgttctactgttagaattctactactgcttcgcttggctactactatcagttagcctttaaattgcctcccatttgattgcacttagttgttcatcatgggaagcctcaaataagaagtatgcaagacttctgaagccacatgctatcatgttgtgtgtttctgggacacaccattctatttcacattatctgtagactctatcccactatttcataaaagctgggcttcccctggctctatttgtactctaattcgtatggacctgtttcatcatttcaaaatggtcaattgtcttgtttgc

SEQ ID NO: 4881 - DNA, 3746 bp, Oryza sativa
  Predicted polypeptide sequence is orthologous to G1146
ttgaggcggaggcagcagcagcagtgcggtagtgcaagcgctagtggaggagttgggaggaggccccctagggtttcccgagaccgcctccccccgcgcctgcgccgccgctcgccgagcgcgcgctccgtgcccatcatggtgaagaagaaaagaactgggtctggcagcaccggtgagagttctggagaggctccaggagctcctggccatggttcttcacagcgagctgagagaggtcctcaacagcatgggggaggacgtggttgggtgcctcaacatggtggccgtggtggtgggcaataccagggccgtggtggacattatcagggccgtggagggcaaggttcacaccatccaggtggagggcctcctgagtatcagggtcgtggagggccaggttcacatcatccaggtggtgggcctcctgactatcagggccgtggaggatcaggttcacatcacccaggtggtgggcctcccgagtatcaaccgcgtgactatcaaggacgtggtggtccacgccccagaggtggaatgccacagccatactatggcggacctagggggagtggcggacgtagtgttccttcaggttcatcaagaacagttcccgagctgcaccaagccccacatgtccaataccaagccccgatggtttcaccaaccccatcgggagctggctcatcctctcagcctgcggcggaggtgagcagtggacaagtccaacaacagtttcagcaacttgccacccgtgatcaaagttcgaccagccaagccattcaaatagcaccaccgtcaagcaaatcagttagattcccgttgcgccctggcaagggtacatatggggacaggtgcattgtgaaggcgaaccatttctttgctgaacttcctgataaagaccttcaccaatacgacgtatctattactcctgaggttacttcacgtggcgtgaatcgtgctgttatgtttgagttagtaacgctgtatagatattcccatttgggcgggcgtctacctgcctatgatggaaggaagagtctttacacagctggaccattgccatttgcttctaggacatttgaaattactcttcaagatgaggaagatagtcttggtggtggccaaggcacccaaaggcgtgagagactatttagggtggtgatcaagtttgctgcccgtgctgatcttcaccatttggctatgtttctagctggaaggcaagcagatgctcctcaagaagcccttcaagtccttgacattgtgttacgtgaattgcctaccacaaggtactcaccagttggtcggtcattttattctcccaatttagggagacgccagcaacttggtgagggtttggaaagttggcgtggtttttaccaaagcataaggcctacccagatgggtctctcactgaatattgatatgtcatcaactgcatttattgagcctctacctgtgattgactttgttgctcagcttctgaacagagacatctcagttagaccattatctgattctgatcgtgtgaagataaagaaagctctaagaggtgtgaaggttgaggtgacgcatagaggaaacatgcgtagaaaatatcgtatatctggactcacttcacaggcaacaagggagttatcattccctgtcgatgatcgtggtactgtgaagactgtggtgcaatattttctggagacatatggttttagtattcagcacaccactttgccttgccttcaagtgggcaatcagcaaaggcccaattatctgcctatggaggtttgtaagatcgttgagggacagcgttactcgaagcggcttaacgagaaacagattactgcgctattgaaagtgacttgccagcgacctcaagagcgtgaactggatattttgcggactgtatctcacaatgcataccatgaagatcagtatgcgcaggaatttggcataaaaattgatgagcgtcttgcatctgttgaagctcgtgttctgcctcccccaaggcttaaataccatgatagtgggagagaaaaggatgtattgccgagagttggccagtggaacatgatgaataagaaaatggtcaatggtgggagagtcaacaactgggcatgtattaacttctctagaaatgtgcaagatagtgctgccaggggcttctgtcatgagctggctatcatgtgccaaatatctggaatggattttgcactggaacctgtgctgcccccacttactgctagacctgaacatgtggaaagagcactgaaggcacgctatcaagatgcaatgaacatgctcagaccgcagggcagggaacttgatttactgattgtaatactgcctgacaataatggttctctttatggggatctcaaaagaatctgtgagactgatcttggattggtctcccaatgttgtttgacaaaacatgtttttaaaatgagcaagcagtatcttgcaaatgttgcccttaaaataaacgttaaggtggggggaaggaatactgtacttgtggatgctttgacaaggaggattccccttgtcagtgacagaccaactatcatatttggtgcggatgttactcatcctcatcctggagaagattccagtccttccattgcagctgtggttgcttctcaagactggcctgaagtcactaagtatgctggattggtgagtgcccaagcccatcgtcaagaattgatacaagatcttttcaaagtatggcaagacccgcatagaggaactgttactggtggcatgatcaaggagcttctcatttctttcaagagggctactggacagaaacctcagaggataatattttacagggatggtgtcagcgaggggcagttttatcaagttttgttgtatgagcttgatgccattagaaaggcttgtgcatccctggaacccaactatcagcctccagttacctttgtggtggtccagaagcggcatcacacaaggttgtttgctaataatcacaacgaccagcgtactgttgatagaagtggaaacattctgcctggaactgttgttgactcaaagatttgccatccaaccgagtttgatttctacctgtgtagccatgctggcatacagggaacaagccgtcctgctcattatcatgttctgtgggatgagaacaaatttactgcagacgagttgcaaaccctcacgaacaacttgtgctacacgtatgcaaggtgcactcgctctgtatcaattgtgcctcctgcgtactatgctcatctggcagccttccgagctcgcttttacatggagccagagacatctgacagtggatcaatggcgagtggagctgcaacgagccgtggccttccaccaggtgtgcgcagcgccagggttgctggaaatgtagccgtcaggcctctacctgctctcaaggaaaacgtgaagcgtgtcatgttttactgctaagagcttgggctgtaccccgtatgcgccaaggaatgtagtactatgttatgttattttagcacttgcactctgtcgttgatcccgttaaaacgggtatgctaccataagctgttggactattctgggtattgtagtactacttgttttgtatttgtgtttgtgacgctgcagagcgtgaacaacgcaagtctggtacttgtatcgttgtgtttgtgggaacctaaatcttgttggacctttgttgtgcttgaagaaccaagttaaataatcctgtcagtatagggatttaattgctgcttggc

SEQ ID NO: 4882 - DNA, 3747 bp, Oryza sativa
  Predicted polypeptide sequence is orthologous to G1146
gaattatttctttgttctcctcctcctgattcgtcgtccgtccctaggaagcaaaggagaaagtttccactctgtctgcgggatatatcatatatatctcaatcgatccgccattggcgatcgacgaagtgatcaggggctagctcctttgcgctgcggctttgaccgcggtgtcgaagcttcttgcacatggccttccagttggacaacgggtactactcccatcaagctttagccatgatgagaaagaaaaaaactgaaccccgtaatgctggggaaagttctggaactcaacaagccactggagctcctggacggggtccttcacagcgacctgagagagctcacagcatggaggtggtggttggcaacctgccaatcctcaatatgctcaacaagctggtcgtggtggtggacaacaccagggacgtggtggacgttaccagggtcgtggagggccaacatcacatcaaccaggtggtggtccggttgaatatcaagcacatgagtactatggccgtggtgtccaacggcaaggaggaatgccacaacacaggagtggcagtggtggacatggagttcctgccagtccatcaagaacagttcccgagctgcaccaagcctcacaagaccagtaccaagctacggtggttgcaccatcaccatcaagaactgcaccatcttcgctgcctgttgaggccagcagcgaagaagtccaacatcagtttcaggaacttgccatccagggtcaaagccccactagccaggccattcaaccagcaccaccatcgagcaaatcagtgagatttccaatgcgccctggcaagggtacatttggtgataggtgcatcgtgaaagccaaccatttctttgctgaattgcctgacaaagaccttcaccagtatgatgtgtctataactcctgaggttccttcacgtggtgtcaatcgtgctgtcattggagaaattgtaacacaatataggcagtctcatttgggtggccgtcttccagtctatgatggaagggagagcttatacacagctggtccattaccatttacttctaggacctttgacgttattctgcaggatgaggaagagagccttgctgttgggcaaggtgcacagaggcgtgagagaccatttaaggtcgtgatcaaatttgctgcacgcgctgatctccaccatttagccatgtttttagctggaaggcaagcggatgctcctcaagaagctcttcaagttcttgacattgttctacgtgaattgcctactgcaaggtactctccagttgcaaggtcattttattcgcctaacttaggaaggcgccaacaacttggcgagggcctggaaagttggcgtggtttttaccaaagcatacgacccacgcagatgggactttctctgaatattgatatgtcatcgacagcattcattgagcctctacctgtgattgactttgttgcacagcttttgaacagagacatctcagttagaccattatctgatgctgatcgtgtgaagatcaagaaggccctaaggggtgtaaaggttgaggtcacacatagaggcaatatgcgcaggaagtatcgcatttctggccttacctcgcaagcaacacgagagttgtcttttcccattgataatcatggtactgtgaagacggtggtgcaatacttccaggagacatatggatttaacattaagcacacaactttgccttgcttgcaagtgggcaatcaacaaaggccaaattatctaccaatggaggtctgtaagattgtggagggacagcgttactcaaaaagactaaatgagaagcagataactgctcttcttaaagtgacctgccagcgccctcaagagcgtgagctggacattttgcagactgtgcatcacaatgcataccatcaggatccatatgcacaggagtttggcataaggatcgatgagcgacttgcatctgttgaagctcgtgttctaccacccccctggcttaagtaccacgatagtggcagagagaaggatgtcttgccaagaattggccaatggaatatgatgaataagaaaatggtcaatggtggtagagttaacaactggacatgcatcaatttttctcgtcatgtccaagataatgctgctaggagtttctgtcgcgagcttgctattatgtgccaaatatctgggatggacttctcaattgatcctgtggttcctctagtgactgcaagacctgaacatgtggaaagagcgctcaaggcacgctatcaagaggccatgaatatactgaaaccacagggcggggagcttgacctgctgattgcaatattgcctgacaataatggttctctttatggcgatctcaaaaggatatgtgagactgatcttggattggtctcgcaatgctgtcttacgaagcatgtttttaagatgagcaaacagtatttagcaaacgttgcccttaaaatcaatgttaaggtgggaggaagaaatacagtacttgttgatgctttgacaaggaggattccccttgtgagtgataggccaacgatcatttttggtgctgatgttacacatccccatcctggagaagattctagcccttccattgcagctgttgttgcttctcaagactggcctgaggtcaccaaatatgccggattagtgagtgcacaggcccatcgtcaggaattgatacaggatctttttaaagtatggaaagatcctcaaagaggaactgtaagtggtggaatgatcagagagcttctcatttctttcaagagggcaactggacagaaaccccagaggattatattttacagggatggtgtcagtgaaggacagttttatcaggttctgttttatgagcttgatgccattagaaaggcatgtgcatctttggaagccgattatcagccacccgttacctttgtggtggtccagaagcgtcatcacacaaggctgtttgctaataaccacaaggaccagcgcactgttgacagaagtggaaatatactaccaggcaccgtggttgattcaaagatatgccatcctactgagtttgatttctacctgtgtagccatgcgggcattcagggaacaagtcgccctgcacattatcatgttctgtgggatgagaacaagttcactgctgatggtttgcaaactctgacaaacaacttgtgctacacctatgcaaggtgcacccgttccgtatcaatcgttcctcctgcatattatgcccatctcgcggcatttcgagctcgattttacatggagccggatacttcagatagtgggtcgatggcgagcggtgcccatacccgtggcggtggcccccttcctggtgcacgcagcactaagcctgctgggaatgttgctgtaaggccgcttcctgatctgaaggaaaatgtcaaacgtgtcatgttctactgctaagtttgggaatatttgtgtatgggggaaaacgtctgacggtttgagtcgccccctgttatctaagacggaacgacctatagtgtgtgtacgttaatgattgtggtgctgtgaactatcgaccatgatctggttgtttatctattatcaacactagaagttgaggattctagactctttcagtgtggctactcaaatcatatcgtcgaagaaatgtaataattgacaattacattgctgccatgtttccaggacaagctgatctcagctactgcggttcctttccacttgttggatgcgcaccttgattcgc

SEQ ID NO: 4883 - DNA, 3168 bp, Oryza sativa
  Predicted polypeptide sequence is orthologous to G1146
atgtcttcgcgcggcggcggcggcggaggccgccgcggtgggcgaggcggcggtggtgggcgggaaggaggcggaggtggaggtggaggtggcgggaggggtggccagggtaggggcgatctcggcgtcgtcggcgagcggcaaggcggtggtcgaggggcgggtgagcgcggaggccgtcacgacgcgccgcgcggccgtggcggcgtcgctgtgggcgccggggctgggcggcagcagcagcagccattccacgccccggccccgccatctggcggcggcggacgaggcggcgtgcaggtgcagcccaatgcggcggcgcgtcgacccgtaggcggcgggcgcggcggcgtcggagtgccggcgcctgcgccggcggttgcggtgggggctctgtgcggcgagatgaaggggaagatggttgtgtcgggtggagcgccgccagcaggccagggttcgtcgttggcggcggcgcagggcacggacaatgtcaagagagagccatctcaggtcgccgcaccggcgcccgcgcccccgcccgcgacgctgccgccgtcgtcgagcaaggcggtgaccttcccggcgcgtccggacgtcggcacgatcgggaggcggtgccgcgtccgcgccaaccatttcctggtgcaagtcgcggacaaggacatctaccactacgacgtggtgatcactccagaatcaacttatcgtgagagaaatagatcaataatcaacaaacttgttgcgttgcacaaacaattcttggatggtaggttacctgtctatgatggaagaaagagcatatatactgcaggtccactacctttcaaaaccaaagactttgttgtcaagcacattaatcctttgaggggtaaccaacgggaggaggaatacaaggtgaccataaagcaagcctccaaaacagatctgtacagccttaagcagtttttggttggaaggcagagggagttgccacaggacactattcaagctcttgacattgctcttagggaatgccctacctcagtaaattttacttgtgacaggtatgtatctatctcaaggtcatttttctcccaatcatttgggcatggtggcgagattggtagtggtacagagtgttggagggggtattaccaaagtctgcgccccacgcagatgggactgtcgctaaatatcggtatggatttacctcaaaatatttctgcaacagcattttacaaggcccagccagtgatggactttgcagttcagtatttgaacatccgagatgtttcaaggcgcttgtctgatcaagatcgtattaaactgaaaaaggccctaaaaggagtccaaattgtggcaactcactggaaagagaaatccatacgttacaagatcactggaataccctcagctccaatgaatgaattgatgtttgatctagatggaaacaggatatcagtcgtccaatactttaagaaacagtacaattactccttaaaacatgttaattggccatgccttcaagctggcagtgatagcagaccaaaatatttgcctatggaggtctgcagtatacttgaaggacaacggtattcgaagaagctaaatgagcatcaagttacaaacattctaaggatgacatgtgaacgacccgcacaaagggagagcagtatcatagagattgttaatacgaactcttatggcaatgatgattgtgcaaaagaatttggcatcaaagtcgctaaccaacttgccgtggttgatgcccgtgtactgcctacccctaggcttaaatatcatgactctggaagagaaaaagtatgtaatccttccgttggacaatggaacatgattaacaagaggatggtaaatggaggatgtatcaaccattggacctgcctatcttttgcttctcggatgcatgtaaatgacattaggatgttttgtgaagacctggttggcatgtgcaataatattggcatgcaaatgaatacgagaccatgtgtggatatcatacaaggacagcaacgcaacatcgagggtgcaatcagaaatatccataggcaatcttcagaaaagcttgaccagcaagacctgacagggcagcaacttcagttattaattgtaatattgactgaaattagtggttcttatggaaggataaaacgaatttgtgaaacagaggttggtgtgataactcaatgctgtgcacccaagagtcttcagaaaggtgggaaacagtatcttgaaaatctggccctaaaaatgaatgttaaggtcggggggcgaaatacagtacttgaagatgcgttgcacaagaaaataccaattctgacagatcgtcctacgatagtgtttggagcggatgttacacatccatctcctggggaggatgcttctccatccattgcagcggttgttgcatccatggattggccagaagttacaaagtacaaatgcttggtatctacacaaagtcatagggaagaaatcatatctaatctttacacagaagtgaaagatccattgaagggaattattagaggtggaatgattagggagttgctcaggtctttctaccaagaaactggacagaaacctagccggattatattttatcgagatggtatcagcgagggacagtttagccaagtgttgctttatgaaatggatgcaattcgcaaggcatgtgctagtttgcaggagggctaccttcctccagttacatttgttgttgtccagaaaaggcatcacacccgcctatttccagaaaatcgtcgagatatgatggatagaagcggaaatatccttcctggaactgttgttgacacaatgatctgccatccgagtgagtttgacttttacctctgtagccattctggtatcaaggggacgagccgtccaacacattatcatgttcttttagatgaaaatgggttcaaggctgatacgctgcaaaccctaacctacaatcttagctacacctatgcccgatgcacccgagcagtctccatagttcctccagcatactatgcgcatctgggagccttccgagcacgctactacatggaggacgagcattctgatcagggctcttcttcctccgtaacgacgcgaacggatcgatcgacgaagccgcttcctgaaatcaaggagaatgttaagcggttcatgttctactgctga

SEQ ID NO: 4884 - DNA, 690 bp, Oryza sativa
  Predicted polypeptide sequence is orthologous to G1146
gtggatccccgggctgcaggttttttttttttttttttttttgaggtcaaaacgacttatagtatagaaaggagagagtacaaccctaggagacaggtcaccacagtccacaagcatttaacagtagaacatcacacctaggacacgatcagcaatctttggaacattcagaaactcaggcaactcagaagacacttcattcctgatgcttgatccatcgccaaacttcccgagatagcttcgtcctcgggctgcagcaagatgagcatagtatactgggggaactatagaaacagcacgggtgcatcgtgcatacatgtaacataggttgtgcgtaagcaactgaagcccgtcagcagtgaaatgattttcatcgaagataactgtataatgcgtaggtctactgtttccctgagaagtatggctacacaaataaaaatcaaaacccgaaggatggcatatgtcttggtcaatcacagttccagagggaatctgtgcaacttgttcagtataattactgcaaagtgtgtgagggaaaatcctggtgtgatgccttttctggacaatcactaatgtgatgggtggcagataatcctcttgtagagagaggcatgccttcctgatggcatctacttcatgaatgataacctggctgaattgactttcgcttattccatctctgtaaaagat

SEQ ID NO: 4885 - DNA, 3165 bp, Oryza sativa
  Predicted polypeptide sequence is orthologous to G1150
atggagggggagcgggagggggtggtggccaagaacgaggacaacgcaggcggaggtggtggtggattaggtacaggtggtaatggtggtggcggcggcggcggcagcgcgaacgggcggaggaggtggaggggcgggggcagcagcgggtataggcagcacccgatcatccaggcctacccggcgctcctgccgctgccgataaacggcgccaccggccacgcacacatcaacggcgcggtctcgctgccgctgcctctgccgccgccggtgctgctgtacctgcagccgccaccgccaccgccgctgctgcccctgctccccaaggtcgccgccgccacgttctacggcaagccacccaaggcggccgacgcggcaccgaggggctcaatgtggaagcacaggccatcgaaaaagccgccaccgcatgccattaccgccgcgctgctgccgctcccgcggggtattgatttgctaacagatggcaaggcgcttcaggagaaaatattcttcgcaaatgaaagaaaaacatctgaaaaggaggtaaatcatgtagacacccatgagaagtttactgttgcaccactggataatgcaatagcacggagacctgacatgggtggtgttgagggggccgagatccctctttctgcaaaccatttccttgtccagtttgatcctggccagaagattttccattacaatgttgacatatctccgcgtccatcaaaagaaacagcaagaatgatcaagaaaaaattagttgaagaaaatccaagtgttctctcaggttcccaaccagcctttgatggccgcaagaacttatatagtcctgttagatttcaggaggacagggttgagttctttgtcagcctcccagttgcattagcacgatgttcagtagttaaagaggatactggccacatgcttgacaaacagaaactcaagactttcaaagtgaatgtccggttggtttcgaagttatgtggtgaggacttgaacaaatatctgaacgaggacaaggatggcatccctcttccacaagattacctccatgcattggatgttgtgttgcgtgaaggtgctatggaaagttctatccttgtgggtcggtcactgtatgcacgctccatgggggaagcaagggacattggtggtggtgctgttggattaagaggtttctttcagagattgaggccaaccaagcaaggccttgcccttaatgttgatctctcactctcagctttccacgagagcacaggcataatttcatacttgcagaagcgctgtgacttcttgaaggaccttccacagaagaaaacaagggctttggcagaagaggagcacagggaggtggagaaagcattgaaaaatatccgggtatttgtgtgccatcgtgagactaatcaaaggtaccatgtgcatagcttgactaaggagacaacagagaacctcaagtttcgcgaccgaagtgggaaggatcttatggtggtggattacttcaaggagcactataaccatgatatacaattcaggaaccttccatgcttgcagattggcaggagcaagccatgttatgtgccaatggagctttgtgtagtttgtgagggccagaagtttcttggcaagctgtctgatgaacaaacttctaagattctgaaaatgggttgtgaaagaccgagtgaaagaaagggaatcataaagggtgttgtcaaaggtgcatttcatgcaagaagcgatacttatgctgatcagtttagtctccaagtgtcgaaacacatgacgaaactctctgggagggttctcttgcccccaaaattaaagcttggcagcagtgggcgcatcaaggacataacaccggaccgatttgatcgacagtggagctttctggatagccatgttgcagagggttccaagatcaagagttgggccttgataagttttggtggcaccccggagcagcacttttgcattacaaagtttgtgaaccagctatcaaatcggtgtgagcagctaggaattctgctaaacaagaagaccattatcagcccaatatttgagaggattcaactactcaataacgtgggaattttggagggcaagctcaagaaaattcaagaagctgcatcaggcaacttgcagttgctaatctgtgtcatggagaggaggcaccaaggctatgctgatctgaagcgaattgcagaaacatccattggtgttgtgacacaatgttgcctttactccaacttgagcaagctgacctctcaattcttgacgaatttggctttgaagatcaatgcgaaactcggtggctgcaatattgccctatacagcagctttccatgccaaattcctagaatatttttgtcggaggagccggtgatgttcatgggtgctgatgtcacacacccgcatccccttgatgattcaagtccatcagtggttgctgtagttgcaagcatgaattggccgtcagcaaataagtacatctccaggatgagatcacagacacaccggaaagaaatcattgagcaactggatgttatggctggtgaactgcttgaagagtttctaaaagaagtggggaagctcccaagcagaatcatattcttcagagatggtgtgagcgagacacagttctacaaggtgctgaaggaggagatgcatgcagtgcgcacaacttgttcgaggtatccgggttacaaacccttgatcacattcatcgtagttcagaagaggcatcacactagactcttccacagggagaggaatggcagctcgtcacactactctgatcagaacataccaccaggaacagttgtggacactgtgattacacacccaagggaatttgatttctatctgtgcagccactggggcaccaaggggacgagccggccaactcattatcatgttctgtgggatgagaataacttccgttccgacgaagtgcagcagttgatacacaatctttgctacacatttgctcggtgcaccaggccagtttctcttgtcccaccggcttactacgcacatctcgcggcatatagaggcaggctgtaccttgagaggtcagatacaactatgtacagggtcagtccgttgcagactgtgccgctacctaagctcagagacaatgttaagaggctcatgttctactgctag

SEQ ID NO: 4886 - DNA, 1548 bp, Oryza sativa
  Predicted polypeptide sequence is orthologous to G1198, G1806, G558
actcactatagggctcgagcggccgcccgggcaggtgtcgctcgtcgacccctctccgccgccgaggctcgctgtcccaagctaatccgtccgcttcgttgaggattccattgaatgcttggctgtggtggagtgctacactgctagtagcagcttgcatctcagcaatttgggtgaaccccccacattcttgaggcagtaacaattggatctacatcttgccactacaaaaggatcaacgatctgtactagccttcatttgtgggttcctcattgggaattgggattctttacaatggcagatatgagccctaggacagatacatcaacagatgataccgatgataaccacatgcttgaaccaggtcagcttgctcttgctgctgcttctgactctgacagatccaaggacaaacatgaagatcaaaagacattgcgtcggctcgcccaaaatcgcgaggctgcaaggaagagtcgtttgaggaaaaaggcatatgttcaacaattggagaatagcaggctaaagcttacacaactagaacaagaattgcaacgagctcgtcagcagggcatttttatatccagctcagtggaccagactcattccatgagtggaaatggggcattggcttttgatatggagtatgcacgttggttggaagaacacaataggcaaattaatgagctaaggtctgcagtcaatgctcatgcaggtgataatgagctccgtggtgttgttgacaagatcatgtcacactatgaggagattttcaagcagaaaggaaatgcggccaaagcagatgtctttcatgtgttatcaggcatgtggaagacaccagctgagaggtgtttcttgtggctaggaggattccgaccatccgagcttttaaagcttctttcgacacagcttgaacctctcactgagcagcagctgtcagggatagccaaccttcagcagtcttcacaacaagctgaagatgctctttcacaaggaatggaggcccttcagcagtccttggcagaaacattggctgggtctcttggttcttctggatcaacgggaaacgtggcaaactacatgggccaaatggcaatggccatggggaagcttgggacccttgagaatttccttcgccaggctgacaacctgcggcagcagactcttcaacagatgcaaaggatactgaccactaggcagtctgcccgtgcgcttcttgtgataagcgattactcttcgcggcttcgtgcccttagttccctctggcttgctcggccgaaagaatagcaagcgcaagtaacttgactgcaaccacatttttcgggtttgggaggtgatggtgatcttacctggaagagttgacaatcctgcaaaggacttgattcggagatatttgcacatactataatccaaaagagatccttgtgttcaggtagcttagtcttatggttaagtgcattaggccctggcccatgttgtactgttagccgctgtaaaatactgttccattattacttatgtatctgtaatatcctaattttcagagaatg

SEQ ID NO: 4887 - DNA, 2155 bp, Oryza sativa
  Predicted polypeptide sequence is orthologous to G1198, G1806, G558
tcgagcggccgcccgggcaggaaaccgctcctcctcctcctcccaaatccaccacggcgacgccgccgccgcagagcccctagctcccggaggtccctcgcccccgccagctccgacggcctcacggaaggaggagtaacgtgggcgttgattggatttttttgttttccccccaccttgagtgagtctgtgccgtttccccggcggcgagggagggcagagggctgatcatggtcgtgcgccgccggtgccttgccgagatttcccccaaccgccaccgacgatcgttcacttggcacaaaggggagtagcactgtccaagctgttgtggtccgtcagggagattggccaacctgtggggtttcagatcgacataagtacgtcagtatttcagccatcgatcaatctggcggttatagggctgtgcttgcaacctttctggcagaaaggagagagcaaagtgatttgctgtctcctgttgattgtggcctgttgaggcccagtaatggcagatgctagttcaaggactgacacatcgattgttgtagacaacgacgacaaaaaccaccagttagaaaacggacatagtggtgcagtcatggcttctaactcttcagatagatctgacagatctgacaaacttatggaccaaaagacaattcggcggcttgctcaaaatcgtgaggcagcaagaaaaagtcggctgaggaaaaaggcatatgtgcaacaactagagagcagtaagctgaagcttgcacagctagagcaggaacttcagaaagctcgtcagcagggaatcttcatctctagctctggagaccagacccatgccatgagtggaaatggggcattgacttttgacttagaatacactagatggctcgaggagcaaaataagcagataaatgagttgaggacagcagtgaatgctcatgcaagtgacagtgaccttcgtcttattgttgatggcataatggcgcattatgacgaggtattcaaggttaagggtgtagctgcaaaggccgatgtgtttcatatactttcaggcatgtggaagacacccgcagaaagatgcttcctgtggcttggtggtttccgtccatctgagcttctaaagctcctagcaaatcacctcgaacctttaaccgagcagcagttgctgggattaaacaacctccaggaatcttctcagcaggcggaggatgcactttcacaaggtatggaagcactgcagcaatctctggcagatactttggctggatctctcggttcatcagggtcttctgggaatgtggcgaactacatgggtcagatggcaatggccatgggtaaactaggaacgctcgagaatttcctttgccaggcggacaacctgcgacagcagacattgcatcaaatgcaacgaattctgacgatccggcaagcctcgcgtgctcttcttgccatacacgattacttttcacgcttgcgtgctttgagttcgctgtggcttgctaggccacgggagtaacaaaatggtcatgtgtgcctgtgacgaggttagacgctcattttgatggactgcagataattgggtttttccctgtacaattgtgtttggcagctgtggactaaagttaaaaactgtacctaaagtggtgtatgcaaataggtgaagcctctaagtaattataacgattgcattattgtgttagcaataaaagttgggtaattcaggatgtgtcctgagttgttttgttgtagtagaagaactgcatgtagtggctggaaatgcagtgttgaatgtaactaaagctctgctgctcacgttgcataatgttgtgtagtaatagttagctagtgatgcccattttacctgcactcctctgggaagctgaaactgcaacctgaagcaaccacggtgcagaagaccgcatgcatggtaaatgattaaaaggatatatatgggctcaacatcgctgccaaatcctgagataatgaacaggcatgctaaactgctacttccacatgaaacctcccagttgacatgaagaatgagctgttcagttttatggtttctgtgttgcactgtacataattcctgtacgggtctgaatttatcctgaaatcatgctaaactgcagaagcatatgaaatctccagaccggttgacatg

SEQ ID NO: 4888 - DNA, 1654 bp, Oryza sativa
  Predicted polypeptide sequence is orthologous to G1198, G1806, G558
tcgagcggccgcccgggcaggtcgcctcgcctctctctcttccttctgaccaacccgacctcggcgcctccccccatttctctctctctctcttcgcgttgccgtctcgaccccgcctccaccgccgaagccgcccgaggcggcggccgccggcagctgggctcctccgaatccgaacacggcggggtctctcccctcgctccccacggcggttggcacctgctggctctcgatccaacgtgtacagctaatttgatctgttggcgccttagctagaaaggtggcgactctggcatctcagtgatcatagggcatttgaaggtggcctgcatccctgttacaagtaagggacaacaaagcaatttgttgtctctttatttggagctgggaagaacccggcatggcagatgctagttcgaggactgacacatcaacagtcctggataccgacgataagaatcagatggtagacgggcaaagtggagctattgtgccttctaattcatctgatcggtctgacagatctgacaagcccatggaccaaaaggtgttacgccggcttgctcaaaatcgtgaggctgcaagaaaaagtcggctgagaaaaaaggcatatgtacaacaattagagagcagtaagctgaaacttgcaagcttggagcaagagatcaataaagctcgccaacaaggaatttacatttcgagctcaggagaccaaactcatgctatgagtggaaatggagctatgacttttgatttagaatatgcccgttggttggaggaacaaaacaagcagataaatgagctgaggactgcagtaaatgctcatgcaagtgacagcgacctccgtctcattgtagatgggataatggcgcattacgatgagatattcaggctgaagggtgttgccgcaaaggctgatgtgtttcatatactttcaggcatgtggaaaacacctgctgaaaggtgcttcttgtggcttgggggttttcgttcctctgagcttctaaagcttcttgtgaatcagctcgagccattaactgagcagcagttgttgggactatcgaacctccaacagtcctctcagcaggctgaagatgctctatcacagggaatggaagcgttgcaacaatccttggcaggtacgttggccgggtcccttggtccatcaggatcttcagggaacgtggcaaactacatgggtcaaatggctatggccatgggcaaacttgggacccttgagaatttcctccgtcaggctgacagtttgcggcagcagactttacatcaaatgcagcgaattctgacaatccgacaagctgcccgtgctctacttgcaatacatgattacttctcacgtttgcgtgccctgagttctctctggcttgctaggccacgggagtaacaacacatagggtgcatcaccgttaatgcttcatgaactgatctgggaggaacggcggagcgggactgattgcggatgcatttgcagaagattggtggctcagttccctcggcacaagttgtattgacaccttttggtttcatgttgtacctgatgttgtacaagtagggtaaagcttgtaacttgtaagttatggtgaatttatgattggcagattgtacaattgtattagcaataaaataaaaggtaggt

SEQ ID NO: 4889 - DNA, 1565 bp, Oryza sativa
  Predicted polypeptide sequence is orthologous to G1198, G1806, G558
atcatcttcttcctcctcccgacctcccgctcctccgcactagtccgaatccgagctccaagtcgtcgagcaacctcaccgccggaggacaccttccgccgctcgccgtcgccgccgccgccgccgccgcgcagcatggcgtagcggtggtgggcatggcggcgcaccaggggatggcggcggcgacggcggcggaccggttctgcctgccgaggatggcggcggcggcggcggccgcctcgcaggtggagaactggggcgactccggcgtcatcgtcagcagcccgttcaccgacgacacctccaccgacctcgacgacagcgccgacaagcaccacctccacgctctagtgggcggcggcgatggcggcgacgacgccggcgagcagcgaggcgcggattcctccgccgtgtccaaggaaagaagaggggatcagaagatgcagcggaggcttgcgcagaatcgcgaggcggcgcggaagagccggatgaggaagaaggcatacattcagcagttggagagcagcaggtccaagctgatgcaccttgagcaggagctccaaagggcaagacagcagggaatcttcattgcaactggaggctccggcgatcacgggcactcgatcggaggaaatggtacgttggcgttcgaccttgagtacgcgcggtggctggacgagcaccagcggcacatcaacgacctgcgggtggcgctgaacgcgcagatgagcgacgacgagctgtgcgagctcgtcgacgccgtgatgatgcactacgaccaggtgttccgcctcaagagcttcgccaccaagtccgacgtgttccacgtcctctccggcatgtggatgagccccgccgagcgcttcttcatgtggctcggcggcttccgctcgtcggagctcctcaaggttcttgccagccatcttgagccgctgacggatcagcagctgatgggcatctgcaacctgcagcagtcgtcgcagcaggccgaggacgcgctgtcgcaggggatggaggcgctgcagcagacgctgggggacacgttggtgtcggcggccgccaccgtggtcagcggcggcggcggcgccgacaacgtcaccaactacatgggacagatggccatcgccatggccaagctcaccacgctggagaacttcctccgtcaggctgatctgctgaggcatcagacgctgcagcagatgcaccggatcctgaccacgaggcaagcggcgcgggcgctgctcgtcatcagcgactacttctcgcggctccgggcgctgagctcgctgtggctggcgcggccgagggactagactgactaaagaggatcaatatcatttgcctgagttctgagttctgacgatggatggaggtgaacctgttttttgattgctgaatcctgagagagcgttaactgcgatcggcattgtaaaatcagttgctttggtgatgaagcagtagtagtaggagaatattttagattgggctcttgggcctgtaacgtgttgtagtgttagcgtagtaagaactaatccgcgtacaatgtcaaaaggagaagttttatt

SEQ ID NO: 4890 - DNA, 1831 bp, Oryza sativa
  Predicted polypeptide sequence is orthologous to G1198, G1806, G558
tattatgctcaggttattcatcattatccacagatatgttttttcttctttgcaaatattctccttttcccagagccgcattggactccaatacaagagtcagagggtggaagcaaagaaatcgtagtaaatgatctctactggcctctgtagccaaaggattcagcaaatctgcgaagacctcacgagtcaggagctttccaggagttgcaacctgcagctgctgcttactttggtgagttggagaaggcccttatccatggcaccagtgctggtgctggtgtcgatcatggcatgatccaaagtgacgcgtacacagagtcagcaggatatcttgcagctaggccccccacactggaaatcttcccttcatggccaatgagtcatctacaggagccatacagtaactcgcagtcagtagggagcaccactgactctagctcagctcagaacacaatgtcacaggccgagttggtgtccccagcgagcatgaggtccgactctgggcaggaacagcaacaacaggaggtattgatggtgaccattgatgattacaactacaaacaaggacttggagcagcaatagctactgcaccaagctttcagcaacatgcaggaggcctagacatgaggaagcatggatccactagaaaagacggaaaactgttagatgccaagactgaaaggcgattggctcagaacagagaagctgcaagaaagagcaggctgaggaaaaaggcttatgtgcagcaacttgagactagccgcataaggcttcagcaaatcgagcaagagcttcagagagcacgctcacagggcttgtttcctggaggatgcagtgcacctggagatatgagctcgggtgctgtaatgtttgacatggattacacccgatggatagacgacgacagcaaatgcatggcagagctccagggcgcgctacaggcccagctccccgacggaaaccttggtgccattgtggaagaatgcatgcgccactacgacgagctcttccaccttagggccgtgctcgccagctccgacgtgttccacctgatgactggcatgtgggcggcgccggccgagcggtgcttcctctggatggccggtttccggccatcagaaattctcaaaatgctgatacctcagctcgatccactgacggagcagcagctgatggggatgtgcagcctgcagcagtcgtcggagcagaccgaggaggcgctcgcgcaggggcttcaccagctgcaccagtcactggccgacgcggtgggcggcggtcctctcaacgacggcgcagatgttgccaactacaccggcctcatggccctagcacttggcaggcttgagaacctcgagagcttttatcgtcaggctgataatctgaggcaggaaacgttgcaccacatgcggcgaattctcacaaccagacagacagctcggtgttttctttccattggagagtataatcgccgtctccgtgctctcagctccctctgggcttcacgtcctcgcgaaaacttcattgcgacagagaatgtcagccctacaggaactgaatttcaggttattcagcaatctcagcaaaatcaattctccggtttctgagacctcttctccaggagggtacaaattctgcatttctgccagtagcaaggtggagagagagagagagagagagagagagcgaatgtaatgttctatcattatgatattgagaaaggaacatcactaggaaaaaaaaagatggcagaaagttggaaactggggcggctcgatcacttgctatgttccaatggctcttgaattgaatgaagggttagctctaagc

SEQ ID NO: 4891 - DNA, 1974 bp, Oryza sativa
  Predicted polypeptide sequence is orthologous to G1198, G1806, G558
ggatgcgtcgtcgccattagcggggagaggagcgggagagagctcgtcgggattattccgagctccatatccattgaaccgaaccagctctgagtgagagagagagagagagatcggagctgttgtttcttctcgtttctttgattggtggcggtgttgaattgaattgaattgatcgatcgattgtttcttggtgtggtggtggcggcgacggcgagcagcgcgccaaggtacatgacctcggcggcgccggcggccgcgcagttcgctgcgccggcgccggcggcgatggggatctacgaccgccggcaccatcccctcgccgccggcgtctggggagaccaccccttcatccgcccggacaccaccgccagcaccagcaacgccgccgccgccgccatggtcgtcgcgccgccgccgctaacagagcccaagttcgagagccagctagctctgcctctgcagcatggagacgatcaagacaacgctgcagctctgcaagaatcgccgaggcatgcgtcggacagcttcgagcaggaggcgtccaagcctcgagacaagatccagaggcggctcgcgcagaacagagaagcagctcgcaagagccggctacggaaaaaggcttacatccagaacctggagacgagccggatgaagctggcgcatctggagcaggagatcacccgagcaaggcaacagagcgcgtacatcaaccgcagcagcaacccagccaccctaccagcgcccatcgattcaggtgtggtgacgttcgaggtggagtacgcgcagtgggtggaggagcaggggaggcagacggcggagctgagggcgtcgctgcaggcggcggcggaggggccggagctccgggcggtggtggaggcggcgctggcgcactacgacaggctgttcgcggcgaagcgtgaggcggcgaggcgcgacgtgttcttcgtgatgtccggcgtgtggcgcaccggcgccgagcggttcttcctctggatcgccgggttccgcccctccgaggtgatcagggtgctcgcgccgcagctggagccgatgacggagcggcaggccgccgacgtgcaggggctccagcagaaggcgcgccacctcgaggacgcgctgtcgcagggcatggacaagctgaagcagacgctcgccgactcgctgctcgccgaggccgtcgtcgtctccacctcctgcgacgcctcgccgccgccgccgccgccggaggaggaggagccgtcgtcctccgccgccggtgacggcggatgctacatggcgcagatggggagcgccatgggcaggctcagcaacctcgtcgcgttcgtcgaccatgtacgccatcgccgatcaccaccacctacctcccatctccatgtccgacgacgagcagagctcggctgacatcttgctgatgacgtgcaggccgaccatctccggcaggagacgctgcagaacatgtacaagatcctgacgctgccgcaggcggcgcgcgggctcctcgcgctcggcgactactgccagcgcctccgcgcgctcagctcgctctgggcggcgcgcccgcgcgagccggcgtaaagcgagctgagctcgccgccggcaacggccagcctgatcgatcaccggaggaggagcaagatgtcgtcgctgagctcgccggggaagacgacatggagctcaagtggctcagtttgagttctctgcattttcatttgcaaggacaggaaagaaattaaacggacgtgttcacttcatcataggatagcagcagcagcagtagctaggaggaggaggaggaggaggagaatttgaatttgaatttaaaagacgtgtaaatatttactacagtaattaacttgcttgggtagttatttgcgtcgctcaacttgtaattgctgccatttccatggataaaaaaaatgtcagggatggtcatatgaaaaattgggagtgattccaggcgcctgaagtttg

SEQ ID NO: 4892 - DNA, 4510 bp, Oryza sativa
  Predicted polypeptide sequence is orthologous to G1198, G1806, G558
gtccttgcgccatctcgcggctgaaccggggaggggcgccgatctctatccgacgagcagaccaagggaggggaggggatcctgggttcacccaaatatttgaagacccaagcgtttggtgattggcaaagatgggttgggggatatcccggttgattggactgaaagcagctgtgttcctctctgtggcttatttcttccatagattggacatgacactgctttcttttcccctcatatatgcctctgtgattgcgatgcttgtttctattgcttcacatccatcaattgaccttcctttgctccttggcaaggggtcgaatggaagctttcctgtgtggtcatggatcatgttctcaccatttcttcttttcatccatctgtttgttctgttacgaagatttgtgaaaaatgagcccttgtacactgagattgctgatggagtgtatgttggagggtggccctcttcagttgagcgcctgccccctggtgaacctgcagtcatagactgtacgtgcgagctcccaagaagctctactatatccgagaattcatatttgtgtgttgccacctgggatacaagggctcctcaaccatcgcagattgagtctgccgtgagatgggcactgagaaagcgttcgcagaacaaagctgtatatgtccactgtgcctatggccatggaagaagcgtctgcgtgatgtgtgcacttcttgttgcattgggattagctgaggattggaaagctgctgagcaaatgattcgtgagaagcgaccttctattagcatgaattctcttcatcgtaaaagtttagaggaatgggcaaaacacttgctcactccctcaaaaagaagtggggaatcagatgtgagttatgcgattctttcggatcatacccgaaaaaggcattgatctcgcaagaaaactaacttgctcagtggctgtgataattgagatgaagtttaaatgctctggcattatctactgttatcctagtcatgtccaaggcatttcattctctaagttaattgtttgggagtatgttgtaaaacttctactactgtggcttacaacgccagctcttttaggcgctctgttggctgcgtttgttgccctgacttgggattagggttcacagatggaatttcgcgaaaaccaatcggatttcttgaaactgctaggtctcggtttatgaaaaccggaccagttttgtaccgcattgaccgaaagtcatcggtttttaccggtttttggtcggatttcggtaaaccggtgaggagcggtttttacttcgaaattgaaaagtaaaacccttgttgggaacctttccttccccttcggcacaaaaaatagagcaactcattagcgcttgagcaattaagttagctcaaactaacttaaaaaatggatttaatatgatttttaaaacaactttgctatagaagagttttgcaaacaccatttagcattttgaaaaacgtgtgtgtggaaaattgagaggtataagttgggaaagctcgttgccgaacgcagcctaagaacaagttttataatagagccaactttaagtttatagcttatattagaattaacatgtatagtgatgagctataaggttatctctctatttttctcctctctctatctctctcatgcatatgcatttaatgtatttatcttgaagtatgtgaatagctatctcttgcataataagagccaatctttttcattttctaaattctctttcctccacataagtttatttgccttatagtgtactattaaacttgctctaatgatcttccctgtcattgaatgcttgccagagacgtggtattgtcggatctctctttctgaaaaagaggggcctctgctagcctgctagattctcatttatagcgaaatgtggtatgtttttcatttttggtagtttgcatctatctctctgttaggttcttttcatctggcctgaaataaatgctcaactattcaccactttgctgtacccctgtattctgtggacatttcatacttgactcatgaaaattttcatgtttgtatctcatgttttgtgtgtaatgatcgtggctaagctgtagtgtactcatcccatcatgctatcttgtgtggagtatgctcttctggccttttcataatttttgccatttttctgcccttgtctcaagcaccagtttgccagttgatggatcaaaatcaagagctgcactattggaacaatctacatcctacggaaagtcgcatgcctggcaagaaatatctcaaatggtcttggtagatgtcacatgacaaaagggttgcttttcacctttctagttctttgatcttcttatcagttgaattcactgatctgccctttcttccatttatttggtctttgaaaaaagggacttccatctatttgtttcttgttttactaataagcattgtgacattccttgtgacttgcgttgtttttctgtgtcctgttttttacatgtatttcagatgtacctcttagtgacaactattttgtctgtcaattgatggtattagatttgtcctccgtgatttcagagttcagacagttatcatctctcttccatcagtgccattagtgccaggttgggaaagccttatttgctggcacgttttcttttttcttttttttttttggtagtgttgatctgcgtcatgttctgttgttatctgtagatgtctattttcaaagtaagcttgggaacatcctacctttaaaaaaaatggcttgttcagcagaaatattagaggttgttttatgcatcgtcttttgggaggattttgtctgctcaagtcatgagcagccacgcatctcctgcctttgcattgctctggtctgcaacaattatttctgtgctaactcttcagcctgttcaagagccattggaagtttggaacaagtgagccagtgaccagcattgcattgcacctcaacaaatttttgcctcttccttttcctagtgatgttgctttctcaatactttaataatagaacattacaacccctctccctctcccaccctctctttctaacatcacttttggccggagtttacatcctccaggagaagctctcaaaatcctgagtactgattctgctgaggctgattatgcatcggttgcagctcggttcctgtgggactgacgctctcggtgccaatgaagttcctgttgcaagagaaaaaagagtcaatgccagccatgttcatctgtttctccgactagaagagatattgcacgaatatctgtcctcgatataacacatcaaatgatcaaatcaaccatccaccctatgaacactagtataattcatcgcttatctaatgactcgctggagataagcagttctgagtcttactcgcgaggacgtgaagaccagaggttgctgagagcacggaggcggcggtaatactccccaatggagaggaaacaccgagccgcctgccgggttgttagaatccgccgcagctgatgcaacgtttgttgcctcagattgtcagcctgcacatttgccaggaatgaagaagaaaaaaaaagtaagttctgcatgaatgatcaacggaacgggatgacaatgctaagctgttgacgtacctgctggtagaagctttcgaggctggcgagcttgtccagggcgatggccatgaggctcatgtagttgggcacgccggggccgtcgttgagcgtgccggcggcgacggtgtcggcgagcgactggtgcagctgctgcagcccctgcgcgagcgcctcctccgcctgctccgacgactgctgcaggctgtagatccccagcatctgctgctccgtcagcgggtccagctgctgtatcagtatctgcatatatagtcgacgatgagtatatattcgtgacacgcccatgcaggcaacgccggcgatgcaggcggcggcggcggcggaggcgaaccttgagaaggtcggaggggcggaagccgcccatccagaggaagcagcgctcggcgggggtagcccacgtgccggtgaggaggtggaagacgtcggagcgcgcgagcgccgccttgagctggaacagctcgtcgtagtgctgcatgcactcctccacgatgaggccaaggttggtgtccagcaggtgcgcctgcaggccgccacggaggtcggtcagccgcttgctgtcgtcgtccagccagcgcgcgtactccatgtcgaacatggccgcgcctgcaaacgattttactgcgccgtggtgagaactccgaggcacaccctcgtctgcaagctgcaggcttgcaggctgcagctgctgctgctcaacgcatcgaaaaaagaaacggacggctctgattaccagaactcatgtcgcctgctgctctgcaccccccaagaaacaggccctgacgatcaatcaagcaatgcgggtaccatattaaattcctgctaatttatttcatttctggatagtagaaaaaaaatagtactagtactagcatcagaaattc

SEQ ID NO: 4893 - DNA, 2225 bp, Oryza sativa
  Predicted polypeptide sequence is orthologous to G1198, G1806, G558
gtgactccatgacaaaacaccttcaagtagagacaagacctatacctctctctcctttcctctcttcaaagaagaaaaaaaccagcataggagaaaggaaggacaagatctttccatcaactgtgtgattagcatgccccagaccggaaggtgaagctgctacactttcagatactccatatcaagattcaagagagagctaaagctataggagtgagcagcaatagcaagagccaagaacagctagctactccagctgagagccaagaaccggtcaagctttgcttcttgcacttcttgctagctaaagctactccggtcacttttctgctatagtagctcttggctcttgcttatcacaagagaccacaatcttgatcgaagaaatttgagctagcgcttcgttctgattcttggagatactgggagatcgagctgtggttttgtggctcgtaggatgggagaggctaggagagggcagaatcctcatcatgttcttggctatggcttccatggcaccaccttgcccaactccatggcttctgcaaacctcttcgagcaaggaggaggaggaggaggtggcgctgcctattttggagagctagaagaagctcttgttcatcaggttgccacactcaggaggagggctcaacaaactgcaaccaccaccacctctcaccatggacacaccactcccttctccactgctgctgctgcagctacagcaacagcaacagctaggcctcctgctacactggacatcttcccatcctggcctatgaggaggagctctcttccaacaccgaaggatggatgttcaaatgtaacggcagacacaacggactccgagagcagcagcaagaacaacggcgatcagggtgcagcagcagccgacatggcgagccagtttgatcagatcccacagcagcagcagaagcagcacaagaagatggcagcaagttccactcacagtgaccacaggatgacaaagacacttgatccaaagataatgagaaggttagcccagaaccgagaggcagcacgcaagagccggctgcgaaagaaggcttacatccagcagcttgagagcagcaagttgaggctggctcagatggagcaggatctcgagagagctcgttcccagggcctcttgctgggaggatcaccaggtggaaacaccagcgcaggagcggcgatgttcgacgccgagtacgggcggtggctggaggacggcgggcggcggatggcggagctgcacggcgggctacacgcgcacctgccggacggcgacctgagggcgatcgtcgacgacgccctggcccactacgacgagctcttccgcctgagggcagccgccgccaaggccgacgtgttccacctcatcactggcacgtgggccacccccgccgagcgctgcttcctctggatgggcggtttccaaccgtccgatctgctcaagacagtggcaccccagctagaccctctgactgaacagcaagtggttggcatctgcagccttcagcaatcatcgcagcaggcagaggaagctctctcccagggcctggagcagctgcatcagtcactagctgagaccgtcgccaatggcggctccgtggtcaacgaagccagccttgggagcttcatgggttacatggcccttgccctgggcaagctgtccaaccttgaaggctttgtcatacaggctgataacttgaggcaacagactcttcatcagatgcacagaattctgacaattaggcaggcagctcgatgtttcttggcaattggcgagtaccataatcgcctccgtgccctcagctccctctgggcttctcgtccccgagagatattggtggcagatgaaggcaactgtggagagctaagcatagcagcacaaccatctgaaagccaattttcagctttctgatttacaaggactttgaagactaaccttcagataggagcagaagtaagcaaaactgggaacaaattttggaagtaatctgacacgtgtgggaaacactgatatgagctgggaaacaatgcaagctccagaactaggaagatttctcagaacccagattgcatagaactcacatggtaatttgcctgagatgtcaaatgatttaatgtcctgcccagtgacaacaaaaaggggttagctagattttgttgctgaaatactacttatttatgtgatttagtggcaaattatgtttcccgtg

SEQ ID NO: 4894 - DNA, 1899 bp, Oryza sativa
  Predicted polypeptide sequence is orthologous to G1198, G1806, G558
gagtggatgaaactccaaggctgattcaatttgccagtgtgtgagaaacgagaaacaaccaagaggctcatcaggatcaagtggctgatcatcatcatctctctctaggatgtagagctagtggtgatcatggtgcaaggtgaggagagttcttggaggatggcagcaagcacccaccatgagagagcaatacctctcaaccaagcacttgcctatggagtccaagcccatgcttctccttctgttgctgctgcaccacctgccagcttcttggacttccagcctgctgccgcggcagctgcctacttcggcgagctggaggaggccctcatccatggcgccaacgccggcggcgtcgtcgatcccggcatgatcagagccgacgtgcacagcaagtcggcggcagcggcagcgacggcaggatatctcgcggccaggccccccacgctggagatcttcccttcatggccaatgaggcagcaacagcagctacacagtgggaattcgcagtcagtcgggagcaccactgactcgagctcagcccagaacacaatgccgcagatggagttggtgtccccagcgagtatcagggcctcctccgagcaccagcaccagcagcagcagccggggcaggaggtcatgatggtgaccactgatgattacagctacaagccaggcctcgctgctgcctccccaagctttcagcagcagcatcagctccagcaccaccagcagcagcagctgcacggaggaggagaccatgacaagaggaagcatggatccacaagaaaagatggcaagtcagtggatgccaagacagaacggagattagcgcaaaacagagaggctgcgaggaagagcaggctgagaaaaaaggcttatgtgcaaaacctagagaccagcagggtcaggcttcagcagatcgagcaagaactccaaagagcacggtcacagggcctgtttcttggggggtgcagagcagcaggcgacatgagttctggcgcggccatgttcgacatggagtacgcgcgctggctggacgacgacagcaagcggctgaccgacctccgtggcggcctgcaggcgcacctgctggacaccaaccttggcctcatcgtggaggagtgcatgcagcactacgacgagctgttccagctcaaggcggcgctcgcgcgctccgacgtcttccacctcctcaccggcacgtgggctacccccgccgagcgctgcttcctctggatgggcggcttccgcccctccgaccttctcaagatactgatacagcagctggacccgctgacggagcagcagatgctggggatctacagcctgcagcagtcgtcggagcaggcggaggaggcgctcgcgcaggggctgcagcagctgcaccagtcgctcgccgacaccgtcgccgccggcacgctcaacgacggccccggcgtgcccaactacatgagcctcatggccatcgccctggacaagctcgccagcctcgaaagcttctaccagcaggctgacaatctgaggcaacaaacgttgcatcagctgcggcggattctaacaacccggcaggcggctcggtgtttcctctccattggggagtattaccgccgcctccgtgctctcagcaacctctggtcttcacgtcctcgcgagaacttcattggcaccgagagcgtcagtcccacaggaaccgagctgcaaccgatgcataatcagcctcagcagaatcagtactcaggattttgagagcttctcctggaggatgtaaactccggccaaaagtgatgttagaaagagagggtgggagagggagaggggttgtaatgttctattattaaagtattgagaaagcaacatcactaggaaaaggaagaggcaaaaatttgttgaggtgct

SEQ ID NO: 4895 - DNA, 2027 bp, Oryza sativa
  Predicted polypeptide sequence is orthologous to G1198, G1806, G558
gtcatgacaaaaaccttcgagtgaagacaagaccctagaccgtctctctctctctctgaccaaggctagctagggaaggaagaacaaaaacagcataggaaggacaacatctttctctgaactgtgggattagtacgcccaagaacgtgaagctattacaccgtcagatatatcaagaagatgcaggcggagcaagagcaactgcgcacagaaacggtcaggcatgcctgctctccctcctgcttgtcataaaagggaagccacaagctgaagccagattgctagaaggtagttcttgaggactgaagcaaggtagaagaacttgagcttctggttcgtgtggagctactgggataagttggctgctgattgctgaagatgggagaagctagcagtagttcaggacatccaaggcagaatcctcatgttcttggctatggcttccatggagctatgcccaactccttgccttctgcaaacttgttcgagcagcaaggaggtgctaactattttggagaactagaagaggctctgatgcaacaggtggccacactcaggaggactcaacaaactgcaaccaccacctccacccttcatcatggagacaccacccccttctccaccactgctactgctgcggctacagctaggcctcctcctacactggacatcttcccatcctggcctatgaggtctctccacacacccaaggagggttcaaatgtgacagcagacacaacagactcggagagcagcagcaagaacaacagcaaccaaaatgcctcatcagaccagcatgtgctagtaggagacatggcaggccagttcgaccaaattccacagcaggaacaacacaagaagatggcaactaacagtcccactcatagcagcaagactggcaaggcgcttgatccaaagacgatgagaaggctcgcccagaaccgagaagcagcacggaaaagccgactgcgaaagaaggcttacatccagcagcttgaaagcagcaagctgaagcttgctcagatggaacaggatatccacagagctcgttcccagggcttactgcttggagctccaggtggaaacaccagctcaggtgccgcaatgttcgacgtcgactacgcccggtggctggaggaagacagccagcgcatggctgaactgcacggagggctgcacgcacatctgccggacagcgacctcagagccatcgtcgacgacacgctaacccactacgaccacctcttcaacctcaagggcatggcggccaaggccgacgtgttccacctcatcaccgggatgtgggcgaccccagctgagcggtgcttcctctggatgggcggattccggccctccgagctgctcaagacattgacaccccagctggatcccctgactgagcagcaagtggttggtatctgcaatcttcaacagtcatcgcaacaggcagaggaagctctctcccagggcttggatcagctgcatcagtcattagcagaaaccgtggctggagggtccccgttggatgaccccaacgtcgggagtttcatgggtcacatggctattgccctcggccagctatcaaatcttgaaggttttgtcatacaggctgataatttgaggcagcagactatccatcagatgcacaggattctgacagtcaggcaggcagctcgatgtttcttggccattggagagtaccataatcgcctccgtgccctgagctcactttgggcttctcgccctcgagagatactggtggcagatgaaggcaattgtggagagctaagcattgcagcacatccatctgagagccaatattcagccttctgaaatcctgtttcaaatgtattttgcaactaaccttcaaagtagggagcaaaagcttgttttttaaatgaaatctagcactctagcagatatgtgagaaactcagaagagagttgggaaacaatggaaggctccagctgcactagcaaaattttcagatggaatgaatgggattgcatgattttcagttactgatc

SEQ ID NO: 4896 - DNA, 3130 bp, Oryza sativa
  Predicted polypeptide sequence is orthologous to G1198, G1806, G558
gacccaacccaacccaacctcaacctcaacctcaagctctcctcctccttcctcctctgctcctgctcctgctcctgctgctgccgtgtgctctgctggctgctcctgctggtgaggtggtggtctctctccccccacttcaccatctcctcctctccttcgccgccggcgcgcttgcttcctcctcagcacgccacctcctcgcccctcctcatagctcaatcagattactcgaccgtgcaaacatcctgaccattttctacagccccgcgctttagcgttcttgtttttttttttttggctgctgctgatttggtggcggcggctatcttggagagagatacagaatccgtgcttcttcttgagcgagctggttggttggtggcatgaggcgtggagagcttcagagtgagtgccatggcgcgtgttgattgctgttggtggtgagatggagggtggtaggctaggaggagcggcggcttcagcatcggcggcggcggcggcggacgcgcgcggcgggatgtcgggcttcgcggctcctcagcacgccatccatacaaatttgaacaacgtgcaacctactcaagttactgattttggggcacttgcgcagtctgctggattccgaatagaagatctcgctaatctcagtacaaatggtttgttcaatctgaagtcaaatgctcataccattatcaatgaccccctccaatttgagaattatgtaaagtctatttctccgtctaatattactacaacagcaacagtaacagtagttgaccctcagacactggtcccacaaaagggagcacaactgaatttggtaactataaggactggtaacgttgagaattggggggagtcgactattgctgatacaagtccaaggactgatacatcaacagatccagacactgatgagaggaatcagatgtttgaacaaggacagttagctgctcccactgcttctgattctagtgacaggtcaaaggacaaactagatcataagacacttcgccgccttgcccaaaatcgtgaagctgctaggaaaagccgtttaagaaagaaggcatatatccaaaaccttgagagtagcagattgaaacttactcagatagagcaagagcttcagcgggctcgtcaacagggcatttttatatcaacatcgagtgatcagtcccactcagcgagtggaaatggagctttggcatttgacatggagtatgcacggtggttggaggagcataacaaacatataaatgagttgagggctgcagttaatgcacacgctggtgataatgatctcaaaagtacagttgatagtattatggcacactacaatgaaattttcaagctcaagggtgtggcagccaaagcagacgtttttcatgtgctgtcgggaatgtggaaaacccctgctgagaggtgcttcatgtggctaggtggcttccgatcatctgagcttcttaaggtaagaatatactattattatattgcgcctacttattttgaagcctcacccggaggcaaaatgctgacctgaatatatattattttaattgatccaatatttttcttaggctctgttttttttgaaaggaatactaccaggcaatggcccagtagtgtattttatagaagccaacaaagtttttacagggaaaaaaagaaaaaatacaaaaggctacaaccccctatagaagctataaagtttgtaaccaattagaaaccaattgtctaagatcatcattcatcctacacatatgtagaagaatttcatgcttaaaagaattccaccagctgtcaaatgaaggatctatattctggaaaatctttccattcctttgcttccaaatgtgccaacacgcaatgaaataaatctccaagaatccttttttctgaaatctcaatcttgctagcaccagcatccttttttctgaaagaattctagagaagtgttccaagatattcccagcttctgccaacattttctactaaaagggcattgaaagaacaggtgagacaaagtttctctgtcatgcaaagggcataagacacaagtaagatcagcatttaggggggcgtattttctcctgtccaacatgtctctcgtgttcagcctatcagagaaaagaagccatatgaaaacttttatcttcatcacacatttgctcttccagatccatcggaaaggtctgggaggttgcgtggatgcaaaattcaacttgtaaaaagcttttgaggtgtaattgttcctgccccatataaaactccaattatccccctgctgacttgctaaggacagagcatccagctctccctttagcagcagaaattctgtgtaagcttcctgggtcagtggcaacttaaaacaatcctcaaaaggtttagcacaggtgacagccaaggaatcatttctggcaatggcatggccacatagatgtggttactggcagggcaattagagcctcttacagagcagcagcttgctggcatagccaacctgcaacaatcctcccaacaggctgaagatgctctttctcaagggatggaagcactacaacagtcgcttgcagagaccctggcatcaggatctctcggccctgcaggatcttctggtaatgttgcaaactacatgggacaaatggcaatggctatggggaaacttggtaccctagaaaacttcctacggcaggctgataatctgcggcttcagactcttcagcaaatgcagcgcatattaaccactcgccagtcagcacgagctctacttgcaataagtgactacttctcccggcttcgtgccctgagttctctttggctcgcccgtccaagggaataaataaattgaattgattcgtaagtaggatattgttaggtaatgtatctctagtgttatatcagataggaattgaggtattccctacttcctagattcttcacaatgttcatgtattggtgacagactcggatcactatctttccatgtatgtcttcaagtgaatgttcaatgcatattgtagtctgtatatgacatcatatgatgagttgttgggcaaatttgtaacatttttgagaaaagtggggatgtaaatacttgcagaataattttagagcttatccagtgatt

SEQ ID NO: 4897 - DNA, 2651 bp, Oryza sativa
  Predicted polypeptide sequence is orthologous to G1198, G1806, G558
gtgcgctgttcctgcctacgagcgagagagagaatctcatctcgatgctgaacaagtaattttcccggttctgaatccgttcaatcatccaggaaaaatgtccggaattccaggtaagtaattttctctaatttcttatcctgatcagatttatagtgagattcaggggaatagagatctgctggctttttcatcggaaaatttcgctgaattgcgttcgcgaaaaaaaaaattcgctgaatttcgtacagcggatgatgaggattgaaaaggttgggtgctgcaaaagcgagagggggtggggaaagaagggcgcaagaccaatcaagccaaaaggaaggcaatgccacgaaggaatcggctagggttagccatccgcagccacagccgaggggttagcgggtttagccctagcccaccatgactgttgcggcgcatttcatctcctcctcgccgaggggaagaaaaaaccgcatcgcgacggcgacatcgggggggcctctttaataatgcttccatcagagagcatggccatggccatggccacgaccttgatcttgaggttagccggggtcgaaaggttcttcttcttttgcgcctttatggcaaaggggaattcttcgtcgtcacgcaccaagcgttacgcaattcgcaaaagaggagggagggcagctgtggctctttatataaccctgcatcacttcttctggctaactggtgtcctttggagctgagctacatagcacatccgtggagtctcttgtgctaagcaatttaccgttccagtgctctactttgtaggccatccatattagacggaagaactttatcagtattattattggaggagaccaattcaagaatgatataatggagctttaccctggctatcttgaagaccattttaacatccacaagcttagtatcagcagcgcctctcctccggagtacatgacctcggcgtcgacgcagttcgcggcaccggtcagaatgggggcgtacgaccggcctccgccagttggcatgtggagtcacgagcagttcaaggttgacaacggccaggccacgagtgcatccacgatcatggaggcagagatgaaatttgagaataggctagaagaaattccccaagtagttctggaggaagggagaaatgttgatcaggaggcaagcaagccgccagacaaggtcctcagaagacttgcacaaaacagagaggctgcacggaaaagccgcctgcggaaaaaggcttatatccaacagctggagacaagccggttgaaactagcgcagttagagcaagagcttcaacgggccaggcagcaggtacacggataacaatttgttgtgcagccacttcagcttacacttgtgtcactgactccattgcaaatttgcaactgctctgatgcaggctgtgtatgcaaatgggagccttcgagaaccaaatcttggatttacaggaccgatcgatccaggtgccttaggttttgagattaagtacagccattgggtggacgagcagaatcgcaacactggtgagctgaggaatgcgctgctgcaggggcagacgacggaccaggacctggagctcaagttgctcgtcgaggctgggctcgacaactacaaccgcctcttcgagatgaaagaggaagccgccaactccgacgtgttctacatcatgtcgggcatgtggaagacccccaccgagcggttcttcctgtggatcggtgggttccggccatcggaggttctcaagaatttgagaccgcagctggagcctctgacggacaagcaggtcgtggaagtgggcggcctgcagcaaacctcgatgcaggtcgaggacgccctctcgcagggcatggacaagctgaagcagacgatcgcggactccctgacggcggccgacccgttcgactcccccgaggcctacatggtgcacatggccaacgccgtggagcagctcagatccctcgtccagttcgttacccaggcagatcatctccggcagcagacgctgcaggagatgctcgatcctgacgacgcggcaggcggcgagggggctcctcgcgctgggggactacttccagcgcttccgagcgctgagctcgctatgggcagctcgcccgcgcgattcagggataagctaaacaccgtaatatggtcacggtagaagctactgatatcagtagcaattcgtcgtgttagttcgctacttcagtgtcaggtcaatggccagtgaaggatgaagagatctttctacctgtgcttcgtcgaagaagaacaactcgtgatcgactttctgcagcgccgctgcaactgcaatccaaggaatggtgtatgttcgcctgctgagatgaagaaataaccaaaattaactttggtctttctgatgtgggcacaagagaagatgtaatataatatgtaaatatatacatgttttgggtatcattgccagaggcctctacagctggttttatagacatgtgatgtaattatctgtaactagtgttgctcggttcctcctccctagtacggcagacataggtgacatactgccattgtattgtatgggagaacaaattagttcacttgagaactagaaaaacatgcagtgatgttttgctgaagttgaagtagtttctgccacc

SEQ ID NO: 4898 - DNA, 1605 bp, Oryza sativa
  Predicted polypeptide sequence is orthologous to G1198, G1806, G558
atgagctctgtgcgctactgcttgggcagggacttccagcctgctgccgcggcagctgcctacttcggcgagctggaggaggccctcatccatggcgccaacgccggcggcgtcgtcgatcccggcatgatcagagccgacgtgcacagcaagtcggcggcagcggcagcgacggcaggatatctcgcggccaggccccccacgctggagatcttcccttcatggccaatgaggcagcaacagcagctacacagtgggaattcgcagtcagtcgggagcaccactgactcgagctcagcccagaacacaatgccgcagatggagttggtgtccccagcgagtatcagggcctcctccgagcaccagcaccagcagcagcagccggggcaggaggtcatgatggtgaccactgatgattacagctacaagccaggcctcgctgctgcctccccaagctttcagcagcagcatcagctccagcaccaccagcagcagcagctgcacggaggaggagaccatgacaagaggaagcatggatccacaagaaaagatggcaagtcagtggatgccaaggcttatgtgcaaaacctagagaccagcagggtcaggcttcagcagatcgagcaagaactccaaagagcacggtcacagcagcagctgcagcctgcaagcctgcagcttgcagacgagggtgtgcctcggagttctcaccacggcgcagtaaaatcgtttgcaggcgcggccatgttcgacatggagtacgcgcgctggctggacgacgacagcaagcggctgaccgacctccgtggcggcctgcaggcgcacctgctggacaccaaccttggcctcatcgtggaggagtgcatgcagcactacgacgagctgttccagctcaaggcggcgctcgcgcgctccgacgtcttccacctcctcaccggcacgtgggctacccccgccgagcgctgcttcctctggatgggcggcttccgcccctccgaccttctcaagatactgatacagcagctggacccgctgacggagcagcagatgctggggatctacagcctgcagcagtcgtcggagcaggcggaggaggcgctcgcgcaggggctgcagcagctgcaccagtcgctcgccgacaccgtcgccgccggcacgctcaacgacggccccggcgtgcccaactacatgagcctcatggccatcgccctggacaagctcgccagcctcgaaagcttctaccagcaggttcaggattgtagtgatcattctgcaaaaacaagtcctctacgatgcatggtgaatagatcaggttgtgttagatatacttgcatgagaaaaaaggtgactaacctggcaaatgtgcaggctgacaatctgaggcaacaaacgttgcatcagctgcggcggattctaacaacccggcaggcggctcggtgtttcctctccattggggagtattaccgccgcctccgtgctctcagcaacctctggtcttcacgtcctcgcgagaacttcattggcaccgagagcgtcagtcccacaggaaccgagctgcaaccgatgcataatcagcctcagcagaatcagtactcaggattttga

SEQ ID NO: 4899 - DNA, 780 bp, Oryza sativa
  Predicted polypeptide sequence is orthologous to G1198, G1806, G558
atgaggtcccgcatcttgtggatgagccacgctgagcgcttcttcatgtggctcggcggcttctgttgctctgagctcctcaaggtacttgagagccatcttgagccgctgacgaatcagcagttgatgggcatctgcaacctgcagcagtcgtcgcagcaggccgaggacgcgctgtcacaggggatggaggctctgcagcagacgctaggagacacactggcatcggcggccgccaccgtggtcgtcggcggtgtaggcgccgacaacgtcaccaactacatgggacagatggccatcgccatggccatgctcaccacgctggagaacttcctcaagcttcggcagcagatgcatcggatcctaaccacgaggcaggcggcgcgggcgctgctcgtcatcaacgactacttctcgtggctccgagcgctaagctcgctgtggctggcgcggccgagggacgcgcgtcacggcatggcagagcgcgcatcgcaccgaccgcgcccccggcggcacggccaggtacgcgccgcagccactgcatcccgctgtcggcgaccacctccccacccaccggccggcctgcccaagaggagaaaagtgagagagagagagaaagagagagaggaggaagggagaggaggggaaagagatagggtgatgacgtggaatcctggcatgtggggcccacatgggttccacgctgattcagccgtcacgtcagacaaaaccgcggtcaaaaccaccgagggacctaaagtgaacggttttgtaagttga

SEQ ID NO: 4900 - DNA, 641 bp, Oryza sativa
  Predicted polypeptide sequence is orthologous to G1246
gagacggccgactacgtggccgcgctggagatgcaggtcaaggccatgcgcgccctcgccgacgcgctcgccgccgcgcagctctcctcgtcaactccgcagcaggcggaggccgccgccgacgagaccgagatggagaggtgagggtttcgtggtcaatcgtgagttcatcacacgatcgatgatgctggattcgattcgatggctcggaaattggaacggctcggggaaaaaataagggcgattaattagtggattattattgcgagagggtttgggatttgaggagggtaattgcgatgattgatgctgctgataatgctgctgctgctgctgctgctgatgatgatgatgatgacgatgatgatttgtaaattcttgatacttgtataagtaatgctgctctgctcctctcttgtttttttctccttgattcttgaaatgtttttctcctcctgatttccaaatcatgttggggattcctgatttcctgtttcatcttgattagtagtattatgctgtgattggggattagtgtgttttgccctgtgttaatcagggattatatgttctctctttttttttttttgcttgcgaagaattggagagaaaaaaatgtgaattctctcaaaataggtatt

SEQ ID NO: 4901 - DNA, 1928 bp, Oryza sativa
  misc_feature (769)..(771): n is a, c, g, or t
  misc_feature (779)..(779): n is a, c, g, or t
  misc_feature (790)..(790): n is a, c, g, or t
  Predicted polypeptide sequence is orthologous to G1246
gtctttctcctcctcgccagggaaaggcccccccgccgccgccgtcgtcgttccagctatagctttccccgccggcggtggcgatcgatcgatcctctcctcgtcggttgattagggtcaagaattcttccctctcccagcttggttgaatttcttggtttgatcaaggggaggaattaattgagaggtgaattagttcgccggagtttgtttctctctctctctcctcttctctgagctgagagggggaggagagaatcaagtgacgagttatagtatggcgaggagcggcggcggcaatggtgggggagaaggtggcggcggcggcggcaatggcggtggcgggggagggttgaagaaggggccgtggacgcaggcggaggacaagctgctggtggaccacgtgcggcggcacggcgaggggaactggaacgccgtgcggcgggagaccgggctgcagcgctgcggcaagagctgccgcctccggtgggccaaccacctccgccccgacctccgcaaggggcccttctcccccgacgaggagcgcctcatcctccgcctccatggcctcctcggcaacaagtgggctcgcatctcctcctacctgcatgggaggacggacaacgagatcaagaactactggaacacgcggctcaagcggcgggtgcgcgccggcttgacgccgtacccgccggagatcgagagggagatcgcgcacctccgcgcgcagaatctcaacctgtccgccgaaggcggcggcggcggcggnnntatgctgnctttcgcgttncttctttacccgagcatcccgttcgccttgcagcaggcgccggtggtggcgccgtcgccgtcggcgtcgcaggcgaattcgccgccgctgatcaaccagaattacccgctcctgaaccagatgcaggggctgcagcttctccacctcgccaaccaccagcaggcgccgccgccgcagcagcagcagcagcagcagccggcgttccaccaccaccacgacggcggcggcggcggcgggttcgtctcgtcggggctcccgccgctgccgaacagaccgcgcgagctcccttcgaaccaattcgagacggcgacgagcggcggcggcggcggctgcgacgcgctgctcgagtcgctgctgctcggcgacgaccacctcctgccgcggcccaaccccgccatgctcagggtgggctccatgcccgagctgatgtaccgcgagcctagctcaagccacgtgctccatggcggcggcggcggcggaggcgccagcgacagtgacgtcacctcgcagtatcctccgggagaagaggacccgcattatggcgggagatgggacttcatcttcgaggacgtgaaacccaagaggaaggcggcgagcgcggtggaggagatctccggcatgttcggcatcgccccgggctccatcccgggggaatggttcaaccccggcggcgtcggcagcgccgccgccgccgccggcgggtcgtcggctccgtctccggggccgtcgtccgtcgtcaccaccgacgacgacttcaccctcgagatgcagcagatcatgtcgtcgctgccgctgcttcaacctgaagagcatcataactggaacgcataaagctttggaacagcaagatgagagatgatttggtagtgagagagagagagagactgtaaatcggttctgatgagcagtgagaaaaaatgttggttcttgttttttgttgtttgtactgggccttattgtcggatctgtcacgcgctctgccttttgagttgcaaactgtttttcgttattgctatcaagtaattaaaagggtttctcgtagttgatagtccttgtctaaatcagtgaagagattcaagaaaattcagctgatatattggaaatccactccagcaactgtggagtatgttccttgtcc

SEQ ID NO: 4902 - DNA, 3047 bp, Oryza sativa
  Predicted polypeptide sequence is orthologous to G1272
ggtgtggagaggcgaggcgttcgagtttcgagaggagggaggggggacaaggaggaggagcgcaccaccctctcggagaggtcgcctccgttcttgcatcgttttctttggatagggcagcgctttgacagctttggggagttagtcgagaagtgtgcacatggagtccaacagtggtgaaatcgaggagttgccacctcccccacctttgccaccaaatgctgagccaattaaaactgatgatacaaaaaagttatcaaaacctaagagggccttgatggctcgctctggttgtggcaaaaaagggcagccgatacagctgctgacgaaccacttcaaggtttcactgaaggcagcagacgaatttttccatcactactatgttaatctgaagtatgaggatgatagaccagtggatggaaagggcataggtagaaaggtgctggacaaactccagcagacctatgcgtctgagctggcaaataaagattttgcatacgatggtgagaagagcctgttcaccattggtgctcttcctcaagtgaacaatgagttcacggtagttctggaagacttcaacactggaaagtcatctgcaaatggtggcagccctggcaatgacagtccaggaaatgacaggaaaagggttagaaggccatatcagacaaaaacttttaaagttgagctgaactttgcagcaaaaattcctatgagcgccattgctcaggccttgagaggccaggaatctgaaaacacccaagaagcaattcgtgttattgatatcatattaagacagcattccgcaaaacagggttgccttttggttcgccaatcctttttccataacaatccttcaaattttgttgacttgggtggtggtgtgatgggctgtaggggattccattcaagcttccgagctacacagagtggactttcactcaatatcgatgtgtccacaacgatgattgtgaaacctggtcctgtggtagattttctacttgccaaccagaaggttgatcacccaaacaaaattgactgggcaaaggccaagcgtgctccgaagaatttaaggataaaaacaagtccagcaaatactgaatacaagattgttggtttgagtgagagaaactgctatgaacaaatgttcactttgaagcaaagaaatggtgatggtgaacctgaaggtgtggaagtatctgtttacgagtactttgtgaagaatcggggcatagagttgagatactctggtgattttccctgtatcaatgtggggaaaccaaaacggccaacttattttccaattgagctctgctctcttgtgcctttgcaaaggtataccaaggctttgagtacactacagaggtcttcgcttgttgagaagtccaggcagaaacctgaagaaaggatgtcagttttgtctgatgtgctgaaacgcagcaactatgattcagagcctatgttgaattcttgtggtatttcaattgctcgaggttttacacaagttgctggcagggtgctgcaggcccccaagctaaaagctggaaatggtgaagatctttttgcacgtaatgggcggtggaactttaataataagaggctcattaaggctagcagtatcgagaaatgggcagttgttaacttctctgcacggtgtaatattagggatcttgtccgagacatcatcaagtgtggtggcatgaaaggaattaaagtagaagatccatttgatgtcattgaggaggacccttcaatgcgacgagctcctgctgcaagaagggtagatggcatgattgacaagaaaaaaaaagcttcctggacaaccaaagtttctgctctgtgttcttgctgagaggaagaattcagatatttatgggccctggaagcggaaatgtcttgctgaatttgggattattacacaatgtgtggcccctactagggtcaatgatcagtatattacaaatgtactgttaaagataaatgcaaagcttggtggcttgaactccctgcttcaaattgaaacatccccttccattcctcttgtatccaaggtcccgacaataatattgggaatggatgtttcccatggatcacctggacagtctgatataccttcaattgctgcggtcgttagttctcgtgaatggcctcttgtatcaaaatacagggcttcagtccgttctcagtcacctaagttagaaatgattgatggactatttaagccacaaggagctcaggaagatgatggcctcattcgggagttattagttgacttctataccagtactggtaaacgtaagcctgatcaagtcattatcttcagggatggggtcagtgagagccagtttacccaggtgctgaacattgagctggatcaaataattgaggcatgcaagtttcttgacgaaaactggtctccaaagtttacactgattgttgcacagaagaatcatcataccaaattttttgtgcctggatctcaaaataacgttcctcctggtactgttgtggacaacgcagtctgtcatccaaggaacaatgacttctacatgtgtgcgcacgctggaatgattggaactacaaggcctacacattatcatatccttcatgatgagataggcttctctgctgacgatcttcaggagttggtccactccctttcctatgtctaccagaggagcactacagccatatcagtcgttgcacccatttgctacgcgcatctcgctgctgctcaggtcagccagttcatcaagttcgacgagatgtcggagacgtcgtcgagccatggtggccatacctcggcgggcagcgctccggtgcccgagctgcctcgcctgcataacaaagtcaggagctccatgttcttctgctgagcagccgcttggctgctatgttatggcctgaacttgtggatgttttggtagtcttgtttatgtcgtgtttgtttaagtaccagctggggggtggatgttattaggctggatgccgcacttctgaacctgttaggataactactgaacctgtccatcttaatcgcagcttgttcc

SEQ ID NO: 4903 - DNA, 3385 bp, Oryza sativa
  Predicted polypeptide sequence is orthologous to G1272
gggtgagcatccgcatcctctttctgattcatctctctctctcccaccgggactacttttttctggaatttgcttgcgttcgtcaatcctagcttctcttctaaatcttggaagaagctcttctcttcttttcagcgccataaccttaatacaagtaacaatctgtttgttccccaaaaagtttgagggtttaactgaacccctatgtctcaagttggatccgctcctgtaacgtttcccccttaaaaattttttttgggggttcaactaaaccctaggtttattggtatctgctcatagaatggacgctcatgatggtgaggccgatgagttgccgccgcctcctcccgtacctgcaaatgtggtgcctattaaagctgatgacgttgagagcgaggtgccagcaaacaaaccagcaaaacctaagcggtttccaatggccaggcctggtttagggagaaaaggacagccaatccagctcttggcgaatcattacaaagtttctgtgaagagtagtgaagaatatttcttccactacaatgttattctgaagtatgaggatgatcgaccggttgatgggaaaggggtaggtcgaaaggtgattgataaactgcagcaaacctaccgttctgagctttcaagcaaggactttgcctatgatggtgaaaagagcctgtttacaattggtgctcttccacaagtaactaatgagttcacagtggtgttggaggatgtttcaactggaaagactgctgccaatggaagccctggaggtaatgacagccctggaggtagtgacaggaagagagttaggagaccataccagaccaagactttcaaagtggagctgtgctttgcagcaaagatccctatgaatgcaattgctcaggccataaaaggtcaagaatcagagaactcccaagaagctctcagagttcttgatataatattaaggcagcactctgctaaacagggctgccttttagtacgccagtcatttttccacaacaatcctaataactttgttgacctgggtggtggtgtgatgggctgtcgaggattccattcaagtttccgtggcacacagagtggactttctctgaatatcgatgtttcgacaactatgattgttaaacctggtcctgttatcgattttcttcttgccaaccagaaagttgatcaccctgacagaattgattggcaaaaggccaagcgtgctctcaagaacttgaggataagaaccacccctgtgaattcagaattcaagatcattggtttgagtgacagaaattgcaacgaacagatgttttcgttgaggcagaggaatgggaacaatggggatgttgatgaagttgaagttacagtctatgattactttgtgaaaaacaaaggcatagagctgcgctattctggcaatcttccttgcataaatgtggggaaaccaaagcgtccaacttattttccaatagagctatgctctcttattccactacaaagatacaccaaagctttgtcaacactgcaaaggtcctcccttgttgagaaatccagacagaagccccaggaaagaatgtcagtccttaatgatgcacttcgacatagtaattatgattctgatcccatgttgagggcatctggcatttcaattgcccaaaattttactcaagttgaaggaagggtcctgcaacccccaaagctgaaagctggcaatggtgaagatatattcccacgcaatggtcggtggaacttcaacaataagaaactgattcagacctgttctgtcgataagtgggcagtagttaatttctctgcacgctgtgatgtgcgaaatcttatccgggacctcataagaaatgcatctgcgaaggggattcaaatggccgaaccttttgttgtgtttgaagagagcccctcattgaggcgagcacctgtatcaagaagagtagatgatatgtttgaacagataaaatcgaaacttcctggagctccgaaattcctcttgtgccttcttcctgagaggaaaaattgtgaagtttatggtccttggaagaggaagtgtcttgctgaattcggtattgtcacacaatgccttgctccacaaagagtcaatgatcagtacctactcaatttgctattgaagataaatgccaagcttggtggaataaactcattgctgcaaattgaagcatccccttcaatacctcttgtatcgaagacacctaccatcatcttaggtatggatgtgtcacacggtcaaccaggacaatctgatagaccttccattgctgcggtggttagctctcgccaatggcctctcatctctaaatacagagcatcggtgcacactcagtcacctaagctagaaatgatgtcttccttgtttaagccacgaggaactgaagatgatggcctcattcgggaatcgctgattgacttctacactagttctggaaaacggaaaccggatcatgttatcgttttcagggatggagttagtgaaagccagtttactcaggtcattaacattgagcttgatcagatcattgaggcatgcaaatttctcgatgagaagtggtcaccaaagttcacagtgattgttgctcagaagaatcatcataccaaattttttcagtctggatctccagataatgttccgccaggtactgttgtggacaaacaagtgtgccatccaaggaattatgacttctacatgtgtgctcatgctggaatgattggaacgacgaggccaacacattatcatgttctgcacgatgagataggtttctcccctgatgatctgcaggagctagtgcactcactctcttatgtgtatcagagaagcacaacagccatatcagttgttgctccgatttgctatgcccatcttgctgctgctcaggtgggcacattcctcaagttcgaagatatgtcggacgcgtcgtccagccaaggaggtcatacgtctgtcggaagtgtaccggtgcctgagctgcctcgcctccatgagaaagtgaggagctccatgtttttctgctgatcgtgccgcctctcgatcaaatgctcgccgacgttgagaaatccggtgatcggcctgggggaactactagtacttttgcttctcataattaggaacatgtatggaacctatgtacctgcccttggcatgctgcctgtgtcatggattatctgctggtaggagtatcctttaaccaaacccttttagcttttaagttaggtttaatggactgctgtttagtatgtggtgtggtgttagtaagtttccagacttcgacattgtgcagctatgcctattgctggttatggtcccttcccttctatgtagcatgtgccgtttccctttgtctgagttgattttagaaatagt

SEQ ID NO: 4904 - DNA, 812 bp, Oryza sativa
  misc_feature (802)..(803): n is a, c, g, or t
  misc_feature (805)..(806): n is a, c, g, or t
  Predicted polypeptide sequence is orthologous to G1272
tttttttttttttttttttttttgcaaaagcattgctgaatcactgaaacatggtgaattctaacaagcaaggccttgcaacgagaggatcaagaacttactgcttaacagagtgctgcctgagcgtgatgtcaagaaccctatgagcctccatcgagttctctgtctcctgccctcttagcacctcggcaatggcgctcatgggaaccttcgccgcgaaggagatctccaccatgaacttcttcaccgccatcggctgcttcatcctcttcctgtcactccccctcgggcttccatcgtctcctccggggctccgcctcgtcgtcgtcctgcacacagcaaaaaaaccaaagaaatggtgctcaccaccttcacaattttttttagatactggaaaatggttacatctccgaactctgccaacagacgtcaccacctggacatagcaacagttacatatccatagtttacttgccttatcagccgcgaacaaaatttaatttatgaaacctaatttcccagctgacctcgaaggctcccccgccacagacaactacgggcgcactggccttttaaacgactatcaggactacccgaagatgtctaagtaagtcgagcgcagggccagaaacatcaagaagagggtccaacagacatggcgcctcgagcacccaggtagcgactacaggagaaaccggaacgagctgctgtgaacgacagccggcactccgtgggctcacgtcgtcacaactgtcctcactgcttcgctgcagtactatgaacgacgagaaagcaagaaaannannagttgg

SEQ ID NO: 4905 - DNA, 2670 bp, Oryza sativa
  Predicted polypeptide sequence is orthologous to G1272
atggctgccaaaattggtgaaattgtccaagtacataatgataatcctgtaaagagagtacctattgcacgacctagctttggccgtgaaggaaagcaaatcaagctgctctcaaaccacttcactgtgaagcttagtggaattgatgcggttttctaccaatacagtgtttccatcaaatctgaggatgataaggtgattgatggaaagggtattggccgaaaggtcatggataaagtgctgcaaacatacagctctgagcttgctgggaaggaatttgcgtatgatggtgaaaaatgtctatttactgtggggcctcttccacagaacaactttgagttcactgttatcttggaggaaacatcttcaagagctgctggtgggagtctagggcatggaagccctaatcaaggtgacaagaagcgatcaaagtgcacacatcttgcaaaaaaaattgtagtgggcataagttatgcagcaaagattcccctgaagtcagtagctttggcccttcaaggaagcgagtcagatcatgctcaggatgctctgagagtccttgatattgtcttaaggcaacaacaggctaagcgaggttgcctgcttgttaggcaatcatttttcagtgatgactttagaaacttagttgatttaactggtggagttagtggatgtcgtggactccactcgagtttccgtactaccattggtggtttatctttgaacatggatgtttcaaccactatgattgtgactcctggaccggtttttgatttcctccttacaaatcaaaatgtcagagacattagagatatcgactggcccagggccaagaaaatgttgaaaaacctgagagttaaagctattcacaataacatggagttcaagatcattggtctgagtgatgagccatgctctagacaaacattccccatgaaagtacgaaatggaagcagtgaaggtgaaaccgttgaaattactgtccaggaatattttaagtccaagcaggtggatttaacaatgccttatttgccatgtcttgatgtgggaaaaccaaaacgcccaaattatgttccaattgaggttgctggcaccaatcctctgtgccatatggtatcacttcaaagatatacaaaggcgctttcttctcaacaaagagcaaccttggttgaaaaatcacgtcagaaacctcaagagcgcatgcgagttgttactgatgctgtaaaaaacaatagatatgatgatgatccaatcttatcttcttgtggaattaaaattgagaaacaactcactcgtgtcgatggtcgtgttctgtctgcaccaacgctagtcgtggggaatagtgaagattgcattccaaacagaggcagatggaactacaataacaagaggctatttgagcctgtcaagattgagcgttgggcaattgttaatttctctgctcggtgtgacatgagccggatctcaagagacctgataaactgtggacgaactaaaggcattattattgaacgccctttcaccttggtagatgaggatagccaatctaggagatgtactcctgttgtaagggttgaaagcatgtttgaaaaagtgaaagcaaaccttcctggtcctcctgaatttttgctgtgtgttttaccagaaaggaaaaattgtgatctctatgggccatggaagaagaaaaaccttcatgagatgggtattattactcaatgcattgttcctagtgttaagatgaatgatcagtactataccaatgttcttctgaaaatcaatgctaagcttggtggaatgaactccaagctttcattggagcatcgacatatgattcccattgtcaatcaaacacccacattaattttgggaatggatgtttcacatggttcgccaggtcgagctgatgtaccatcaattgctgcggttgttgggtccagatgttggccgctgatatcacgctacagagcatctgtccggacccagtctccaaaggtagagatgattgattctctttttaagccactggacgatggaaaagatgatggcataataagggaacttctactggacttctacaagaccagtcaacaaagaaagccgaagcagataatcattttcagggatggtgtgagcgagtctcaatttagccaagtactgaatgttgagcttaatcaaattataaaggcatatcaatatatggatcaggggccaattcctaagttcacagtgatcattgctcaaaagaatcaccacacaaaacttttccaagaaaatactccagacaacgttcctccagggactgttgtagattctggtattgttcatccaagacagtatgatttctacatgtatgctcatgctggacctataggtacctcaaggcccacccattaccatgtcttgctcgatgagattggtttcttgcccgatgacgtgcagaaactagttttgtcgctttcttatgtgtatcagaggagcaccactgcaatatctgttgtggcacctatctgttatgctcatctcgcagcagcgcagatgggccagttcatgaaattcgaggaattcgctgagacttcgtctggaagtggtggtgtcccttcgtcatcaggagcagtggtcccagagttgccgcgcctgcatgctgatgtctgcagttcgatgttcttttgttga

SEQ ID NO: 4906 - DNA, 612 bp, Oryza sativa
  Predicted polypeptide sequence is orthologous to G1273
atggaggaggatgatgggttggccttgatgacgggggcaaaccagagcttatggagttactacaagtgcaccagctcccgatgcagcgccaagaagcacgtcgagaagtccaccgatgacccggagatgctcatcgtcacgtacgaggggtcgcaccatcacggcccgcagccgctcttcccgccgcacatcgcccagccaccgccgccgacgtcggtagtgggcttctccgccgcctccggcgctggcccgccgccgtcgtcgcccgcggcggcggcaaggaagaggaagaactatgtcagggcggccttctcgccgacgacgtccgaggacgacggcgacggcgccggccggctacggccagagtggccacaagacgatgggacgtcgtgtgacgtcgccgagttacgacgacgtggcgacgcggagcacgccgcgccgcgtcgtgtcgcgacggatcgctcgtgcgacgatggcggcggcggcggctcgacctcggcctcgtcgtccgtggcgcgcgctgacgccgctacggcgctgtcctctgactcgccgccgaccatatggtcgtgcctggactggccgtggtcccaggaaacactgtttctgtag

SEQ ID NO: 4907 - DNA, 1193 bp, Oryza sativa
  Predicted polypeptide sequence is orthologous to G1274, G1275
aagagagtcggccaacccacatgcacgtgtaccgatgtacatggcggcggcggctgcgggagcaagcacacccttcaatttttgccgccacggctcgcacgccgagtacgacgccgtcttcagcggcagctggatggcgcgccgcccctccgcggcgccgcacggtggcggcgcctccggctccggctccggcagcggctacggcgccgcctcgtacgttgctcccaccttcggcgcggcgtttaggcagcagcatctcgacctcctcgactacctgtccgacgatcagggcgttccggcgccaccaccagcggctgtgcccagcgcgtcgtacgtgacgccggcgccggcgatggcccccgctgaaccggtcgtgccggatgctgttgccgccgccggcggctatccgaggagcgtggctgcggcggcggcggccgtggccggcgagggaagagatcggacgacgacggacaagatcgcattccggacgaggtcggacgatgagatactcgacgacgggtataagtggaggaagtacgggaaaaagtccgttaagaacagccctaatccgaggaactactaccggtgctcgacggaggggtgcaacgtgaagaagagggtggagagagacaagaacgacccgcggtacgtggtgacgatgtacgaggggatccacaaccacgtgtgccccggcactgtctactacgccgcgcaggacgccgcctccggccgctttttcgtcgccgggatcagtcacccagaccttaattaagctaggatatgctttgccggcccagctgtggcttagcttgatgtgcagctctagttattgtatgggctgtacggttcagttatttgaagcgggttatacttatatgttgttaatgtttgcctactgattttaattaatttcttagagttagactcaatttggcggagggattcccttcaaaaaaagaaatcccttcaaaaaatttggcggagggacgactgatatatatggtgacattagctaggtttgctcacttttggcaaaaataacaagtttcctttcgtgccactctccgtccctaggtcagtgtttggcaaaacgcccaaaaaaatgtccgtgttgccaattaatttgtcgattgtgtacttcaatttcaagccaaatttcggcaaagctagtactttgtgtgttttagatgttg

SEQ ID NO: 4908 - DNA, 1091 bp, Oryza sativa; identical to SEQ ID NO: 2085
  Predicted polypeptide sequence is orthologous to G1274, G1275

SEQ ID NO: 4909 - DNA, 839 bp, Oryza sativa
  Predicted polypeptide sequence is orthologous to G1274, G1275
ctgtcaaacactcaatcagcagcagcagcagctagcttagcttagctaacgcacagtgacgcgagcatggcggcttcgctgggactctgccacgagacgtcgtacgcctactcgtacccggcgtcgaacacctcctcctccttgtgcttccctcctctcatggcggaccacatcgtcgacggcggcggcggcggcggctgttcctttggtgaattcctggagctcggccattccgtgtactcgctgccgcttccgccgccgccgtcgcagccggtggtggtcgccggcgggaacaatgatcagtatggcgtgtcgtcgtcgtcgtcggcggcggcgacgacgagcaggatcgggttcaggacgaggtcggaggtggaggtgctggacgacgggttcaagtggcgaaagtacgggaagaaggcggtgaagagcagcccgaacccgcggaactactaccggtgctcggcggcggggtgcggcgtcaagaagcgggtggagcgcgacggcgacgacccgcgctacgtcgtcaccacctacgacggcgtccacaaccacgcgacccccggctgcgtcggcggcggcggccacctcccgtaccctacttccgctgcgccgccgtggagcgttccggcggcggcggcctcgccgcctcccgcgcacgcgcaggcgtggggggcgccgctgcacgccgccgcggcggcgcactcgtcggaatcgtcgttctgaacgctgaatttacttctgtttttgtttttcttggttgcttgttagttgtaccgccgttcgtgatcgatcgatcggttcttgtatgcactagacttactacttaaaaaaaaaaa

SEQ ID NO: 4910 - DNA, 666 bp, Oryza sativa
  Predicted polypeptide sequence is orthologous to G1274, G1275
atggcggcagtcggcgcgcacgcagcggtctaccaccacccggtctcgggcctctcggcgccggcgggcgacgccgcctactcgatgtcatcgtacttctcccacgggggaagctcgacctccagctccgcgtccagcttctccgccgccctcgccgccgcaacgacgccgccgcttcccgacccgtcggggtcgcagttcgacatctccgagttcttcttcgacgacgcgcctccggccgccgtgttcaatggcgcgcccaccgccgcgctgccggatggcgccgccgcaaacgcaacaaggagcgcggcggaggcggtgccggcgccggcgccggcggccgtggagaggccgcggacggagcggatcgcgttccggacgaagtcagagatcgagattcttgacgacggctacaagtggcgcaagtacggcaagaagtccgtcaagaacagccccaacccaaggaactactaccggtgctcgacggaagggtgcaacgtgaagaagagggtggagcgggacaaggacgacccgagctacgtggtgacgacgtacgaggggacgcacaaccacgtgagccccagcacggtgtactacgccagccaggacgccgcctccggccgcttcttcgtcgccggcacgcagccgccaggttctctcaattaa

SEQ ID NO: 4911 - DNA, 1042 bp, Oryza sativa
  misc_feature (845)..(845): n is a, c, g, or t
  misc_feature (892)..(892): n is a, c, g, or t
  misc_feature (894)..(895): n is a, c, g, or t
  Predicted polypeptide sequence is orthologous to G1274, G1275
agtcgccgaggtcggcggaatccgggtgaccacgcgtcgcccacgcgtcgagaaaatcacggtgaaaaggttcagcactgtgcaatggcggcttccgtaggactgaaccctgaagctttcttcttcaacaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaaggtacacgaatattgacgtcactgccactatgcccatttggctatcaatcttaattaattagtaccacaagtttaatcactagcttaattactggcgttctgcccaatcaaagttttataatcaccttttctgaaatatcatctgttcagggttaaaaattttagaatgcaaaaaaattgcggagatcttgaactgaattttcagacaaattttgtaatttgaacaggttttcactttacttgaaccgaatttgagaaaatccctcacatccgagggttgggcggattacttccaccgggaccctgttacccaatgattctttgaactgtacttgagggtcggaattgtccatatggtgggggaaatcaccctcatttgaacaacggggcgaggggcgcacgggtgaggggaganttccagggacaccgccggttcgtacaccccccgcgtggcaatacacntnngcgaacgtgcgtaaacaccgaggagacagctcgagaagagcaggacactggagacatatgaggaagaagcgacaaacatagaacattcgaacacaagcatgcggacgaacggtgagagaaagcaaaacagccagcacgaagcgaacg

SEQ ID NO: 4912 - DNA, 1726 bp, Oryza sativa
  Predicted polypeptide sequence is orthologous to G1309, G237
acaactcatggcttcgaagtccaaactcaacactacaagccagtaagtttaactactacacatgcacggcacgatttacacctctgaaaaagagggggaaaaaaaagaaactgacgaatttacacttcggcgacgaactgtacggaagaaagagcgtacgctcccgcctagttgatgccgaggaactcgctcatggagagcaggtcgcagagccctcctcctccctgcatgtgatcggccgcgtcgtcgaagtcccagcagaagccgccgtcgcccagcccgtgcagggagtccacggcgccgccgcacgggacgtcgacctgcaccgacgacgagccctggtagctcaggcccggcgccgtcccggcgaggctagtcccgtagtccatgtcgaaccagtcggcgaacatgaccttggggatcacgggcgcgtgcggccggacggcggcgagccccgccgcgggctcggtgaggctgctcgagtcgtcggccgacgacgactcgaccggcccggaagactcggagctcgccggccggtcagcggcgacgcgttcttggccggtctcgctgcggttcgggctgccggtgacgacgtcggccggctcggcggattttctggccgcagcctccgcgccttcgactcgcttcttgagcgtgcaggttcatgacggtttcttcttcctctcgggaaaacatgccgtgcttcagccccggcctcaggtaattgatccatctcagcctgcaactcttgccgttacgctgcagccctgcatgaaaggcaaattcagaagagaattcagctcaccagacaaggtacatttgacgaaaaaacacaaaagctcaaacaggcttcatctatcgtcctgaagctgaacaacactttgcaaatagtaggaaacaaaaaaaatcccttctccccttcccttaaatcaaggtgcatttgaaaaaaaaaagaaaaaaacgagagcagcaacaagcaaacaggggggttttgaagcaggacacaggtgcaatgcattcaggcgtacagcagttgcaaaattcgcggtgaattccccggcgaaatcgtcgcaggcggagctcggaaccgtggtcttaccggccttcacggggacggcgctccagcagccgtggccgtagcggaggatgaagtcgcggagcttctggtcctcctccggcgaccacaggcccttccggtagtgcaccttgggcttctggcacgccttgcaccccatcaatggcggacgagaagagagcaagaggagactctagagtctagactctagagagacaatgccaaaccgcgagcagcacgaggggaaaagaaagcagaagaagactttggcttggtaaggaggaggaggaggcggcttgcttggacggccgtgattgctttgcggcctgcactgttgtgtcggtctgcgttggcgtgagagatgggcgcaggggctttataggcctcgcccaatcatcaccgttggccctgtggcccctcacgggaataagcaagtggttaggtcgccgattgtttttccttcttttagttccgaggaaaaaataaatggttttttttatctgtccgaccaaaaccatatatgtacatggcactagtatcattacatcggacggagtacataccttcgctttctgtaattctcagaggctgcagtagtctgaaagcagatgcaatttttagcgaaataaaattacaaggtttggcacttgc

SEQ ID NO: 4913 - DNA, 954 bp, Oryza sativa
  Predicted polypeptide sequence is orthologous to G1309, G237
atggggtgcaagtcgtgcgagaagcccaggccgaactaccggaagggcctgtggtcaccggaggaggaccagaagctccgcgactacattctccgccatggccacggctgctggagcgcgctccctgcgaatgccgggctccagaggaacgggaagagctgccggctgcggtggatcaactacctgcggccggggctgaagcacggcgtgttctcgccggaggaggaggagacggtgatgagcctccacgccgcgctcggcaacaagtggtctaggatagcacggcatctacctgggagaacagacaacgaggtgaagaactactggaattcttacctgaagaagcgagtggagagcggcggcggcaagacgagccaagggccaccaaccacgcctgcgtcagccgcgagctctcccgccgattcagacgactcgcacagcctgcagcagaagccgcacgagccggccaactccgactcgtcggagccggcgcacgagtcgtcgtcggcgtcggccgactcgagctgcctgacggtgaccacggaccacccgcccgtctcgaggccccacgcggcagtgacacccaaggtcatgttcgcggactggctcgacatggagtacatctgtgggcaggtcgcggcagcacctggtctggacgctgccggattcgcggtggttggtggtgctgcaggcgatcagcagcagcagcagcagcaggtgatgagccaggacggatcggttcatcaggccgatgggccatcgtgcggcgtggacgattcttccctgcagcagcagcagcaggaggggttcggtggcaacggcggctgctgggattttcaggagcagttcgacagcatcgaccagatgcaggcgagcggcggcggcggcggcttctgcgacctgctctccatgagcgacttcgacctctgggccgagctggaacgtaccgcgtga

SEQ ID NO: 4914 - DNA, 435 bp, Oryza sativa
  Predicted polypeptide sequence is orthologous to G1309
taaccgcagccaaggtggctggagctatttgccagaccgctctctacgactatcgactcccggttgatgccaagacacacttcggtcctccattgaccagcgtcgagctatatctcaaggacgccggcgctcacaagactactgatgagaaaatcgaaggccatattgtcgtgagaggaccttccgtggctggaggagaagtcaatgttgggattcccggaaaaattcgacatgacaatacccttgcttatgcttgatttcgtagagctacgtgcggaatagggtggtgatgccatcggagatggagacagcaagatatacagattgatcgaacttggcctctcggtccatagattattctatctagcatttatgatcttttcatggttctctcgaaaccgagagagtacgatatacaaaagtatggcattccct

SEQ ID NO: 4915 - DNA, 411 bp, Oryza sativa
  Predicted polypeptide sequence is orthologous to G1309, G237
ggttgaaacggcacaaagctccatccgttctgaaggctttgtggccgagttctcctcccccacctcctcctcctcctcctcctctgtagccgagctgaggccaacgcgagtagtgacattctcctgcaatggggtgcaagtcgtgcgagaagcccaggccgaactaccggaagggcctgtggtcaccggaggaggaccagaagctccgcgactacattctccgccatggccacggctgctggagcgcgctccctgcgaatgccgggctccagaggaacgggaagagctgccggctgcggtggatcaactacctgcggccggggctgaagcacggcgtgttctcgccggaggaggaggagacggtgatgagcctccacgccgcgctcggcaacaagtggtctaggatagcac

SEQ ID NO: 4916 - DNA, 1640 bp, Oryza sativa
  Predicted polypeptide sequence is orthologous to G1313
gttgccgcacatatactcgtgctcgcgctcacgccgccgcccccgaaactccccgctccgccattgccgggggaggcgatctcccatctccatctcccatctcgcctcagcgaactccccttcacatcgcgtctcttccgtcgcagagagtggcggccggtgaccatttccggtgggagggcggaggttttgtcccggctccggcgacactccacactccgacagcccaccgctccgtcaccctgcatttttggtcaggatgcacgagagcgacagcagtcctgattctgacaggacacactggtatatgagcaatagcgatgacgagtcatttgttgataaagataaagattgcagaaggagcaccgtagccctgctgttgaagaaaggtccatggacatcttgggaggactccatcttagagaagtacatcaagaagcatggtgaaaggaactggaagcttgtgcagaagaacactggcctcttgaggtgtggcaagagttgccgtcttcggtggatgaaccatctgaggcctaacctaaagaagggggctttcagcaaggaagaagagaataaaattattaatcttcatcgcaaaatggggaataagtggtctcggatggctgctgatttgccagggcgtactgataatgaaataaagaactactggaacactcgaataaagaaatgcaagaacaatcgttcgcctttgtatcctgctaatgtatgcaacgatgctttgaatgaagatcaacatgagtctgctgaccccaacgttagggagaagctgaccaataatcatctagaagatactactagtatgtattctgcacccccaggttttcaggatgcttccatcagtaatatacttgataggagacttgcatcaaaagattatgactccatagaagatcaaagaaaccaaatagaagttgtagcaaaatatgagattccacttcctgtgttgaaaacaacgaacaatgacatatttccatcagcctctatctttgccaaccatggtatttcaaatggcaatctctctgctttgtccacaactgatgctttgcagatggagctccctttaatccaatttgatccaaacaaccagttcgtttactcaagggcttatgcgatgcacctaacaaactttgctttattaaatgatcaatcagaagaattactaaatgatactgatgtattgaactatgtggtgatgaaagaagagctttctggagggagtttgagtcctactattaatatgccatgtgaagcacataactccatggctgcctctaatgagctggtagtgccacaatatgaaggagatgctccacctcttcaagatgatttcacatcatatttctatttgaatgatactaatctatccatattcgaagacacaaatgaattgtttttggaaaacaagttggatactaaaggtaactgacgccagattgtcatgagttgctgctctcttggataaactcatcatgaaaccaagaattttattccatgaagctcgtgaacgagccagtcgttgctatctctcttattaggatttccagtttggatattgccgtactcctttacttttcttcatgtcgaaattaccatgcgtgctatgttgaatttcatctgct

SEQ ID NO: 4917 - DNA, 2412 bp, Oryza sativa
  Predicted polypeptide sequence is orthologous to G1313
atcctgcagactcgccccactctcttgctcagctcctcttcatccagtcctcaaaactctctctgatctctctctcttgctgaaaattctccgcacactccggtgggcttaagcggtggcggcgtctcgcctgggtgggcgagatccctctcttgctcgtccgcaaggtcgctccccctgcgagtccaatctactgacgagctgggaggagcaaaggagggggcaattggagctccgctcggttccaattcagccccaattttgagccccccggctgcggggttcggccagttgagacgccatgtatcgggtgaagagcgagagcgactgcgatatgatccatcaggagcagatggactcgccggtggccgacgacggcagcagcggggggtcgccgcaccgcggcggcgggcccccgctgaagaaggggccatggacgtcggcggaggacgccatcctggtggactacgtgaagaagcacggcgaggggaactggaacgcggtgcagaagaacaccgggctgttccggtgcggcaagagctgccgcctccggtgggcgaaccacctgaggcccaacctcaagaagggggccttcaccgccgaggaggagaggctcatcatccagctccactccaagatggggaacaagtgggctcggatggccgctcatttgccagggcgcactgataatgaaataaagaattactggaatactcgaataaagagatgccagcgagctggcctacccatctatcctaccagcgtatgcaatcaatcctcaaatgaagatcagcagtgctccagtgattttgactgtggcgagaatttgtcaaacgatcttctgaatgcaaatggtctttacctaccagattttacctgtgacaatttcattgctaattcagaggctttaccttatgcaccacatctttcagccgtttctataagcaatctccttggccagagctttgcatcaaaaagctgtagcttcatggatcaggtaaaccagacagggatgctaaaacagtctgatggtgtgcttcctggattgagcgataccatcaacggtgtgatttcctcggtggatcaattctcaaatgactctgagaagctcaagcaggctgtgggttttgactatctccatgaagccaactctaccagcaagattattgcacctttcgggggtgcacttaatggcagccatgcctttttaaatggcaatttctctgcttctaggcccacaagtggtcctttgaagatggagctcccttcactccaagatactgaatctgatccaaacagctggctcaagtacactgtagctcctgcgttgcagcctactgagttagttgatccctacctgcagtctccagcagcaaccccttcagtgaaatcagagtgcgcgtcgccaaggaatagtggccttttggaagagttgattcatgaagctcagaccctaagatccgggaagaaccaacagacatctgtgataagttctagttcttctgtcggtacgccatgtaatactacggttcttagcccagagtttgatatgtgtcaggaatactgggaagaacaacatcctggtccattcctcaatgactgtgctcctttcagtggcaattcattcactgaatccacccctcctgttagcgctgcatcgcctgacatctttcagctctccaaagtttccccaggttggactctgaaattcctcatccctctttgatgtgattattcggttatttatgatgtactgttttgcagcacaaagcacttcaatgggatctggagagcaagtaatggggcctaaatatgaacctggggacacttcacctcatcctgaaaacttcaggccagatgcattgttttctgggaatacagctgatccatcagttttcaacaatgccatagcaatgcttctgggcaatgacttgagtatcgattgcagacctgttcttggcgacggtatcatgttcaattcttcctcgtggagcaacatgccacacgcctgtgaaatgtcagaattcaaatgaattctgtatttggtatttgccagacgctacagcagattcttggtatcgttcttgctcattgtttggatcataacttgaggaagatctcgtcggttgtaattctgcattgctgacagagtccttgatggcatgcaggcactatcagatgttctcttatgcgactagcccttttgtccaataaagtagtgcatggagataagccggttaattattgttttcttttttgtattagagaaccctttttgtcatctctattgcccgaattctgttggaaattcgtcatgtttgtttgaacaatgtaagaccaattattgcatttgtggtgtactatcttgttgagcatttaccacttgccaatcaatagcaatttgttactact

SEQ ID NO: 4918 - DNA, 1577 bp, Oryza sativa
  Predicted polypeptide sequence is orthologous to G1324, G2893
aaggggatcatacatcgacctcatcatccaatccaccaactgaccaacaacatttatactactagtagtagaagaagaagctctagatagctatatatcccagctgctgcaaaggtagtagacagcaatgtcgcagaggagagttgcagggcccatgggagtgatgagcaagcagcagcaggaggccatggcagaggagatgatggagctgaggcgaggaccatggaccctcgaggaagacaacctcctcatgaactacattgcctgccatggcgaaggccgctggaatctcctcgcccgctgctccgggttgaagaggacgggcaagagctgcaggctaagatggctcaactacctcaagcctgacataaagcgcgggaatctgacgccggaggagcagctgctcattcttgagctccattccaggtggggaaacaggtggtcgaggatagcgcagcatctgccggggaggacggacaacgagatcaagaactactggaggacgagggtgcagaagcaggccaggcagctcaaggtcgacgccaacagcaccgtcttccgcgacgccgtccgctgctattggatgcctcgcctcctcgagaagatggccggagcagccaccgaccccactccgccgccgccaccgccactccaccaccacgccgccatggccaccgcctcctcctcgccgttcgacttcgacacccacctgcagcaagcagaagcagcaacggcgtgcgtcgtcccgaacaacgtgtaccaccaccacatcgacccgagcccgagcacgtcgacgtcggccggctcgacggcggccgcggcggcgttccagccgctgccctgcttctccgagctgagatgggaccagcagatgcagtcctccggcgagctcgacgacggcgccgccggcgtgttcgtcgactcggcgtcggcgctgggaagcctcagcctcgacgggctggaccttggtccggccgagtactactccgactcgacgctcctcgactacctcaactccagctgcaccggcagcgccatgatgacgatgatgaccgcctccggcaacgccggcagctacaactactgcggcggcgccatggacggcggcgacacgtggaggtccgacgaggtgtgccaagcggcggcgagaaagctcggcgagtggggaggaggaatctagctagctagctaggtagctacgtatccagctgagcttagctgtagctaaaggctaagtggatggatggatcatggatagatgagatggtaagttgcttcttgtgatgtctctccattaaagcgagatgagatgatgatcatgatgatgatgttgatgatgctgtcacattagctaatggatgagttgttccatcatatcgatcaagatagaagtactagtgatcgatcaagcaaaaatcaaaagtagaagatgatcaatagcgtgatgattccgatcgatggagagaatattattgagatgtgtttaaacatattagctagagctagctagcttcttgtagtggttgatcgatcgatggtgcatgtaactattgttagtagtagtactttgttaatgt

SEQ ID NO: 4919 - DNA, 984 bp, Oryza sativa
  Predicted polypeptide sequence is orthologous to G1335
gattcgcttccactcccacaccgatctagggtttctagggttttgggttgcggcggcggcggcggcgagagggcgagggcgaggtcgagatggcgtcggagagggtgaaggggacggtgaagtggttcgacgccaccaaggggttcggcttcatcacccccgacgacggcggcgaggatctcttcgtccaccaatcctcgctcaagtccgacggctaccgcagcctcaacgacggcgacgtcgtcgagttctccgtcggatccggcaacgacggccgcaccaaggccgtggacgtcaccgcgccggggggcggggcgctcaccggcggatcccgtcccagcggcggcggggaccgcggctacggcgggggcggaggcggcggccgctacggcggtgaccgcggctacggcggcggtggcggcggctacggcgggggcgaccgcggctacggaggcggcggcgggtacggcggcggcggcggcggaggcagccgcgcgtgctacaagtgcggcgaggagggccacatggccagggactgctcccagggaggaggcggcggtggtggctacggtggtggtggcggcggctaccgcggcggtggtggtggcggcggcggcggcgggtgctacaactgcggcgagaccggccacatcgctcgcgagtgccccagcaagacctactaggcgctgctcgcggcgtcagatccagctccctcccatgatgcgttttgctccccctccctcactgaatcaccgagcagcgggtgatcagttctatcttattagtagtcgtagatctcgttaggaaagctatggatctatcggttcgtcgtcgtcgtcgttctatgtaatgggatgggagtcttggagtggtttaatctttttgtttcgttgggtcggtttgagagacaagccatggatttgcactgtctgatctatctatgaatctatctattatgaaccgagaagaaaatattcatcagct

SEQ ID NO: 4920 - DNA, 963 bp, Oryza sativa
  Predicted polypeptide sequence is orthologous to G1335
gattcgcttccactcccacaccgatctagggtttctagggttttgggttgcggcggcggcggcggcgagagggcgagggcgaggtcgagatggcgtcggagagggtgaaggggacggtgaagtggttcgacgccaccaaggggttcggcttcatcacccccgacgacggcggcgaggatctcttcgtccaccaatcctcgctcaagtccgacggctaccgcagcctcaacgacggcgacgtcgtcgagttctccgtcggatccggcaacgacggccgcaccaaggccgtggacgtcaccgcgccggggggcggggcgctcaccggcggatcccgtcccagcggcggcggggaccgcggctacggcgggggcggaggcggcggccgctacggcggtgaccgcggctacggctgcggtggcggcggctacggcgggggcgaccgcggctacggaggcggcggcgggtacggcggcggcggcggcggaggcagccgcgcgtgctacaagtgcggcgaggagggccacatggccagggactgctcccagggaggaggcggcggtggtggctacggtggtggtggcggcggctaccgcggcggtggtggtggcggcggcggcggcgggtgctacaactgcggcgagaccggccacatcgctcgcgagtgccccagcaagacctactaggcgctgctcgcggcgtcagatccagctccctcccatgatgcgttttgctccccctccctcactgaatcaccgagcagcgggtgatcagttctatcttattagtagtcgtagatctcgttaggaaagctatggatctatcggttcgtcgtcgtcgtcgttctatgtaatgggatgggagtcttggagtggtttaatctttttgtttcgttgggtcggtttgagagacaagccatggatttgcactgtctgatctatctatgaatctatctattatgaaccg

SEQ ID NO: 4921 - DNA, 1398 bp, Oryza sativa
  misc_feature (1308)..(1308): n is a, c, g, or t
  Predicted polypeptide sequence is orthologous to G1335
acgcgttcgcccacgcgttcgcgccgcatcacctccgccgccgccgtcgccgccgcatcgcgcctcctcgtccgccgcgcgccgccgcgcctgctgcgccggttaccccgcgcggcgctcgccgcctctcgcccgtcgccgccgtcgtcgtcgtcgtacggtgcagcagccgtcgccctcggccggcagccgctcggccaccgcgctaggatgggacacaccgccgccgccgccgccgccgcgggccccgcgctcgggctcaccaagcccaacgccgtcgagccgccgcaggtttcatttgctgctaaagacgtcgagatggcgtcggagagggtgaaggggacggtgaagtggttcgacgccaccaaggggttcggcttcatcacccccgacgacggcggcgaggatctcttcgtccaccaatcctcgctcaagtccgacggctaccgcagactcaacgacggcgacgtcgtcgagttctccgtcggatccggcaacgacggacgcaccaaggccgtggacgtcaccgcgccggggggcggggcgctcaccggcggatcccgtcccagcggcggcggggaccgcggctacggcgggggcggaggcggcggccgctacggcggtgaccgcggctacggcggcggcggcggcggctacggcgggggcgaccgcggctacggaggcggcggcgggtacagcggcggcggcggaggcagccgcgcgtgctacaagtgcggcgaggaaggccacatggccagggaactgtcccagggagggggggggcggcggtggctaccggtggtggtggccggcgggcggcggcggggttgttacaacgtgcgggcgagaccggggccacattcggtcggcagatttgcccccaaggaaagaaccttacttagggcgcgctgtgtcgcggggggtacagattccaagggttcccttccccattagttccgtttttgggtccccccccttcccctccaattggaattcacgcggagacaggggggttgaaccgggcccaaccttaattaaggcaagccagaacgctccccggttcggaaaacagctatgcggatccaaacacgcgttccagcccgaccggcacggccggcctatattgtacccgcgcgactggggaagcccttcggagagtggggggttaaaaccccttttattagagttccgaggatggggagtcacggggtttagaaaaaagagaacaggggccattgggagatttttgcgagccgttgggtagaggcctctaattctttagagaaaagatcatcagcttgaatatantatgaagccgccggctgaataagaagaagttatttttctctatgacggggcgagagagaaggagaaacagacacaacagacgaaacagag

SEQ ID NO: 4922 - DNA, 445 bp, Oryza sativa
  Predicted polypeptide sequence is orthologous to G1341
aagtatgagaagagcattggggtcacaagagcaatgaccttgaacaaccttcagacaggtttccctaacgtttttcaggcgatgacgggattcgccagcgtttgcatggaagcgtttgaatcggtgtacaacttcaagagttcagatcggatccttgattcgaagaggctactaacatgagattctgagaagttgtcttttgttggtgcttggtaggtcactgtataaagtgtatacagttctagagttcttgtagaatagcaggtggaacagggtttaacttacaaccgtctctgtctgttatcgtcttctatcttatggtactagagtaggcaggcacagaaatgcctcgagttcatttactcgctgtgaacgaacttgaggccttgttcttcctctttttggttagctctgaggtgtttgtccattcttggattcgaaatct

SEQ ID NO: 4923 - DNA, 1553 bp, Oryza sativa
  Predicted polypeptide sequence is orthologous to G1361
ggttccctcctctcctcctttctctctccctcctcccgcgcgcggggtctcgccttaacgtttgccgcatatgggggcgacgagcaaagcgtaggccggagggagggacagggagagagagagagagaggctttctggctcgctctctctgcacgatctctcgtcttgttggattatacagccatgacatggtgcaacagcttcaacgacgtgcgcgccgtggagaacaacctggccaccgccgccgccgtggccgcggccaagaagcagcagcagcagcagcaggtctcccagcacgtcaacctcatcaagacctgcccctcctgcggccaccgcgcgcagtatgagcaggcagcggcggcggcgacgatccaggacctgccggggctgccggccggggtgaagttcgacccgacggaccaggagctgctggagcacctggaagggaaggcgaggcctgacgcgcggaagctccaccccctcatcgacgagttcatccccaccatcgagggcgagaacggcatctgctacacccatcccgagaggcttccaggagtcggcaaggacggcctgatccggcacttcttccaccgcccgtcgaaggcgtacacgacggggacgcggaagcggcggaaggtgcacaccgacgagcagggcggcgagacgcggtggcacaagaccggcaagacgcggccggtgttcaccggcggcaagctgaaggggtacaagaagatcctggtgctctacaccaactacggcaagcagcgcaagccggagaagaccaactgggtgatgcaccagtaccacctgggctccgacgaggaggagaaggacggcgagctcgtcgtgtccaaggtgttctaccagacgcagccgaggcagtgcggcggcggctcggcagcgacggccaaggacctctccgtcgacctcgtcgccggtaacaacatcaaggctagcaatgctgctgctgaacaccaccataacgacggcgtcggcggcggcggccacggtggcaacaacagcagcatgctgaaggaagctgcaggcattgtagatttctacaacccagcggcggcgctaatcggctacagccaggcggctcctaacaacagggcggctgcttctgctcatttgacgatgcctaactttgaggtgcacacaggaggtgcaggctttggcccctgatggatggaagaaaacaaagcaaattaaacatatttgactgatgatatatataggttagatggagagggcagggcaggtatatgatggcaaatgtgcatcatgcatgctagcatggtgtaatttgcatcgagtgaaaaaaaaggagtttactaaaccgtctacgtacgtattactggacaataaggagtgtgtcgagtgagttgctgcacagatgttgaagcgtaggggggtcgatattcttacagtgttcattattgttacatgtgtacacatatataacttgacattctcaatttttttgtttaatgatatatatatatatatatatatatatatatatatatatatatatatatatgttgttctat

SEQ ID NO: 4924 - DNA, 1539 bp, Oryza sativa
  Predicted polypeptide sequence is orthologous to G1361
gaagctttccttcttcttttttccccctctcgacgatctctctctcatcaggaccccggccttaagttgtttcttccctatcagctcaggtctctctcgatctctcctagctagatagatagcttaattagcagctagagatgtgtctctagctaagctaactagctagtaggcttcttcttttaatccggcattgttcttggctgctggtcttagtttttggctgtcatgtatggagttagtggtaaaatactaggttaattaataatataaggcgtgtgtatatattggtgtggaggaggaggagaaagggggttggccggagagatcgatgacgtggtgcaacagcttcagcgacgtccgcaccgccgtggacagcagcttgtcgccggccgccgccgtggccgccgccgcggggaagaaggcggcggcgtcgctcgccgtcctcgtcaagatgtgcccctcctgcggccaccgcgcgcggtatgaacaggagacgacgacgatccaggacctgccggggctgccggccggagtgaagttcgatccgacggaccaggagcttcttgagcatttggaagggaaggcgaggccggactcgaggaagctccaccctctcgtcgacgagttcatccccaccatcgagggcgagaatggcatctgctacacccatcccgagaggcttcccggtgtgagcaaggacgggctggtgaggcacttcttccaccggccgtcgaaggcgtacacgacggggacgaggaagcggcggaaggtgcacagcgacgaggtcgacggcggcgagacgcggtggcacaagaccggcaagacgagaccggtgatggccaacggccggcccaggggctacaagaagatcctcgtcctctacaccaactacggcaagcagcgcaagccggagaagaccaactgggtgatgcaccagtaccacctcggctccgacgaggaggagcgggacggcgagctcgtcgtctccaaggtcttcttccagacgcagcccaggcagtgcggctccaccgccgccgccgccgccgccaaggaggcctccgccgccgtcgccgccgccgtggtgaacagcaactactccatcgtccatggccatcaaggtggtggtggtggtagctttctcaaggaggcaaacgttgtgcacgagttctacgacccggcagcaacgatgggttaccggccacctgctcctgctgcgcacttcgcgccaaacttcgcggtgcacgcggcaaggaacagctttggtggcccttgaaggaaaaaccaaaattacacaaaatctaaacattaccgtttataccgatatgattcacataggtgccattatattacattcttaaccttacattcatccatcagttatttgcagttttgttcaaagttgttatatcgtttccgatgctatactgtgcaaagattattactacacgccgttctaactcgaaaatgtcaattaatgtatcagtttgtacatgtatacatgcacacggaagaggtcctgatgatgcatcacttcat

SEQ ID NO: 4925 - DNA, 717 bp, Oryza sativa
  misc_feature (20)..(20): n is a, c, g, or t
  Predicted polypeptide sequence is orthologous to G1361
cttcgccaagaagcgcaagncggagaagaccacctgggtgatgcaccagtaccacctcggcgagctggacgacgagaaggaaggggagctcatcctctccaaggtcttctaccagacgcagacgcggagcgccgccgcagcagaggcaccggtaagctcgggtgctgccatggaggtgcagggacagcagcagcaagtgctgaagctgcaggctgatgatggtcacttcagctcagctcctaccaagaagagactgcatcaggatgttgtagcacaagtaaaagttgatcggggtcaccactgcatgccagcacaacgccaagtcaacttcaatttgaaagtaactcctgtgcccaccaccagttcattccctgtcgttgtcgacaaacagttgtattctcctgtggcgctattccgaagtgaacatcttcatggaagaacttcaattcatcagccccaaaaagcagattggcctcaccagcgctggcctcctgacaaccaagatcaacatggataacttcctggattcacagtagatgaacttaactggtaaatggttctagtgttgattttgaaacgtacaacagaaactggctgtaatatcttcggctactgctagagtgctagtgctagtaacctatctacttctgttcttagcccgtagggcagtattgtttcttattgagaatgactgtctatatacatgtcaaatctctt

SEQ ID NO: 4926 - DNA, 837 bp, Oryza sativa; identical to SEQ ID NO: 1795
  Predicted polypeptide sequence is orthologous to G1364, G481, G482, G485

SEQ ID NO: 4927 - DNA, 1082 bp, Oryza sativa
  Predicted polypeptide sequence is orthologous to G1364, G481, G482, G485
aaccgccgtctcctcctccccccactctcgccttcccccctctctctcctctcctctccgcgactccctccacccccgcgcgcgcgcgttttttttttttcgtaagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaccggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagagatggagggtgatagtaagctgtcctcaaaggctggtgatggttcagtaaagaaggatacaattggtccgcacagtggcgctagtagctcaagtgcgcaagggatggttggggcttacacccaagggatgggttatatgcaacctcagtatcataatggggacacctaaagatgaggacagtgaaaattttcagtaactggtgtcctctgtgagttattatccatctgttaaggaagaacccacattagggccatatttattagtagaagactaaagcacttgaagggtgttggtttagaaagggtgttaacagttggctgtggcgattgcttcacagatgtaaattgcttcataagtggtttaatgcttgtttttgcctgtatattcagagcaattttcacatattggtagttctgcaatcttttgcattcccatacatgtatcaggtggcacaaatctattgcaagtaccctagcattgaataatgctggttaacatataattctgtaacgtccgtattgtttcgactgtgatgcttgccgtatgggcaatggcatgtgttctagagggggcattcaatatttaggtatctcaagaatgtaccaaatactcccttcgttcaattc

SEQ ID NO: 4928 - DNA, 1225 bp, Oryza sativa
  Predicted polypeptide sequence is orthologous to G1364, G481, G482, G485
gaccccgaccccttcaatcgcgcccgcctcagccgccttctcttctccagcgtccgatctccccctctcgcctctccgcctcacctccgctccgcttcccacccccgcttcctctctctctcctctccccctctctctctctctctctcctcctcgcttcaccacctcgcgcccaacccccctctctctcctctccacgtcgcgccctctccgcgcgcgcccgcgcttctatataaggaggggggaggtgggatggcggatgggccggggagcccggggggagggggggggagccacgagagcgggagcccgagggggggagggggaggagggggaggtgggggtgggggtgggggggtgagggagcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagagatggagggtgatagtaaattaactgcaaaggctggtgatggctctgtgaaaaaggatgtacttggttctcatggaggaagcagttcaagtgcccaagggatgggccaacaagcagcatacaatcaaggaatgggttatatgcaacctcagtaccataatggggatgtctcaaactgaagataggaccttttcatgcaactgttgctagcgcaggtggattttatttggtgctgcagtcgttagctaatatatatacctacacctcatggtgagcagtgaaggaagtaacttgctaccacctctaggtcccatgtttgtcaaccaggaactgatgctgcttggaagcgtcgagccaaggctgcttctcagatgtaaattactccccgtgaggatagtttcggttcgtggtctagctctgttgttgtatgtatattcaggataatttaacaattggtctttggctgtcattcggttccatataatctgtattgggaggcataaatattcatgttgtatttcgtcctgaactagcgtgttgtactattgagaaatagatgctctctgtaatggtagcaattttactctgattccc

SEQ ID NO: 4929 - DNA, 558 bp, Oryza sativa
  Predicted polypeptide sequence is orthologous to G1364, G481, G482, G485
atgcaagggcttcctagggcgtcgtcgtcgtcaacctcggcgtcgagagatcgagacggcggcgatggcgatggcggcggcggcggcgtgacgatgacgaacgggcaggacaacctgctgccgatcgccaacgtgggccggatcatgaaggacgggctgccgccgcaggcgaagatatcgaagcgggccaaggagacgatccaggagtgcgcgacggagttcatcagcttcgtcaccggcgaggcgtcggagcggtgccggcgggagcggcggaagacggtgaacggcgacgacgtctgccacgccatgaggagcctcggcctcgaccactacgccgacgccatgcacaggtacctgcagaggtaccgcgagggcgaggagctcgccgcgtcgctcaacagcagcagcagcgccgccgccgccgccgccgccgccggcagcaggggcggtggcgccatacagatcgacgtgagagctgagctctccatcttcagatcaggcaacaaccaaggtaaaaagggtgttaactctcttttcgtggaggtgaaacttaactga

SEQ ID NO: 4930 - DNA, 932 bp, Oryza sativa
  Predicted polypeptide sequence is orthologous to G1364, G481, G482, G485
cccgcgccctcctctcctcttcgtcttcctcctcgcttcgcttcgactgcttcgatcgaggagatcgaggttgcgatgccggattcggacaacgagtcaggggggccgagcaacgcgggggagtacgcgtcggcgagggagcaggacaggttcctgccgatcgcgaacgtgagcaggatcatgaagagggcgctcccggcgaacgccaagatcagcaaggacgccaaggagacggtgcaggagtgcgtctcggagttcatctccttcatcaccggcgaggcctccgacaagtgccagcgggagaagcgcaagaccatcaacggcgacgacctcctctgggcgatgaccacgctcggcttcgaggactacatcgacccgctcaagctctacctccacaagttccgcgagctcgagggcgagaaggccatcggcgccgccggcagcggcggcggtggcgccgcctcctccggcggctccggctccggctccggctcgcaccaccaccaggatgcttcccggaacaatggcggatacggcatgtacggcggcggcggcggcatgatcatgatgatgggacagcctatgtacggctcgccgccggcgtcgtcagctgggtacgcgcagccgccgccgccccaccaccaccaccaccagatggtgatgggagggaaaggtgcgtatggccatggcggcggcggcggcggcgggccctccccgtcgtcgggatacggccggcaagacaggctatgagcttgctttcttggttggtgttttggtaattaattaatcagaggacatgtcgggttaattaatcttaatctctgttttttcactctttttttttacctttctttctctctcttttatctttccttttctcaatgtgctaaaatgagtcaattatatggctaaattctctactaattcgcttc

SEQ ID NO: 4931 - DNA, 1717 bp, Oryza sativa
  Predicted polypeptide sequence is orthologous to G1364, G481, G482, G485
tctcattctcataaaataatcatcccctgcctaactccataacaaagaaatgcatactcctcggtcattagtatatgttagtataaattaaataattaacaccttaaacaatatctcttcgtcgtagtttgatcatcacctaagattttttagtcttttcaaaaatgatcatcaagctaacaagtgtatctttatttatttgtgcaagaagtaaatgagcatcattgaatgcgctgcacacatgtaatgcaaacaaccaagttaatttttattggtgcaacgggcgcgcactatttaaaacgtgacgcaatgcagcgatagagcaccttgatagataagaattaatttcagcatgatgtagattttgttatccttaatctctactcactttgcataggtgataaattaaaccgctgaactattactacatggtttacatgaaaggtgatcgggtagggacgagaatgtcgcgacacacatgatatatatagtagcgtccttatgtttgctttgtgtccgcatcgataccgtcttcccactcgcatctcctcacctcctttccttctttaaaaggagagcatcaccactccatcctcaactcccataacacctcccccttctctctctctctaactacacactctctctctagctagctagctagctatagctagtgttgttagcttcacatgaagagtaggaagagctatgggctcttgctgagcccggtgggcagcccgccgtcggacaacgagtccggcgcggcggcggcggcggctgcggcgggcggcggcggctgcgggagcagcgccgggtatgttgtctacggcggcggcggcggtggggactcgccggcgaaggagcaggacaggttcctgccgatcgcgaacgtgagccgcatcatgaagcggtcgctgccggcgaacgccaagatctccaaggaggcgaaggagacggtgcaggagtgcgtgtcggagttcatcagcttcgttaccggcgaggcctccgacaagtgccagcgcgagaagcggaagaccatcaacggcgacgacctcctctgggccatgaccacgctggggttcgaggcctacgtcggcccgctcaagtcctacctcaaccgctaccgcgaggccgagggcgagaaggccgccgtgctcggcggcgccggcggcgccgccgcggcgcgccacggcgagggcggttgctgcggcggcggcggcggcgccgatggcgtcgtcatcgacgggcattccccgctcgccggcggcctgtcacactcacaccatggtcatcagcagcaggacggcggcggcgacgtcgggctcatgatgggcggcggcgccgccggcgtcgggtacaacgccggggccgggtcgacgacgacggcgttctacgcgccggcggcgacggcggcgtcagggaacaaggcgtactgcggcggcgacgggtcgagggtgatggagttcgagggcatcggcggcgaggaggagagcggaggcggaggcggcggcggcggcggcgagagggggttcgccggccacctccatggcgtgcaatggtgaagactaaagaggagtactaattagctagctaggcacacgcgtagttttattattacttaattaccgcgttaattaattgttgatgctgatgctgtttaaaattgattctccttttgcatgaaaatgtttgatggtatggtttaaaaattgaagaa

SEQ ID NO: 4932 - DNA, 1800 bp, Oryza sativa
  Predicted polypeptide sequence is orthologous to G1364, G481, G482, G485
aacttcaaatcctacttagcagaagagaagtgctatacgaacgaccaatgcattcgactagcgtacgtctcatctcatcggattggcctgtttggtagagttttagcttctaaatttagcttcaagctccagaagttttaagtggagttgtggagctgtctaaactcatctctacctctctaaattattttgtgagagttttactcagcttcgctcctattttaagtagagctgaaactgtttggctaagttttagctataggagaggtggagctggagctgtgattacttttgtgggtccagtttttttatagctaatcatggtcatataggagttggatgtgcaagtcgtatgcatggtcattctgtgctcggcttattaaaaaaattgtgtaaatataaaaaacgaaaagttatgcttaaagtactttaggtaataaagcaagtaaaaaaaataaataataatttaaaattttttgaatcagacgagtgattaaaagtgcaaacaaaaacttaaaattttttgtattatgggacggagggaataggactgcaagtttaactaaagtatcctataaattcaagtattcaaaatattatgctttgcctgctgctggctggtgcagcaaattggtcctggccccggtgcacggtcctacgtggcgagccgggcactcgcgcatgtcaggggggccaaggcgccgtcccacgtggcctcggcccacccagacggcggggatccgtccgacgtggcgatgatggacagacggttgagcgccaagtggcacacgcttatcagcaaacgaacggctggggtcggtccacgtagacgcctcgatacgttcttatccgcgcgatccaacggaccgatccccccacgccattccccaccccaccatctctctctctctctctcttctcttcttcttcctcctagactagtcagtctctcccaagaacacccactcctctagtctctctctctcgagagagaaaattgatgattcttgggatgattttgaggcgtctgatttgctgaagaggaggaggaggatgccggactcggacaacgactccggcgggccgagcaactacgcgggaggggagctgtcgtcgccgcgggagcaggacaggttcctgccgatcgcgaacgtgagcaggatcatgaagaaggcgctgccggcgaacgccaagatcagcaaggacgccaaggagacggtgcaggagtgcgtctccgaattcatctccttcatcaccggcgaggcctccgacaagtgccagcgcgagaagcgcaagaccatcaacggcgacgacctgctctgggccatgaccaccctcggcttcgaggactacgtcgaccccctcaagcactacctccacaagttccgcgagatcgagggcgagcgcgccgccgcctccaccaccggcgccggcaccagcgccgcctccaccacgccgccgcagcagcagcacaccgccaatgccgccggcggctacgccgggtacgccgccccgggagccggccccggcggcatgatgatgatgatggggcagcccatgtacggctcgccgccaccgccgccacagcagcagcagcagcaacaccaccacatggcaatgggaggaagaggcggcttcggtcatcatcccggcggcggcggcggcgggtcgtcgtcgtcgtcggggcacggtcggcaagacaggggcgcttgacatcgctccgagacgagtagcatgcaccatggtacatatatacagtaatcagcagctgttcatttttctatgattactagttgactt

SEQ ID NO: 4933 - DNA, 693 bp, Oryza sativa
  Predicted polypeptide sequence is orthologous to G1364, G481, G482, G485
taattttttttttttgaatttgaaacccaactttgcataaacttgtgtcagcatcacacctgcttgcgtaatagagtttagaaaagtttctcttagatctctttacccctctgaatttagcatatgcaggacagccggaaacggccaaatatggttagacacaaccacacaacacacgactgaactagaacctacaacaaatttggacatcctggctaacacaagaacatttcaaaaagaacgacgactaacattcgtggtaacaaggtattggaactttggaagcatcctgcttacaacataacaggatgctggagcgttctttccctaaaaacgatggttctccttcctagatgccattagcgtgccaatcagtatcacactcctcgtcctacatgccttcaaacgatgatccaggatctccattaagtacaacatctttctttactggcagttcagaagctcttgaaccctttgtgtcaccctccgtctcccggtagagcctgaggtagagcttgagaggctcgacatagtcctcgaatccgagcgtgcccattgaccagatcaggtcgtccccattgatggtcttgcgcttctccttgaggcacttgtcgcttgcttcgctggtgatgaagctgatgaactcggagacgcactcctggacggactccttggagtccttggcgatcttgc

SEQ ID NO: 4934 - DNA, 1284 bp, Oryza sativa
  Predicted polypeptide sequence is orthologous to G137, G145
gaattaagccacagcttgagcagatcagctgcaggccggccggtgtgcgtgtgtgacagtaggagagagagctagcgagagagagcaaggaatcggaattgatttcatgcactgatcgatccatccatcatgcagatgctgcatggatgagaagagctagcagctaagctttgctgaagaaaattcttcagaggtttgtgttgatttgctggtctgctagagatcgatctagagagagagagaggaagggaagactgaagagagatctcgagcgggagatcgagatggggcgaggcaaggtggtgcttcagcggatcgagaacaagatcagccggcaggtgacgttcgccaagcggcggaacggcctgctcaagaaggcctacgagctctccatcctctgcgacgccgaggtcgccctcgtcctcttctcccacgccggccgcctctaccagttctcctcctcatccaacatgcttaagacgcttgagagataccagaggtacatttatgcttcgcaagatgctgccgcaccaactagcgatgagatgcagaacaactatcaggaataggtgaacttgaaggcacatgttgagattctgcaacaatcacaaaggaaccttctaggtgaggatttagctccactggctacaaatgaacttgagcagcttgagagtcaagtagtcagaaccttgaagcaaatcagatcaagaaagactcaggtactacttgatgaactctgcgacctaaagagaaaggaacaaatgctacaagatgcaaacagggtcctgaaaaggaagcttgacgagatcgacgtagaggcagctcccccacagcctccatggaacggaaactgcagcaatggccatggcggcggcggcggcgtgttttccagtgagcctccccaaccagagcacttcttccaggccctcgggcttcatgccgtggacgtgaaccagccgccggcgccgccaccgggcggttatcctcctgagtggatggcctagctagctagctagctaccgtttcagcttcagttaatcagggtcaagtatcagctgagtttggccatatgtatggattctatatgttgcttcagaagttcctctctccttcctcttcaatttgttgctaattaagtgcttgccaaacttttctcagtgtaatgtactactactatgtatagttttgtcttgtatgaacagtttgtgagtactgtcactgcgagtaaggtgcgtgatatggtaccgtgaaaacaaaagcgggacaaccatcctttttgcgttt

SEQ ID NO: 4935 - DNA, 1203 bp, Oryza sativa
  Predicted polypeptide sequence is orthologous to G137, G145
gagctttcccctctctttcgcttcgcgagattggttgattcatctcgcgattgatcgagctcgagcggcggtgaggtgaggtggaggaggaggaggaggaggagatcgggatggggagagggagggtggagctgaagaggatcgagaacaagatcaacaggcaggtgacgttcgcgaagcggaggaatgggctgctcaagaaggcgtacgagctctccgtgctctgcgacgccgaggtcgccctcatcatcttctccaaccgcggcaagctctacgagttctgcagcggccaaagcatgaccagaactttggaaagataccaaaaattcagttatggtgggccagatactgcaatacagaacaaggaaaatgagttagtgcaaagcagccgcaatgagtacctcaaactgaaggcacgggtggaaaatttacagaggacccaaaggaatcttcttggtgaagatcttgggacacttggcataaaagagctagagcagcttgagaaacaacttgattcatccttgaggcacattagatccacaaggacacagcatatgcttgatcagctcactgatctccagaggagggaacaaatgttgtgtgaagcaaataagtgcctcagaagaaaactggaggagagcaaccagttgcatggacaagtgtgggagcacggcgccaccctactcggctacgagcggcagtcgcctcatgccgtccagcaggtgccaccgcacggtggcaacggattcttccattccctggaagctgccgccgagcccaccttgcagatcgggtttactccagagcagatgaacaactcatgcgtgactgccttcatgccgacatggctaccctgaactcctgaagggccgatgcgacaaccaataaaaacggatgtgacgacacagatcaagtcgcaccattagattgatcttctcctacaagagtgagactagtaattccgtgtttgtgtgctagcgtgttgaaacttttctgatgtgatgcacgcacttttaattattattaagcgttcaaggactagtatgtggtataaaaggccgtacgtgacagcctatggttatatgctgcacaaaaactacgtatggtacagtgcagtgcctgtacatttcataatttgcggtaaagtttattgactatatatccagtgtgtcaaatataataaaatgtcgaggtttaattacc

SEQ ID NO: 4936 - DNA, 1188 bp, Oryza sativa
  Predicted polypeptide sequence is orthologous to G137, G145
gaggtagccaaaccacaccaccataaagctagcttgcaaaggggatagagtagtagagagagagagagaggagaggaggaggaagaagatggggagggggaaggtggagctgaagcggatcgagaacaagatcagccggcaggtgacgttcgccaagcgcaggaacggcctgctcaagaaggcctacgagctctccctcctctgcgacgccgaggtcgccctcatcatcttctccggccgcggccgcctcttcgagttctccagctcatcatgcatgtacaaaaccttggagaggtaccgcagctgcaactacaactcacaggatgcagcagctccagaaaacgaaattaattaccaagaatacctgaagctgaaaacaagagttgaatttcttcaaaccacacagagaaatattcttggtgaggatttgggcccactaagcatgaaggagctggagcagcttgagaaccagatagaagtatccctcaaacaagtcaggtcaagaaagaaccaagcactgcttgatcagctgtttgatctgaagagcaaggagcaacagctgcaagatctcaacaaagacttgaggaaaaagttacaggaaaccagtgcagagaatgtgctccatatgtcctggcaagatggtggtgggcacagcggttctagcactgttcttgctgatcagcctcatcaccatcagggtcttctccaccctcacccagatcagggtgaccattccctgcagattgggtatcatcaccctcatgctcaccatcaccaggcctacatggaccatctgagcaatgaagcagcagacatggttgctcatcaccccaatgaacacatcccatccggctggatatgatgtgtgtgttcagttcaggcttcaggcttcagagaagccaatgcaaacagtgtcctgtaatccagtaattacagggcatatgtaatgtaatgtaatgtaatccctgatctatattttgctaagtacgtgcgtgctctcttacgaccttctcccccgaacagttaatcaggggaataataatttcgtttgatgcacgtactgtatgtctgtatctgtcactgtatcgtaggaccgtccatgtataacaatttccgttttggatgtggtaacaagttaattggcacttaaatttatatttgtgatgatctgggagagtacctaatctc

SEQ ID NO: 4937 - DNA, 1265 bp, Oryza sativa
  Predicted polypeptide sequence is orthologous to G137, G145
caatccaacaaatctacataggaattactctttcggactcaaactcctcaattttttcccacttaaaaatccttcgccctaattaaagttcacccgttacaaatggagagcgatcgagctctcaactagcctaattcaagaggtgatgaagaaaaatggcagagaaaaagaagaagaagaagaagaagaagccgcaatcactcctagtccttacaagctggagatcgatcgggatggggaggggtcgggtggagctgaagaggatcgagaacaagatcaaccggcaggtgacgttcgccaagcgcaggaatggcctgctcaagaaggcgtacgagctctccgtcctctgcgacgccgaggtcgccctcatcatcttctccaaccgcggcaagctctacgagttctgcagcacccagagcatgactaaaacgcttgagaagtatcagaaatgcagttacgcaggacccgaaacagctgtccaaaatagagaaagtgagcaattgaaagctagccgcaatgaatacctcaaactgaaggcaagggttgaaaatttacaacggactcaaaggcaatactacaaatctaaacataggctgtgtttagttcggtccaaagtttggaatttggttaaaattagagacgatgtgactgaaaagttgtgtatgtatgaaagaaatttgctgggtgaagatcttgattcattaggcataaaagagctcgagagcctagagaagcagcttgattcatccctgaagcacgtcagaactacaaggacaaaacatctggttgaccaactgacggagcttcagagaaaggaacaaatggtttctgaagcaaatagatgccttaggagaaaactggaggaaagcaaccatgttcgcgggcagcaagtgtgggagcagggctgcaacttaattggctatgaacgtcagcctgaagtgcagcagcctcttcacggcggcaatgggttcttccatccacttgatgctgctggtgaacccacccttcagattgggtaccctgcagagcatcatgaggcgatgaacagtgcgtgcatgaacacctacatgcccccatggctaccatgatgatgacggggacaatgaattacgaaataacaaggatatgtggcatatatgtggtgccgcatacatgcatgtatcatggctagctacttaattggagtgatggatttgaactagtttcgtatgtagcctgtttgtgtgtaacttgtgtgagatactaccttaaaaacaaaaaaaaaa

SEQ ID NO: 4938 - DNA, 1094 bp, Oryza sativa
  misc_feature (992)..(992): n is a, c, g, or t
  Predicted polypeptide sequence is orthologous to G137, G145
ctgcaagggagagggagagagagggaagcttgcaggctgcagctaactagctaggcggggagagagaggagatagatcaagaagagattttgagaccgagagagagctagagagagatcgatggggcgagggaaagtagagctgaagcggatcgagaacaagataagccggcaggtgacgttcgcgaagaggaggaacgggctgctgaagaaggcgtacgagctgtccgtgctctgcgacgccgaggtcgccctcatcatcttctccacccgcggccgcctcttcgagttctccacctcctccggtatgtacaagacactggagcgataccgcagttgcaactacaaccttaactcatgtgaagcatctgctgcactggaaactgaactaagcaattaccaagagtacttaaagttaaagacaagagttgagttcctacaaacaactcagagaaatcttcttggcgaggacttggttccacttagcttgaaggagctcgagcaacttgagaaccagatcgagatatccctcatgaatatcaggtcatcaaagaatcaacagttgcttgatcaagtatttgagctcaaacgtaaggaacaacaacttcaagatgctaataaagacttaaaaaggaagatacaagaaactagtggagaaaatatgcttcatatatcttgccaagatgtagggcccagtggccatggttagtaaggttaccaaggagttttccatcatgcatttgggaccttcccgggatatgggtatcagcttaatggttacctcaccatgatgatggctttccctatggacatcccagggggagcgggcgacgaagcccctactgcggtacctaggtgggggcaatcgggtggaacgccgacgacagagaacgtgaagaggccaacacctgtcggccagtcaattggcccaaacaaaacaaaggggcaacacacgagaaatagaaagctagacatcccgaccgcgccctcgcnacaacatacacaagaaacaccacgaagaaacagaacacacaacaaaaagcaaaaacaacacgaagagacacacaacacagcacgaaaataccaaacgaaacc

SEQ ID NO: 4939 - DNA, 2328 bp, Oryza sativa
  Predicted polypeptide sequence is orthologous to G1382
gactctcacgagacagcttcccacgcagcgcagcgcaaccgcagcaatggccgattcgccaaaccctagctccggtgaccaccccgcgggcgtcggcgggtcgccggagaagcagcccccggtggatcggcgcgtcgcggcgctcgccgcgggcgcggcgggcgcgggggcgaggtacaaggcgatgtcccccgcgcggctgccgatctcgcgggagccctgcctcaccatccccgcgggcttcagcccctcggctctcctcgagtcccccgtcctcctcaccaacttcaaggttgaaccctctccgacaactggtactctgagcatggctgcaattatgaacaagagtgcaaatccagacatacttccttcgcctagggataaaacatctggtagcacccatgaagatggtggctctcgagattttgaattcaagcctcatctgaattcatcctctcaatcgacggcttctgctatcaatgatcccaaaaagcatgaaacttctatgaaaaatgaaagcctgaatactgccctgtcatctgacgatatgatgatcgacaatatacctctatgttctcgtgagtcaactctcgcagtcaatatttcaagtgccccgagccaactggttggaatggttggtttaactgacagctcacctgctgaagttggtacatctgagttgcatcagatgaatagctctggaaatgctatgcaggagtcacagcctgaaagtgtggctgaaaagtctgcagaggatggttataactggcgcaaatatgggcaaaagcatgttaagggaagtgagaacccgagaagctattacaagtgcacacatcctaactgtgatgtaaaaaagctattggagcgttcgcttgatggtcagattactgaagtggtttataaagggcgtcacaatcaccctaagccccaacccaataggaggctgtctgccggtgcagttcctccaatccagggtgaagaaagatatgatggtgtggcaactactgatgacaaatcttcaaatgttcttagcattcttggtaatgcagtacatacagctggtatgattgagcctgttccaggctcagctagtgatgatgacaatgatgccggaggagggagaccttaccctggagatgatgctgttgaggatgatgatttagagtcaaaacgaaggaaaatggaatctgctgctattgatgctgctttgatgggcaagcctaaccgtgagcctcgtgttgtagtacaaacggttagtgaggttgacatcttggatgatgggtaccgctggcgcaagtatggccagaaagtagttaaaggaaaccccaatccacggagttactacaagtgcacaaatacaggatgcccagtcaggaagcatgttgagagagcatcacatgatccaaaatcagtcataacaacatatgaaggaaaacataaccatgaagtccctgcgtcgaggaatgcgagccatgagatgtccactccccccatgaagcctgttgtccatccaattaacagcaatatgcagggccttggtggcatgatgagagcatgtgaacctaggacatttccaaaccaatattctcaagcagctgaaagtgacaccatcagccttgatcttggtgttggaatcagcccgaaccacagcgatgccacaaaccaattgcagtcctcagtttctgatcagatgcagtatcaaatgcagcccatgggttcagtatacagtaatatgggacttccagcaatggcaatgccgactatggctggcaatgcagctagcaatatatatggttcgagagaagaaaaacctagtgaaggttttactttcaaagccacaccgatggaccattcggctaacttatgctacagtaccgccggcaatttagtcatgggtccgtgagagtctatactaatgcttatagctcgagaatcatatattaccaatgcttcgtattgacattctcttcagaaagatgctcctatcattgacacatcagttgaaccggaggcgagagctgtacctgtgggctgcagcaaaatacaccacatgggtcttctggagcggcaaaggccttgttgtatacttgtatgtggcactggccctatattcgttgtacagtgaacccgttaagattaattagatcatcagaatttggttttctttaactatcttcgccttcagtggaatgtggatagaacatggattatggttgatttggttttgtgagcttgtctaattctcttttgtgacaaagctttgtatctcactgcatatgtacaatgccgttggcagtaaagatatgcaaatgtgatacctgtaacacg

SEQ ID NO: 4940 - DNA, 297 bp, Oryza sativa
  Predicted polypeptide sequence is orthologous to G1389
tgcggttcatgccccctggtttgtgtggcactcgggtgtgtgtggtggaacgacccgtgatgcgtcatgttctatccgtgagattgatcttcccggtcggagacctgctagtgtagagaaagctgcgtgagagagtgcgaggagagataaatgcctgcccctgtatgagcggatatggaccccccaaccttggctgcccatgtttggtgatgtgtagttctgagcttgcgtgttctctgaacctgttggatctttaataccgagagtatggcttttgttaaaaaaaaaaaaaaaaaa

SEQ ID NO: 4941 - DNA, 1511 bp, Oryza sativa
  Predicted polypeptide sequence is orthologous to G140, G146
aatcagattggaattggccacaaaagctactgctaactacattcacctcacatttcttcttcccctttccctcctcctcctcttcttcctcttcttctcccccacctctctctttaatacctctcctcctcctgttgctgcttctgcctctctcacatcttctttctttccttctctggatctcttccatcttcagaagagagagcactagttagcatacccatccatgatgaacatgatgaccgatctgagctgcgggccatcgtcgatgacggagctgaccgcggcagcggcgccggctgggtcaggatcgtcggcggcggtggcggcggggagcagcgagaagatggggagggggaagatcgagataaagcggatcgagaacacgacgaaccggcaggtgaccttctgcaagcgccgcaatggcctcctgaagaaggcgtacgagctgtccgtcctctgcgacgccgaggttgccctcatcgtcttctccagccgcggccgcctctacgagtacgccaacaacagtgtgaaatccaccgttgagaggtacaagaaggcaaacagtgacacctccaactctggcacagttgcagaagtcaatgcccagcactaccagcaggagtcctccaaactgcgccaacaaatcagtagcttacagaacgcaaacagtctaactcggcttgcctaaatatctctagtaggaccatagtgggggattctatcaacaccatgagcctcagggaccttaaacaggtagagaacaggctggagaaaggcatagctaagataagggctagaaagaatgagctgttatatgctgaagttgagtacatgcagaaaagggaagttgagctgcagaatgacaacatgtacctgaggagcaaggttgttgagaatgagaggggacagcagccactgaacatgatgggggcagcatcaacaagtgaatacgatcatatggttaataacccatatgattccaggaactttcttcaagtgaacatcatgcagcagcctcagcattacgcccatcagctgcagccaactacccttcaactcgggcagcagccggccttcaattagttttggtgtagacaccgtacgtacacacgtacgttagatgaaatctgaaggcgtcgatacccgcggctacgtaacagcgtgatcaacctgaagaaatcgatgcagtaattctatgtgttcgtcagatcatcataaccagtattgtcattaggcgttgtgaaaaaaaaatgtgtcagcatgcattgcaagctagcgtttgtggctgctcatcagctgcatgcgtaattgcgtacgtgcacaaattaaacagaccttgccaccattgtgccatattgtgtgtgttgtatgatatatatatatatatatatatatatatataaacagcacgtttgtgctctgattcgtgtaactgatcagcagatcaaactctaccactgccgatatatatgtgaggaccatggattgatgcattgtcgttgatcttc

SEQ ID NO: 4942 - DNA, 1407 bp, Oryza sativa
  Predicted polypeptide sequence is orthologous to G140, G146
gataatgtgcatcagccataactaccagcacacacaacgactacccttctttaaaaggaaacctcacagagcccaaggcttctccatgccgttgccctaagttgtcttctccaatctccactccccacccatcgatcaactcacagctcgatccagccccctccagatcttcagatcggtggatcgattgatcaacatggggagggggaagattgagataaagagaatcgagaacaagacgagccgtcaggtgaccttctgcaagcgcaggaatgggctgctgaagaaggcctacgagctcgccatactctgcgacgctgagatcgcactcatcgtcttctccagccgaggacgcctctatgagttctccaatgtaaacagcacaaggtcaacaatcgagaggtacaagaaagcctctgccagcacttcaggatccgctccagtgatagacgtcaattctcatcaatactttcagcaagaagcagcaaaaatgcgccaccagatacagaccttgcagaatgcaaacaggcacctcatcggtgagtccattggcaatatgaccgcaaaggagctcaagagccttgaaaatcggcttgaaaagggcatcagccgaattcgatcaaagaagcatgagctgctgttctcggagatcgaatacatgcagaaaagggaagcagatcttcagaacgagaacatgttcctgagagccaaggtggcagaggccgagcgagctgaacatgatgatcagcaggcggcggaggacgacgagatggcgccggcgccggcggtcggcggcgggtcatcgtcggggacagagctggaggcgctgccggcgacgttcgacacaagggaatactaccagccggcgccgccggtgagcatgctggccgccgcggcggcggcggcggcggcgcagtactcgtcggaccaccaccagactgctctccacctcggctacttcaaggtcgactccggcaaaggcggcctcctctagatcgatcgccatggatgcaaatattgcatgcattcgatcgaattatactgtattccgtaagagcgacgacgatgaagatgacaataattattgtggtattgtacgtatagtacgctggtagacctacgtatacgtatacgtatgtatgatgaagaataaggtggtgtttggttggaggggctaaagtggggctaaactttagttcctctcacaaaaatataagttcctattatagagacttatatttttgtgagagagactaaatttagtcctagttcccaaacacccctaatatacatttgtggtgtgcatgcatggtgtgtgggtactatatgatcagagtgtgctgcatatgcgtattccgtttgctagctctgacatgcatttgtctaaatatatatttttatttatgc

SEQ ID NO: 4943 - DNA, 1214 bp, Oryza sativa
  Predicted polypeptide sequence is orthologous to G140, G146
gagaaaacccaccaactggagctctcctttcctactccaagaaacgaagttgagagcaagaagacatggggaggggcaggattgagatcaagaggatcgagaacacgacaagccgccaggtgaccttctgcaagcgccgcaacggacttctcaagaaggcgtatgagctctccgtcctctgcgatgccgaggtggctctcatcgtcttctccagccgtggccgcctctacgagtactccaacaacaacaatgtgaaggctacaattgacaggtacaagaaggcgcatgcttgtggctcaacttctggtgcacctctcatagaggtcaatgctcagcaatactaccagcaggagtctgccaaactgcgccaccagattcagatgctgcaaaacaccaacaagcacctggttggcgataatgtgagcaacctgtcactgaaggagctgaagcaacttgaaagccgcctggagaaaggcatttcaaagatcagagccaggaagaatgaactgctggcttcagagatcaattacatggccaaaagggagattgagcttcagaacgacaacatggacctcagaaccaagattgctgaggaggagcagcagctgcagcaggtgacggtggcccggtcggccgccatggagctgcaggctgcggcggcggcgcagcagcagcagcagaatccgttcgcggtggcggcggcgcagctggacatgaagtgcttcttcccgttgaacctgttcgaggcggcggcgcaggtgcaggccgtggcggcgcagcgccagcagatcatccccaccgagctcaacctcggctaccaccaccaccttgccattcccggcgccgccgccgccgacgcgccgcctcctcacttctgaacctcatgaacttcattctgcaccggcctgctgccatggatatgatgatcagctcatcttctatatcttatgctgttatgcagacagacactactgatgtggctatatatatagtatttgtgtgctgctgcattttgttaatcccttataaattgctacttaattatctcatggagaattggagagaccaaatgggcagagctagctagttagctgtgcccaattaagaagctaaatctatcagaagtgtgtactgatgagtgatgagtatttttcttcatttgggatcaaattaaactaagtaaaacatatatatttgacttatgttttacgtgc

SEQ ID NO: 4944 - DNA, 1181 bp, Oryza sativa
  Predicted polypeptide sequence is orthologous to G140, G146
gactccatctcatctcatccttccccaaccattctcttctccttgaacacacccctctcttcctcattataatctcttctttgattagagaggaattagcaaacatgcacatatacaaagagcaggaggctgaaccatccactggcctgatgatgccagagccagcacctgttgcttcccccggctccggtggctcaggtggctcaggctcggtgggagctgagaagattgggagcaggggaaagattgagatcaagcgcatcgagaacacgacgaaccgtcaagtgaccttctgcaagcgccgcagcgggctactcaagaaggcgtatgagctctccgtgctctgcgatgccgaggtcgccctcgtcgtcttctccagccgtggccgcctctacgagtactccaacaacagcgtgaaggaaactattgagaggtacaagaaagccaacagtgacacctccaacgccagtacagttgcagagatcaatgcccagcactaccagcaggaagctgctaagctgaagcaacagatcaccaacctgcagaactccaacaggaccctagtaggtgataatatcaccaccatgaaccacagagaacttaagcagctggaaggcagactggacaaaggcctaggaaagattagagcacggaagaacgaattgctgtgtgctgaaattgagtatatgcagagaagggaaacggagctgcagaatgacaacatgtacttaaagagcaaagttgctgagagtgaaagaggactgcaaacagtgaacatgatgggttcagcatctacgagcgagtacgtgcaaaatatgatccattatgatccaagaaacttcctgcaattcaacatcatgcatcagcctcagtattatcctgaacaggaggaccgaaaggcctttatgtcagatgaaagataaatatggatccgtatcatgcaactatctcaatcatgcatgtgccttcttcaaggagactgatcagttagatattacactgtgtcagtagaacttttatgtgtgaactcttgtatgcatgaataattaactttatcccataattcaggcttggcactatcaaggtgatgtacctaagtattggttcaacctgtgaaattaaaatacttcatacccttcctatgtttatatatgaaatattggtgataatatcttgtgtat

SEQ ID NO: 4945 - DNA, 811 bp, Oryza sativa
  Predicted polypeptide sequence is orthologous to G1419, G43
ctttttttgcgctcaattgctctgagcctctgatgttcttcattagtactcttcaacttgtaattaatacatatttatatcatttcattgacaaatcgcaatgaagctactatgatcatcgatcacctgagcagcaatagaacgaaagaattcaatatttggccgaaagccaaatcgattacctaatattacgaagtttagcgaattaatcaaagaacaccctatctaattcaggattaaggccatatccttcgcacgtgacgtcacggacaccaccacgcggcagccatgcgtgtaccgcgccgggcgcgcgccatggctgcactccaagctcgccacggcgccgtccatggccggagctagcgatcgatcagcttacgaacagctgcgggaaggccatgtgcgggtgcggcgacagcggcgagagcggcggcaggctgcagatccccttcagctcgtcccagatgtctccggctgccgccgccgccgacgacgacgacgaggaggagttctccggcggcgccatgatcagcctctccttcttcacctccctcaagtagtactgctcctccgacctcaccctcttgcctcttccggcggacatggcggcggcggggataggggcgacgggaggggcccacttgacggcggcgtcggcggcgacctcgttggggaagttgaggatggccttggacccgcggagctggaacgcggcgcggtcgtaggcgcgcgcggcctcgacggcggtgtcgtaggtgccgagccacaccctcgcgcccttccctcgcgggtcccggatctccgccgcgta

SEQ ID NO: 4946 - DNA, 1399 bp, Oryza sativa
  Predicted polypeptide sequence is orthologous to G1419, G43
gaggcacagctaactcaacgcaaacaaatcaaacgccacgcacctctcgctctcccactgaagttgtgtgtgccaccgcaccgtgtcgttccctctccttgcaacggcccacgaccagccgccatacgcagcatacatggacttccaccacggagacgccgacgacttcgccctcgagttcatccgcgagcaccttctcggcgtcgacggcgccaccgccacggccaccgagccggcggacctcgaggtcgtcgaaccggcggcggcgtacccgcctatgtcgtggcaagagcagcggcagcaggagcagcatggttgtcacgtagaactaacggacgagcacctggaatccgcacccgctgctgaggcagcggcggcgttccgaacggcgcccgcgcagccggcggccgaggtgatgatcaagttcggtggcgagccctccccggtgaggccgtcgtcgtcgctgaccatatccctgccaccgagctcgttcggcagctgggcgtccgcggcggcgccggccgcggccgccgtggaggacttccgcaagtaccgcggcgtgcgacagcggccgtgggggaagttcgcggcggagatccgcgacccgaagaggcgcgggtcgcgcgtgtggctgggcacgtacgacacccccgtggaggccgcgcgcgcgtacgaccgcgccgccttccgcatgcgcggtgccaaggccatcctcaacttccccaacgaggtcggcacccgcggcgccgaactgtgggctcctcccccgccgccacccgcgcactccgccgccgcctcgacgacgaacaagcggaagcggcagccgtcggaggaccccgacgacggcgtcgaggtgatcggagtggtaagcaaggccgtcaagaccgaggcgccgacgtccaactcgtcgtcactgtcgtcgtccctgacgtcgcgggacacgacgccggccacgtcgtcggcgggggcggagcacgccggcgcggccgccgagagttcgccggcgacgccgtcgagctggagctgggagcagtactgggaagcgctgctcggtggcctcccgccactgtcgcctctgtcgccgcacccggcgttggggttccctcagctcaccgttaactgagaaaattaaacaatgattagctgacgtgggcacagaaataatgcgtttttttcccgttgttaacgacgtcatgtgtacattggaactttttttgggagcttaacagaaggggcgtatagacaaacatcagaaagtggtagtcgtgtttacttttttttttctttcgagttgagaaccttgagatcaatcgatgcttgtaaagaataagcagagggtgctgtttggcatttgatatgacaatgtaaacaaatagtacaagttactttgtttactgag

SEQ ID NO: 4947 - DNA, 1312 bp, Oryza sativa
  Predicted polypeptide sequence is orthologous to G1419, G43
cccatcttagctttctcctcgcagatgcaattgcgcgaacacctccaaactcccgagtcccctctcctctctcgtcttcctctccacgacgacctctccgcttcaattctgcgccgccgcctcagagcgccatggacttcagcggcgacatcgatgacctgatctccctccagctcctccacgatcagctgctcggggtcgaggccgacgcgtgcctcccggtggcagttcatcacgatggcgtcgccgcgttcgccgagcatcagcagggtttccatcccgcggcgttcttgccgcagcagccgatgacgatgacaccggctgggtacgtggacatggcgaatgatcagtatttgggtgcgcatgccgccgctggcgaggcggaggcggtctaccgggcggcggcggcggagccggtgatgatacggttcggcggcgaggtgtccccggtgtcggacccccggaggccgcccctgacgatctcgctgcctccgacgtcgcacgcgtgggcggcggcggaggcggtgcacccggccgctctgctgcaggcgcaggccgcggccgcggccgccgacccgaacgacttccggaagtaccgcggcgtgcggcagcggccgtggggcaagttcgcggcggagatccgcgaccccaagaagcggggctcgcgcgtgtggctcggcacgtacgacacggccatcgaggcggcgcgcgcgtacgaccgcgccgccttccgcatgcgcggcgccaaggccatcctcaacttccccaacgaggtcggctcccgcggcgccgacttcctggcaccgccgccgccgcccccgccgccgacgacgtcgacccacggcaaacggaagcggcacgagacggcggcggccgacccggacgtcgaggtgatcggagaatcatccaaatccgtcaagaccgagacgtacacatcgccggcgtcgtcgtcgctggcctcaacgacaacctcaacggtgacatcatcatccacgtcgccttccccctcgtcggaggcagctgcctgcggcggcggcggcggcagcgagctgttcgtcccaccgatgccgtcgagctggtcgtgggatcagttggaggggttcttcggcatcctctcgccgctctcgccgcacccgcaaatgggattcccggaggtcgccgtaaactaattaagcgcgctaatgatctctctaagcatgattaattaggcgcaataatcggcaattaattagtggcttctagttctcgacggccttcgctttggacacatctcaggagatttggcttggagcagtgtactataaaaaaaaaa

SEQ ID NO: 4948 - DNA, 1145 bp, Oryza sativa
  Predicted polypeptide sequence is orthologous to G1419, G43
ctcgctcgcgcgccacactcctcgaaccaccaccaccaccaccacgtgttcgatcgcgtcctccaagccccagcacctacgcgtcgtcgcgccatggccggcttcggcttggaccagcacctcgacctcatccgcgcccacctcctcgaagacgcccaccaccacgtcctcgcgccatcgccgtcgccctcgccaccgggtactgggcgtgtcaggccggcgcccgtgtcgctgcccccgaggccgccgctcctgtgggcggcggcgtcggcggcgccgcggcagcaggaggagtgcttcgagctcggcggcggctacgcgggggagggggagggggaggaggaggacgacttccggcggtaccgcggggtgcggcagcggccgtggggcaagtacgcggcggagatccgggacccggcgaggaagggcgcgagggtgtggctcggcacctacgacaccgccgtcgaggccgcgcgcgcctacgaccgcgccgcgttccagctccgcgggtccaaggccatcctcaacttccccaacgaggtcgccgccgacgccgccgtcaagtgggcccctcccgtcgcccctatccccgccgccgccatgtccgccggaagaggcaagagggtgaggtcggaggagcagtactacttgagggaggtgaagaaggagaggctgatcatggcgccgccggagaactcctcctcgtcgtcgtcgtcggcggcggcggcagccggagacatctgggacgagctgaaggggatctgcagcctgccgccgctctcgccgctgtcgccgcacccgcacatggccttcccgcagctgttcgtaatcgatttggctttcggccaaatattgaattctttcgttctattgctgctcagaacacgtgattttgcttttgactatgctatttgatgattaaacagagaagaaatattcgtcttacaagatcatatcaccgaaaagactagctaggcgcatggagtagtactggaaacaagctctgctaaggccctctttgtttaggcttaagcttattggactagacttttaagccagctgtggttaatctaggcccattttggaaaaaaaaacattagctgtaatttttctcgaagttatatatttcttgcactaaaaaatta

SEQ ID NO: 4949 - DNA, 1206 bp, Oryza sativa; identical to SEQ ID NO: 2411
  Predicted polypeptide sequence is orthologous to G1421, G1750, G440

SEQ ID NO: 4950 - DNA, 1817 bp, Oryza sativa; identical to SEQ ID NO: 2403
  Predicted polypeptide sequence is orthologous to G1421, G1750, G440

SEQ ID NO: 4951 - DNA, 1089 bp, Oryza sativa
  Predicted polypeptide sequence is orthologous to G1421, G1750, G440
cgagtgaagcactagctccacccatcatcttggatcgtgccatgtcccggtcgcgcacggtgcggatcttctgggacgaccccgacttgacagactcgtccggcgaggacgaggggtgcggcggccggagggtggggagcatggtgcgggagctgccgcctgcccagatgcccgtggcgcaggcagccgctgctgctgctttgccggagcagtgcagcggcggggacggtgatatgggaagaagggtcgttggtggcggatgcactgtgggtgtgggacggaggaggttgacgaaggacggagggcctggcgcgccgagcaccaagttccgcggcgtcaggcggaggccgtggggcaagttcgcggcggagatccgcgacccgtggcgcggcgtgcgcgtctggctcggcaccttcgacaccgccgaggaggccgcgcgcgtgtacgacaacgcggccatccagctccgcggccccagcgccaccaccaacttctccgcctccaccaactccgcgggtgcacaagatccggtggcagttggctacgagtccggcgcggagtcctcgccggcggtgtcgtccccgacgtctgtgctccgcaaggtcccgtccctgtgctccctggccgaggacaaggacgactatgaggccggcccctgcgagcccgcaactgccgccggttccaacctcaccgttctcgaggaggaggagctcggcgagttcgtgccgttcgaggacgcgccggtctacggcggcagcagcttctgggacttcgagcccgagtccggcttcctgtacgccgagccgtcgtcgcctgagacgccgtgggacgccggcgccacgtcctccggcgaggcccaagactacttccaggacttgcgcgacctgttcccgctcaacccgcttcccgcaattttctaaaaacgggatcggcttcttcaatcacggaactgcttttttgggtgttgttgagtattcgtgcctactgtgtgtacttcctgtacgtgctcttctggtgtctgcttgtgttgagtgagtcgatgagaaatgtattgtcctgagagtagagtttttttccgaaaaaaaaaaa

SEQ ID NO: 4952 - DNA, 2363 bp, Oryza sativa
  Predicted polypeptide sequence is orthologous to G1435
ggccgacgcgccattgccctcgtcctcttcctcttcctcttcctcgtcgtcgtcgtcgccgagccgtcgcatggtggacgccgctgcggcctccggggacgcgtgcggccgcgtgacggagtgggagaccggcctgccggctccaggcgagatgacgccggtctcgcaccagctcgtcccgccggcgctcgccgccgccttcgggatcgacctcgcggccgtgggcgtgctcctcccctctccctccgtcgactcccctgtctcccacctcttcttccccgtcgacgaggacgacgacgaggatgaggagggggagggcgaggggggtaacgatgacgcccccgccgccgccgccgcgggcggcggcggcgggaggtgcgggaagaaggcgaggatggtgtggacgcccgagctgcaccaccggttcgtcgaggcggtggcgcacctcggcgagaagggcgccgtgcccaaggccatcgtgcgcctcatgaacgtcgacggcctcacccgcgagaacgtcgccagccacctccagaagtaccgcctctacctcaagcgcacgcgcgtcgccgccacgccgcctccttctccaccaccacctcctcctcctcctccgcccctgccgccggcgatgtacgtcccctgcttcgccgcgaaaccacctctcgacgcagctaaccgcagcgattcccctccttccagaacctcggacgcaacgactaagcagtaagctttatattttgcaaatttttttccccaaaagatagccaaaatcagatagtacgttttttttcctttttttttctcatattttcgaggatccaagtagatatattgagtatttaatttcgtcaggaatcaagtgaaaccaatcaaagaggtacaatatattgaactcctgtcgtctgcaaaatcgaaatttggcttaccgtccgatggcaagttgagggatagtacatttcaagtacagttatgcacatatcgggaacaagatatagaccacactaaaatgccgctccttgcaaaaatttatcaaaccattgcatatattagttttctcttggtgatagagttcattcttttcggtaccagtgttgtcctcctggcgaaaatgtttttagccacagacatccttgggccgtttagctagaattactctcttttttttttctctgcgcttgatccgtatagaatgtttgttgtttatacttttgtaaatataatacttactactagttacgagtactatattatattaaaaaaaacttaacgtttacatgtcttccttctttcttctgtaacttaaaagccaacttttatgtttggcatacatatccattgttgtcgcaaccaaaattcattagttagatagcaaaatatagtagtttctgttttcagtaacgcgatgatagactattgaaagcaactttatgctcacaccaccttccctttaagagcaatttaggtatttaagttctttgaaggaactgctgtaatgatacccagttgatgattgaatggtggtggggttatctgtaatgtgcttccttgaatcagaagacttgggtatatggttaggagtacttccctcccttgccaccaccttgatgttgaaatggactgcccatttcaatgattatttgatgctttctggggcaatcaatcattgttagaggaattatttgttcctagcatgatttatactttaatataattaatattagtaaaggtcagcactatgttaattccatggtttgggggttctggcttctagcagtattccccacattcatggagctagcaaaggcatatgtctaaccttttactatgtgtgttcactcttaatagttgatacagtttctgaattgtttcctcgttttattctaactggttagctagctcaaggctagagaaggaaatgcaccaagagtgaattatattcagaagttgtgtctcttaagaattaggggacagaacatacaatatttttggatcatttcaagtgcatgctttccatgcatgctcccatcaaaagggataacgagacttgtccacgaggctacgacgcaaaactcggctaaaataaatatggaaatgctgctcatatccaagaacggcctcaggaaagatgcaaagtttttttctgtgtgagctgctaatgctcgaggtattgtctgaaggctacaggcacaataaggtttaccaaaggaattgtaattaggtttcctctgatctagattcagtttcaaattcatgcagcgtgctgtatcaaatgctgcctagatgtaacatcatttttcctcatcatgtatgtgtaagatgctactctttctaacctggtgacatcggcaaagctgctcccc

SEQ ID NO: 4953 - DNA, 579 bp, Oryza sativa
  Predicted polypeptide sequence is orthologous to G1435
atgacgccggtctcgcaccagctcgtcccgccggcgctcgccgccgccttcgggatcgacctcgcggccgtgggcgtgctcctcccctctccctccgtcgactcccctgtctcccacctcttcttccccgtcgacgaggacgacgacgaggatgaggagggggagggcgaggggggtaacgatgacgcccccgccgccgccgccgcgggcggcggcggcgggaggtgcgggaagaaggcgaggatggtgtggacgcccgagctgcaccaccggttcgtcgaggcggtggcgcacctcggcgagaagggcgccgtgcccaaggccatcgtgcgcctcatgaacgtcgacggcctcacccgcgagaacgtcgccagccacctccagaagtaccgcctctacctcaagcgcacgcgcgtcgccgccacgccgcctccttctccaccaccacctcctcctcctcctccgcccctgccgccggcgatgtacgtcccctgcttcgccgcgaaaccacctctcgacgcagctaaccgcagcgattcccctccttccagaacctcggacgcaacgactaagcagtaa

SEQ ID NO: 4954 - DNA, 1243 bp, Oryza sativa; identical to SEQ ID NO: 2359
  Predicted polypeptide sequence is orthologous to G1435

SEQ ID NO: 4955 - DNA, 3731 bp, Oryza sativa
  Predicted polypeptide sequence is orthologous to G1451
gaggaagctgcaagaggaactgaggaaggaagcaagaaagcaaaccaaaccaaaccaaaccaagaagcaaatctcagttgcaactcttgagctcagaagaagttgcaacagaagaaggagggagaagggaagcatctcagctagctaggcaggaagcatgctcctagcctccctctccggctgcggcggcggcggcggcggtcggatctgccggagagcggcggccggggagcccagagctgagagctaaccgtgcagacctcgcggccgcgagatctgaccacgcgactcctcggatcaagcggtgtcgcctcccgcagcagcatttccccccccccccccccccccgaagatcacagcctttttttccactggttcttgctggtcttggaagtggggaaaaaaaattctcatcacctcgtcgatggagaagcttacgacgcttgctcggtagatttgatttttctttttcttcttcttccgggggaagcgtaattgcgaaacagcgaaagaagaagtgttggtgagttggcgaaactgagaaagcgatggtttttgggaaggcgctgtgatttggcctaaaaaggaggaatctttccttcgttctctccttccttccccagcttcgtgcacgctcttatattgcatttcagatcggtcttgtgattggtcttttggagagagagagagagagagaagaaaaatgaggctttcgtcgtcgtccggcagcgtcctcccggctcaggcggcgtcgccggaagctgtagaagaacaaaatgcctgaattcggagctctggcatgcgtgtgccggtccccttgtttcgttgcctgcagtgggtagccgagtggtttatttcccacagggtcacagcgaacaggtagctgcatcaacaaataaagaaatggagtctcagatccccaattatcctaacttgcctccacaacttatttgccaacttcacaatgtgacgatgcatgcagatgcagaaacagatgaggtttacgctcagatgacgctacaaccacttagcccgcaagagctcaaggacccatatctaccagctgaattaggttctgccaacaaacagccaacgaattatttttgcaaaacattaacggcaagtgacacaagtacgcatggcggattctctgttccccgtcgagcagctgagaaagtgttccctccgctggattttactcagcagcctccagcacaggagttaattgcaaaagatcttcatggcaatgagtggaagtttcgtcatatctttcgtggtcagccaaagcgacaccttctaactacaggctggagcgtctttgtaagtgcaaagagacttgtcgccggggattctgtcctatttatctggaatgacaacaaccagcttcttctgggaattcgtcgagctaaccgcccacaaactgttatgccatcttcagtcctatctagtgatagcatgcatattggtcttcttgctgcggctgctcatgctgcttcaacaaatagccggtttacaattttttataacccaagagcaagcccttcagagtttgttatcccactttctaaatatgttaaggctgtatatcatacccgtatatctgtgggcatgcgtttcaggatgctttttgagacagaagagtcaagtgtacggagatacatgggcacgataacaggaattagtgatcttgatgctgctcgttggccaaactcacattggcgttctgtaaaggttggctgggatgaatcaactgccggagagaggcagccaagggtgtcgctttgggagattgagcccttgacaactttcccaatgtacccatctccttttccactcagactgaagcgtccatggccaacaggcttgccttcattacatggtggtaaggatgacgacttgacttcttctctcatgtggctccgagacagcgcaaatcctggtttccaatcattgaatttcgggggtctcggtatgaatccttggatgcagccaaggtttgatgcttccttacttggtctgcaacctgacatgtatcaaacgatagctgcgactgctttccaggacccaacaaagcaggtctctcccacgatattgcagttccagcagccgcagaacataggtggcagagctaatacacttctgccaagtcagattttgcagcaagtgcagcctcagtttcagcagcagcaatacctccaaaacatcaacgagaccacaatccaagggcatgctcagtctgagttccttcagcagcagctccaacgctgccagtcgtttactgagcagaagccacagctgcaaacccagcaacaacagcaagaatcacagcaacaacagcagcagcaatcgcagtgtatgcaagtcccacaacatcagcaaatgcaacagcagaagaacatgaccaactatcagtctgtacctaatgcattgtcaccgttttctcaactctcctctccttctcagtcttcacctatgacactgcaaacagtattaccattctcccagccacagagctatccagacacgagtatgagctcattatcaccatccaacacatccaccatgcataatgcattgaggccattttcatcggaagcaccttcgcacctaagcatgccaagaccgactgcagtacctgtccctgacccatggtcatcgaagcgagttgcagtggagtctttgcttccctctcgtcctcaggttacatcgcagatggagcagttggactcaacagcacctagtataccacaaagctctgcgttggcgccgcttcctggaagaggatgcttggtggatcaagatgggaactctgatcctcaaaaccatctgttatttggcgttaacatagattcacagtcacttctaatgcaaggtggcatcccaagcctccagggtgagaatgattcgacggcaattccttattccacctccaatttcctgagcccgtcgcagaatgatttccccttggatcaaacactaagtagtgcagactgcttagatgaatcaggatatgtgccgtgttcacagaattctgatcaagtgattaatcgaccacctgcgacctttgtgaaggtttacaaatcgggaacctatggaaggtcacttgatatcactagatttagtagctatcatgaacttcgtagagaactagggcgcctatttggccttgagggccagttggaaaaccctttgagatcaggctggcagcttgtattcgtcgaccgagaggatgatgtcctcctcgttggcgacgacccttggcaggaattcgtgaatagcgtctcctgcataaagatactttcaccacaggaggtgcagcagatgggcaagccctttgagcttttgagctcggctcccggaaagaggctaggtagcagctgtgatgactatgtgagcaggcaggaatcaagaagcctgagcacaggaattgcatctgtcggctcagttgaattctgaagcaagggcgctaacgagcccttcaatcaaatctagcctgttacctatgtttctgcagtttttcttcccctagttttgagacctggaactgaaagaacatagatccatgcttagctaagttatgtaccatctaataattatgctatatgatatcaaattccaagtagaaactatcaacttttggtatatatatatataccaaaactttgttccatgaaacactaatcctgtgaatgtaggccatctaaattatcaggctcaccgcgaagtttagc

SEQ ID NO: 4956 - DNA, 3262 bp, Oryza sativa
  Predicted polypeptide sequence is orthologous to G1451
gtcgctactgtacggccccctgcgctgcgccccccctcgtcgcgcacacgcacacacgcactcgcactactcgaaccacgcgaacccctctctttctctctctctctctctctcgcttaaatgccacaaacctaatcatttccacccctcttgcgctctctctctctctctccaaccccaccctttctccccaccatggtggcgatctccgagctcgggtgagcggaagggaaagaatgcggccgatttgaggagggggatggggttttcgggtggatttgtgaggggatagattaagagtttgtgcttctctggtttggtcggaggaggaggagatgagctcgtcgtcggcggccagcatcgggccgccgcagccgccgccgccccccgcgccgcccgaggaagagaagaagtgcctcaactcggagctatggcacgcctgcgccggcccgctcgtctgcctccccaccgtcggcacgcgcgtcgtctacttcccgcaaggccacagcgagcaggtggcggcgtcgacgaacaaggaggtggagggtcacatcccgaactaccccaacctgccggcgcagctgatctgccagctccacgatgtcacaatgcatgcggatgtggagactgacgaggtgtacgcgcagatgacgctccagccactgaacccacaggagcagaacgatgcgtaccttcccgcggagatggggataatgagcaagcagccgacgaattacttctgcaagacattgacggcgagcgacaccagcacgcacggggggttctccgtgccccgccgtgctgctgagcgcgtcttccctcctttggatttcacacagcagcctccagcccaggagctaattgcacgggatattcatgacatcgagtggaagttcaggcacatctttcgaggccaacccaaacgacacctgctaaccactggctggagcgtttttgtcagtgctaagagacttgttgctggagattctgtgcttttcatatggaacgagaaaaaccagcttttacttggaataagacgtgccagtcggccacagactgtgatgccttcctctgttctttcaagcgatagcatgcacataggtctccttgcagcagcagctcatgctgctgctacaaacagccgtttcactattttctacaacccccgggcaagtccatcagaatttgtcataccactgtcaaaatacatcaaggctgtttttcacacccggatatcggttgggatgcggttcaggatgttgtttgagactgaggaatcaagcgttcgcaggtatatggggactataactgaagttagtgatgcagacccagtccgttggcctagttcctattggagatctgtgaaggttggttgggatgaatcaactgcaggggaaagaccaccaagagtttctttatgggaaattgaaccattgacaacctttccaatgtatccatctctgttcccactgagagttaagcatccttggtattcaggagttgcttccctgcatgatgacagcaatgctttaatgtggctgagaggagttgctggtgagggaggttttcagtctctgaactttcagtcacctggtattggctcctggggacaacagaggctccatccatccttactgagcagcgatcacgatcagtaccaagcagtagttgctgctgctgctgcttcccaatctggtggttacttaaaacagcaactcttgcaccttcagcaacctatgcagtcccctcaagaacactgcaacctcaacccattattgcagcaacaaattctgcagcaagcaagccagcaacagataattaatcctgatgcccaaaatatccaaacgatgttgagcccaagtgctatacaacagcaactccagcaactacagcaaatgcagcaagttcagaatgatcagaagcagaagattcaaccagatcaaagctaccaagttcctacaagtgcagttctcccaagtccaacatcattaccgagtcatttgcgagaaaaatttggcttctctgatcctaatgcgaattcttcaagcttcatcacctctagcagtagtgataacatgttggattcgagcttccttcagggaagttcgaaagctgtggacttatctcgatttaatcagcctgtagctagtgagcagcagcagcagcagcaacaggcatggaagcagaagtttatgggttcacagtcagtgtcttttgggggctcggttttgcataactcacccacaagcaaagatggttctgttgaaaacaaaattggtcgtgatgtgcaaaaccagtccctttttagtccacaagttgactcttcatccctcctgtacaacatggttcctaatctgacttcgaatgtttcggatggcaacttatcaacgatcccttctggatcaacttatctgcagaatgcaatgtatggttgcttggacgactcttctggtttattgcaaaatacaggagagaacgatccagcaaccagaacatttgtgaaggtttacaagtcaggttcggttgggaggtcgttggacataacccggttctctaattatgctgaacttcgagaagaactgggtcagatgttcggcattaagggtcaattggacgaccctgatagatcaggctggcagcttgtattcgtcgacagggagaatgatgtgcttctccttggagacgacccttgggagtcctttgtgaatagtgtatggtacatcaagatactttcacctgaggatgtgcataagatgggaaagcaaggaaatgatccacggtatctgtcctgaagtgagagaacatggtgccatttctgggcttccaggaggattctgcagtgcatggtggcactcttgctctcgacaatgcacgtcgtcagaagtcccaaatttgtatcttgcatgtacgccgtacatgtttccagaactctctgttacctattcggtgcaggccaccggaaccacgaaacctgatattttgtaggttccacttaggaatcagtatcggtttaactcttatcctagatgatttgtaactcgcacggcagtccactgttttcatgtttcatcgagtcttcctagacattaaacttagttgatattgtatcaggatttatgtgtattgagattcctctacatgctttcaaccaaaaaaaactgcaataatcgaagcgcacgaggattgtttcaattcgtgttgtaggatctggattttcaccgattgtccggttatgtcagtttcgagaggagctgtcaatctg

SEQ ID NO: 4957 - DNA, 3885 bp, Oryza sativa
  Predicted polypeptide sequence is orthologous to G1451
gagctcacctccactcgtggggttaaaaccccgagaactgcacagcagcagcagcacacggcgcagcagcggcaaaggcggcagcagcagcagcagcaagaaccgagcaaagtcgcaagaagcgagcacacacactcctctctctctctccctctctagctactgttgttcttggagttgtagaggaggaggaggtggtggtggaggtggtggagatagggggaggatgctgatgctcctagtcctatcctagttcgtcgtcaactccggcggcggatctgcggtggagcggcggctggattgtcgagcggtgagggtgacacgcatctccggagctcgccgcaggcgggagggatctgaggcgcgtttcttaatttgccttctctttgagctagctgcaaaggcggcggcgtgcggcggcggcggcgtcttggcgcgcgcattctatccggcgagtcgacgacgacgacgaccttcgcgccggtgtagcggcgcccgtgatgtgaaggaattcgagctcgctcccttgggatcgaaaaggttgcgggttggagaggcaagaaggtttggccggtttggggaaggagagaaagcgatggtggtggtggtggtggtggtggctgggttgcttgctccatgacacgacagcgcgtttgggaacgcctcgtgatctcggtgcagaaaggattccttctctgctccatttcttgcactctccactttgcattctagatcggttgggggaagaagaagaagagaagaagaagaatgaagctctcgccgtcggccggcggcgtctccgaccagccgccgtcgccgccggaagttgcagaggagcagaagtgcctaaattctgagttgtggcatgcatgcgccggccctctcgtttcgctgcctgcggtcggtagtcgggtggtttattttcctcaaggccacagtgagcaggtagctgcatcaacaaataaggaaatggagtctcagatccccaactatcctaacctgccgccgcagcttatatgccagctacataatgtgaccatgcacgccgatgcagagacggatgaagtctatgcgcaaatgacgctgcagccactcagcccgcaagagctcaaggatccattcctacccgccgagctaggcactgccagcaagcagccaacaaattatttctgcaaaacgttaactgctagtgacacaagtacacatggtggattctctgttccccgtcgagcagcagagaaagtatttcctccgctggatttcactcagcagcctccagctcaagagttgatggcgaaagacctccatggaaatgaatggaaattccgtcatatctttcgtggccaaccgaagcggcatcttctgactacgggttggagcgtctttgtaagtgcaaagagactggttgctggagactctgtcctttttatctggaatgacagtaatcagctgcttctgggaattcgtcgggcaaataggccacaaacggtcatgccatcatcagtattgtctagtgacagcatgcatattggtctgcttgctgcagctgctcacgccgcatcaacaaatagccggtttactattttctataatccaagagcaagcccttcggagtttgttataccactggctaaatatgtaaaggctgtctaccatacccgcatatcggtgggcatgcgtttccggatgctttttgaaacagaagaatccagtgttaggagatacatggggacaataacaggaataagtgatcttgatcctgttcgttggatgaactcacactggcgctctgtcaaggttggatgggatgagtcgactgctggagagagacagccaagggtgtctctttgggagatcgagcctctgacaactttcccgatgtatccatctccttttcctctcagactaaagcgtccatggccaacaggcttaccttctttatatggcggaaaggaggatgacttggcttcttctcttatgtggcttcgagatagtcaaaacacaggtttccaatctctgaattttggaggacttggtatgagtccgtggatgcagccaaggctggatagttccctacttggtctgcaacctgacatgtaccaaacgatagcggcggcggcggctttacagaacaccactaagcaagtatcacctgccatgctgcagttccagcagccgcaaaacattgtcggtagatcttctcttctatccagtcagattctgcagcaagcacagcctcaatttcagcagatgtaccaccaaaacatcaatggcaactcaatccaaggccatagtcagcctgagtacctccagcaaccgcttcaacattgccaatcatttaacgaacagaagcctcagttgcagccgcagcaacagcagcaagaatcacaccagcagcaacctcagcatcaacaaatgcaacaacagaaacacttgtccaactttcagactgtaccaaatgcattgtcggttttttcacagctttcctccacccctcagtctacaccctccacattgcagacagtttcaccattctcacagcaacataatttccctgacacaaatatcagttgtctctctccatccaatgtctcatccatgcacgatacactgagatcattcccttcagaagctgcttcagacctcccaggtgtgccaagaatcacccctgtacctgtctctgacccatggtcatctaagcgagttgcagtggaatctacgatcacttctcgcccacatgacatttcatcacagatagagaacttcgacttgacaccttctagtattcctcaaaactccacgttagcaccactgcctggaagggaatgcctggtggatcaagatgggagctctgatcctcaaaatcacttcttgtttggtgtaaatatagactcacagtcacttttgatgcaagatggcattccaagccttcacaatgaaaacagttcaagcacaattccatattccacatccaacttccttagcccttctcaagatgattatccattgagtcaaacactaactactccgggctgcttagatgaatcaggatatgttccatgttcagataatgctgatcaagtgaagcgaccgcatgcaacctttgtgaaggtttacaaatctggaaccgttggaaggttgctcgacatcactagatttagcagttatcatgaacttcgtagtgaggtagggcgcctttttggccttgagggccagttggaagaccctttgagatcaggctggcagcttgtatttgttgaccgagaggacgacgttcttctagttggcgatgatccgtggcaggaatttgtgaacagtgtgtcttgcataaagatactttcgccgcaggaggttcagcagatgggcaagccgggcattgaactcttctcgacttctgcaaggagacttggcaacagctgtgacaactacatgagcaggcaggaatcaagaagcctaagcactggaatcgcgtcggtgggctcagttgagttctgagaaatagggagctcatagcacccggcgttaggcgtccagttctgtacgtctctgtagctcttagttctgtgacctggaacccaagcacataggtcaagtgtagctctaagttatgcgctgtctggtaattatgtcatattacattgacttttagtggtacctattacattttggtatacatgccgacactttgtttcctggaatactgatcatgttaacttagggcatctaattattaggttcatgttgagtagtgctgtagtgccgcaggcgctagctttggccatattctgtatattgatgatgttttcctcctgcaatgtactgttaatgacagcaagtaaggttttccatgcaactgtgaaaattcagttcaagaactattgagct

SEQ ID NO: 4958 - DNA, 3878 bp, Oryza sativa
  Predicted polypeptide sequence is orthologous to G1451
ggaagaaaaaaaaaactcgaccaccacctccaccactcacacctcgatccggccatggcggcctagccctagcacctagggttcgcgcccccaccaccctccccgccgtctcggaggccgcgcgcccccagctcccgcctcgctgtcgcgccgcctgattccgccgccggcgccgaatgctacgccgtttggtggtggtggtggtcgtcgtcgcctgattccgcgatctcgtgagctccggggggtgcgcggttgcggcggcggcgcctgagaggaaggctggactcgtccgcggcggcggcggctgcgggctagtgtcggtggcgatttgagggcggcggtttgggttagccgtcgccgagagtgaaggtgctgtgttttgagtgcttgggatgagctgcgtgttgatctgatgaactcggggtcggcggcgttcttcggtttctccgctcacttgctcccgccgttggcgaaaatccggttcttcggatcgagttgcggtcgcctgggtgtttttcatcagttttgggtgaaaatactcgagctctgaggggggtgattggtttccaagtttgattgatttaaagagtttgtgtggaattttttcggggagatgaaggggaggatttgctgcgacggtccaggttttggttagttgttgagggagaaaaaaatggaagatatttctgggcgcaagagaggaaggcaggtgtttgctgctgctgctgggagcatgatgggaagctgaccagcagcttctccagtatcctggtgcggcggagtttcgtgctctttggcgacgggtgcactggtgattggagatgaagctctctccgccggcgtcggcggatatgccgcaggccttgccggagaacgacggggaacaaagatgtctgaactcggagctgtggcatgcatgcgctgggccccttgtgtctttgccagtggtcaggagcagggtcgtctactttccacagggccatagcgagcaggttgcggcatcaactaataaggaagttgatgctcaaatcccaaattatccaaacttacctcctcagttaatctgccagcttcataatgtcaccatgcatgctgatgcagagacagatgaagtctatgctcagatgacattgcaaccattgagcccggaagagcaaaaggagcctttccttccaatggagttgggtgctgctagcaagcaacccactaattacttctgcaagacattgactgcaagtgacacgagcactcatggtggtttctctgttccccgccgggcagctgagaaagtcttccctccactagatttttcacagcagccttcggcacaggagctgattgcaagagatttgcatgataatgaatggaaatttcgccatatatttcgtggtcagcctaaaaggcatctcctgacaacaggctggagtgtgtttgtgagtgcgaaaagactagtagcaggagactctgttatatttatctggaatgataacaatcaacttcttttgggaatacgtcgtgcaaatcgccaacagactgttatgccctcttccgtgttgtcaagcgatagcatgcatataggtcttcttgcagcagcagctcatgctgcagccacaaatagtcgcttcactattttctataaccccagggctagcccttctgaatttgtgattccattggccaagtatgtgaaagctgtttaccacacacgtgtatctgttggaatgcgttttagaatgcttttcgagacagaggagtcaagtgtcaggcgatacatgggtacaatcaccagcataagtgatctagattcagtgcgctggccaaactcacactggcgttctgttaaggttggttgggatgagtccaccactggtgataaacagccaagggtttctctttgggagattgagcctttgacaacctttccgatgtaccccagtgcttttcctttaagacttaagcgtccgtgggcttcaggactgcctatgcatggcatgttcaatggtgggggaaatgacgattttgcacgctattcttctctcatgtggcttcgagacggaaatagaggaacccagtccctgaattttcaaggacatggagtctcaccatggcttcagccaagaatagattctccattgctgggccttaagccagacacgtaccagcaaatggctgcagcagcactggaagaaattcgatatggggacccttcaaagcagcatccagctactctgcaataccaacagactcataatctgaacagtggattaaattctctgtttgcaagccatgttctagggcaggtgcagtttcaacctcagcagtcacccctgcaagttgttcagcaaggccattgtcagaacactggtgactctgggttccttcaaggtcagcttccacggctgcagttgcataacactcagcagctgctaaaggagcaagagttgcagcagcagcaaagacagcatgttttacaagagcaatctagtcaagagatgcaacagcagctcccatctagtgatcatcatgttgctgatgtagcttctgagtctggatctgctcctcaggcacaatcatcattgcttagtggatcatcattctacaatcagaacctcttagaaggaaatagtgatccccctttacatctacacaacaatttccacaacttctctaaccaggaagcctcaaaccttcttattttgcctcgaagtagccaattaatggcatcagatgggtggccttcaaagcgattaactttagaatctgctgttcatcctgaagctccgtccatgcaccccaagattgagaaagtaaatcaccagggtatatctcattttcctggcgcctttccaccacaatcagcaagaggctgttccatcgtccaggattgcagggcagatgctgagaaccgcctactttcatcatcatttgaactccaggatggcatgacaagcatcataactgatgctaacagagaaactgatactatggccatacctttgttgagatatagtggtgcagatttgacaactgaaaacaccttagcaacctccaattgtttaggtgaatctggaacgttcaatcctcttaataacatatctgtaaatccatcacaaggagcaacctttgtgaaggtttacaaattagggtcccttgggagatcacttgacatctccagattcagcagctactgcgagttacgtagtgagcttgagcgtctctttggtcttgaaggccaactggaggaccctgtaagatcaggctggcagcttgtatttgtcgaccgggaaaatgacattcttctcgtcggcgacgatccatggcaggagtttgcaaatagcgtatggtgcatcaaaatactctcgccacaggaggtgcagcagttggttcgtggtggagacggccttctgtcctcacctggagcaaggatgcagcagagcaatgcctgcgacgactattctgcaagccacaacatgcagaatatcgccggaaacattgcatctgtagcgcctctggactactgagatgtagaccagaatccaaactaagcacccttaagactgcagggtcaccattcgtgatcgcctgcattccatgcgatcttcactagtcctgtccgaatcagtagcaactcagtcaataatatagctagatgatccgttgtattccatctgatcatggacatgctgtatgatagctgctttagctctattaaatctctaatggcaggcaactaggcaagaacagttctatgatgaatgatggcagtcgctgtagaattgaccttattctgtagctataatatgatgtctagaactgatgattccaatttccaaatggagcccggaacatattaaaatcaatcatttgtcgccttcttc

SEQ ID NO: 4959 - DNA, 690 bp, Oryza sativa
  misc_feature (28)..(28): n is a, c, g, or t
  misc_feature (77)..(77): n is a, c, g, or t
  Predicted polypeptide sequence is orthologous to G148
aagaaaggccttacgagctgcccgtttnttctgcgacgccgaggtcgcgctcatcatcttctccagccgcggcaagntctacgagttcggcagcgccgggtataattaatacagacacaacaacacacacaaccaacaaaccagcatcaatttgaacctgcagatctgctgttttctctgatcaattgcttctttttttttgttcttttttgtttcttttatctgctgcaacggcgtcctgctcctctggggtttctcgttttctttttcatttatttttagcaggtgccaagtagccgagctactatacttacctggccatgttaattattttattccgtctgtctgtgtgtgtctgtgcatactactatagggacatggcgcggtgttcttataaaccgggaggccggatccctaactagcatgggaggatatcttttcagcggatctatacaaaccctactcctgctgacctctttcttccagtttctccgggtcttccttggattattattgcccatcttccgggttgtgcgtgtgtcagagacagctcgaacgataaatttctcaaaaccagtactagagagggtgtgttgtgtgtgagaactgagtggagagttagcatgaaggctgcaaactagaaaggaaggtatgttctttcctttttgatccaaaaaaaaaaaaaaaaaa

SEQ ID NO: 4960 - DNA, 1134 bp, Oryza sativa
  Predicted polypeptide sequence is orthologous to G148
gatattctcgtcatcattggaggctttagcaagcaagaagagaggcagtggtggtggtggtggaggaggagctagctagcctgtgcttgctgatcggtgctgagctgaggaatcgttcgatcgatcgggcgagatggggaggggaagagttgagctgaagcgcatcgagaacaagatcaacaggcaggtcaccttctccaagcgccgcaacggcctcctcaagaaggcctacgagctgtccgttctctgcgacgccgaggtcgcgctcatcatcttctccagccgcggcaagctctacgagttcggcagcgccggcataacaaagactttagaaaggtaccaacattgttgctacaatgctcaagattccaacaatgcactttctgaaacccagagttggtaccatgaaatgtcaaagttgaaagcaaaatttgaagctttgcagcgcactcaaaggcacttgcttggggaggatcttggaccactcagcgtcaaagaattgcagcagctggagaaacagcttgaatgtgcactatcacaggcgagacagagaaagacgcaactgatgatggaacaagtggaggaacttcgcagaaaggagcgtcagctgggtgaaattaataggcaactcaagcacaagctcgaggttgaaggttccaccagcaactacagagccatgcagcaagcctcctgggctcagggcgccgtggtggagaatggcgccgcatacgtgcagccgccgccacactccgcggccatggactctgaacccaccttgcaaattgggtatcctcatcaatttgtgcctgctgaagcaaacactattcagaggagcactgcccctgcaggtgcagagaacaacttcatgctgggatgggttctttgagctaagcagccatcgatcagctgtcagaagttggagctaataataaaagggatgtggagtgggctacatgtatctcggatctctctgcgagccacctaatggtcttgcgtggccctttaatctgtatgtttttgtgtgtaagctactgctagctgtttgcaccttctgcgtccgtggttgtgtttccgtgctacctttttatgttttgatttggatcttgtttgaaaataatcttaccagctttgggt

SEQ ID NO: 4961 - DNA, 1134 bp, Oryza sativa
  misc_feature (54)..(54): n is a, c, g, or t
  misc_feature (121)..(121): n is a, c, g, or t
  Predicted polypeptide sequence is orthologous to G148
tagatcatatctcatcccatcatcggtcatattctcctcagcttcatgttgctnagctataggcgaatggttgacaagagtactagttagcttaataatatagctttgcaaaagttgaggnaatggatcgatcagagatggggaggggaagggttgagctgaagcgcatcgagaacaagatcaaccggcaggtcaccttctccaagcgccgcaacggcctcctcaagaaggcgtacgagctctccgtgctctgcgacgcggaggtggcgctcatcatcttctccagccgtggcaagctgtacgaattcggtagcgccggaataaacaagacattggaaaagtacaatagttgctgttacaacgctcaaggttcaaatagtgctcttgctggtggtgaacatcagagctggtaccaagagatgtcaaggctcaagactaagcttgaatgtctccaacgctctcagaggcacatgcttggtgaagatcttggaccattgagcataaaggaactgcagcagctggagaagcaacttgagtactcactgtcacaggctcgacaacgaaagacacaaatcatgatggagcaggtcgacgatcttcgccggaaggaacgccagcttggagagctcaataagcaactgaaaaacaagctagaagctgaagccgatagcagcaactgcagatcagccatccaggattcctgggtccatggcaccgtcgtcagtggcggcagagtgctgaatgctcaaccaccaccagatattgactgtgagcctactctgcaaattgggtactatcaatttgtccgtcctgaggcggccaatccaagaagcaatggaggaggaggggatcagaacaacaactttgtgatgggatggcccctctgaagtccaagcttgctaataaaaacgctggcgtgctataatatatagttcggcaaatgttgaaacacatgtgttctcagtatgtatatttctcccctatccggtggtactcttagcacgtacctatgagtgtatgtttgtacgttatctatactctatgctaggcaaccctatactattatggtaagacgtctatcttttcaatctatctatacgtaccatactaattggcaaattttgtaaaaaaaaa

SEQ ID NO: 4962 - DNA, 724 bp, Oryza sativa
  misc_feature (620)..(620): n is a, c, g, or t
  Predicted polypeptide sequence is orthologous to G1480
gatgaataataccatatagttgtgatttattcgttggggggagctaatacaatatagatgatcttgctgatcaaaaaaataattaccactaagtagtaagcacgtaattagtagcagtagtagtgtacaaaactagcgtgagctagctcaaaatgagtactacatgggattactacgcccctacacatcgatcgatcgatttgatacaagattacaagcgacggcgcggcggcggtggccggcggcgggcggcgatcagaaggacgggacgacgccgtagccgaagtcgagcatgtaggaggatgggacggcggcggggtcgtcggcgtcggcgtcggcgtcgtcggcgtcgtggtcggcgcgcttggcgaagcggcccttgatccgggggcgcgtctcggcgtaggccttgcgcgacgcgtaccggatcgtcttctcgaaccgccggttcttccgcttctccctgtacctcatcagcctcgcctccctcccttcccccatcgccgccgcccgctccggcaccacgcccacgtcgaccaccgacgacgacatctgcgcgcttactacgctgtggctcggaggaggagtcgccgtgtacggcatgtagggttgaggcttcngcctcgtgaagtcgagcttcatgtccttcgcctccacgttgaggttgagcgcgccgtgctgctgccgctgctggtgggggtggtgctcggccgcggccttatcc

SEQ ID NO: 4963 - DNA, 1025 bp, Oryza sativa
  Predicted polypeptide sequence is orthologous to G1480
acaaacacacacaatttagcttagcttaagccacttgatctcaagctcaagcttaaaattagcttaagattaagccattaattagccaagctaactaagcaagcaagatcttgttgaggagatgatggcaagcgacggcagcgcgagcccggccagctgcggcggcgcggcgtgcggggtgtgcggcggcgcggcgacggtgtactgcgcggcggacgcggcggcgctctgcgtgccgtgcgacgccgcggtgcacgcggccaacccgctggcgtcgcgccacgaccgcgtgccgctcgcggtcgccatggcggcggcgagctccggggtgtacgaccacctgttcgcgcccgacgacgacgccgcctcgtcatgggctgccgccgcggcggcgggggcggcggtgcaggggcaggggcaggggagccccaacgacagctcgtcgagcttcaccaacgacagcgccgccgcctcctcgtcatcggacgacgacagcacggccgccgccggagtcagcggcgccggcggcgccggcgccgccgccacgaaggaggccaagttctggctctccttctccgacgacggccgcgccgacggcgtagggttctacatggacagcaccaccgctgccaccgcggcctacggcgtcgtgccaaccttctagaaagttccagaaacccctctcccaatgggcgccaacgcggcaacggcaatggcgttggcccgtcttaagacaaacattaagaaaagggcaacatgtcataatctcgccgtcatgctaatggtggcgcatggtgttcatgtcgtcgtcttcttcgccgtcgctttctgattccgtggtggaaacccgcatcactatttttaactgctgatgcgggttttcggtgggtggaattccaaattccatcggttaaaattagggggattattattaatgcattgtgacttttgtaagataactcatgtagttaatttctatggttcagtgctgaaataataaaaaaaatccaatgtgatttttctct

SEQ ID NO: 4964 - DNA, 1370 bp, Oryza sativa
  Predicted polypeptide sequence is orthologous to G1480
gcggcgcgtgcgcggtggcgccggcggcggtgcactgccggacgtgcgacggcgacggcggcggaggtgggtatctgtgcgcggggtgcgacgcggagcatgggagggcggggcacgagagggtgtgggtgtgcgaggtgtgcgagctcgcgccggcggcggtcacctgcaaggccgacgcggcggcgctgtgcgccgcctgcgactccgacatccacgacgccaacccgctggcccgccgccacgagcgcgtccccgtgcatccgatcgggtcatccgccgccccgccgccggacgcgctcctgctcggcggggagaacgacgccgctgccgccgtcgacggcggcggcggcggcaaggaggtgaagctggacttcctgttcgccgacttcatggacccgtacctcggcggctcccccgagctcgcgcgcttccctcacgccgacagcgtggtgcccaaccacaacggatcggccggtcccgcgatggagctgggcttcgccggtggcggcggcgccgccgtcaaaccgtcgtacagctcctacacggcggcttccctcggcaacagcggctcgtcgtcggaggtcgggctggtgccggacgccatctgcggcggcggcggcggcggaatcatcgagctcgacttcgcgcagtccaaggcggcctacctgccatacgcctcgacccctagccatagcatgtcctcgtcgatggatatgggcgtggcggcgccggagatgagcgactgcgcggcggcggcggccgggagggcgtacgcggcggaggggagagcggcgcggctgatgcgataccgggagaagcgcaagaaccggcggttcgagaagacgatccggtacgcgtcgcgcaaggcctacgccgagacgcgcccccgcgtcaagggccgcttcgccaagcgcgccgacgaccacgacgccgccgcgccgccgccgcagatcatgctcgacttcgccggctacggcgtcgtgcctaccttctagtgttctagctcatcgatctgaacgttttttgagctggcaaattgatcaagctggcgttgcatacgtacaacgtagtacttcaattcaccatgcataggattagccaaagttctagttgatcacaattcacaaacttgaaagttttttttacctagcctgattgagttttaggctagtttctgcaatcgtgtttgctagaacggctataactagttgtagttaatctggattttctgtatgtatggtgttttgtagtaccgatctgatgatgatgatgaagaaaaatatttgggcaaaatcgatcgatctcatccagtttctaattaacatgcatgcgatcgatcgattgcgcgcgagatctggattgagatt

SEQ ID NO: 4965 - DNA, 1388 bp, Oryza sativa
  Predicted polypeptide sequence is orthologous to G1480
gtgcccaacgcccaaaaaacacagccaaactccgcgagaaaccgagctgcgagcgagtgaaacgcaccacgcgccgagcggcaaagcgaagcgaagaagaaatggaggcggtggaggacaaggcgatggtgggagtgggaggagcggtggcggcggggtactcctcgtcgtcgtggaggttggggacgcgggcgtgcgactcgtgcggcggggaggcggcgcggctctactgccgcgcggacggggcgttcctgtgcgcccggtgcgacgcgcgggcgcacggcgccgggtcgcgccacgcgcgggtgtggctgtgcgaggtgtgcgagcacgcgcccgccgccgtcacgtgccgggcggacgccgcggcgctgtgcgccgcctgcgacgccgacatccactcggcgaacccgctcgcgcgcaggcacgagcgcctccccgtcgcgcccttcttcggcccgctcgccgacgcgccgcagcccttccccttctcccaggccgccgcggatgccgccgcggcgcgggaggaggatgcggatgatgaccggagcaacgaggccgaggcggcgtcgtggcttctccccgagcccgacgacaatagccacgaggatagcgccgcagccgccgacgcgttcttcgccgacaccggcgcgtacctcggcgtcgacctggacttcgcccggtccatggacggaatcaaggccatcggggtaccggtcgcgccgcccgagctggacctcaccgccggcagccttttctaccccgaacactccatggcccacagcttgtcgtcgtcggaggtcgcgatcgtaccggacgcgctgtcggcgggctcggcggcgccgcccatggtggtggtggtggcgagcaaggggaaggagagggaggcgcggctgatgcggtacagggagaagcgcaagaaccggcggttcgacaagaccatccggtacgcgtcccgcaaggcgtacgccgagacgcggccgcgcatcaagggccggttcgccaagcgcaccgccgacgccgacgacgacgacgaggcgccatgctcgccggcgttctccgccctcgccgcgtcggacggcgtcgtgccgtcgttctgaggaaggacgtacgcacggtacggcgagtcggcgacgtgcgccgtcgtaattttggcgcgccccgtgcgcgcgtgcatgcgtgcgtgtgtgcgacgcatggccccgtgtgacatgaataatatgtacagtagtttttcatccatggacgtagtattctattgtactccttgtactcctactactcctcttctgcctaaccaaggcttgtacattaccatgggagtagctgtttttgcaaccgtgaccatggttcagtgcttcaagttcaagggcgttaatgttactgtc

SEQ ID NO: 4966 - DNA, 861 bp, Oryza sativa
  Predicted polypeptide sequence is orthologous to G1480
atggggatggccaatgaggagtcgccaaattatcaggtgaaaaaaggcggccggattcctccacgatcgagtttgatttatccgttcatgtcgatgggaccagcagccggagaaggatgtggcctgtgcggcgccgacggtggcggctgttgctcccgccatcgccacgatgatgatggattccccttcgtcttcccgccgagtgcgtgccaggggatcggcgccccggcgccaccggtgcacgagttccagttcttcggcaacgacggcggcggcgacgacggcgagagcgtggcctggctgttcgatgactacccgccgccgtcgcccgttgctgccgccgccgggatgcatcatcggcagccgccgtacgacggcgtcgtggcgccgccgtcgctgttcaggaggaacaccggcgccggcgggctcacgttcgacgtctccctcggcgaacggcccgacctggacgccgggctcggcctcggcggcggcggcggccggcacgccgaggccgcggccagcgccaccatcatgtcatattgtgggagcacgttcactgacgcagcgagctcgatgcccaaggagatggtggccgccatggccgatgatggggagagcttgaacccaaacacggtggttggcgcaatggtggagagggaggccaagctgatgaggtacaaggagaagaggaagaagaggtgctacgagaagcaaatccggtacgcgtccagaaaagcctatgccgagatgaggccccgagtgagaggtcgcttcgccaaagaacctgatcaggaagctgtcgcaccgccatccacctatgtcgatcctagtaggcttgagcttggacaatggttcagatag

SEQ ID NO: 4967 - DNA, 1396 bp, Oryza sativa
  Predicted polypeptide sequence is orthologous to G1480
gtcagcctggtggggaggggaggtgggtcgccgaaagcttggctgagattcgcctcgcctcgccttctagctcgcggccgccgctagcgcgagtgagagactgagagtgagtgaggtggtgtggccatggagggggacgacaagtcggcggtggcgggaggggcgtactgggggctggcggcgagggcgtgcgacgcgtgcggcggggaggcggcgcggctgttctgccgcgccgacgcggcgttcctctgcgccgggtgcgacgcgcgggcgcacgggcccgggtcgcgccacgcgcgggtgtggctctgcgaggtctgcgagcacgcgcccgcggcggtcacgtgcagggccgacgccgccgcgctctgcgccgcctgcgacgccgacatccactccgccaacccgctcgcgcgccgccacgagcggctccccgtcgcgcccttcttcggcgcgctcgccgacgcgcccaagccgggttccggtgcccacggcggcgacgcggcggcggccgacgatgacgggagcaacgacgccgaggccgcgtcgtggctcctccccgagcccgaccacgggcagaaagatggcgccgtcggtgcaaccgacgagctctacgccgactccgacccttacctcgacctcgacttcgcgcgctccatggacgacatcaaggccatcggcgtccagaacggtccgcccgagctcgacatcaccggcggcaagctcttctactccgaccactccatgaaccacagcgtatcatcctcggaggcggcggtggtgccggacgcggcggcgggcggcggcgctccgatgccggtggtgagcagggggcgggagcgggaggcgcggctgatgcggtacagggagaagcgcaagagccggcggttcgagaagaccatccggtacgcgtcccgcaaggcgtacgcggagacgcggccgcgcatcaagggccgcttcgccaagcgcaccaagggcggcgcgggcgcggacgccgacgcggacgccgacgccgacggcgaggacgaggagatgtactcctccgccgcggccgccgtcgccgcgctcatggcgcccggcggctccgacgccgactacggcgtcgacggcgtcgtgccgaccttctgatcgatcgcaaccaaagccgctgtgtacactagcccttctcccccattgggctgtaattttgttgcatgcatttcgcgcgcgcgggaaatgctttctgtagcattaatcaattgtatgattattacacggaagtaatccggacttccaatctcctcttctctctctctactctgatccttccatccttgcatgtatattatcatcgcgaactgctgctaatctgcaaattgtaattttactaatcagtaatcagtacagtggtggttgc

SEQ ID NO: 4968 - DNA, 557 bp, Oryza sativa
  Predicted polypeptide sequence is orthologous to G1480
ttttttttttttttttttttttttcgggttccttacaacctacgtcaccttttcaatggtgcctaggcctcttgaaggacaatacaccaaggagaaaggtagtgtagaagcacagcagagtatataaaggatctttaaagaccacctagtccgttggcaggtcctgcacgcagctttcccttgtactcggcatgtaaaatagccttgttgcttactgcacaagttgcaccaatacattttgacgtatctatcagacaataatggaaacagttctagcccagcctatgtggtactaacttacctcttcacctgtatttccctgtattcggttgattgtcatgtgcacctcggtacgacttaaatcgccaggggctctattgagccacgcacatttctcaaatactaaaaaaaagtccgaagactttttctagtacaattcggtgtcccaaatgtagcatcatattcattggctccgaatcatgtctttgatcaatagtagggttgcccggatcctgtgattactaacgtacgttccaatcgttccgataaggtagtaa

SEQ ID NO: 4969 - DNA, 1022 bp, Oryza sativa
  misc_feature (642)..(643): n is a, c, g, or t
  misc_feature (724)..(724): n is a, c, g, or t
  misc_feature (728)..(728): n is a, c, g, or t
  misc_feature (777)..(778): n is a, c, g, or t
  misc_feature (780)..(780): n is a, c, g, or t
  misc_feature (782)..(782): n is a, c, g, or t
  misc_feature (785)..(790): n is a, c, g, or t
  misc_feature (792)..(792): n is a, c, g, or t
  misc_feature (794)..(810): n is a, c, g, or t
  Predicted polypeptide sequence is orthologous to G1488
gtcgggcaccgcggcgccggcattcccggccaagaaggcggcgaagtccgccaagaagaaggacgggccgtcccccgcgccggcgccgaacgcggccgcgcaggcggcggcggaggggaggaggtgcctccactgcgagacggacaagacgccgcagtggaggacggggcccatgggtcccaagacgctgtgcaacgcgtgcggggtgcggtacaagtccgggcggctcgtgccggagtaccggccggcggcgagcccgacgttcgtggtgtccaagcactccaactcccaccgcaaggtggtggagctgcggcgccagaaggagatgcagctcctgcaccaccaccagcagccgccgccgcacgtgggcgcgggcggcggcggcgccgccggagggctgctccacgtgacgagcccgctgctgttcgacgggccgacgtcgtcggcgccgctcttcgccggcgcggacgaattcctgatccataaccgcataagcccggactaccggcgccaggctacctaggaaactattcattagcccaggaataattcagcgataaaaacagctaatttttttttgtcctgcaaaccgcattttgggtactctttatttctcagcttcttaagtttcttttttctttnnttgagaattttagtgtttttcccccttagaagcagactctgaggagtttctttcgtagcacatttttttttcttttgattnttgnatgcaggactcttagaagaagaggaacaggagcagttttcattgtttcnncnanaannnnnntntnnnnnnnnnnnnnnnnnctcttgaggggggcccggacccaattcgccctttatgagtgtttaccgccctacatggccgtgttttacacgtgggaatggaaaacctgcgttcccactaatggcttgagaaaatcccttttcagatggtaattacaaaggccgaccatgcctttccaaatgccccctaattggatggaacccctttacgcctttaaacgggggggttgtct

SEQ ID NO: 4970 - DNA, 1753 bp, Oryza sativa
  misc_feature (599)..(599): n is a, c, g, or t
  misc_feature (838)..(838): n is a, c, g, or t
  Predicted polypeptide sequence is orthologous to G1488
gagctgacctctctccgccccgcctccccttccgtctctccgcgctccagctccacgccaattaaaccctactcctcttgcgttgcgttatctgcggttccgtctcccactactcgcgcacacgtagaaacggaaggagaaacaaacaaaaggcgccgagtaacgcagatagagagttgtttccgcaccgagcgcgtccgcggcagtgtgtgtgtgtagcggtagcgcacgcgcggctcgcgggcgcgccggttgcaccagctgtgcgttgcggcgacgatggaggtgacggccgagttcggcggcgcctactacggcggcgcggcgggccgcgagaagaaggcgctgcagcaggggtgcggggaccacttcgccgtggacgacctcctcgtgttgccctacggcgaggaggatgaaacaacaagggagggtgaggccaccggcggtaaggaggaggctgccggctttgggaacgcgtcggcggactcgtcgaccataacggccctggatagctgcagcaattccttcggcctagccgacggcgacttccccggcgagctgtgcgagccgtacgatcaactcgcggagctggaatggcntatccactatatgaacgagggagacgacgcattcgccaccgaggacctccagaagctgcagctcatctccggcatcccctccggtgggttctcgacggcgagcgtcccgtcggctcaagctcaagctgcgtcggcggctgcctccatggcagtgcagcccggcggcttcctgccggaggcccctgtccccgccaaggcacgaagcaagcgctcccgcgctgcgcctggcaactggtcgntccgcctgctcgtgctgccgccgcctccggcctcccccgccgtcccggcatccatggccatctcgccggcggagtctggcgtgtcggcgcatgcgttccctattaagaagccgtcgaagccggctaagaagaaagacgcgccggcgcccacggcgcaggcgcagctctcgggcgtgccggtgcactcgggcggctcggcgccagcggccgcggccggggaagggaggcggtgcctgcactgcgagagcttacaagacgccacagtggaggacggggccgatggggcccaagacactgtgcaacgcgtgcggggtgcggtacaagtccgggcgactggtgccggagtaccggccggcggcgagccccaccttcatggtatcgaagcactccaactcccaccgcaaggtgctggagctgcgccggcagaaggagatgcaccagcagacgccgcatcatcaccagccgcaggtggccgccgccggtggagtggggagcctaatgcacatgcagagctccatgctgttcgacggagtgtcgcccgtcgtgagcggcgacgacttcttgatccaccaccacctaaggacagacttccggccgcccatctagagatgagtcgtgtgctagaattgatcaattagcccatgaataatctaaaagaaacccttgaaccaaaaaaaaaacagaagaactgatattttcttaggagtttccccagtttttgtctcttttcccttcgtttagtttgtgcgcttttgctcagctcgtcgaatttttcgtgtcaattttgtttatgatgctctttaagtttaccaccttttctagccgggagttgatttctctagcttctacttatcttcctctctatcttgccatttaatttgtaacgcatttcaaggtacttaaatctcttcttcc

SEQ ID NO: 4971 - DNA, 2008 bp, Oryza sativa
  Predicted polypeptide sequence is orthologous to G1494, G789
gacgcagcccacgggccttgttcccttctcaccacctccaagtacgctttgcgggacactcgcggcagcaagagttcgtatactcgcctctgctgctgctgcactgccgcgcctaaagctgagcaagaagaggagactttgcagcaagagttgctactgtttggtttggttcaggtgagagaggtcaacaatagctgttggcgtggctagttgcttgtgcagaaaaggattctcttttggttttgccctttctgagaagctgatgatgatgtggtggtgggctatggttgtgcaggttggggagctactagaagaaggaggaatagctaggttgtgaatttcttggggggacacaagaatcgtgggatggatggcaatgcgagatcggcggcgaatcagacgaagcaaatcgtgtagagatttcatctgaaacccaagaacggattcgtcttgtgttgttgccgaatggtagtgacctgacctgactctgtgtgcatttgctccaatggcgatttgcagcacggacaacgagctggtggagctgctatggcacaacggcggcgtcgtggcgcagccgcaggcggcgcaggcgagggtcgtctcctcctccggccgcggccagagcgccagcgtgctcaccggcgacgacacggagaccgccgcgtggttcccggacaccctcgacgacgcgctggagaaggacctctacacgcagctctggcgcagcgtcaccggcgacgcgttcccggcggccgcggcggcggggccgagctctcaccacgctccgccgccggacttgccgcccccggcggcgaggccgccgatgaggagcggcatcgggtcgagctggaccggcgacatctgttcggccttctgcggcagcaaccacatcccggagacggcggcgcagcgctgccgggacgccggcgcggcattgccgccggagcggccgcgccggtcgagcacccacgacggcgccggcacgtcgtcgtcgggcggctccggcagcaacttcggcgcttccggcttgcccagcgagagcgccagtgcccacaagaggaaaggcagagaagattcagacagtcgcagtgaggatgctgaatgcgaggcaaccgaagagaccaaatcgtcgtcgcggcgatatggatcaaagaggagaactcgtgcagctgaagttcataacctgtcagagaggagaagaagggatcggatcaacgagaagatgcgcgcattgcaagaactcatacctcattgcaacaagaccgacaaggcatctatattagatgaagcaatcgagtatctgaagtcactccaaatgcaagttcagatcatgtggatgactactgggatggcaccaatgatgttccctggtgctcaccagttcatgccaccaatggccgtgggcatgaattctgcgtgcatgcctgcggcacaaggcctaagtcacatgtcaagattgccatacatgaaccattctatgccaaatcacatccctctaaattcatctccagctatgaacccaatgaatgttgcaaaccagatgcagaacattcaactgagagaggcaagcaatcccttccttcacccagatggctggcaaacagtgccaccacaggtatcaggaccatatgcttctgggcctcaagtagcacagcaaaaccagataccgaaagcgtcagctagcactgttctgccaaattctggggctgaacaaccaccaacctctgatggaatttagaatgaccagaaacatgataaggaattcaatgtaggctttgcacaaagggtcgtctttctggagatagctgaaaatattgacatgatgaacagattgcatccatattgctgttatgtatctcaatcagtatctgtctgacataaatgctacaagtgtctgtaaatgcacatagcatttccccccttccctaagatgctaattcccagtgtatgtactaataatccttataatatgaagtgccagtggcaatctttgcccttctttaaaaac

SEQ ID NO: 4972 - DNA, 2081 bp, Oryza sativa
  Predicted polypeptide sequence is orthologous to G1494, G789
ggctctccggcgagtcctcttcctgccctgccctgccctgccctgcattctttctttctccaccaggggaatccagttcacccccagtgctgcttctgctgctgcttctgcatcatcttgccctgttaaaaagacacagtgcccttgttctttcgcagttgcaactagcatctcctcctctacttgtactcacttcacacctcagctcagctcagctcatctcctgtcatctcagctcaaagagaaagagctgaaggtgtaagctgatcaccaggaagcagaggctttttttcagattacagttatctgaaacaaccaacttcagaatcaatcagcaaaggtagaaacaagacagagctgctgtgcttctgtgattaattagggttgttaatgccatgaaccagttcgtccctgattggaacaccaccagcatgggcgacggctttgcgccattaggcgaagacgacgggctcgtcgagctgctatggtgcaatggccacgtcgtcatgcagagccaggcgccgcggaagccgccgaggccggagaagacgacggcggcggcggcggcggcgatggcggaggatgagtcggcgtcgtggtttcagtacccggtcgacgacgtgcttgagaaggacctgttcaccgagctgttcggcgaaatgacggcggccggcggcggcggcggcgacgtccgcagggcggcgtgcaaggaggagcgcggcgcggtcgccgcgttccagagcaggatgatgccgccgccgtggccggcgagggggaaggcggagttcggtgacgtcgacgacgtgtgcggcgtctcggaggtcgtcatggcgaagatggacggggcggcggcggcggagacggtcggcgagtcatcgatgctgacaatcgggtcgagcatctgcgggagcaaccacgtccagacgccgccggtggggaacgggaaggccggcgccggcaccgccggcgccgccagaagggcgcacgacacggcgacggtggcgtcgtcgtcgatgaggtcgaggtcctgcaccgccaaggccgagccgcgcgacgtcgcagccgccggcgtcggcggcaagcggaagcagcgcggcggcgccgccatggagtccgggagccccagcgaggacgtggagttcgagtccgccgccgcaacgtgctcgccggcgcagaagacgacgacggcgaagcggcggcgcgccgccgaggtgcacaacctctccgagaggaggagaagagataggatcaatgagaagatgaaagcattacaggagctcatacctcactgcaacaaaacggacaaagcatcgatgctggatgaagcgatcgagtatctcaagtcactgcagctccagctacagatgatgtggatgggcggcggaatggcgccgccggcggtgatgttcccggcggccggcgtgcaccagtacatgcagcggatgggcgccgtcgggatgggcccaccacacatggcgtccctgccgaggatgccgccgttcatggcgccgccgcccgccgccgtgcagagctcgccggtggtcagcatggccgacccctacgcccgctgcctcgccgtcgaccacctccagccaccgcctccgatgcattacctgcaggggatgagcttctaccagctcgccgcggccaagaaccttcagcagcagcagaacacggcggaggcgccgccaccgccaccggccggaggcaaccgcgcagccgctgactcctgacgacattctgcacaaaaaatacgacaactgtagtaagtctgagagcaagggtggcaccagttgattgccgtcaatctgaagatatgtatataaggctctgatgcaattgagttgagaggctggatcatgatggctacctaatcattaaggggaatttaagatcatcccttttactgacgtctaaattcggtaggcagtgtagatcgatcagcggttaagagttaacaagtcgtgaattcttttttgctatgtatgtagtactattttttcccctttggggagacattggttatgtatcagttgttgatgtacctgttcaaatttatgccaaccagagcaaattgtatt

SEQ ID NO: 4973 - DNA, 2134 bp, Oryza sativa
  Predicted polypeptide sequence is orthologous to G1494, G789
aagcccggtcccccttgctctgcctctgcctcttcttcctcctccttgctctgcttctgctctctagctagccttcttcctattggaagcttcttctcaagtgaaaattaagaagctagtattggctgagctgagctgagcacccagccaaagtcttgggcctacttaattagtgaggtgaaggggagatcgtcgtgtcgtcatccatggttgctgccatctgatgagcgatgaaccagttcgtccctgattggagcaacatgggtgacgcatccaggacactcggcgaagatgacaacctcattgagctgctctggtgcaacggccatgtcgtcatgcagagccagaatcaccaccggaagctgccgccgaggccgccggagaaggcggcggcggcggcggtgcaagaagacgaggccggcctgtggttcccgttcgcgctcgccgactcgctggagaaggacatcttctcggacctcttctacgaggcgcccgtcgcggcgacggcggaggcggcgcctgctggcccgggcgcgggcgccgacggcgaaggaaagacttgcaagggcgacgcggcaatggcggaggaggagcgtggcgggccgggcgcggcgtccgaggcgccgcgcgagctgatgccgccgcccaagtcgacgaacgcgtcctgctcgaggcagcagacgatgagcctggcggacggcggcgacaacgccggggacctgtcggagctcgtccgggcgaggaggtcgtccggcggcgcggctcggcggaaggcggaggccggcggcggcggcggcggcgcgtcgtcgtcgatgctgagcgcgatcgggtcgagcatctgcgggagcaaccaggtgcaggtgcagcagcgcacggcgagcgagcccgggcgccgcggcgcgccgccctcggcggtggggagcgcgaacgccatcccctgcggcgggcgcgaccacggccacggccacgaggcgaccaccgtggcgtcgtcgtcggggcggtccaactgctgcttcggcaccaccaccaccacggagccgacgagcaccagcaaccggagcagcaagcgcaagcggctcgacaccaccgaggactccgagagccccagcgaggtaggcgtcctcccgtcgaacaccaacagagacgcacactgacactgacaccggcggcgcgtgggatgcaatgcaggacgcggagtcggagtcggcggcgctggcgcgcaagccgccggcgaagatgacgacggcgcggaggagccgcgccgccgaggtgcacaacctctccgagaggaggagacgggacaggatcaacgagaagatgagagccctgcaggagctcataccacactgcaacaagactgacaaggcgtcgatgctggacgaggcgatcgagtacctcaagtctctgcagctgcagctgcagatgatgtggatggggagcgggatggcgccgccggtgatgttcccgggggtgcaccagtatctgccgaggatgggcgtcgggatgggggcggcggcggcggcgatgccgaggatgccgttcatggcggcgccgcagccggtggtgcccacaccgccggtgaaccaccttgacctgggcgtcaaccacctgcagccgccgccgacccagctttatttgcagggagtggggtattatccgttgggggccaaggccgtgcagcagcagcaaaatccaccacttcacgtgccaaatggaagcattatgcctcctcctgaaaatgcacccaacacaggatcaggataattaacaaaaaagagtgagagcaaagaggaagaaaacattcatggttgcattgatcctgaatgagtatatatggcaataaaggtaactgagctgcacagcaggacggagcagaggaatttgacagggggacgatttctttagctttttcccctctttgggaagccaggaactagctgtgatgtgcagaagatgttagcaaaatctcttgaagatctctaactgattgtaattaggggtatgatggcatgttcaaagcataaggctggtctggtcttttgtaccattggaattaacattagagacagaaattgtgccatacatttggaacaagagtagttagtataaattgacacacttcttttcaaaaagt

SEQ ID NO: 4974 - DNA, 1254 bp, Oryza sativa
  Predicted polypeptide sequence is orthologous to G1494, G789
atggatgcgggtgcaactgcaaggtcgtcgtcgtcgtcggcgatgatgatgaaccagaagaagcccttgtcggatggcgagctggtggagctcctgtggcaggacgggggcgtcgtcgcgcacgcgcagacgcgccaccgatcgtccgacgtcctcgcccggagcggcgtcaccggcgaggaggagacggcgtccgcgtggttcgcggatggcggtggcggcggcggcggcgacgacgacgcgctgggcctgggcatgggcagggacatctactcgcagctctggcacagcttcgccaatgtcgacgggcacgcggcgggcgcgctcgcgctcgcgacgccgacgccgacgccgcgggcggcggcgaggagcgacgacgtgtcgagccgtctcgacgaggccgacctgagcatctgcggcagcaacgcggtcgtggcgccggcgctgcccgcggacgacgacgacgacatcgacgccgccgcgccgcgcgaggaggaggaggaggaggaggaggggccgggcgccgcgcgcgccgccggcgcgtcgtcgtcgggcgggtcggggagcgggagcgggagctacccgctgttcaagcgggggagggaggagctggttgacagccttagcgaggtcgccgacgagacccggccgtcgaagcggccggcggcgaagcgccggactcgcgccgccgaggtccacaacctgtcagagcgtagaagaagggataggatcaatgagaagttgagagcattgcaagaactggtacctcattgcaacaagactgacaaagcatccatactagatgaagcaattgagtacttgaagtccctgcaaatgcaagttcagatcatgtggatgactaccgggattgtgccgatgatgttccccggtacccaccagctcatgccaccgatgggcatgggattgaacacggcatgcatgcctggggctcaagctcaaggcctgaatcagatgcaaagaacaacatattacatgaacaattctctgccaaaccagatgcctcagatcccttctccagctatgaatgcacccagtgttccagacgatatgcagaatgataatcgcatccgcgggccaagaaatccttttcttcattgcaatgatacactgacagcaacagctcaggtgccaggtttgtttacctatggatctcaaattgcagaacaaaatgagattcaggagttactctctggcgctgtcattccatcctcatctgatgggaccataaaataa

SEQ ID NO: 4975 - DNA, 1578 bp, Oryza sativa
  Predicted polypeptide sequence is orthologous to G1494, G789
atggcgatttgcagcacggacaacgagctggtggagctgctatggcacaacggcggcgtcgtggcgcagccgcaggcggcgcaggcgagggtcgtctcctcctccggccgcggccagagcgccagcgtgctcaccggcgacgacacggagaccgccgcgtggttcccggacaccctcgacgacgcgctggagaaggacctctacacgcagctctggcgcagcgtcaccggcgacgcgttcccggcggccgcggcggcggggccgagctctcaccacgctccgccgccggacttgccgcccccggcggcgaggccgccgatgaggagcggcatcgggtcgagctggaccggcgacatctgttcggccttctgcggcagcaaccacatcccggagacggcggcgcagcgctgccgggacgccggcgcggcattgccgccggagcggccgcgccggtcgagcacccacgacggcgccggcacgtcgtcgtcgggcggctccggcagcaacttcggcgcttccggcttgcccagcgagagcgccagtgcccacaagaggaaaggcagagaagattcagacagtcgcagtgaggatgctgaatgcgaggcaaccgaagagaccaaatcgtcgtcgcggcgatatggatcaaagaggagaactcgtgcagctgaagttcataacctgtcagagaggagaagaagggatcggatcaacgagaagatgcgcgcattgcaagaactcatacctcattgcaacaaggtaagaaacattattatatatgcatcttttttctgatcaggtgcaagtccatggactgatacagctatgttgaccgacaaggcatctatattagatgaagcaatcgagtatctgaagtcactccaaatgcaagttcagatcatgtggatgactactgggatggcaccaatgatgttccctggtgctcaccagttcatgccaccaatggccgtgggcatgaattctgcgtgcatgcctgcggcacaaggcctaagtcacatgtcaagattgccatacatgaaccattctatgccaaatcacatccctctaaattcatctccagctatgaacccaatgaatgttgcaaaccagatgcagaacattcaactgagagaggcaagcaatcccttccttcacccagatggctggcaaacagtgccaccacaggtatcaggaccatatgcttctgggcctcaagtagcacagcaaaaccagataccgaaagcgtcagctagcactgttctgccaaattctggggctgaacaaccaccaacctctgatggaatttagaatgaccagaaacatgataaggaattcaatgtaggctttgcacaaagggtcgtctttctggagatagctgaaaatattgacatgatgaacagattgcatccatattgctgttatgtatctcaatcagtatctgtctgacataaatgctacaagtgtctgtaaatgcacatagcatttccccccttccctaagatgctaattcccagtgtatgtactaataatccttataatatgaagtgccagtggcaatctttgcccttctttatcatcctc

SEQ ID NO: 4976 - DNA, 1440 bp, Oryza sativa
  Predicted polypeptide sequence is orthologous to G15
agaaggaaggccagaccaggaaagggaggcaagtttatctcggtgggtatgacatggaggagaaagcggcgagagcgtatgacctggcggcgctcaagtattggggcccttccacacacatcaacttcccgctggaggactaccaggaggagctggaggagatgaagaacatgacaaggcaggagtatgtggctcacttaaggaggaaaagtagcggtttctcacggggagcttccatgtaccgtggtgtcacaaggcatcatcagcacggacggtggcaggcacgcatcggccgagtctccggcaacaaggacctctacctcggcactttcagcacgcaggaggaggcggcggaggcgtacgacgtggcggcgatcaagttccgggggctcaacgccgtcaccaacttcgacatcacccgctacgacgtcgacaagatcatggccagcaacaccctcctccccgccgacctcgcccgccgcaacgccgccaccaccacctccaaggacgaccactccgccgccggcgccggcgccattgtctcggtgcactccgccgccgacatcgccgtcgccgacaccctctggaaggccaccactgccccgaggcagcagcagcagcaccacgacgacgtcgtgctgtccggcgccgaccaggccgcattctccgtcctccacgacctcgtcgccgtcgacgccgcggcggcgcaccagcagcagcagcagcagcagcacatgtccatgtcggcggcgtcgtcgctggtgacgagcctgagcaactcgcgcgaggggagccccgaccgcggcggcggcctctccatgctcttcgccaagccgtcgcccgccgtggcggcgtcggcgcagcagcaggcgtcgaccaagctcatggcggcgccgctgccgctcggctcctgggtctcctcgccgccggcgtctgccaggccgcccgccgtctccatcgcccacatgcccctcttcgccgcctggaccgacgcctaatcaccctcgccgccatggctcaccggagtagtaattagctagctatagctagagctaggcaacgacgacgacgacactagcttaattagctcgtgtttagttggttaatttagggttcttggttgctcggcgacatgattagctaagctagcgatgtagtagtagcactagcagctagttggagtattaattagtatcactcaaggcgaggaaaccgacgcacgccatggccgcggcctctcccccacctttccttcttctccggcgacggccggccgccatgtatcagagagctcgatcggcgccggagaagaagggtttttgtaacacggaggccggagatctatcgaggcggtgcttctcctccaaaatccaaaactatatatcttatattaattaattaattaattatagcctcaccaaattaatttctcaaaaaaac

SEQ ID NO: 4977 - DNA, 2510 bp, Oryza sativa
  Predicted polypeptide sequence is orthologous to G15
tccttttgcagtttttttctgctcagctcaccgggtcccctctctcatcttcctcgtcgtgcaccttgcatggatgtagaagtagcgagctagcgcgcggcgactgcgagccgagagagcaacgcaagaacggcacgagaggctggcagcgagcgagcgtgtgcatggttggtgcgagcaaatggccagcggcggcggcagcagcaactggttaggcttctcgctctccccgcacatgccggccatggaggtgccgtcctcctctgagccatcgactgctgctcatcatcatcatcatcatcatccacctgctgctgctgctgctgccggagccatgtcgtctcctcccgacagcgccacgacctgcaacttcctcttctcccctcctgcagcacagatggtcgctccttcacctggctactactacgtcggcggcgcctacggagacgggaccagcaccgccggcgtctactactcgcacctccctgtcatgcctatcaagtccgatggctccctctgcatcatggaaggcatgatgccgtcgtcatcgccaaagctcgaggacttcttggggtgtggcaatggcagtggccatgacccggccacctactatagccagggccaagaagcagaggatgcaagcagggcggcctaccagcaccaccagctagtcccctacaactaccagccattgacggaagcagagatgctgcaagaggccgcagcggcgccaatggaggacgcaatggcggcggccaagaacttcctcgtcaccagctacggcgcctgctacggcaaccaggagatgccgcagccgctcagcctctccatgagcccagggtcccagtccagcagctgcgtcagtgcagctccccagcagcatcagcagatggcggtggtcgctgcagctgctgctgctggtgatggccagggaagcaacagtaatgacggtggcgagcagcgtgtcgggaagaagaggggcaccgggaaagggggccaaaagcagcctgttcaccggaagtccattgacacgtttgggcagaggacatcgcagtataggggcgtcaccaggcacaggtggactggaagatatgaagcccacctctgggataacagttgcaaaaaggatggacagacaaggaagggaaggcaagtatatctaggtggttatgacactgaagataaagctgcgagggcttatgatctggctgcgctgaaatactgggggctatctacgcatataaatttcccgttagaaaactaccgagatgagatcgaggagatggaaaggatgacaaggcaagaatatgttgcgcacttgagaaggagaagcagcgggttctctcgcggtgcttccatctaccggggagtaacaaggcatcaccagcatggaagatggcaagctcggattggcagggttgctggcaacaaggacttgtatctcggcactttcagcactcaagaagaagcagcagaggcatacgacattgctgccatcaagttccgtggcctgaacgcggtgacgaactttgacatcacaaggtacgacgtggacaagatcatggagagcagctcgctgctgcctggtgaggcagcgcgtaaggtgaaggcgatcgaggcagcgccggaccatgtgccaataggccgcgagctcggtgcgaccgaggaagcgagcgctgctactgtcacgggcaccgactggagaatggtgctccatggatcacagcagcagcaagctgcagcgtgcaccgaagcaacggcagatcttcagaagggcttcatgggtgacgcgcactcggctctccacggcattgtcgggttcgacgtcgagtcggcggcagctgacgagatcgatgtcccgggagggaagatcagtggcatcaacttctcgaactcgtcttcgctggtgactagcctgagcaactcgagggaggggagccctgagaggcttggcctcgccatgctctacgccaagcatcatcccaccgccgtcagcctcgccgccatgaacccctggatgccgatgccggcgccggccgcagctcacgtgatgaggccgccgagtgccattgctcatctccctgtttttgcagcctggacagatgcttaattagagccatgttgctgcttgctcgatcttgcttttgatcggctctttttgtaaactaaagcaagatcagcagcaatcaggtgcttatggtacttaaattagctggaagcctggagtagcatacttggttatgatggtaagcactaggctggtggtgtaagtgtttaaccagtaaacccataggtaggacattcaagcaaaatccaaatctctagagcatccactggtagtagtagtagtagacctttagtgttagaccggtagtgttctttgcttcttttgagcctctttttttgggggaaatttggttggaatgtatggctttttaacacgaaatcaggaatgtatggcttttaacacgaaatctggctgtggcattaaaaggaaaaggttcagtgag

SEQ ID NO: 4978 - DNA, 593 bp, Oryza sativa
  Predicted polypeptide sequence is orthologous to G15
cttgatggctacagctatggcgtcggctacggcagcagctgcatcgatcaggtcgacaacgacaagctgttccagcatcatcatcagcaggatcaggcacaagaacagcagcagcagctggtgtacaactacgacgagatcaagcagctgctgatgaacacatcaaccacaagtaatagtattaatgctggtcaggatcatggcggcagcatggaagcagggttgatcggctcacaagggaaggtaaccatgatgtaaattaaactgatcgattaaagaggaggggaaggcagcagctgggcacggcaagattaaggatggattaattaaaccaaggtgtgttgttttttttactgttctttgattggattctaccgtacgtacgtgatgcatggcgcgtttaattgttgtggttaaaaaaaaaaaacaaaggaaagaagtgtgtcccgtgtcacggtcgcatgcacgtgccagtgcagctgctagtatagcgtttgcgttcgtgttacagcctgcagtgtgttgtatgtcactgtgacatgggatcgatcgatggatatcatgactagagataatctctctctctctctctc

SEQ ID NO: 4979 - DNA, 2077 bp, Oryza sativa
  Predicted polypeptide sequence is orthologous to G1506
ggcattccttcctccattatttctccatccctttcccctctcctcctctcctctaccttctctctaaaagactggatacagaacaaaaaaaagggaaaaaacagaaagaaaggaaagaaagaagaacacctaccaagcaagtcttggtctttgagttcatgggctgtggaattgttcccaggaatcccctctggctctgaaaagattcacaccgagcaacagttctttgatttttttccccctttgttttgctgaagaattgcttgtacagaactgcttctttcctgtttccgcttggttttccggtgtttattttgttggaattttcttgggccctttcttcttcgcttgtggaggcgaggggagaagagaggcatgggaaagcaaggaccttgccgtcattgcggagtcaccagtactcctctctggagaaatgggccaccagataagccagtgctctgcaatgcatgtggctcaagatggagaactaagggttcgctgacgaattacacaccaatgcatgctcgggatgatattgatgctgaggaacctagagctagcaagctgaaacctccaacattgaagctgaaggaacagaagcaactgaagaaaaatccaagccacatcacaatggagaatggaccattttctgatcaaaacttccgtaagatgggagatcctgacctaagtaatcgatctggttctggatcagcactatcatactcagagagttgtgccccctatggcactgctgatgcaagtgaaatgactgcttcagcacaatcacatgcttgggaatcacttgtgccatcaaagagaaggagttgtgtcactcggcctaagccttcacaaatggaaaaacttgcaaaggatcttaattccataatgcatgaagagcagctactttacctttcaggatcctcagaggaggatctaatttaccatagtgcaactcctgtggattcctttgagatgggatatggaagtatgcttctcagaccaaattcaaaatcactggaggaagaatcagaagcaagctctattcctgctgataataagtcatatattactagtgaatcttactcagggtcggtctcatttgtatatagtgaaagcaaggcaacaagcaaccaaaatgttataactgaacagccaaagaagtttctggtgcaaacatcagataatgctagaagggctaatctccatactgaaaatcaggatactctggagaatgcaaactcacctttagtttccctacatatggagggaaaagacagtgaagaaacaagagtaaagaccagtgcttcaaatcgccttacaaagtccaccatgaatcctctgaaaaggccgcatgacacccacttccaaagctccgtagaactaagaggaaccatgaggagtcctaaaagagtttctaaatatggtgatgctatgggtctaaagtgccaagcgtcgtttatgccgaaaccaggcaatggcaaagatttagcctgcagtgacagagcacttaacttattcatgttacccccggataaactatccatgctggttcctcctcagtatgccaacactgattctgatcaagacctgttgctggatgttcctcttaatgctcggcacccagaggccgagcttctttgccagccatctcaactgagctcagtagcccacagctccacctcagaggctgggaatgccggaggagaggggcgccttaagcagccctagttccagttccagttaacaagcaacttaggaacaggaagtagctgtagtttactttagtttccctggatcatggttccctttatttaccggccactgatggggcgttctgcggtttgttcatgctcttatcgtcgtcgccctggtttactaggcaatgtgcgtctgccaagttggcaaaaattgtgtgttcagctaacacttctagctgtgcttttggagtagacttgtgcttgtttgtagcatatggcttttggagaaggtatataactcaacatggctgtatggaaaagaggtaatctccttatgggtaaaatgaaaaaggaaagaaagatggaagttattaggagct

SEQ ID NO: 4980 - DNA, 659 bp, Oryza sativa
  Predicted polypeptide sequence is orthologous to G1510
taagaaagatcctaagtggcccgtagcagatgaagatcattttctctttgctcgtctggcgagtgcgtgcaagcagctgcctttgctgcaggtttgatgtttgtagggtcaaaagttatgagggcaaataatgcaaggctggcagtgcggcctgctgcctgactgacaaggcaacatggtggcttgtgagccctatgatgaatggagttgcgtaaaggcaaggcaggtgatgggcatgagcgggcaagcccactgtgatccacaaatgcaaggttggcatgttgcaagactggaggaaatgtaagccagagtgctggcacagctgcaggctgggtgggtgcaacatgtgctgcacctgatgcaggatgattgaaccttggtgtgcagggccatgagcgcatgcagctgacaagctgccagcgtgttggatgatgctgctgactttgggtgcggaatcctggactgcaagctgcaagctgcaaagctgctggtgtgggctgttggaacttggccatgctgaggatgatggtgatgctgaccctaggtactatagtgcacctagtagcattaccacccttgcggtgtattgtactgagttttaacatatagtggttctcggaagttagaaaataagctcagatatcaaaaaaaaaaaaaaa

SEQ ID NO: 4981 - DNA, 1343 bp, Oryza sativa
  Predicted polypeptide sequence is orthologous to G1510
gaacttctctcccatctctttcctcctcctcctctctgatatgtctactatctacatgagccagctacctgctactctccctctaatggagggggatcaggatcaggggctctacccagccttccatagagcaaaggaccctcctatcttgttccctttcatgatcgacagcgccgtcgagcaccaagggcaaatctatggagatcagggcttgaggaggcagcaggttttgggtgaatccaatcaacagttcaatgatcacatgatgatgggcggatcagatgtcttcctcacaccgtctccgttccgaccaaccatccaaagcatcggcagcgacatgatccagcgatcatcttatgatccatacgatatcgagagtaacaacaagcagcatgccaatggatcaaccagcaagtggatgtcgacgccgccaatgaagatgaggatcataaggaagggggcggcaaccgatcctgagggcggggcggtgagaaagccaaggagaagagcacaagcgcaccaggatgagagccagcaacaactgcagcaagctttgggtgtcgttagagtgtgctcggactgcaacaccaccaagacccccttgtggagaagtggtccttgtggccccaagtccctttgcaacgcgtgtggcatcaggcaaaggaaggcgcggcgggcgatggccgctgctgccaacggcggagcggcggtggcgccggcaaagagcgtggccgcggcgccggtgaacaataagccggcggcgaagaaggagaagagggcggcggacgtcgaccggtcgctgccgttcaagaaacggtgcaagatggtcgatcacgttgctgctgccgtcgctgccaccaagcccacggctgctggagaagtagtggccgccgctccgaaggaccaagatcacgtcatcgtcgtcggtggcgagaacgccgccgccacctccatgccggcacagaacccgatatccaaggcggcggcgaccgccgctgccgccgccgcctctccggcgttcttccacggcctccctcgcgacgagatcaccgacgccgccatgctgctcatgaccctatcctgtggcctcgtccacagctagctagctagctgatcaaaactagctagctactagtaccgttaatttgatgagggcaacaaccagagtactatgtaccactactagcaatattttgtgtgtgccttgtgatcttttgttgttttgtgttgttgaggagatcactagatcaggatgaaggagagatagtgatcacatgtctaaggacgaaataaacgagaacaaactcgctagctagctactagccgggatcaggattatattt

SEQ ID NO: 4982 - DNA, 1633 bp, Oryza sativa
  Predicted polypeptide sequence is orthologous to G1510
gaatcgtgctggacctcgcaaaattgcccctccaaccgcatcaacactcgtcgcgcgaagcgtaccatcgtctctctcatcttcctcgcggtctcatcctgatcgatctctgcgagtttatccaatatctgtactcgcaaactagctagagagatctagttagtagctaggcagttgctgcctctcatgtctaccatctacatgagtcagctctcagctgctctccctctcatggagggggagcaccaccatcaccaccaggatcatcaccaaggccacttccaagccttctccctgcagcctaaggatcccccagtcttattcccctttgtgatcagtagaagaagcagcagcagcagccctagcgacagcaccactctaagctatggttcagaccatcacttgacacagcagcagcagcatcagcatcaagccatgcttgagccccaaaatatgattggaggatcatccgctggcatctttgcgacgccgttcccgaccgtcaagagcatccgcgacgacatgatcgagcggtcgcagttcgatccatacgataccgagaagctgcaggcgagctgcgggttagccaaggtcgtcgccggcggcaagtggagcgcggtgccagcggccaagatgaagatcacgaggaagatgggtgagccgtcgtccggtgtcactggcggggctgcgacgacggtggcgccgaagaagccgaggaggaggccggcgcaggcgtacgaggatcacggccatggcggcgccatgggccaagcttttggcgtgattagggtgtgctccgactgcaacaccaccaagactcccttgtggaggagtggcccgtgcggccccaagtcgctttgcaacgcgtgcggcatcaggcagaggaaggcgcggcgggcgatgatggcctccggactaccagcgtcccccaacgccgccggccccaaggcggccgcacatagcggcgccacaaacgcagccgccgcagctgccatggaggagacggccgagtccgccaccgtcgccccgcccccggcgccgacgacgaggggtggtactctcgtcgacagcatcgggctcagctggagcaagacccatgccgccgccaccgcctcctgcagcttccggccgtcaccggtggctcccggcttcgcggcggcggtgcaggacgagatcactgacgccgccatgctgctcatgacgctgtcctgcgggcttgtccggagctgagaaagaaaagctatacttcatctctgcatgcatccatcgatcgatcgattggcaccaagctagagagaccaatcgatggagatggagagaggtgcaggctttttgcagctagtgcgttagcctgttcttgctcgctcgatcgatcgtacactgccccccagttggaatgtctcttggcgtcttgtttcctgttcgagtcttgtgatctctgttactttgtgcactgtactagagagtgagagagagagtgaggtagaaacatcaagaggagattagaggagaaagaataattaagagaaaagtgtgagctagctaggtaagatttactgtactgtgagttcaatttggagtaagctttttgggctgcttcacggctaattatgccactggctgctatatatgt

SEQ ID NO: 4983 - DNA, 3742 bp, Oryza sativa
  Predicted polypeptide sequence is orthologous to G1535
gggttactcctcttcctcgctcgctcgctcgctgccttagccttgacctccatcgatattgcaaccataaagaggaggaggaagaggaggcgagaaagagagagagatcgtcttcttctccagccagccagccagccgtgattgatctcaagggggaaggcagctgcagggatcaagaagaaggagaagaagtgatcaaggaaggaaggccacggaacaaccgacagggcaggagggcgctggccggatcgccggagaaggaaccactagctagctagctagctactcctattgaagatatcgccggccggacatatgcgcaggatgttcggggactgccaggtcctgtcgtccatggccgccatggccggggccgcctcctccgccgacgcgctcttcgcctcgccgctcatccccaaccccgctctcgccggcttcatgtcctcctccgccgccatgcccttccaccacttctccaacgccgccgccaccttaatacctaaggaggaggggttgatgggcggcctccatgtggccaaggacgaggggatggacctcgagatggacatggagctcagtggcggctccggcagcgcccacctcgacggcctcctcagcttcgccgacgtcgacgacgaccacaagccgcagcacagcggccatgaccagccgcccgacgccgcccagcccagcggcgccgcggggggcaacgccaagaagaagcgctaccaccgccacacggcgcaccagatccagcagatggaggcgctgttcaaggagtgcccgcatccggacgacaagcagcggctgaagctgagccaggaactgggcctcaaacctcgccaggtcaagttctggttccagaatcgccggacccagatgaaggcgcagcaggacagggcggacaacgtgattgtgcgcgcggagaacgagaacctcaagagcgacaacttccgcctccaggccgccatccgcaacgtcgtctgccccaactgcggccacgccgccgtcctcgccgacatgtcctacgaggagcagcagctccgcatcgagaacgccaggctcaaagacgagcttgaccgcttggcctgcatcgccacccgctacggcggcggcggcggacggcagccggtgctgtcgacgtcggccctgagctgcatctcggcgccgccgccggtcctcatgccaccgctcgacctcgacatgaacgtctactcgcggcacttcgccgagcaggcgccggtcatgggctgcggcgacctcatcccgccacccgtcgtgccgcagcacgatggcgcggcggcgtacatgggcgccatgatggcgcccgtgcaggagcaggacaagcagctggtggtcgacctcgccgccacggcggcggaccagctcgccaggatgtgccgcgccggcgagccgctgtgggtgcggcagcgtggcgcggaggtgatggccgtggaggagcacgcgcggatgttcagctggccggtggacggcgcgaagcagggagacggcggcgcggtggcgagggcggaggggacgcgtgacaacgcggtggtcatcatgaacagcatcaacttggtggacgccttcctcgatgcgaacaaatggatggagctgttcccgtcgattgtttgcaaggcaagaacaatccagatcataaaccacggagctgcgtctggtcacctcggcagtggaactctcctcttgatgcaagcagaggtgcagttcttgtcgcctctggtggcggcgcgcgaggtggtgttcttccgttactgcgtgcacaacgccgacgaggggagctgggcgatcgtggatttcccggcggaagggtttgaggaggggctcctccaagcctcggtggtcaggtgccggcggcggccgtccggctgcatcatccaggacatgcccaatggatactccagggtggtgtgggtggagcacatggagatggtcggggaggagaagccgctgcagccggtgttcagggactacgtcgccagcggcgccgccttcggggccacgcgctggctctccatcctccagcgccagtgcgagcgcctcgccagtgagctcgcccgtaacatcgccgacctcggagtgatccgcacccctgaggcaagaacaaatatgatgaagctgtcgcagcggatgatcaccactttctgtgctaacatcagtgcttctggaacccaatcttggacggccctctcggattcaacccaggacactatcagggttacaactcggaagaacactgagcccggacagcccagcggtgtcatcctcaccgctgtctccacaagctggcttccttttacccatcagcaggtgtttgagcttcttgcagatgaacaacagcgctgccagcttgagattttgtcaaacggcggctcccttcatgaggtggcacatattgcaaatggatcacatccaaggaattgcatctctcttcttcgcattaacgctgcaagcaactcgtcacagaatgtggagctcctgctgcaggagagcagcacccaccctgatggtgggagcctggtggtgttcgcgacggtggacgtggacgcaattcaggtgacgatgagcggcgaggatccttcctacatccctctcctccccctgggcttcgccatcttccctgccaccagcccatcacctgctgctgcacccaccatcagctcaagcaccaccaccaccactggcaatggcaatggcgaaaccagtagcactcctccaagaaacagcagcagcaacaacaacaatgcagatgagctgctgcctcccaatggctgcctcctcaccgtcggcatgcaggtgctggccagcgccgtaccttctgccaagctcaacctctcgagtgtcactgcgatcaacagccatgtctgcaacgccattcaccagatcacagctgcactcaaaagttcagcaggtggtgctgggggtgagccggcgtccgatcagtagcaaaggagacctggaggagaggggatcggagcaacatgggatcagacaccaaaatgcctcccaatttatttcgctaacatcgcagtttgtttttctgttagctctcggtctggctggttcatcaggtgcaagggagggtttgacaagaagccaacactaacagctactcaaatctctcctctcttcccgccatatttctgcctctcaaaatgacgaaaatacccccaaccagccaacaagcaaagccatggggggcattttgatcattttgggaagctacttctgctgagaaagaaagaaagaaagaaagggtcttgtcaagctctcacttgcaccaaccagctgattcatgaatttgctgacatcagctctgcaggcattttggtcgtgcatcggtttcttgctactccatccatccctctttaggttcttcctccctttcctcatcaaaagtgagaactgcatgtgaagaaggttagctccttgttttgaatttttgtaataataagatggaagaagaagacttggtagcttgagtgtgtggtttgtgttaagatcgagctagactttgtgtaaggttgaagaagaagaagacattaagcagattgttattaggagatgagataagagaaaggaggagaggagaagtcaagagcgaaccagttgtgacccttcttcacactagaagggggtcttggttcgggaattgacttgttacctctctgcactctttgtctgtaacctttgccctatcttattattactactagtattgttc

SEQ ID NO: 4984 - DNA, 1170 bp, Oryza sativa
  Predicted polypeptide sequence is orthologous to G1538
gacagactcggacaccaccggtcacttgaattgtcaagctagctagccttctcatcagcctggctctcagtctcaaagaaagcacaaaggtagctagcttagcatcgattgaagctgaccagagagatagttaagaatttgccatagcttagtgtttggtgcatacacacaactgctctcgttgtttttgctcttttgggttcgctcggaagatgagccgtgaggaggatgagaagctgctgttcccttcgttcgccttcccggcggagtgcttcccggaagccgccacctccggtggcgagcagaagaaggctcggcagcggcggaggaggaaggtgaagccggaagcggcggcagcgttggctggagagagcggaggggatgagcaggcgaagaagcggcggctgagcgacgagcaggcgcggtttctggagatgagcttcaagaaggagcggaagctggagacgccgcgcaaggtgcagctcgccgcggagctgggcctcgacgccaagcaggtcgccgtctggttccagaaccgccgcgcccgccacaagagcaagctcatggaggaggagttcgccaagctccgctccgcccacgacgccgtcgtcctccagaactgccacctcgagaccgagttgctgaagctgaaggagaggctggcggatgtagaggaggagaaggcgaagctagcagctgtcgccgcggcgacgaccggcggcggtggtggcggcggcggcggcagcagcagcccgacctcgtcgtcgttctccacggtgacgtaccacccggcgctggcggggcagttcggcgtggaggcggcggccgaggaggccgacctcacctacatgagtgagtacgcgtacaacagctacatgctggagttggcggcggccggctactgcggcggggtctacgaccaattcagctgagcgccgccactcgccggggccggcgccgacggaggattaactagctacagtagctgttaattaatggatcgatcaattgcagggtagtaattcagtagtggtggtgtttattagtagtatcaatgatcgatatatcatcagtcgtgttgccctaacgaaaaatctttagcggtgactttgctaagccatgtagattattaaattggatgtctttgtaagtatatgtgtttagaatacc

SEQ ID NO: 4985 - DNA, 1173 bp, Oryza sativa
  Predicted polypeptide sequence is orthologous to G1538
cggacgcgtgggtggtggtgcgtggtcctcttctccatccagagacaatccagttcagttcagtttcctctctccctcctgtcctcacctcacgcttgacaagagagagagagagagagagagagagagagagagagagagagagagagagagagagagaaaggctgaactgagctgagctgatcgagctagtgtgcgagacggcatggaccgatacggcgagaagcagcagcagcagcagatgtttgcctcctacgtggacgcctccctcctagcagccagcggtgaggtgcagggcgagaggccgagagcgcggaggaggaggaggcgtggggcgaggtgcgttggcggcggcggcggtggtggcgaggtggacggaggggacccgaagaagcggcggctgagcgacgagcaggtggagatgctggagctgagcttccgggaggagcggaagctggagaccgggcggaaggtgcaccttgcctccgagctcgggctcgaccccaagcaggtggccgtctggttccagaaccgccgcgcccgccacaagagcaagctgctcgaggaggagttctccaagctcaagcacgcccacgacgccgccatcctccacaaatgccacctcgagaacgaggtgctgaggctgaaggagaggctggtggtcgccgaggaggaagtgaggcggctcagatcagcggcggggagccacacggcctccggagaaggcggagacatcatgggcttaggcggcagcggcgcctgcgtcgccgggagcccgagttcgtcgttctggacgggtacctgccagccgccgagtttcggcggcggagatcccttcggagacgatgacctggtgtatgtcccggagtacggcggttacgctgataacagtgtggttgagtggttcagcctgtatggattgatctaacgaagatcaagttgatgatggcatgtgcggggaatttagttagtcatagtgttaattaagctgtatggtgatcgatcgaactgatatggtcagctttaagtgtgtgtgtttaattatgtacataaagtgattaatggcaaaacctggccagctagctagtaatgtattaatattagtagttcgcttaaaaaagatcaagatgtgtgttcaaaaaaaaaaaaaaaaaaaaaaaaaaaaaaaaaaaa

SEQ ID NO: 4986 - DNA, 1406 bp, Oryza sativa
  Predicted polypeptide sequence is orthologous to G154, G1797
catttcggggggggtagtttataagggcttgcgcgaggagggggaggagtagcgggtagcggcgggctcgagtcgagtcgagtcgccgtcgtcgtcgggcggcggcggccgagagagatcgggatcgatggtgcgggggaggacggagctgaagcggattgagaacccgacgagccggcaggtgaccttctccaagcgccggaatggcctcctcaagaaggcgttcgagctctccgtcctctgcgacgccgaggtcgccctcatcgtcttctccccccgcggccgcctctacgagttcgccagcgcccccagcctacagaaaaccatcgaccgctataaagcatacacaaaggatcatgtcaacaataagacaattcaacaagatatccagcaagtcaaagatgatactttaggtttggccaagaaacttgaagctcttgatgagtccagacggaaaatattgggagaaaatttagaaggatgctctattgaagaactgcgtggtctagaaatgaaacttgagaagagcctccacaacataagactaaagaagaccgagcttctggagcggcagatagccaagctgaaagagaaggagcggactttgcttaaagacaacgaaaatttacgcggaaagcatcgcaaccttgaggctgcggcgctggtggctaaccacatgacgacgacgacggcgccggcggcgtggccgcgggacgtgcctatgacgagcagcacagccggcgccgccgacgccatggacgtggagactgatctgtacattggattgcccggcactgagcgctcctccaaccggtcggagacaggttgaagaaggccagccacagcaacagctgctatatagcatgcagtagcagcaacgacgccagtgacatcctgttcatctcacaagaataaccagagctctacgcatgcgcacatgaaacccaggcatgcagttctcggtgggtaaattattatctcgcattattagctatatgcgtgtccttgtctttttctttaggcaatggaataaaatttccggtaagtacaaacacaaacggaaacaaagaattaacaaagctgtagcagaccagatcggcaaattgaaatgccaggtaatccagtatatatttcgctaaagttattcatgttggtgtgatgggcctgtgagtgtgggtgcttgggaggagatttcttgggttttttccccgagcaaaatcaatctgctcgtgcccttgagatttcagttccgcccataagaactccgacgcacatttagcattcggagagtaattttgttaggttaaaagtatggtaagttataggtggtatgttatgtttttctttttcttttctcaatgttatctggtacctaagtttgtcaagaaaatcatagtggacaagtc

SEQ ID NO: 4987 - DNA, 257 bp, Oryza sativa
  Predicted polypeptide sequence is orthologous to G154, G1797
cttagcttagctagggttcgtggtcgatcggtggaggagttggggaatggagggaggagggaggaggaggaagagggggaaggtggagctgcggcggatagaggaccggacgagccggcaggtgcgattctcgaagcggcggagcgggctgttcaagaaggcgtacgagctgtccgtgctctgcgacgcccaggtcgccctcctcgtcttctcccccgccggccgcctctacgagttcgcctcttccacctccagca

SEQ ID NO: 4988 - DNA, 1117 bp, Oryza sativa; identical to SEQ ID NO: 2303
  Predicted polypeptide sequence is orthologous to G154, G1797

SEQ ID NO: 4989 - DNA, 583 bp, Oryza sativa
  Predicted polypeptide sequence is orthologous to G154, G1797
ctgcatctctcgctgctcctcctcctcctcctccgccgtgcaggccgcagccgctcgtgtggttggttggttcatcggcgatcgaagatggtgcgggggaagacgcagatgaagcggatagagaaccccacgagccgccaggtcaccttctccaagcgccgcaacggcctgctcaagaaggccttcgagctctccgtcctctgcgacgccgaggtcgcgctcatcgtcttctccccgcgcggcaagctctacgaattcgccagcgccaggaaaattcggcctgaaaagacggcaaaaactatatttccccgtgtggcgattgattgccgtctaaacagtcacactacttccataaagaaattagttgtgagactggcaaggttagaaattctgaaaacataggcaacttagtactggcattccggagggcaatatgatatgagcactaattagttaatgataatgtacgttgcagtaatcttgccgtgcatatgaatttctatgcgtaacatgcatgaaagcacactaacgggagtttccagggagcctccaatcttattaatgctgtacaactaaaaaaaaa

SEQ ID NO: 4990 - DNA, 437 bp, Oryza sativa
  Predicted polypeptide sequence is orthologous to G154, G1797
gaggtttgggatgctttcctttgcgaggaaaatcagccagcagcgacatagatcgatctgttcccggccggcgagccggagtagatctctcgcataccctgcacgcacgtactgcttatggcggcggcgggagggcagcagaggcggcgcggcgggcggcgagagatgcggcggatcgaggacacgacgaggcggcaggtgacgttctcgaagcggcggaaggggcttctgaagaaggcgtcggagctgtcggtgctgtgcgacgcggaggtggcgctgctcgtcttctccccgcgcggccgcttcttccacttcgcctccgctccctccctggaggggacaatcgaccgctacattagccacacccaagaggcgcctgcaaacaagaagccccgtgaacttactaatatgaaatctcaatccgaaaccttagcaat

SEQ ID NO: 4991 - DNA, 870 bp, Oryza sativa
  Predicted polypeptide sequence is orthologous to G1540
atggatcacatgcagcagcagcagcggcagcaggtgggtggagggggaggagaggaggtggcggggaggggtggtgtgccggtgtgccggccgagcgggacgaggtggacgccgacgacggagcagatcaagatcctgcgggagctgtactacagctgcggcatcaggtcgcccaactcggagcagatccagcggatcgccgccatgctgcgccagtacggccgcatcgagggcaagaacgtcttctactggttccagaaccacaaggcccgcgagcgccagaagaagcgcctcaccacgctcgacgtcaccaccaccaccgccgccgccgccgacgccgacgccagccacctcgccgtcctctccctctcgcctacagcagctggcgcgacggctccctctttcccgggcttctacgtcggcaatggcggcgccgtgcagacggatcaggccaacgtcgtcaactgggactgcaccgccatggcagccgagaaaaccttcctgcaggactacatgggcgtgagcggcggcggcggcgccgccgcggcggccccgacgccgtgggcgatgacgacgacgactcgcgagcccgagacgcttccactcttcccagtcggcggcggcggcggcgacggcgcgcatcgtcacgccggccacggcggtttcccgtccaacttccagcgctggggttctgctgctgctaccaccaacaccattacggtccagcagcatttgcagcagcacaacttttacagcagcagcagcagccagctgcacagccaggatgggccggcagcaggcacatccctggagctcactctcagctcctactactgctcatgctcaccttaccctgcagggtccatgtga

SEQ ID NO: 4992 - DNA, 1174 bp, Oryza sativa; identical to SEQ ID NO: 1957
  Predicted polypeptide sequence is orthologous to G1543

SEQ ID NO: 4993 - DNA, 561 bp, Oryza sativa
  Predicted polypeptide sequence is orthologous to G156
atggggcgtgggagagtagagctcaaaaagattgaaaatccgacaaaccgccaagttaccttctccaagaggaggatggggctgctcaagaaagcaaatgagctggccattctttgtgatgcacaaattggggtgattgtgttctcaggcactggcaagatgtacgagtactccagccccccttggaggattgcaaatatctttgatagatacctgaaagcccccagcacccgttttgaggagatggatgttcagcagagaatcatccaagagatgacaagaatgaaggatgagaacaacaggcttaggatcatcatgaggcagtatatgggtgatgacttggcttcactgactctgcaagatgtgagtaatcttgagcagcagattgagttttctctgtacaaagttcgtctaaggaagcaacagctacttgatcagcagctgcttgagatgcacagccgggtatgtaacaagaggatataccggttcagtattcttccctaccttatacactatattgaaataatcaagttttgattgccctctttccatcccaatagg

SEQ ID NO: 4994 - DNA, 729 bp, Oryza sativa
  Predicted polypeptide sequence is orthologous to G156
atggggcgagggaagatcgagatgaagaggatcgaggacgcgacgaggcggcaggtgacgttcagcaagcgcagggctgggtttctcaagaaggcgaacgagctcgccgtgctgtgcgatgcgcaggtcggcgtcgtcgtcttctccgacaagggcaagctcttcgacttctgcagcccgccggtcatcttgatggagctgtttcaccgttatgagatcaccaccagaaacactcggcttcaggagacaaaccgtgatgatgagcaaatggtcatggagatcacaaggctaaggaatgagatcgaccagctcgaagccagtttaaggaggcaaactggagaagacctgtcatctgtgtccacagtggatgagctcagccagctgcagctgcagcttgaatcatctctcagcaaagttcatgcgaggaaggatgagctcatgagccagcagctggaggatatgcgtcgcatgcatcagaccgtgcatgagcagaacaatttcttgtgccgcatggtaactaaaatactcctactaaatgtgatcacaataatgatacttgctgccatgatttctatcactcatgcacgcattgcccttgatgattgtatgcagttgggatatattgtcatcaagcaagaaaattcttggcgattctggtttatatgacttcctggaagcagtaggaacaacaagagttactgaaccagaaattgaacttgccttcttcat

SEQ ID NO: 4995 - DNA, 1325 bp, Oryza sativa
  Predicted polypeptide sequence is orthologous to G156
agcctttgaagcaagcttagcacttcacaagtttcctcttgtgcagaagaaggagaaacaaaagaacacagaaattaaattaaactcgatcaggaaggtatagcaggcatggggcgcggcaagatcgagatcaagaggatcgagaacgcgacgaacaggcaggtgacattctcgaagaggcggggagggctactgaagaaggcgaacgagctcgccgtgctctgcgacgcccgcgtcggcgtcgtcatcttctccagcaccggcaagatgttcgagtactgcagccctacctgcagtttgagggaactcatcgagcattaccagaccgtcaccaacactcatttcgaggagatcaaccacgatcagcaaatatttgtggagatgactcggatgaggaacgagatggagaagctggacggtggcatcaggaggttcaccggcgacgacctctccaacctcacgctcgccgacatcaacgatctcgagcagcagctcgaattctccgtcaccaaagtccgtgcgagaaagcatcagctcctgaaccagcagctggacaaccttcgtcgcaaggagcacatcctggaagaccagaacagcttcctgtgccgcatgatcaacgagaaccatcatcaggcggcggtgggcggcggcgacgtgaaggcgatggtggagatggcgccggtgctgtcgatgctgacggcggcgccggcgtactacggcgaggagtcgtcgagcaccgcgctgcagctcaccccgccgctgcacgccgtcgacgccgccgccgccgccgggttccggctgcagccgacgcagcccaacctgcaggaccccggctgcagcagcagcagcttccatgccgccgccgccggccacggcctgcagctgtggtaagaacaaacgaagcaaagcatacatggcacatcctgatactctcatcagagatctagatgattgcttgctaattaagcacatgatggcattgtcgattctgggagctaggagtaacttggagaccatgaagatgcatgatcagctgatgatagacgatcgagttgggttgctgtgttgttcaattgttcatcgttctggacatatatatatatatatatgtgtgtgtgtgtgtgtgtgtgtgtgtgtgtgtgtgtgtgtgtgtctaattagcacatcagaataatcaagcttttctacctagttaactagtacagctgctaagtaccttttgatttgttggtgtgtgaactactgaactggagttggatattaaggtctccatgcatttgcatggttaattagcagagagatcattgaggtttttaggatgtaac

SEQ ID NO: 4996 - DNA, 2016 bp, Oryza sativa
  Predicted polypeptide sequence is orthologous to G1635
gattttccccttcctgccttgcctcctcgtctccttctctgctgctctccaagctcttcctgcttccatcaggttgtctcgagaaagattggagtttttggtggtttgggttgtgcggttcttgcttttgttggcgcaagcgcatggctggttctgggacatagtgagctgagatagagttcttgtgttcggtggagtttggctttggtgaatcttcgattcaagtctggagatggcgcgttttcaggaaaccaaggcgaggaatgatcaaggacctgttgctgatcatgttgggcaccgaaacctcatggaaaacctcacagatcctctggattccagtggcatggacatgatggacgaagcgcgaattcctaaggcgcggaagccatacacgataacgaagcaaagggagaaatggaccgaggacgaacataagctgttcttggaagccctgcagctccatggccgagcctggcgacgcatccaagagcacataggcaccaagactgccgtgcagatcaggagccacgcacagaagttcttctccaaggtcatcaaagaatcatctggggacaattgcaacagcttgggtgctgcatcatcaattcagattcccccgccgcggccgaagcgtaagcctgttcatccgtacccacgcaatctagggagcacagccagcaagaacgtccctgcactgaaacagctagagaagcctcagctgcaggtgcagtctctctacgaccaggacaatgggtcgccgacgtcagtgttaacagtaccacagatacgggctgatacactgggaagtgagagtggtgggtcgccaacctcgacgattgatattgaagagagatgtcctacaccaagcatagcaactgctgagttagctatggagttgcctcctacaaatgacgaggaggtcaagggcaatggcgatcatgaagaagttacatgtgacagatcaggagttccagtccttaggctatttggcaagagggttatggtgaatgatttacatcagatgtcagcccctgatgccgggaacctgcaaactgtggcagacatggaagtggacgcttcagctgagacaccaactagtggaactgggaaattctcttcccatggtgcagcagaagcaaatacatggaacccatggctgactaacacacagcagtttctgtattatcttcctaacggacaaattttctccgtgcattctgctctcccatgcttcacctaccataatgagggtgttacttgcacccagttttcaaacccacaggtggtagcctcagatcagcagcatcaacaccaaacttctgaagctgtagattacaagggtatacagagggaaggatcttggacggagtcaaatacatcctcaagcagtgtgcctgaaacagcaactcataattcagagactacagaatcatatagaaacggaaacagaaacgaagatgaaatggtaccttctccagattcaagaaaatgtgtgagcccaggttccaactgcaggcgaggctttgtgccgtacaagagatgtgttgctgatagtgaggcgctgctgaagtcacaggcgcctcaggaggaggcagacggagagatgacgaggctgtgcttataaatttttggagcctcgtagatcactgcaactatagatgcttgctactaatattttgttcacagatgagtaggaactgatgtactgcaggaggggctgctttcctgttacaagaggcagattgaaaccgcgttagtactccacaaaacagggagtggccgtggttcttgtctggccatgtacagttcaaatattctatgtttccattttcctcgtcgtgtgtttgtaatttcgctcccattgcgggagcgttcagaggtcaatggctgtcatgcaatgacaagtattttgatagagttgtagaagggttgtactgatgtaaattatacagtaacttattatctgtaagacaataacaggcgagctaaagaaaacaacgttggaaagctttgttc

SEQ ID NO: 4997 - DNA, 1146 bp, Oryza sativa
  Predicted polypeptide sequence is orthologous to G1635
atgggtggggactgcaaggactctctgaagaatcgcatccggatattcactgaagcagtagtggtcatggtatgcccagtccttctctcgttcgcgctaaagaaggtggacctgacggccaatcgaagcaaacaaatcgtggacagcatttccccgattggagcgttaactctggaagctggcatactccctttcctcggcctctgcctctccacggtgctcggagagaggctcgcgtggctcgtattggcctcgaagctgctcatccacctatgtgtcattctcctcatggctctagcctttgtgattctgctgctcatcagcaagagtaacattgtctgcctaagcatctggatccccttcgtccccttcatcctatggctaggctacaactccgtgaaggatgaggagcatgagaacgccgacgacgccacgaaatcagcccaccacgggaagctggaaatctcggttgatttctctgctagtatcacctcccttctgttcctgggattaaaaggtcttgcgttggagggacaggccagcgccatcaaggggctggatgctcacctttccgactccctcatcgtcagtttcgtgacctgcgtcctgggtgtagtcttcatgcttgttggaacggctccaccggtgtacggcatgggccgcttggtggattccttgaggatcttggatacctctctggcaatagcgttcggggtgatcgtcgtgctaatcacaattgcacctctgaaggaggcggcgtggttagtatccatcccgtggatcctttcctttttcgtgtggttgttcatccgtttgttcgaccacgacgagggagaggacagggatgtgaagccggtgtctctagagctgaccaaggccgcgttcacagggttcttggccgtctccataccgagcttcagcaatagctccaccagcggcggctacacccacgctttcatagtgcttactgggtcagctgtcctcgctggcctcgcgtggaggctgatcacgcacgtgaagaagccgtcgcgagccatggtctgggctgaaaatgtagcttcttcgtgtgcgcacatctgtgttgcggcggctgttgttccatttgcaagcatatccatgacggtgctcaggtctctcgaaagttag

SEQ ID NO: 4998 - DNA, 2083 bp, Oryza sativa
  Predicted polypeptide sequence is orthologous to G1635
tgagtgcgacggggcctacgtaacgctcgcttctttgcctcctcgttcccttctcctcctcatctccccccatctcgtcgtcctcatcaacaacatcgaggagaaaactcgcaaagattgcggggtttgggaggcgctgattttttggctttggtgtggcgatcctgtggagtgtggtttggtttgggaggagttcggttttttcagaatggagatggcctgtttgccgggaaacgccatggcaaccgacgaaaacggtgccgacgatcgcgccggcggcgagagcaccgtggatcatctcaggagccatatgaactacggcgacatggatttgtcaggggaagagcacgtgccaaaggcgcgaaagccgtacacgatcacgaagcagcgcgagaagtggacggacgaggagcacaggctgttcttggaagccctgcagctgcacggccgcgcatggcgccgtatacaagagcacataggtaccaagactgccgtgcaaatccgtagccacgcgcagaagttcttctctaaggtcgtcagagaatcttcggggagtaacaccggctcgggcggcgcgtccgccgcggcggcggcggcggccatccagatccctccgccgcggccgaagaggaagccggcgcacccgtacccgcgcaaggtggacggcgcggccaagaagcacgtcccggcgctcaggcagctggagaagccgccgttgtggatgcagtccctgtccgagcaggaggagggctcgccgacgtcggtgctgacggcggcgcaggtaggcaccgaggccctgggcggtgggttctcgaataactcgagcggcagcgggtcgctggctccgtcagccgccggtacggatgagcatgtcgacggtggcggctcgccggcgtcgtcggtggacagagaggacgggtgcctctcaccgagcatcccgactgctgagttggctatgcaggcgccaaatactaagatgtcaattgcaaccacggatgccaaagaagcatcctcagaagcatcagtcttcaggctattcggaaagagcgtagtggttaaggattcagaccagctgcacctgcttaatggcagtaacattgcaacgagtggttcagttgagagagcaaccagaaacatactagtaccttcttttgctgctgccccagaagggagctcgtcgaatccatggccgagcagcatgcaacagtttctctacttccttcctcgatcggatggtttcgccgcgcaacctgtcatgccatggttgagctacaacgggagccttccatgcgcgctgttctacccggcggcggcggcggctgcgaaccagcagtgccaccgtgattcagagggcgtagagttcagagtctcgcagagggaaggatcgctgacgggctcgaacacggcctccagcgtcgtgcttggatcgtcggcggcggtaccggcggcggcggcggcggctcagaattcggacgtcgcggagtcccgtggccaagggaacagcagggaggcggcggcctcgccacggccgaccaagtgcgagagctcggcgtccgtcaccctgctgcagaggggcttcatgccgtacaagaggtgcgcggcggagagcgagctgctgcgatcggaggccgccggaggagaggaggccgtcgccgacggtgagctgacaaggctgtgcttgtgacaactgactcgtcgcacggacacgtcacgccacagtacttctattcgtaggtgacaaataacaaatctgacatgagattaaggcgggaagaagaggcatgtcctgctgttaggatgttgctcgagaccactttagttttccagaaaatggaagagcaattctggtttttactcgtcgatatagtattgtataatctgtaagataacaacttttgtacttttttttttactttgcctgtaattttatccccaactcgaatacgttcagagttgagtggctgtcaatgttgccttttatcaacctgaatctcggacaggggttgccataggctaactacatgtaatctaggcttgtatctctccacaaaatgcaatggaaagacgaggaaatgttggatgc

SEQ ID NO: 4999 - DNA, 2082 bp, Oryza sativa
  Predicted polypeptide sequence is orthologous to G1635
tagtgcgacggggcctacgtaacgctcgcttctttgcctcctcgttcccttctcctcctcatctccccccatctcgtcgtcctcatcaacaacatcgaggagaaaactcgcaaagattgcggggtttgggaggcgctgattttttggctttggtgtggcgatcctgtggagtgtggtttggtttgggaggagttcggttttttcagaatggagatggcctgtttgccgggaaacgccatggcaaccgacgaaaacggtgccgacgatcgcgccggcggcgagagcaccgtggatcatctcaggagccatatgaactacggcgacatggatttgtcaggggaagagcacgtgccaaaggcgcgaaagccgtacacgatcacgaagcagcgcgagaagtggacggacgaggagcacaggctgttcttggaagccctgcagctgcacggccgcgcatggcgccgtatacaagagcacataggtaccaagactgccgtgcaaatccgtagccacgcgcagaagttcttctctaaggtcgtcagagaatcttcggggagtaacaccggctcgggcggcgcgtccgccgcggcggcggcggcggccatccagatccctccgccgcggccgaagaggaagccggcgcacccgtacccgcgcaaggtggacggcgcggccaagaagcacgtcccggcgctcaggcagctggagaagccgccgttgtggatgcagtccctgtccgagcaggaggagggctcgccgacgtcggtgctgacggcggcgcagataggcaccgaggccctgggcggtgggttctcgaataactcgagcggcagcgggtcgctggctccgtcagccgccggtacggatgagcatgtcgacggtggcggctcgccggcgtcgtcggtggacagagaggacgggtgcctctcaccgagcatcccgactgctgagttggctatgcaggcgccaaatactaagatgtcaattgcaaccacggatgccaaagaagcatcctcagaagcatcagtcttcaggctattcggaaagagcgtagtggttaaggattcagaccagctgcacctgcttaatggcagtaacattgcaacgagtggttcagttgagagagcaaccagaaacatactagtaccttcttttgctgctgccccagaagggagctcgtcgaatccatggccgagcagcatgcaacagtttctctacttccttcctcgatcggatggtttcgccgcgcaacctgtcatgccatggttgagctacaacgggagccttccatgcgcgctgttctacccggcggcggcggcggctgcgaaccagcagtgccaccgtgattcagagggcgtagagttcagagtctcgcagagggaaggatcgctgacgggctcgaacacggcctccagcgtcgtgcttggatcgtcggcggcggtaccggcggcggcggcggcggctcagaattcggacgtcgcggagtcccgtggccaagggaacagcagggaggcggcggcctcgccacggctgaccaagtgcgagagctcggcgtccgtcaccctgctgcagaggggcttcatgccgtacaagaggtgcgcggcggagagcgagctgctgcgatcggaggccgccggaggagaggaggccgtcgccgacggtgagctgacaaggctgtgcttgtgacaactgactcgtcgcacggacacgtcacgccacagtactactattcgtaggtgacaaataacaaatctgacatgagattaaggcgggaagaagaggcatgtcctgctgttaggatgttgctcgagaccactttagttttccagaaaatggaagagcaattctggtttttactcgtcgatatagtattgtataatctgtaagataacaacttttgtacttttttttttactttgcctgtaattttatccccaactcgaatacgttcagagttgagtggctgtcaatgttgccttttatcaacctgaatctcggacaggggttgccataggctaactacatgtaatctaggcttgtatctctccacaaaatgcaatggaaagacgaggaaatgttggatgc

SEQ ID NO: 5000 - DNA, 1795 bp, Oryza sativa
  Predicted polypeptide sequence is orthologous to G1638
gaaggcccaatcaccagctgccactctcaagaacctgactttggatcgctatcccttttgcttcttattagtgctcagggaaagaaagctatagcagtagctaaataagccagagagaggctaagagagagagaggtgaggggagagaagaaatcctcgcagaattcgagcaagaaccgagggagatcgatcgcctcttgtcctcgttccgaggcagagatcgacctgaagtgagctgagctgcggcaaggaggaggaggaggaggaggaggagaaggagattggagatgatgatgagggatgtgtgcatggaggtgctgcctccgatggaccactacgcgtcgagggggaactggttcatggcgcgcaagtggtcgccggaggagaacaagcagttcgagcgggcgctcgccgggctggacctgcggtgcccggactgggaccgggtggcgcgcgccatcccgggcaggtcggcgctcgaggtcatgaaccacttcagggacctcgagctcgacgtccagcagatcgagaatggcatggtgcccttcccggtctacggcgccgccgccgccggcggcgcgttcacactgcagtgggatggcgcccatggcgtcggggacttcaggaacgcgtaccggttcggcggcggcggcggcgggaagcggcacttcggccgtacgccggagcaggagaggaagaaaggcgtgccatggacggaggaggagcacaagttgttcctcttaggactgaagaaatatgggaaaggggattggaggaacatatcccgcaatttcgtgcagacgaggacgccgacgcaggttgccagccatgcgcagaagtatttcatcaggctcaactccggtggcaaggacaagaggagatccagcatccatgacattaccacggttaacctgacggatgaccggcctccctcgccatcacagtcctccttgatcagcaatcagtccaacacatcaactctgaccgcagcggttgcccccttctcatcgacggccgatgtcaagccacagaatgccgcgaatgcgtccttcaattcgccaagccggacacttgggatggcgggttacgggatgggattgcaagatcaaggattgcagtgtggtggtcctctacatgatcagttggccgcgagccgaagcatattgttttagatgaaaccaatccaggcagcaccatggatcagatgtctagtgtaatattgccctgcttgtagcttcatcactacctgtattgaagtaattaattatggggaatttttcggaacataacagagggggtgtggagggatctttgtgccatgttggtgactgataacctgtgatccataattgttggcaatactgagaatgtaacgaaacgaacgtcaagaacttgatgccggtggtattttcagacagtgattgctgctagtgctgaacactgatcatgcatgaagtggactttgtattcaatcatggatccagcttttgtgaggtggatgaggagaattctattcactatgttcttctggtcagtgatgcactgagaaacaccggttgccatctgattgaggggtttcagatcatgctgtacttcacacatacttatccacagttctatcaatttgctcattggtgctccccccatttgatgtttgcatagaatttatttggataaacggaaaataagtttgctctgagtcattcagcattattactactttcagttgctcatctagtcaacttttcttgtttgtagcttcatttttataataaaataataacttctttttttt

SEQ ID NO: 5001 - DNA, 1527 bp, Oryza sativa
  Predicted polypeptide sequence is orthologous to G1638
atgatggcagaggcgcttcgggaggtgctaccgctgccctacttccccgggcagccgtgctggtacttgcaggagcggcgaggtgcggaggcgtggtcggcagaggagaacaaggtgttcgagagggccctcgcacaggtcgacctggactcgccgaacaggtgggagatggtcgccgcgatgctgcccaggaagacggtcatagacgtgatgaaccactacagggacctcgagaacgacgtcggctccatcgaggcagggctggtgccgttccctcactacagcagcagcttgtccccggcgtcctccgggttcaccctgcaggactgggacggcagcgacggcgggttcaggcgcggctgctacctcaaacgcggccgcgccccggaccaggagaggaagaaaggcgtcccgtggacggaggaggagcacaagtcgttcttgatggggctgaagaagtacgggaggggagactggaggaacatctcgcgctacttcgtgacgagccggacgccgacgcaggtggccagccacgcgcagaagtacttcatccgcctcaactccggcggcaaggacaagcgccggtctagcatccacgacatcaccacggtcaacctgccagaagaagacaccagcaacccctccccatcgccgccgtccgtgctcaccaccgcctcagaccagctcggctccctcgtggacacgaaacccgttcccccgccaccgtcactcggcgcgcaacggcacttcatgtcgccgctgccgggagcgctcggcgtcagccaccacccctacggcaacgtgaagctagagcccaatgcctcgttcttggccggcggcgatgcaatgcggacacttgtgacggcggttctcagcggcggagaaccgcacaaggaggaacacagagcaccgcctccgatcatatctacgggaacgacgaggctccggccaagtcgcagtcccgtgtcagtgtgtgattggctagccagttggttgcagagttgcttcatgcgtctcaggatcgcaaagtactggacggaagggccactaaccggttactgttttgatcaggaacaccagggctttccgagaaagagaaagcgaaaggctctgcttgatcgatgcgactatacaattcactgcatgaatctttcacttgattgtttgttcggcaagccgcaccgaccagcctcagccggaggtcagtgtatctcaacgccgacgccgtcggcgatcccgattcccgaccgaatgcatggtgaaataggagatcacagaccggagataaagtggcaccggtgctactgccgctttgtgttgtgctccagcgacttttgttcgtgcgaggtggaggaaagtgccagtactggcggtggtgcgctcctttccagcatttgctctgccattgggcacggcagggagagtgaaagcatcatcgacgccatcgcgcttttggggcgtcatgtccgccctcgccttcgtgcaaatattcagattctgcaaatggacgatataattgaggaataa

SEQ ID NO: 5002 - DNA, 826 bp, Oryza sativa
  misc_feature (2)..(2): n is a, c, g, or t
  misc_feature (51)..(51): n is a, c, g, or t
  misc_feature (813)..(813): n is a, c, g, or t
  misc_feature (819)..(819): n is a, c, g, or t
  Predicted polypeptide sequence is orthologous to G1646, G715
tngggccgaggacgagacaagggggctcatcgaccacaccataaattggtnacctgcttcaacatcttgatataagaaaggagtaaagaaatggcgattccaacaaaggaggaggtggagcagaatgaggaggacaatacattttcaaggttgcaattgcttgcacaacaacggcatgccatggaggaattctggaggaggagccaggaacaaattgaggcatctgcaggcaaccatgagcatatactaccaattgactgcgtgaagaatgtcattcgaccaaagaatgatgctatgatgctatctgctgacacaccaacttttgtgacaaaactttgtgagctcttcgtgcaggagctcaccctccgtgcatgggtatgtgccaactctcacaaccgtgacatcatattaggcacagacattgctgaggcaatcaccaccactgaatcctatcactttcttggtaatgtacttcgtagccacaaggcactaggaagtactgctcctgacatagatacttctgctaggaagcatattaagctagaccaaatgacctcactctaccatcctacccaagaaatgcaggcctcacgtttagctgggtatccaccccatgttcctatatatcctcctataggtcaaatgggaactcaacacaagctgtctccattcgctttcatgatgcaagggagaatctcttctcaacatgaaaagagaaaattccctagttaatgaagtgatggtatgcaccaacaaggatgagcataaacaactttgatggagctactagtattggtggtggtagtagtaagnggatgntgctatt

SEQ ID NO: 5003 - DNA, 962 bp, Oryza sativa
  Predicted polypeptide sequence is orthologous to G1646, G715
gctccgcatcggcagcaaccgttgcgaccaattcccccaattccattccattcccctcctcccccggagagaaaccctagcaatggagcccaaatccaccacccctcctccgcctcctccgccccccgtgctgggcgcccccgtcccttacccgccggcgggagcctaccccccacccgtcgggccctacgcccacgcgccgccgctctacgccccgcctccccccgccgccgccgccgcctccgccgccgccaccgccgcctcgcagcaggccgccgccgcgcagctccagaacttctgggcggagcagtaccgcgagatcgagcacaccaccgacttcaagaaccacaacctccccctcgcccgcatcaagaagatcatgaaggccgacgaggacgtccgcatgatcgccgccgaggcccccgtcgtgttcgccagggcgtgcgagatgttcatcctcgagctcacccaccgcggctgggcgcacgccgaggagaacaagcgccgcacgctccagaagtccgacatcgccgccgccatcgcccgcaccgaggtcttcgacttcctcgtcgacatcgtgccccgcgacgaggccaaggacgccgaggccgccgccgccgttgccgccgggatcccccaccccgccgccggtttgcccgccaccgaccccatggcctactactatgtccagccgcagtaacattttcctaccgtatagcttcaagtttatttagcgatttttatttatggaatgcttttctgctgttgtcgtagttgttattatgttttgcttgttgttgccgtgtaataactagaagatgtgattatcattgtgaggagcctcctctcggtgtataaacaatccgatttgaggattgggcgagctttgttgcgattgaggaaggctgtatggtggttttgatgcatgtctaacttatatcacaatgaattatttattaccc

SEQ ID NO: 5004 - DNA, 921 bp, Oryza sativa
  Predicted polypeptide sequence is orthologous to G1646, G715
aagtgaagagaagcagcaaagagagagcttttccatccccaaatcccctcctcctcctcaaaccctagctaagctccgctcgcagcagcagctgcagatgttctgggcggagcagtaccgcgagatcgaggccaccaccgacttcaagaaccacaacctccccctggcccgcatcaagaagatcatgaaggccgacgaggacgtccgcatgatcgccgccgaggcccccgtcgtgttcgcccgcgcctgcgagatgttcatcctcgagctcacccaccgcggctgggcgcacgccgaggagaacaagcgccgtacgctgcagaagtccgacattgccgccgccatcgcgcgcaccgaggtgttcgacttcctcgtcgacatcgtgccccgcgacgacgccaaggacgccgacgccgccgcggccgcggcggcggccggcatcccccgccccgccgccggtgtgccggccaccgatccgctcgcctactactatgtgccccagcagtaatgtatctgattaacccctttcaagccttttctaagcgaaggatgtgttgttgtttgttgttgctgttgctgttcttgttgttgttgttgccgcgtaataagatatgttgataatttatggcttcccctgagcttaaagaatttgagcttttggttctagaatctgggtaaaattgttgtaatggggaagactgtatgactgtatttgtagtgcatgtcttaacttgtcggatagtgtaatccgataattattatgcggttagctggttacctctcatgattactgtgctcatgtgctgtgcaatttatgttctttgttttggatgtacaatgctgtaaccagaatttggttgtgtaaggaaactattaaaggttgtgcgagggcagtgtggctatcgctgcattttagcttac

SEQ ID NO: 5005 - DNA, 1476 bp, Oryza sativa
  Predicted polypeptide sequence is orthologous to G1646, G715
cagagcaacgaagggaaggaatggagcaaactttggacgtacctagatcgttgagactactggcgccaaaagctcaacaacaaatggatgaattttggagggatcgacaaaaggagattgaaacaacaaaggactttagcgagcatgcgatccctatggcccgcttgaagaagatcgtatcttctcaaaagggtaacatgatgatgacctttgacatgccagcattcttatcgaagatgtgtgagctcttcgtacaagaacttgctgtgcgtgcatgggcatctgctcaatcccataatcgttgcatcatactagacacggatattgctaaagccattgcctccacagagtcttatgactttcttgttgatatcctccataatcatcgtgtgaaacacaaatccactccttgttctacacttactacaaagcgttgtaggttagtcgatcaaccttccacatctcacatgccctaccaacatcagctgccacaatttgctcctacatatactccggccatccctattactcctagtttaatgccaccaatttctcactatataccgttccaatatccatccttatcacaagaagtgtccccgatgatggcttctgcacccatagtgaatagatcaatgttgctcattcacaacatagcaaggggtctaggcttacaaggaaacaatatcagcacgttcgccaacaataatatcccagacaatattgttggttgtagtagccccacagttcttgcaagtatgatgagtcctgctttactagaagttgcagggacatcactaaatccaccaaactctcattccatctgcacaatgaacatgatcaactcgagtgatcctagtggatctagtattggtgacattaatgttgcaaatcaagcaagtcttgctccctctggacgttttaaccctgctatccttcgagagtcatcatgtccttcgttcttacatagtaacaatgacacaattgttgctataccggagggtgtagatattagtggcaccatggatgttgctagtgatgttgctgctatagttatcaatggtcaagaagaacatgagagggaaacaaatgttgagcatcatcagcaaaatgagatatatgaaagcattgatataggaataatcaatgcaagtgttgcggatgataataaatatagtattagctgggatgaattgggaatggctgatgattcattgctagacaaatttttggaggagtttcaagtaagaaatgacggtgttttgcgcactgggattgagttgcatgaagacccattccttggtgacgtgatgttagcaaacccaagtacaagcaatgccaataagtaatttagttggcaagttttgtttatatctcttttgtaagaatgaggttggtaactttttcttgttgaatataatgtttgcagcggcggacctatgtggggtgccgggtgtgcaccggcataaaaaaaaa

SEQ ID NO: 5006 - DNA, 1266 bp, Oryza sativa
  Predicted polypeptide sequence is orthologous to G1646, G715
atggagcaaactttggacgtacctagatcgttgaggctaccgacaccaaaggctcaacaacaaatggatgaattttggagggatcgacaaaaagagattgagacaacaaaggactttagcgagcatgcgatccctatggcccgcttgaagaagatcgcatcttctcaaaagggtaacatgatgatgtcctttgacatgccagcattcttatcgaagatgtgtgagctcttcgtacaagaacttgctgtgcgtgcatgggcatctgctcaatcccataaccgttgcatcatactagacacggatattgctgaagccattgcctccacagagtcttatgactttcttgttgatatcctccataatcaccgtgagaagcacaaatccactccttgttctacacttactacaaagcgttgtaggttagtcgatcaaccttccacatctcgcccgccctaccaacatcagctgccactgtttgctcctacatatactccagccatccctattactcctagtttaatgccaccaatttctcactatataccgttccaatatccatccttatcacaagaagtgtccacgatgatggcttccgcacccatagtgaatagatcaatgttgctcattcacaacatagcaaggggtctaggcttacaaggaaacaatatcagcacattcgccaacaataatatcccagacaatattattggttgtagtagccccgcggttcttgcaagtatgatgagtcctgctttactagacgttgcaggggcatcactaaatccgccaaactctcactccatctgcacgatgaacatgatcaactcgagtgatcccagtggatctagcattggtgacattaatgttgcaaatcaagcaagtcttgctccctctgaacattttaaccctgctatccttcaagagtcctcatgtccttcgttcttatataataacaacaatgacacgattgttgttgtaccggagggtgtagatattagtggcaccatggatgttgctggtttagttatcaatggtcaagaagaagaacatgagaggaaaacaaatgttgagcaaaatgagatatatgaaagcattgatataggaataatcaatgcaagtgttgcggatggtaataaatgcagtattaggtgggatgaattaggaacggccgatgattcattgctagataaatttttggaggagtttcaagcaagaaacgacggtgttttgcacagcgggattgtgttgcatgaagaccattcctag

SEQ ID NO: 5007 - DNA, 1283 bp, Oryza sativa
  Predicted polypeptide sequence is orthologous to G1646, G715
atgccgatcccggaaaaggacggggtggaggacaatcaagaggatgatacattttcaaggttgcaattgcttgcacaacaacgacatgccatggagaagttctggaggatgagccaggaacagatcgaagaatccgcaggcaacgaagagcttatactgccgatttcccgtgtcaagaatatcatccatgcaaaggagggtggtatgatgttatctgctgataccccagcttttgtaacaaaactttgtgaacttttcgtccaggagctcatccttcgtgcttgggtgtgcgccaactcacacaatcgtgaaatcatacttggcacagatattgctgaggcaatcaccaccacagaatcctatcactttcttgctaatgtagtccatggccaccaggcgctaggaagcaacataccagagataggggtttctgcttggaagcgccataagctagatgaaatgacctcactctgccatcctccccaagcagtgcaggtcacagatttagctaaccatccacccaatattcctgtttgtcctcctataggtcaatcgggtactcagcacacaacatctacacatgttttgatgatgcaaggagaatctattcacaaggcaagtaaagaaaaatccccactgaaggaagtgatggtgccgaccaacaaggtgggcatgaccaacagctcttatggagttcctaatggtggtggtgctactagtagtaaagttgttattgatagcccgaaaggcgaaacagcacaagttttctcttcccagcatgcatgtccttccctagaagataactatgttattcccattcctgctggacatggtgatagttttcgtactcttgatgaggccaatataccccagctacatcaggagcagaaaaactttatttcacaagatgctattgttggtgaaaacattccgctgaatgagtctttggaaaagagcaagcataaggatgaggacttactttttcctgacaaagatcttcctgagtgatctacaagacagaagatgaatttcatgacaatactaggaatacaaaataagcaacgaactgaagaaggatgcatcctggttaatccatcgaccatgtcttagtagagttttcttctgtgtttctgtgttgaagctttatgatttaccttatactttagtcaagatgaataagaaataagtatgtgtttccgtgtgaggcggtaatatgtagtaccttgtatttccatccatcttcgtatggacaataataataagacctctgtttgcttcatgat

SEQ ID NO: 5008 - DNA, 1095 bp, Oryza sativa
  misc_feature (775)..(775): n is a, c, g, or t
  misc_feature (822)..(823): n is a, c, g, or t
  misc_feature (825)..(826): n is a, c, g, or t
  misc_feature (828)..(828): n is a, c, g, or t
  Predicted polypeptide sequence is orthologous to G1646, G715
tttttttttttaatcggctatatattacaaattgaaattaattagtagattgtacatcccttaattagcttgagcgtccattacgtacatcggttaagttaatacgtaccacattaattaattaccgacacattgagcatttgatttgagcagctatagtagctagctagcacctcagcgatgcatgcatggaaccatatggatcatcactattcggagcttggaggtgcaggagggaagccagctgccgcaccgccatggcctgcaaaaccttgctgcccttcctcgctgaagctgccggcggcgccctggtccacatccggcgctgctccttgctgccacgccgggtcccacgccggaacatgccacgccggcatcatcggcgccggctgccccatcggcgggtagtagtacggcagccccgcggcggggccggccgctccaacggcgccggcgggccctcccgccgcgaacccgagcgcgctgccgggctcctccttggcctcctcccgcggcacgatgtcgacgaggaagtcgaacacgtcggtgcgcgcgatggcggcggcgacgtcgttgcgctgcaggtgcggcgcttggcccctcggcgtgcagcacgagcggatgtgagctccgaagaaaagccgcagcctggcgaacagcaggcgctcgtcgaaaatagccgtccgtcgagtagatatgaagggccggagggggtgttaataacgcgcgcgcccctccgggtggtgcacccaagggcgccgtgagagtgatgccnccccactcccgccgcgctctgtaccgcgcgccagcgcccgcacgccnncnnangagacagagagaggcacacagcagggagcaagagagacaggggaaagaggcaaagagagagaagcgaagcgagagaagcgagaacggagaacagcgaggagaagaagagagcacgaacgcgaaagggcgacaaccagacgagacaaacgcacgaaacgaaagcaagaacgagaaaggagaaacgaaaaacaggaagaaagaagagagaagaagaggacgagagagatagaagcaagacgacagagaaagaacagaagcaaacagaaa

SEQ ID NO: 5009 - DNA, 2113 bp, Oryza sativa
  Predicted polypeptide sequence is orthologous to G1660
gaggtggcctcctccccgcgattcccgtgtgaatttgctctttcttcccggatttttcgactttcttcttcttcttggtttgctcttcttctttcttggcggtctgcacccattcggagtccgagctcatctccgagtccatggcgcctctcgccttcgatggctggaactgaaatactaggcattagcgccacttatcttgcttcgatttggtaaattttgctcgattccttcatcgtggagttgtgctgttcttcgtactggaggtgtgtcctttttaatgattgctaatattcttggaaagcaggcacgcctgccattgctgaactcgatgttttctcatcgattggtcgggatattgccgttgatagattcccctgcagtgctccttttcgtctcttccattctcctctcaaattcgccttgacattttggtcggcactgtacttttgtggtggtggccactggccaacaatgttcaggcctggaacgatcgcctgtgtggctaattcggcgcgcattttgctgaaaagtttgcgggcttttatcctgtttgctgctctaccgggtcactgctctgccagttttgtctcaatttctgtgatgctttctgtgccatagctttcaaatgttggctttggtaaggaggggattgagataggttgggttatctgagtgcacacttcactaaaaagtttggatccttttgtccattctgctgtgattccgtcggaatttggcaattttcgcatcgggtggattctccccagctaagctacgagcaatgcttctcggactagagaaaaatcagcacaacggggaggacacatcgcctgaggccaacgattccggcgagctggacgaccagaggagcatggagtgctccacctccaccgaaatgtcgagcaacagtggccacagatcaagaaaccgagctcaggacgacgacagcttcgactccgagagcagctcgtcgggcccgccgacggtgaagaggccggcggcggtgaccgccttgctgccaccgttctctaggccgacgccgtcgaagtgggatgatgcagagaagtggatttctagccccacggcgaaccgcggtggccgtgtggggagtgcagctggggctgcgccgaagaaatcggcgctggcatttcctgaacatgtaagccggcctccagccgttgctaaggtggttgctgaggtccccatcaacactggaaccttggtgaagaattcagttgctctcgcacagcctatttcatttaatcctgcacaaagtgcttcgatagttgatgaaccagctcctgcagttaggtctgtttcgatgagagacatgggcacagaaatgactcctattgccagccaggagccctctcggactgggactcctattatagcttctagtccaacctcctctcggacaccaacaccacaacgtaatgcagaaatcagtattggtgaatttggtccaaataagatggaaatgtctgaggaggaactacaaatgaatacaagaaaggaaatcatggatcttggccaacggctgggaaagacaactatagctgcatgggctagcaaggaagagaaatctacaacaagtttcgcaaatgtcataaccgacaaggctgtagaaatcgacagagaggctcgtgctgcagattgggaggaggcagagaaagcaaaatatcttgcaaggtttcagagggaagaggtaaagattcaagcttgggaaaaccaccagaaagcaaaaattgaagctgaaatgaagaggatggaggcaaagatagagatcaagagagctcgcgagcaggacaggctttcgagcaagttggcagctgcaaggcaaggcagaggcgaggagggaggccgctgagtccaggaagaaccaagaagcagcaagaactgaagagcaggcggctcagatccggaaaaccgggcacataccttcctcaatctcctgctggtgctggtgcctgtgattcttcactctgccatgatcatctgttatttgggtagaagaaaaatacttgctccttgcacgaccatgtaaaatattcgctactggttggttcatcgttcagtgatcaatgccaatgagtcgccatttttgtcc

SEQ ID NO: 5010 - DNA, 1874 bp, Oryza sativa
  Predicted polypeptide sequence is orthologous to G1660
gagcttttaactgctcgtctcatcactctccacctctctccctctctctctcttcctcgcgctcccacgccacgcagcagccgcagatctccacccgcctccggcgagcccgccgccgccgccgccgccatggagtacgagcgcatcgagaagccgttccccacccagggcggtgggttctcgccgaagcggctgcgcgcgatgttgctgggggtggagaagcggcggaaggggcaggaggaggaggaggagggggacgccggggaggtggacgacgagtacggcgcggtgcccaagtcctctgtcagatccgacgccgactccgatgcgcgcagaggaggtagcatgtgcgaagaatacaaggatgtagatgtggtgagcaccatctcagaatcttcatcctcgttggagacagggagtgggcaccgatcgcgtgacacccactccatgggttcacgagtaagggtgcctgaggaggactcctgtgactctgagagtgtggcttcaaactttgagttccataaggagcgaggggcctctgctcggtctgtgacggcggcaatcgttcctccattctcaaagcctgcaccatcaaagtgggacgatgcccagaaatggatcgccagcccgacaacaaaccgtcctggtagggctggtggagtgccacagaggaagatggaaaaaactagctttggtggcgggaggctgccggctacgaaggttgtgttggaggccacagaggagatagatactaagagggttgatccaagccaagagaaaagggaaattgggtggcaaaaagcggtgaattgggccccacctgatccatatccagaagttgagacttgtgcaaagtctgcacttgctgaagaaattacagtagctgattcagctgttacttttagtcgccatgattcatctgccacgcttcagagcgcgacaacatgcatacctcccccaccaacagtccgatcagtgtcaatgagagacatgggtacagaaatgacccctattgcgagccaggagccatcccgaacaggaacaccggtgagagcaacgagtccagattgttctcgcccaactactccacgaaaaacaataggccccaatgcaatcggtgctgttattggccatggtgaatgtagcaacgtggaattaagtgaacaagaattgcaaatgaagactaggagggagataatgctcctcggcactcagcttggtaaaaccaacattgctgcatgggcaagcaacaaggaagaggaaaaagatgcatcactttcgcttaaaggagtgcccatggaccaatctacacagaaggtaacagaaattcgtgcagcagcgtgggaggaggcagagaaggctaaatatttagcaagatttaaacgagaagagattaagatccaagcatgggaagatcatcagagagcaaaaatcgaagctgaaatgagaaaaattgaggtcgacgtggaaaggatgcgagcccgtgcgcaggacaagctgatgagccagctcgcatcggcgagacacactgccgacgagaagcgggccgcggcggagctgaaacggagccgtgcggctgcaaagacggcggagcaggcagaccacatcaggagaaccggcaggatgccgtcctccattggctgctggaactggtgctcgtagtagcgtagctaagctcaagcaactgaagcaagcaaaaagctctcctcactatgtctcgcaagacttgaagcgccatcatctgtttttaccgtgatcttgtagaatattgtcttttgattggtttcagtagatataagtcagaagaagacgagtcacttgtaagtaactatggagcagtatataagatgcaagcttcttgcctttttctgtgc

SEQ ID NO: 5011 - DNA, 1790 bp, Oryza sativa
  Predicted polypeptide sequence is orthologous to G1666
gagccttgtggacagagaaattaaacagttaagttctagatttctatcgtggtgatggcatctgctcctccagttcaggaagaagccctacagccagggacgaaccacttcaggagccggcttgctgctgctgtgaggagcatcagttggagttacaccatcttttggtccacttcaaccagtctcccgggagttctgacttggaacgatggattctacaacggcgaggtaaagacgaggaagatatccaacttagaggacctcaccgctgaccagctcgtcctgcggagaagcgagcaactgagcgagctctactactctctcctgtccggcgagtgcgaccaccgggcaaggaagcccgtcgccgcactgtcgccggaagatatcgcggacacagaatggtactacgttgtctgcatgacatacgcctttcgacccggccaagggttacccggcagaagctatgcaagcaatcgatctgtttggttgtgcaatgctcagtctgcagatagcaaaacctttctacgtgcgctcttagcgaagagcgcgtctattcagacaattgtctgcatccccttcatgagtggcgtgcttgagctgggaaccactgatccggtttcggaggacccaaacttggtaaaccgaatcgttgcatatttgaaggagcttcagtttccgatatgcttagaggtaccgagttctactccttctccagacgaaacagaagatgccgacaccgtgttcgatggcctcattgaagaggaccagatggtcatactccagggagaagacgagctaggcgacgtcgtcgtcgctgagtgcgagaccaacggcgccaaccccgaaacgatcaccatggagaccgacgagttctacagcctctgcgaggagctggacctggacctcggttcttatcagctagtcccgacgtcggcacgggagacggtggctgcggcggcggcggcggctaacgatgtcgacggcgttgcatactctcacgcctcgtgtttcgtgtcatggaaaagagcgaacccggcggagaaggtggtggccgtgccgatgactgcaggcatagagtcacagaagttgctgaagaaagctgtaggcggcggcaccgcatggatgagtaatattgatgatcgtggtagcgtggcaataacgacgactccaggaagtaacatcaagagccatgtcatgtcagagagaaggcgccgagagaagctcaacgagatgttcctcattctgaagtcactactcccctccgtccgcaaggttgacaaggcatccatacttgcagaaacgataacctacctcaaagtgttagagaaaagagtgaaagagctggagtccagcagcagggagccatcgcgttggcgcccaaccgaaattggacaggggaaggcgccgtaagatcaccgggaaggaggtctatgagatcggtgtcagtggtggtacctcgtcggtacctcgtcaacaccgtacgtatatgatatgcatgtataagatcaccgggcaggaggtctctgagatggatgtcatacggtgttgacgaggtaccgtacgtatgatatatagttatcgttttcattatggaaaaaaaattccgaattacctcgtgtactataaaagacgcgaatattagggaagaatctaatatcaaataattagaaggggtgaggtttcgaatccaggtcgtctatcacaccaccttgtgaagctagccggaaaacccctaagcgtttttttacctccatgtactattggtgccatctgaattaccgcttactaat

SEQ ID NO: 5012 - DNA, 2240 bp, Oryza sativa
  Predicted polypeptide sequence is orthologous to G1750
gtgacccggagtacaactacaacaacggcaatcgcttatcttgggatgacaatgccaaagatgaaacatatgcatatgtgcagcacaattacagttcgtatgatcgctcttatgatcagtcttacagtcttgatgccgtttccgatgaaactacttggtttcctaatcagaactaccagcacgtgtacaaagaggaggaatctcagtatcaggaaatcttgtccagctcttgtgcagaaagtaagatttcagctcagcctatttattgttacaaccagcagtttagtgaacaaccgctacatgttcttgttgagcccccagaaacagtttattctcagaagttggagtactatgagagcttctcaacatacaaccaccataacagcaacgatgattcagatatgttgggacattcatatgacatacagctgcccgatgaacatgtgccagatgaaccatttgaaccaattaagccttcttgggctatgcattcgggatactatcagtcctgcacagatggggcatctgctgaattcgaaaatcatactttaagctccagtgaattcagtggtattgcaagcttatttgcaacttccttctaccctcaacaaacacaaatttatgggtgtcatggagatgagaatgtttccttgcagcaaaattggcagtgcaactggaatgtggtttctgaaaatgatttccaatcggtaagcgtaacggtgtctatgtctgtgaacgtgcttttttaataccctatactcttatttttatcgctccattttactcctatttgtgtactgttgaatgtgtgtcatggtcggtacacatgtagttgaagtgctaaggatggcgcacagggggcagaaccaagcggcagcagatagaccatcaatgcatttgccgcacctatcgtacctccttagttgtttgattcaatttgtttaggttgagatttgttaaactttttaggtttgttaggggctggctttatttaagggagcttggcattatctttgaaattaagagcaaattacaagtctactctctcatcccctgttctctctgcctctccccttttttggtgctgcctggtgccatctcattcaaccatgggtagtaagactgttaacctatctagctacttcccactcctatcttattagatcactccctaacgcccgaatatattatattgttcttggcctcatgggtggctgatgacgatcaatgaaaacttcagacatgtctgtgagtgatgctttttttccccttgcaaacgatagaattatgaattagtatctgttttcgttttggatgctgtaaatttaaaatgtctggacctttatagtatgtcccgtgtatcctttcacattcttctgaaatatttatttttgctatttaatatgcaatccatgacacaatttgttttgttgctcaagaatggccatcacatgatctcatttgctgaagttcaaaatggcactgcttggctgcgattttttgcggctgcagctgtgcttaatgtctgtggctgtggtgcacagccgtggctactagcagcagacgcagccacaaaaatgacagccaaacaagcccaatatatctctttcagatttagttaatacttggttgctctttgttccatatattctgatgttagtgtaacttttatccacattcatgatctaccacacttgccagtgttagtagtaattgggatttacttgccaaaagaataattctcagactccagcagataagtgaggttaactctgtctttatggtatagttttcttaacaaatcagcaatctcagtacccttgctagacgattttaatgagtgttaatagtttggttgtttgtgctttgctggtattgttgctagatttcaactgaaacaatcttgtatggtgcccgcatcacatttttatggttgaaacatgagtgtgcaactgtgcatgcgatgtctccatgttgtcttttgaactgaaatatttctccatttttatttgcagggttacgattccaaccatatgaatggctacttctggccgtttggagatcattcagcataataccacatagtctatattgttgtaatttcactcttatcttttttatgtacatttcatttaaatttacccggccaaatgtaaatgaaaaaaatatatataagaggttatgcaccaatgtatctaggttcagcatataatgtaagatcattgacgctgttgttgacc

SEQ ID NO: 5013 - DNA, 917 bp, Oryza sativa
  Predicted polypeptide sequence is orthologous to G1752
atactcgatctattatttggcggcggctgcctctgcttgcttgtgactgtcgtgtctgtgcgtgtgtgtgtacgtacatactccagtatatatatgcattgctgcatgtcgcttcatcctcaccgccgccacggcgacggcgacgtcgacggatcagcatcaggatcaggatcagcgcgcctcaccgccggcctcatcaacttcctcgaatcgcgtcgcgccggcgccatgagcaccaccaacagctcatcctctgtctctgtcccagccatggacgcccatggacaggaggaggaggaggagccgatgcaggtgcagcaacagcaggcgttccgcggggtgcgcaagcggccatggggcaagtttgcggcggagatccgcgactcgacgcgcaacggcgtgcgcgtgtggctgggcacgttcgacagcgcggaggaggcggcgctggcctacgaccaggcggcgttcgccatgcgcgggtcggcggcggtgctcaacttccccatggagcaggtgaggcgttccatggacatgtccctcctgcaggaaggggcgtcgccggtggtggcgctgaagcggcggcactccatgcgagcggcagcagcggggcggcggcgcaagagcgctgcacctgcaccggcggatcaggaaggcggaggaggggtgatggagctggaggacctgggacctgactacctggaggagctgctagccgcctctcagcccatcgatatcacctgctgcacaagcccaagccaccactccatctgatctctactcgtattcctcacacgcgcagaggatgcacatcctctgcactacacttgtactagcagtggttaacatgtggatccggttccatgctctgattgttgcttatatttttcaaggaatataaacaaatccgatcctgagtt

SEQ ID NO: 5014 - DNA, 899 bp, Oryza sativa
  Predicted polypeptide sequence is orthologous to G1752
cttcctggaaagggaataatcaaacacgccccgtcacttcgccgcacacatcacagtgatcgcagccgctaagtcaaacattcccagctcacagagtcacacacatggagcaacacagccactgctggtactacggcggcggcatggctgtcaccgcagccgccggtgccggcgcggcgtcgtcgacatcctcggaatcgcagccgtctggctacgactacgagacggcggggagcgccgaggtgtcggcgcccggcggcggcggcgggcttcatcggcgtgcggaagcggccgtgggggaggttcgcggcggagatcagggactccacgcggaacggcgtgcgggtgtggctcggcacgttcgagacggccgaggccgccgcgatggcctacgaccaggccgcgctctcggcgcggggcgcggccgcggcgctcaacttccccgtggaacgcgtgcgcgagtcgctccgcgcgctcgcgctcggcgcggccggaggctcgcccgtgctggcgctgaaggggcggcactccaagcgaaagcggcggaagagatcagagctggccggtgccacggcgacggcgaacaagacgacgacgacgacgtccgccacgaccggcggggagcacaagcagatcgtcctcgagctggaggacctcggcgccgactacctagaggagctcctctggatgtccgagcaaactagccattgatgatgatgcgaacgaacctgcaaaaacatagctctcgcgcgcgatcgatcgcgagttcaatacttcaactcgatcacatccatgccttgcaatgcagtgtgtgaactcgaccgatcagttggtagtggattccatgtgaaaaaaggctgcaacgtaactgcttcaaatcgtgacataaaattggactc

SEQ ID NO: 5015 - DNA, 1492 bp, Oryza sativa
  Predicted polypeptide sequence is orthologous to G1752
gaaccaatcagcagctaaaagtcaatccacgccaccatcgatctctctatccaatccaagcgcgcaaatcaatggcagagcatttcagccacgccggcatgtacatcggctacacggcagacgccgccgcgtcctcctcctcctcctcctcgtcttcgtcgtcttcctcctcggagatgcttcggttcgacacgggctggcccgacgagacacctgcgccatcctccgtggcggggaggaggaggagcgcgggcggtgatcatcgtcaaggtcggggacagacggaggcggcggcggcgttcatcggggtgcggaggcggccgtggggcaggttcgcggcggagatccgggactcgacgcggaacggcgcgcgggtgtggatcggcacgttcgacagcgccgaggccgccgcgatggcctacgaccaggccgcgctctcggcgcgtggcgccgccgcggcgctcaacttccccgtggagcgcgtccgcgagtcgctccacgcgctctccctcggcgcggccgggggctcccccgtgctggcgctgaagcggcggcactcgaagcgaaagcggcgcaagaaagctgaactactcgccgccgccgccgccaccgccgcgacggcgaatgccacgccgcagacgcggaggatcagcaagagcacggaattgactactgcgacgacggacgagcagaagcggttcgtcgtggagcttgaggacctcggcgccgagtacctggaggagcttctctggctgtcggagatcaatggtggtagtgaccctgctgactgatcatccaaaaggttggcaatttgcaaggcacctcttgcgaattacatttcgcgcgcatgcagttgcaatggaacgtgcaaactgcaaaaagctgcatgcaagtatgcaactgcaactggaagtactacttgaacacatgcaagtatgcaactgcaagtactacttgaacacatgcatgtgtgttattgcatcctactacttgctgtctggctctctctagagtgccaataaagtgcagacaatgcaacacatgctggagcaagcaacaatttggtggtcaccaccatattatacgcacaacatgctgaagtattttcaaggtgtgtactttgggcggggactgaactttatgtctttatcggacacaaggacctacttcccaaaagctagctagcttgatgcatgcatcttgccccatgggtacacataataatattattaaactttgtatggcatgtgcccaaattagtactatcaacatttatatgtactagtatgaccgtgattttactctcgaaattcactgtacttaacaactttctatgctccctcgagtaattaaggtaaaagagagtaactcaaaaatacgttaagctaccattaaacactttcagcttgttgttaaacggaatactagctagtgtgtacaagaagatgaactgaatgaacaaaaggaaaatctagcggggaattggctcgag

SEQ ID NO: 5016 - DNA, 803 bp, Oryza sativa
  Predicted polypeptide sequence is orthologous to G1760
atggggagggggaagattgtgatccgccggatcgacaactcgacgagccggcaggtgacgttctcgaagcggaggaacgggatcttcaagaaggccaaggagctggccatcctctgcgacgccgaggtcggcctcatgatcttctccagcaccggccgcctctacgagtactccagcaccagcatgaagtcagttatagatcggtatggcaagtccaaggatgagcagcaagccgtcgcaaatcccaactcggagcttaagttttggcaaagggaggcagcaagcttgagacaacaactgcacaacttgcaagaaaatcatcggcagttgatgggcgaagatctatctgggctgaatgttaaggaattgcaatctctagagaatcagctggaaataagtctacgtagtgtccgtacaaagaaggaccacgtcttgattgatgaaattcatgaactgaatcggaagggaagtctagttcaccaagaaaacatggaattatacaagaagatcagtttaattcgtcaagaaaatgctgagttatataagaagatctacgagactgaaggaccaagtgaagtcaatcgggattcaccaactccttacaattttgcagtaattgaaaaaacaaatgttcctgtgcaacttggactcagcacactaccacaacatagtgacgccgaacaatcaactgctcctaagctagggttacagttgaatccatgaccagaaaaacattgttttgctacacccttgtatgctgaagggatactatttgctgtcaagagttgatactcagatcaaga

SEQ ID NO: 5017 - DNA, 1845 bp, Oryza sativa
  Predicted polypeptide sequence is orthologous to G1760
atcgctcgcggtcgcagtcgcagtcgcccacacccttgccgcaccatggctggaacccgcggcggattcgagaatcattagatgattacttgtggctttcttgcaagttgtgcagttgctgcctcaagcttgctgcctccctctgccaaatctatcagcaaaaaaagaaaatcatgtcagtttccttgaactatatacatatgattaatctagaaacgcagtatgttgccaaaaatcacacacaactcaatcacatatgcatttgagatgaggtaaaatgctatctgattcacatagttccaatatctcaagatgtgggatatgcgtagcacaagtgcatcagagtgttatagttgttcagtcttcagtacttattattctagattaatttggaccaacttgtcaattcagctgacacttgtttttgtctagtgctccagtagcttggttgtttcatcatcattagacttttaaacctttggtcctaaactcctagctgaaaaatttgcacactgaacttccctgtgttctaaggaaaaaaaaaatctagacataaccttgctgatctgtattatggaccggccattggagtgcataatgcataactgctgatcactttgttggcacaaaacttacgcatagacataggaggtacttatgtataattgtatctttaatcaggactttgttttcaaccattttgttgatataacagttatactgtagtaatgatgagtacagtctccaatgtaaactcagggcaaatcagatttatccctttttggtgcttggtatctttttgtatttttcatgagcgatggcatttttgaacccaaaatagagggaaagagaaggatctctgtgggggcatgctatgtactacagttctttgagaccatgtaggtgtggatgcttgttttgaccttttccttaacatatagaaagaataaacattaaataaatgatgacatggaaatgaaattcataaaggagtacataagctagtactcctgaaaatatcacttcatattcccccatgattcagtaacatgaatatcataccatcagcagcagtgaaatttttatgcgtagacggtttgtttcttaaggtatatattttttatgtttacaattgtctgtcgagtttactggtcaattgagcaacaacggtacttttaactgttaatatcacttggtttgctatgtatccttgttgttctggctttgttgctttacagccattctgcttacgctattggcatctgttatttagaaaaccattttctaacagtttttagatttcctttcgagtctccaactgtttttaacctccaagttgccacataatgcataaatataccgagtaagtttgcccccctctgaaatatggatgttagatactcagacaggttcagtatgtgttgggtgttgttttctgagtttgtggttgtcataagatgcagcgaaattactgcgctgtatcttggaccaatgcaatcagcgaagtccttatcgtgccaaaaggatgtgcatggattttccatcatttgcaaacttgaggatggcctgccctgatgccctcagatgctgatgaagtgtgtggttcatgaaaacgtgagaagctaagtagtggagtaacgggagtgagtaccagtgtggccactatgaagaaagttaattactgagaaattaagacttgagcatgttattttcaagcaacttgtacagcattatattgcactaccatcaaatgcttctcctgcctatacaatactctgcaagctcttgtattgtacactgttttatcttgtttaaagtatgcttgtttttgcttatgttgagatt

SEQ ID NO: 5018 - DNA, 1104 bp, Oryza sativa
  Predicted polypeptide sequence is orthologous to G1760
gtgctatacgcatcttccctagcttgctaagctagctagtcttctccttcctttctcctcttcctcctcctcctcttcttctcaatcttgctcagcaaatcttgtcggggagagagagagagagatcagcaaggagaagagggaattaagctagatcgaggtagtcgtcgatcgatcgattgaagatggggagagggaagattgccatcaagaggatcgacaacacgatgaaccggcaggtgaccttctcgaagcggcgcggcgggctgatgaagaaggcccgggagctggccatcctctgcgacgccgacgtcggcctcattgtcttctcctgcaccggccgcctctacgacttctccagctcaagcatgaaatcaataatagagcggtaccaggaggcaggagaggagcattgtcggttgctgaacccaatgtcagaggctaagttttggcagcgggaggttacaactttgaggcagcaagtgcaaaacttacaccacaacaacaggcaacttttgggagaggaaatctccaacttcacagttagagatctgcagcttctccagaaccaagttgagatgagcctacattccataagaaataaaaaggatcaacttttggcagaggagattctaaaactcaatgaaaaggggtctcttgttcaaaaggagaacagtgaacttcgcaagaagttcaacattgctcatcaacgcaacatagaattacacaagaagcttaactctggagaaagcacgtcaagtgagcaagttaccagaagctcaaaggatcccggagaatcgagtacaccccgtgattcacgtgtgtgtattgaccttgaattgagtcaaaaagaagttgaagatgaataacacatgatcaagtgttaaaaacaacatgatggccagtaacttttgcagcatcacgcctactacaagcgcaagaaaagctagctactactggaacaagggatcttaatcatgttttgaaacttaattagtaatattttaaaaaatcgtactatactaatcatgatgtgtagcgtattgcaccactgaatttattactgtaattaacatggtgagtgttaaaatattttgtgatatc

SEQ ID NO: 5019 - DNA, 3149 bp, Oryza sativa
  Predicted polypeptide sequence is orthologous to G1760
gttgtgtgcctacaaggctagagtaaagaccttatcgctcttgctaaacatacatacgtgcaagcacagtgcctagctaatccatcagcagaatagaagggtggagggggtgggaagaggccaggcccctccgccccctggcgtcgctcttgctgatacttttcttgttctggtacatctgcacagataaattataatgccttttcatctcttctgtctgcttatggctttttaagataaaacagagcattgatcttgcatgctctacacttcgcgcactgtttgtttttgccaataagtttgcacacatgtagctgtcatttgggtaaacaaacttgcagatagtgccaaatagtcataagaaaataattttcatgggctcttcagataatacatttttattcgaatagattttacagtatcagatattaatcatccaagcatgcaaactgtgtcttgttatgtgttagcttctttatgaccaatacattttaagagctctgaactgtagcccttaagaatagtgaaaatataggcaacacttccacaccataaattgtcatggatgcaattggagcctgcaataatttcattaagttataattgatgtttcactaaagaactgagaatggatagatggatcatgtgcagaaaatctgagttaccctagtttaggaggtgtggtttgctcagcatcattttgttggcttgggggattgagttcaagacgagcaggagtgttggcttcctcgataaccgcaaagttgtatggagttgttgaatctcgattcgcttcattttctgcccctgtctcatagagctgaggagagagattagctgtcatcatataatgaagcgtatatcctgtgaaatcatctatctgcatttatcaagtaccttcttgtacagctcagcattttcttggcgaatcaggttgacctttctgtacagttccatgttttcttggtggatgagacttccctgcaaataagccagcaatagagttagcttactagctgattcaaagatttagcaattgtacatgatgttgtagaacctttcgattcagttcgtggatttcatcaatcatgagctggtcctgaaaacaacaatattgatcttaagttaatccattatataatcaatcaggtgcccaacaaaaaaatatggttagtaggttgaccttttttgtccggatgcagcgtatgctcatttctagctgattttctagagtttgcagttccttgacacccaatccagaaagatcttgccccatcaactgcctgccatcaaccaatggatgttatagtgttgttctgatgatatacagagtgaatattgacacttaattttagctgatcaacagacagctgttaattgataataaaaataatttgtacctttctagtttaggtattgtaaattaggcctgaaggacaaaatggagtgtttgaacaataatttaccaggcagaaagcacaggtgaagaaaatgtgatattcactctcctttgtaaatttggtctgtccgcctttgatgggtgctcagttctgtttttcttttagagataaccggaaatgcataaaaatcgaatggctgaaggtatatatttcttacttttaaatgatatagaaaattcacgtgccttcttcatttcttttgtttgtgaaggttaaacaatgcattatctataggaaatttggaatcagcatatatcactttcatactctgttttttcttcttttttctaagtatcatatacccaagcactaggtgcttgtttttatgatctggtactagtttatatttactatacaatcaggtgctggaagtattattgtcgctagcagttgctggattcatgagcaagtccccacaaaaaaaaaagttcgtcatcaagggttcatgatgcatgtatttcatagtagtagatatatgatggtttatgtttttctatcttgaggaattttctgatggaacattgaaaaacttgcagggttttatggccataccgatgattttcttgcaagctgtgcagttgttgtctcaagcttgctgcctccctttgccagaactattggatatgaaaacagagtcaagaaatgcagaatccaggtttgccaaaagcagcaatataaatatgttgtgtatacccatagaaacatgctgggttatcaactcactagtttttttttaaaaaaaaggaaactcaattacattagacaagaagactatttgaactgaggaagttattgtgtatggtaaaagaagtaacaagaggcaaacaaagaaatttgttgtaaacaaataagggaagtagtattatctttccagtttgaagacagtttttttttccagataagacgatgagctaccaactctattgaatttggtactccattatcagtcctcgttttgcggggtgttaccccctattgtaaaaagcttgtttgtctaagcaaaatgcttccaagtcccaccaaagctagattaactacaaagtatctgcagagtgcacaagtcaggtaaaaaacttgtttgtctaagcaaaatgcttccaagtcccaccaagctagattaactacaaagtatctgcagagtgcacaagtcagataaaaaacttgtttgtctaaacaaaatgctcccaagtcccaccaagctagattaactacaaagtatctgcagagtgcacaagtcaggtaagtgatgattatatcatcctggtacaagctttattgcggtgaaagataagcagttagtctgaaatctgtacagatctgtcagctgttaccgaagcaaaaggttcaatgtgaacttaaagatgcagtactgatccttttaagaggatttaacacagatttaacaggtacgtgccccttgtgattctttgttagttttcttgttataatgatgtttttatcctctgaattcaagcagggtgttctgtatgcgagctgtgatgggatggttctcttcagaagcattttattttaactaaattcagaagcatttcgatggcatgaggactgttcgattgacaatttgtatgtacatttccaccgtttacgcagcttaggaattggaccataattagttgtgtacctgcaagttttgtatacgaattatcctgaagggtgttcggtggattg

SEQ ID NO: 5020 - DNA, 3308 bp, Oryza sativa
  Predicted polypeptide sequence is orthologous to G1760
acaatattttgtattaatttatgttttacaggcatacaacagatccaactttcaatgacatgtttattgtttagtttagctacaataattgttgggtagttgtagagcagcacatggtacttatgccacaagcccgcaaataaaataattcgcatttgctcatcctaattcatgctagcatctctattgcagaacaattttgatactattttttttttaaaattagccttgaaaatgccacttcccctaaggaatgacaaatgcatttttttttacaaatgcaaaaacttgcaggtagacacatatttggcaggtgaattcgtgtcatatggacatatctttcattggaagatatgtccatatgttggagctatttcaccagttctttcattggaataatgttagcatttaatcagtgatataggagatgattcaccttcaacaagctctcatttatcatcatgacgagtcagaagaatccgattgtcaagttacgccttctaccatatactccccaccaaaaacagctaccactggtaaataaattgctttctgttctaattggtgcctgaatttctgtatgctagatctgattgtttgttgctttcctggtattgtgtagtttttagttatgatgtacataatcctaagttaatccagaaattaatttttgagttctttctggagtttattcagtagtttataggttgtgaccaccagtgtccttttatggctgaatacaactcaaagaatcttcatgttggagttggattcactttggcagttcatacagtggatgctgatagatgcgctcgattattcctgtcgatagcatcctagtattgtgtctttatatagctatatctagcattttcatgtaaaagctatctgttctgtggatgggtgctcttattggttgcagcaatcaggataatcagctaaaataatgatatattgcagccttgtcagcctttattatatactgggttccctaaattgtcatctagtcattagtgccaaagtgcatgtagtcttctctgatcgttatttataactttatatgccaatggatgttacagacaacgtagtgtatgtcaatctatctggcgttttatttatcagaatactagaagagaatttgcaccagtggttcaagtaaatccctgaacattgaaactagatagtttgggctttttggcccctaatcttgtttgattgatacaaacaagtcaacgggtcacaagtgcttttgactgacagactacatccgtttctctcctctcatcttcactcttccccatcgaattctcctctcatcttcttcactcttccccatctttgaccaaattagccgcatcctatgcctggtggaatattctgacacaacatagcagtgtggcttgtttcagcagaaaattatttgacaggcgttgattgcaaagctgtcacagctgcacccatctgatcagatataggtaaactgagatgtggttctcagccagtgggaatgatgtacaaccacgttgtcattcaggggaactaaaaaccatctactcctgtttttagcaactcacatacagtacagatacctagaatcaacagatatccctactttaaccactttaaacaagtctgaggacatatattcctagtatcaatgttcatacacttgaaccagtaatgcaaggttcaggacatacaatgcaatttactcttgttttcttttatagttcatttgtcctcattttggtccctgatttaagttggacattcttatctcactagacggttgggtaagtaatgttaggggtcaaaatatagtggagttatgctatccaatcttgaaagcaatgtagagctttgatctgttactatccagtactacagtgaacagctagacttggagctagtgatttactcccttattggatacggatattgaagtagatatgggctggatgcctatactatgtaaattcacccattgacggttcattggctcagtcagatagagaacatgcctgcttaactgaattagtgaaagcaagtcaaataactaagtggcaactcttatcagcaaaactaatttgtgattatgatctgtggcttgtttatttcaaccatttcttttatatgaattgcgtgtaactcagaatttcatgtgaatactgagtaactagcacatctattttgatttgggcccaatttttcaactggcaagaaagaattggagtacaagatcaaagggtgggagtaactcttagtcttaggcatcgggattgggcaggatttgttgtgcacctaattttctttcatttctcgtacttgaacttgtttgtgcatataagtatgtgatcatccaactatttctaagaggaaattagccacaagcaacaaataggaagtttttatattcatacctttgcctcagaacttgcgttcatggtttgatggggatcttctttcgtctcattgtatctctcaattatggatttcatgctggttgaaaaaaaaaatcaagatcccattagaacacatgtcaacacatgccacagtagtgttgaatgctatcatatagctcctgcaagcttattttgtagtacatgggcatcagtatgtaagatgacaaatgcaaacttttaatgaaggcctagttctttgacaagtaatccacgtggatagataactgtaaggtcaacacaaagaattaagtgtggagtgttttgagttaattggttcttactgcttaatttcctgttatcttaaaacttcctgttatcttaaaactagacactgttctcctaatttgtcatccttttcctatttagtttgttgttttctacgaatcttgagctatttgtatggagaaaaagcagtgacaatggtaaaagatggttttgaaggcactacaagacatgcctcaagttataaccgtgctgttacgaggatccaagcatccaaaacacttggaagattaagcttcaggcgttgtcgacataatgcataattagttgcatacttcagtggatgattgaacgggatgtttggatatgcaaatatttctatgcatccggactgaatactttctgaacacaaagcaagccaacctgccatggccatgacacgatggttctatccatattttcctatttgtcatgtacggctgggctgggcctagcaccaaaactattcgttgttgtttattattattaggtaattaggttattcgtagatcatggttgtttattttattatgaacattttgataacattttttttaaaaaattaaagcctttatttttccgatc

SEQ ID NO: 5021 - DNA, 437 bp, Oryza sativa
  Predicted polypeptide sequence is orthologous to G1760
aaacaaaagacccctccatttccattcctcctcttcctctcttctccccccccctccaataattcaaccccctcttctgggaaacctgggagctttctccttcaagagctccctgctagctagatctcctcctctctttctctctctctctctctctctttctgtccatttctatctgtgctctcgcctgagcggcgacaatccagctgagatcgatcgatcgatcgatggggaggggcaagatagtgatccggcggatcgacaactcgactagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccaccatgaagtcagtgattgatcgatatggg

SEQ ID NO: 5022 - DNA, 695 bp, Oryza sativa
  Predicted polypeptide sequence is orthologous to G1760
ggaaaaggaggaggagatcgaaggggaagatggggagagggaagatagagataaagaggatcgacaacgcgacgagccgacaggtgacattctcgaagcggcggagcgggctgttcaagaaggcgagggagctctccatcctctgcgatgccgaggtcggcctcctcgtcttctccagcaccagccgtctctatgactttgccagctccagcatgaaatccataattgagagatacaatgagacgaaagaagatccccatcaaaccatgaacgcaagttctgaggcaaagctttggcaacaggaggcagcaagcttgaggcagcaactgcataacttgcaagaatatcatcgacagttgttgggacaacagctttctggtctggatgtagaagacttgcaaaatttggaaagtaagctggagatgagcttaaaaaatatccgtctgaggaaggacaatgtcatgatggatcaaattcaagaattaagcaggaaggttgttaccacttagcacattcactcaacattacttatgtacactagtctacttggtccaaatcttattggagtgagataatttgcttgacactgcacaaacttctcactgaattgtagggaagcctcatacatcaggaaaacatggaactacacaagaaagtcagccttgtccatcaagaaaacatcaatttacagaaaa

SEQ ID NO: 5023 - DNA, 708 bp, Oryza sativa
  Predicted polypeptide sequence is orthologous to G1760
atggggaggggcaagatagtgatccggcggatcgacaactcgacgagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccagcatgaagtcagtgattgatcgatatgggcgagctaaggaggagcagcagcacgtcgcaaaccccaactcggagctgaagttctggcaaagggaggcagcaagcttgagacaacaactgcacagcttgcaagaaaatcatcggcagttgatggggcaagatctttctggattgggtgtcaaggaactgcaaactctagaaaatcagctagaaatgagcatacgctgcatccggacaaaaaaggaccagctcatgattgatgaaatccacgaactgaatcgaaagggaagtctcatccaccaagaaaacatggaactgtacagaaaggtcaacctgattcgccaagaaaatgctgagctgtacaagaagctctatgagacaggggcagaaaatgaagcgaatcgagattcaacaactccatacaactttgcggttatcgaggaagccaacactcctgctcgtcttgaactcaatcccccaagccaacaaaatgatgctgagcaaaccacacctcctaaactagggtaa

SEQ ID NO: 5024 - DNA, 992 bp, Oryza sativa
  misc_feature (876)..(876): n is a, c, g, or t
  Predicted polypeptide sequence is orthologous to G1760
cagcggagggacggtcggagattccgggtgaccacgcgtcgctctctgtctctctctctcggggtattgcaagatagtagctaattaaccagcctttggccttcagtttccccatcggttcatcagagcacgccttcaatttcctaatcaatctcccatataattccccttagcttgtatgcctatcattagtacttcttgtgttgtgttgtcttcttgccttctttgagctagagctagctaggtttgtgacctgctgtacgtgcgtgtgttaattagatagatgtcttagatctgggagagagcgaggagatggggagggggaagatagtgataaggaggatagacaactcgacgagcaggcaggtgacgttctcgaagcgtcggaacgggcttctgaagaaggcgaaggagctatccatcctctgcgatgcggaggtcggccttgtcgtcttctccagcaccggcaggctctatgagttctccagcaccaacatgaaaactgtgatagaccggtataccaacgcaaaggaggagctacttggcgggaatgcacttcagaaatcaagatttggcagagggatgccgccagcttgaggcagcaactgcacacttgcaagaaagccaaaggcactgatgggtgaggagcttctggcctagtgttagagacttacaggcttccggatcgggtgaaatcagctacgtatatccaatggaacggccccctttgcacaggaacccgggctcctgtgaggggacctattccaggaaaatgaatcttaagctagtcgttgacaaaggggggttacgctggcggaacaagggcggttgtagatgacccaggtgggatcaggctgtctctcttagacacagagngaggatatcactaagacaccgcgccattcgtgcgcagtgatagtacctcagctcaggcgactaggcgtgctggcgtctaatcagagaggtagcagcagatgactggtgagtagagg

SEQ ID NO: 5025 - DNA, 716 bp, Oryza sativa
  misc_feature (452)..(452): n is a, c, g, or t
  Predicted polypeptide sequence is orthologous to G1765
ttttttttttttttttttttttttctttccatcacatatacatttaatttatttgtttagaagtatgtcttgaactagcttttgcatgggaaccaatatactctagtttttgttaaatcttttctccacataagtttatagttagcttatagctcaccattaacgttgatatgctactatcaagaagctaacaggggttctaattcctttgtcatttagtagttgcacagagccaaatgcagcacatcatcatcctcccccctggagcaaattaaaatctgggcagtgggtcgtttgtttaatagggtggccaatgcttcaagaatgcggtgaatgttattattcctcacgcccctcatccctaggagaatgtttttttgtgggcccctccatgcaactcctctccaggggaaggatcataccacatggtggtgatgaggttgtgtgtgtgncattgtatgagtacttctacattgagaagaatcattgggggacaactttttggtgatcaagagctggtgggtgccattcagccattgtatagtactccattaacaggaataaccccagagcccatggtacagaacaggaaaaagaatcattgggggaacactttttggtgtgggcaggggaaacttgccaagtaaaaaagttgctttttttacccctttgacatgaagggaagagggacatcccaaagatcagggaggatcaag

SEQ ID NO: 5026 - DNA, 680 bp, Oryza sativa
  misc_feature (640)..(640): n is a, c, g, or t
  Predicted polypeptide sequence is orthologous to G1765
ttttttttttttttttttttttttgattgccataagaacttagaagccacataagtacattatccgataatggaaaatggcggcaacgacggtaatgggtctgcggtgccagtggtgagctggaagcatgagctggtgtcacggctacagttaagtcctagcttccactttgtgccgacggacaaggagctcgtggacttccacctccgcggtaagatcaagagacgcaaaccgcctctctacctcatcaatgaggtcaatatcatgcgtcatgattctgaaatgattggtaatttaatcttctttagttgattgatcgctttgaagttatgtatatctatgaaccaattgatttgtgataacacaatatgcatgcatatagaaatacaagggctatggggaaggtatgtggtactttttcatggtgagggggccctcgaagactaaaaacacggttgagttgaccacaaaaaacattattaccgtctcacattatcaaataacttatgacgatacctacttctttatcacttcacaccagtgctattgttccatagcctattccgcatccctacccttcacaatgcgcgaccgttatatattgggtgtaaagcactccataatgcgctactcatccccntcgggcgtctcccgtccgcacccatggcgtagccacagat

SEQ ID NO: 5027 - DNA, 1405 bp, Oryza sativa
  Predicted polypeptide sequence is orthologous to G1765
gaatatctcaagagagctagctagagctccatttacaaccattacaagattgcatcagagaagatatcttcatagataattgttggagcaagaacacaagaaaacacgtaggttcaattataatcgatcgtggagatggtgaccagcaaggagtttgcatgggatcaggcggccatggatcagaagatcaagagcgacgtcggcgaggtggtgctcgccggagacgaggaagaagacggggacgtggtgctcccggggttcaggttccacccgaccgacgaggagctcgtcacgttctacctccggcggaaggtggcgaggaagtctctcagtatagagatcatcaaggagatggacatctacaagcacgatccatgggatctccccaatgcgagcacggtaggtggagagaaggagtggtacttcttctgcctgagagggaggaagtacaggaacagcatcaggcccaacagggtgacgggatccgggttctggaaggcgacggggatcgaccggccgatctactccgccgccgtcaacagcaactccggcgagtcgatcgggctgaagaagtcgctcgtctactaccgcggcagcgccggcaagggcaccaagaccgactggatgatgcacgagttccgcctcccgccggcgatcgccgccgccgacgcctccccgtgcatgcaagaagctgaggtctggaccatctgcagaatcttcaagagaagcatcacctacaggaagcagcagcagcagcaggcctggaggccgccggcgacggtgaccgtcaaggccccaccgccgggggactcgagctccaacaccggcagcttcgagtcggacggcggcggcgacgagttcatgaactgcggcctgactccggccatctcccagcagcagcagcacggcggccgtcatcagatgatgagcacgatgagctgcaacggcggctacttcttcaacgacggcatccatcacagccacagccaccacaagcttcatagtcaatggggctccctacaaatggcgccgccggagccgaagccggagccggagcagaagcctctgagctcgccggcgatgacgatcgccttccatcaaaacgaccatggcttccccgccgccgccgcggatttctacaaggatgggtacttggaagagattgcgaggatgatggaggtggctgatccaagtccaacaggattctatgactgtagatattgatcagtaggaacagggtttcagaatagatgctagatatgcagaattcgccgacaagaacagtgccccctttgtgtgagaggctgacatgtagggcccatgctgcagaggctgctatcactattagtcttgtacttttgttttctgatctaatatatacactccagatgggatgtgaactgtc

SEQ ID NO: 5028 - DNA, 1118 bp, Oryza sativa
  Predicted polypeptide sequence is orthologous to G1767
agaaaccgttccccccactttcccctctctctccactttttacggattaggcggcgacgatgatggcttgcgtgtgcggcaggcggttgaccgacgattgcaggacgacggcgggcgggcgatggcatgggcttcctcggcttcctctggcggcgggcgacggcgacggcctgcgccagcagcgagcgacggggatggcctacgttagcggcgggcgacgggctcgccggggtgacctccgcccgggtccagcagcggtggccgtcccccgccttgatccgacatcggcggtgggagtttgagacggagctgacttcgatggcggtgggtcgtccggactggtcgccggcgatggaggcgtggtggcgcatcgtccgtccgtgagttggtgccgcctcctgggatctgccccgacgacctaccgccaaatccaagccctcgaccatgaaggaaccgttccaggaggccggtagcctcactgctctggccttcctccgtgacggctgagatcgtgtggtggtggcggagaaaagccgagtagctgatgaagcggagaccacatagaggaggagttggaagaggataactcgccgacggcgtgagttcctgccgagcggtgggagaccggcgtgtcctgggcgcggtgcacgcggtcggcggagttatcgctggcggcattcagtgatgacgtcgccgacgacgtgcggtcgcttctccggcggtacaaggtggctggttgatgcgggactacggcagtgacatggacaacgccgccgctgccggagcattccttgcgtggaaggagcagcctgtcgtgtggacgagtgcgtggatgccttgagatcgattgatccaacaagtccaaatccgccattgctgcaaatgatcgagcctgcgattcatttgattcatttgtttaatttgattctcagttgattcctctgttctttttttttttttgaactagctgattcatttgtataactgaatattccagtgacttgtataggaggtagtgatagattatttgctttaccggttaacactgaatctcacgttcttgatgcatgttatgtatatatctgtgtcctctatgcaattatgagcttgtttgcatt

SEQ ID NO: 5029 - DNA, 2279 bp, Oryza sativa
  Predicted polypeptide sequence is orthologous to G1767
tagatggatacgctgtttaggttggttagcctccaagccgcctccgagcagcagcagcagcagcagcagtcggcgtcctacaactcgaggagcacgacgtcgagcgggtccaggtcgtcgtcgcaccagacgaacgcgtcctacagctactaccaccacagcagcaacagcggcggcggcggcggaggcggcggagggtactactacggcggccagcagccgccgccgtcgcagtactactacctggagccgtaccaagaagaatgcggcaacgccccacaccaccagctttacatggatgaagacttctcctcctcgtcgtcgtcgaggcacttccaccacggcgcgcgggtgcagcagcagcagccgccggcgtcgtccacgcccacggggacggcgccgacgccgccgctgtcgacctcgtccaccgcggcgggcgccgggcacggcctgttcgaggcggcggacctgtcgttcccgccggacctcaacctcgacttctcgtccccggcgtcgtcgtccggcggcgggacagcgtcgtcgggcgcggttgggggcggtggcggcgggaggtgggctagccagctgctgctggagtgcgcgcggtcggtggccgcccgcgacagccagcgcgtgcagcagctcatgtggatgctcaacgagctcgcgtcgccgtacggcgacgtggagcagaagctggcttcctacttcttgcaggggctgttcgctcggctcacggcgtccgggccgcgcacgctgcgcacgctcgccgcggcgtccgaccggaacacgtcgttcgactcgacgcggcgcacggcgctgcggttccaggagctcagcccctggtcctcgtttgggcacgtcgccgccaatggcgccatcctcgagtccttcctggaggtcgccgccgcggcgtcgtcggagacgcagcggttccacatcctcgacctgagcaacacgttctgcacgcagtggccgacgctgctggaggcgctggccacgcggtccgccgacgagacgccgcacctctcgatcaccaccgtggtgtccgccgcgccgtccgcgcccacggcggcggtgcagcgcgtcatgcgggagatcgggcagcgcatggagaagttcgcgcggctcatgggcgtgcccttccgcttccgcgccgtgcaccactccggggacctcgcggagctcgacctcgacgcgctcgacctccgcgagggcggcgccaccaccgcgctcgccgtcaactgcgtcaactcgctgcgcggcgtggttcccggcagggcccgccggcgcgacgcgttcgcggcgtcgctccgccggctggacccgcgggtcgtcaccgtcgtcgaggaggaggcggacctggtggcgtccgatcccgacgcgtcgtcggcgacggaggaaggcggcgacacggaggcggcgttcctcaaggtgttcggcgagggcttgcgcttcttctcggcgtacatggattcgctcgaggagagcttccccaagacgagcaacgagaggctggcattggagaggggagcagggcgcgccatcgtcgacttggtctcgtgcccggcgtcggagtcgatggagcggcgggagacggcggcgtcgtgggcgcggcgcatgcggtcggccgggttctctccggtggcattcagcgaggacgtcgccgacgacgtgcgatcgctgctgcgccggtacagggaagggtggtcgatgcgcgaggccggcacggacgactcggcggccggagccggcgtcttcctcgcgtggaaggagcagcctctggtgtgggcaagcgcgtggcggccatgatcggatcgtcgtgatcgatggatcaaagctcaccggtgagtggaacagcatggaagaaaagagctccatagctaagcaagcacgcatgcatatccaccatgcatggggtaagctagcaagctctctcgtgtgtgtcacgatcgacattaatggcggctcacacaaaggcatgtagggttttgaaacagcgtagggagctacagaaatggatcacgtacgtacgtacacattgggttgcagcgatcgaggagggagatgatagttttagttcctagatttgcatccatttttattcatcgatcgccaacaagttcttggcgagaagatgattttgatttgcttgcttccatcttcttgtttatttttccccctttcgtttgtgtttcttcttaatttgtaagggttaacgacatttttcttcactctggagaaattttacgtgcatggtttttatcatgcgtacctgc

SEQ ID NO: 5030 - DNA, 1812 bp, Oryza sativa
  Predicted polypeptide sequence is orthologous to G1767
atggataccctcttcaggttggttagcctccaccaccatcaccaccaccagcacgcggcctcaccgtcgccgccggaccagccgcacaagtcgtacccctcctcgcgagggagcaccagctccccctcctcccaccacacccacaaccacacctactaccaccactcccactcccactacaacaataatagcaacaccaactactattaccagggtggtggaggcggcggcggagggtactactacgcggaggagcagcagccggcggcgtacctagaagaatgcggcaacggccaccagttttacatggatgaagacttctcctcctcgtcttcctcccgccagttccactcgggaacgggcgcgccgtcgtcggcgccggtgcctcctcctccgtcggcgacgacgtcgtccgcgggcgggcacgggctgtttgaggcggcggacttctcgttcccgcaggttgatatcagcctcgacttcggcggctctccggccgttccgtcgtcgtccggtgctggcgccggcgccggggcagcgccgtcgtcgtcggggaggtgggcggcgcagctgctgatggagtgcgcgcgcgcggtggcggggcgcgacagccagcgcgtgcagcagctcatgtggatgctcaacgagctggcctcgccgtacggcgacgtcgaccagaagctggcctcctacttcctgcagggcctcttcgcgcggctcaccacctccggcccgcgcacgctgcggacgctcgccaccgcgtcggaccggaacgcgtcgttcgactccacgcgccgcacggcgctcaagttccaggagctcagcccgtggacgccgttcgggcacgtcgccgccaacggcgccatactcgagtcgttcctggaggccgcggcggcgggcgccgccgcctcctcctcctcgtcgtcttcatcgtcgacgccgccgacgcggctgcacatcctcgacctgagcaacacgttctgcacgcagtggccgaccctcctggaggcgctggccacccggtcctcggacgacacgccgcacctgtccatcaccaccgtcgtgcccacggcggcgccgtcggcggccgcgcagcgcgtgatgcgggagatcgggcagcgcctcgagaagttcgcgcggctgatgggcgtcccgttcagcttccgcgccgtgcaccactcgggggacctggccgacctcgacctcgccgcgctggacctccgcgagggcggcgccaccgccgcgctcgccgtcaactgcgtaaacgcgctgcgcggggtcgcgcgggggcgcgacgcgttcgtggcgtcgctccggcgcctggagccgcgcgtggtcaccgtcgtggaggaggaggccgacctggcggcgccggaggcggacgcgtcgtcggaggccgacaccgacgccgcgttcgtcaaggtgttcggcgagggcctccgcttcttctcggcgtacatggactcgctggaggagagcttccccaagacaagcaacgagaggctgtcactggagagggcggtcggccgtgccatcgtcgacctcgtgtcatgcccggcctcccagtccgccgagcgccgggagaccgccgcgtcgtgggcgcggcgcatgcggtcggcggggttctcgccggcggcattcagcgaggacgtcgccgacgacgtgcggtcgcttctccggcggtacaaggagggctggtcgatgcgggacgccggcggtgccacggacgacgccgccggcgccgctgctgccggagcgttccttgcgtggaaggagcagcctgtcgtgtgggcgagcgcgtggaagccatga

SEQ ID NO: 5031 - DNA, 600 bp, Oryza sativa
  Predicted polypeptide sequence is orthologous to G1767
cgagaggctgtcactggagagggcggtcggccgtgccatcgtcgacctcgtgtcatgcccggcctcccagtccgccgagcgccgggagaccgccgcgtcgtgggcgcggcgcatgcggtcggcggggttctcgccggcggcattcagcgaggacgtcgccgacgacgtgcggtcgcttctccggcggtacaaggagggctggtcgatgcgggacgccggcggtgccacggacgacgccgccggcgccgctgctgccggagcgttccttgcgtggaaggagcagcctgtcgtgtgggcgagcgcgtggaagccatgagatcgatcgatccaacaagtccaaatccgccattgctgcaaatcatcgagcctgcgatgcatcgtgcatgcaatacacaatatggatcatgcatatcgcacgtgcgggttgaatgggaagaggaagcagcgcgcgcgtgtacgtacttagggtttttcagccagcaacgtacgtgtgtagcagggagaggaggtagcaaaacacatcagatggattaagttaatcaatcaccagttattactagaaaattatttggaggaattaattggcatttattgtcttgc

SEQ ID NO: 5032 - DNA, 1978 bp, Oryza sativa
  Predicted polypeptide sequence is orthologous to G1772
gtcgcggcgatcaaaaaaacccaacccctcctctcctcgccgccgccgcccatggccagcgaccgccgctactactacttcgaagaagacgatggcgatggcgaggaggaggtggagtggctggcgatggaggccgacgaggacgacgtcggcctgctcgaggaggacgaccttcacctgcggcttcccgacgaccgccccgcggattgctgggccatcacacaagagtcacttcctgctgcccagcaacaagacctgtctatggtaatgaacttgctcaacataaagcagcaccttgcacgcacactccttatccaccaccggtggaagatgcattgcatttatgatcaccttgacagaaaggggcgggaccgcatgctcagtgaggcatgcattattttgccgaagaatagcatgtcagcagctagctcaacaagtgttacctgcaatgtgtgttttgaggacttctcaatgactgatgtctcgaccatggactgtgggcattgcttctgcaatgactgttggacagagcacttctttgcatccattaatactggcaacaagcagattcggtgcatggaggttaagtgcaaggccatttgtgatgaggacattgtgcgccgcctcctcagtctgaagtaccctgctgcatctaagcgcttcgatctcctcctacttgagtcttaccttgaggacaatgactcagtgaagtggtgccccagtgccccacactgtggccgcgcaatccaggtaggcaccggcgagaggtactgcgaggtcgcttgcccctgtggtgtcagcttctgcttcaactgtgcagggcaggtgcactcgccttgcccatgtgccatatgggagaagtggaaagctaagggccatggagactcggatagcgtcaagtggattcttgccaacaccaagagctgccccaagtgctccaagcccatcgagaagaacggtggctgcaaccttgtccattgcaagtgcggccagtgtctatgctggctctgtggtgggcctaccgggagggagcacacttgggatagcatctccggccacagctgcaaccgctacaaggaggaaaacggcgacaaggtggacaccagcagacagcagatgcagcggtacacgcactactgggaccgttacaacatccacgccggctcgtacaaggtggagcagaaggatcttgggcctgccgtcgaggagcaggtgaagaagctggagtcgaacctaacaggtccgaagatgaactgggacggtagctggctcgccatggcgtaccaatccctgctcgcatcgcggcaggtgctgtcgcggtcgtacgccttcgcctactacatgtttggcggcggcgaggtgaagacgcgcccgtcggagcgggcgagcctcgccgtggcgcagaacctcttcgaggaccggcaggagcagctggagcgccacgttgagcatctctccaaggagctcgccacggacttgctggggctgccggaggaggagatcgtcctgaagaaggtggagattgccaacctcgccaagatcgtccaggcaatctgcgggcagttgtacaggtgcatccaggacgaactcctgccactgctcgtccagcccatgaacattgccgcgtaccagccggacggccctgacaaggccaaggagttcatcggggcttgacatacagacaaggctagcttccagtttggcagctgccgctaacctcactgtgcttatcaggtaagttatatatatatatgtgtgtgtgtgtgtgtgtgtgtgtgtgtgtgtgtgtgtgtgtgtgtgtcagtatgtagatttgacttacttacgcctgagcgaaggacgtaatgttcattcgaaattaaagtgctatacttgccttattttttggttgttggggcgtattttggtttcaaaatagtattctaagcattgaccattcttctcataagatagataattctttttttttccgtgaggc

SEQ ID NO: 5033 - DNA, 1995 bp, Oryza sativa
  Predicted polypeptide sequence is orthologous to G1772
atcaaattccaaaaaccctccgcgagctccgacgacgcggccgccatggacggcagcgacgacgagtgctgctactactacgacgccgtcgacagcgatggggacgaggaggaggaggaggagataataatgctggacgaggacgacgtaggcttgctcgacggcgccgcgctgccgccgccggaggaggaggtggagcaccgcgcgatttgctgggccattacaaaagaatcccttgcagctgcgcaggagcaagacctgtccatggtgatgaacctggtgaacgttgagcggcacaacgcgcgcgccctcctcgcccaccaccggtggaagatggagcgcatctacgaccgcctcgacatgatgggccgggacgccttgctcagggacgccggcgtcgttgtgctgccggagaagagcagcagcagcggcagcagcatggccatggcgaagacgaaccccccgggaagcgtggctgtcacctgcaacgtctgctttgaggagtacccactcggctctgtctccgccatggattgtggccactgcttctgcaatgactgttggacggagtacttcgctgcggcggtgagcgacggcagcaagcagatgaggtgcatggaggtgaagtgcacggcgatctgcgacgaggcggtggtgcggctgctgctgcacgggaagcaccccggcgcggcggcgcggctggaccgccgcctcctggaggcgtgcgtggaggccagcgacgcggtgcggtggtgccccagcgcgccgcactgcgggcgcgccatccgggtggacggcgggggcggcggcgaggagcggtacgccgaggtgtcgtgcccctgcggcgccgtcttctgcttccgctgcggcggcggcgcgcactcgccgtgcccgtgccccatgtgggacaagtggggcgccatgcgcggcggcggcgaggtcggcaacctcaagtggatcgtcgccaacaccaagagctgccccaagtgctccaagcccatcgagaagaacggcggctgcaaccatgtcacttgcacctgcggccagcatctctgctacgcgtgcggcgcggcgacggggacgttgtacatgcacatctgcaaccgctacaaggaggagggcggcggcggcggcgtgaaggtggagatgaccgccggtgggcggcagcggctgcggttcatgcactactacgagcggttcgagatccacaccgagtcgtacaaggaggagcaggggaagctgggtccggccatcgacgctctggcgcggcggctggaggcggacgccacgctgccgtggtcgggcaccagggacgcccggtggccgtcggcggcgcaccggcggctgctgcggtgccggcaggtgctcccgcggtcgtacgtgctcgcctactacatgttcggcggcggcgcggcgacgcggcgcgagcgggaggaggcggcggcgcagaaccggttcgaggatttgcaggggcagctggggcaccacgtggaggtgctgtccaggacgctggcggcggcggcgcggccggccgacgcggcggaggtcgtgaaggcgaagcgcgacgccgacaacctcgcccgcgtcgtcgaggggctgtgcgccgggatgtaccggtgcgtccaggacgagctgctgccgctgctcgtcgagcccatgaacatcgccgcgtaccatccggacggcccggccatggccaaggagttcccgccggcgaccagcgtgaccggcggagcaccgccggcgacacgccactaagccacaacgtgtcgagttcattattactatacgaagcaaggttgtaaacggtcgatgggtgaagggaagcaggtggttttgggaaaaattctattgtccaaacatgtttgtggtttggcatggtggatttttggattaattactagctaagtagtataggaaatatcctatattgatacagaggaaatgatggattattttgtgctgattaattagtctaattgttcgacgttgtgc

SEQ ID NO: 5034 - DNA, 2482 bp, Oryza sativa
  Predicted polypeptide sequence is orthologous to G1777
gaaaccagtccctctttccggccgcaccaccaccgcctcccctccgtttcccctccctcacttccccttccgcgactgcgagcttctccgccgccgccgccgcccccaatcgcccgccgccccgcgccgcgattgcccctcccggtgcccctcccgcaggcgccgccgattcccccgacccggggaagccccggtttgccgcgagctgcgtcgccggtgggggtttgatttggggctgatccgatcgcccccccctagatggtgaccgacgccgaggaggtctccccgacggcgtcctcgtcggaattggagcaggaggacgatgacgatgactgctacctgagcgatcaggaggacgacgccttggaggagtccgtcctccaggtgctggaggacgaacgcgacgaggattgccattggtcctccacctccgtgatcaccaaggaatccctcttggcggcgcagagggaggatcttaggaaggtgatggagttgctagggttgagagagcaccacgcgcggacgctgctcatccactacaggtgggatgtcgaaaggattttcgagctgcttgatcagaaggggagggacaggctcttctcggaggctggtatccctctccaacctgctaataatcccggctcgccctcctcaacggaggtaacctgcaatgtttgctatgacgatgtgcccctctcggacgcctccaagatggactgcggccacaactactgcaatgaatgctggacaggatatttcattgtgaagataaatgagggacaaagccgccgtatcaagtgcatggctctgaagtgcaatactatctgtgacgaagcaatagtccgtaagctagtaaatgcaaagcggccagatattgcagagcgctttgaaaggttcttgttggaatcttatattgaggacaatgatacagtcaagtggtgcccaagcacaccgcattgtggaaatgctatacgcgtcaaaggtgatattcactgtgaggtggaatgtacatgtggacgccagttttgttttaattgctcctcagaagcacattcaccatgttcctgtgtgatgtgggagctctggatcaagaaatgccgtgacgagtcagagaccgtgaattggataacagtaaatactaagccctgtcccaagtgccacaaacctgttgagaagaacggtggctgcaatctggttgcatgtatatgtgggcaagcattctgctggttatgcggtggtgctactggcagagatcacacatggtcaagtattagtggccacagttgtggtcgattcactgaagatcagtcaaagaagacagagcaagctaggagaaacctttatcggtacatgcactaccacaacagatacaaagctcacactgattctcttaagcaggaagcaaagcttaagggcgacatccaggggaagatttccatttctgaaaacaaggattccaagataaaagattactcttgggtgataaatggattaaacagacttttcaggtcaaggcgggttctttcatattcttatccttttgcattctacatgtttggtgatgagattttcaaggatgagatgacttctgatgaaagagaactaaagcaaaacctatttgaggaccaacaacaacaattagaattcaacgttgaaagactatctggtttccttgagagggattttcaaaattttagtgatgatgaggttatggatacaatgaagcatgtcatcaatctttccaatgtggttgatagactctgcaagcaaatgtatcagtgcattgagaatgatttgttgtatccactgcgtacgcctcataatattgctccatacaaatccaagggccttgacagggcctcagagctcaatgtttgttgggattcttctgaacaaggtttgcaaccaattaactacagtcaagatgaacacaagagtcagcctggtttatctggttcatctatttttggaaagcggcaacttggctcaagttctaataacaatgggcggcctcacaagcgagaaagaaatgatgcccatggtggggttgccctttttgacctcaatgtgccagctgaagtggcagacaagatatgaaacttaaataacttacagcacattccgttgcaagtgtacagctgacccgggcttcttcagctacataaaggaaaactctgctcttttttgttgcgttagagtgtcgacatggcaagtttaaacggggggctataataccaacaatagggtagcgttcacttattctcttgtaaatcatgacaagaattggtggcaatgtgcaatgtgcacgttgcatagctcttataatgctaaatctacccctcgggcaagacgatggcattttggaagataaaattttgaaatgtccttttgcaaacatgcaaggtaatgtatgaagcatattggaagtgcctgcggatgcgtagcacctggaaattaatagaaacaaactaattgagtcgcg

SEQ ID NO: 5035 - DNA, 392 bp, Oryza sativa
  misc_feature (29)..(29): n is a, c, g, or t
  misc_feature (35)..(35): n is a, c, g, or t
  misc_feature (44)..(44): n is a, c, g, or t
  misc_feature (284)..(284): n is a, c, g, or t
  misc_feature (326)..(326): n is a, c, g, or t
  Predicted polypeptide sequence is orthologous to G1777
gggcccgggccggggtgcgggtcctggcncagccnccgagcccncgcctggatggccgggcccaggttctccgcctccgccgtgggcgagtcgccgtgggccgtgtgccggtcgtagtggtgcgcgtaccggagcaccttgcgcctcgccccgtccaccttcctcttgtccgccgcgtcgtcgtagcggttgcagcggtgcccgtcgatgctggtccagttgtgcgccagcccggtggccgcgccgcacagccagctgcaaacaacattcatgcatggtcgtcncatcaatggcgatcgaattgccaaggtgaattaagaatcttngaagtggatttttgtccctcagagggggcatcatctcgttttgtacatggcgtttataaggtaatt

SEQ ID NO: 5036 - DNA, 504 bp, Oryza sativa
  Predicted polypeptide sequence is orthologous to G1786
cagttttgctatactgagtatccaaaccacagtgtctggcaaaacatgtctgcagcagtctggtgggctgcaccacacaatgctgcacctgatgcaaggacacagtagacacgtggtgtgacaaggcacataagcgctaggcaaggctgacacgactgccctagccaagtgtttgggtggatgctgctactgtggatgcggaatgtctggctgcaaagctgcaaagctgctgattgggctgtttgaacgtggccaatgtctgaggatgatgcggtgatgctgacccctgagggtgactgatggtcgcaaccccagtgacccttgaccacccctgtggcaggtggtgctgtggtaatggagtgtgttgaaccagtgatgagtgggtgtgcaggaaagttgaaaaatgaagctgccagatatcatcagaggtgacatgtgaaactttgggggatataaaatagaaataaagttgtctttcatatgtaaaaaaaaaaaaaaaaaaaa

SEQ ID NO: 5037 - DNA, 462 bp, Oryza sativa
  Predicted polypeptide sequence is orthologous to G1786
tttttttctttttttttttttttttttttttttttttttcgacccaacccagtccccctcttcaaaactcaaagctttcaaaacctgaatactacagggattaccggattcaatcatgaatgaatctaccctgttcaattttcgatgcaaacctgccttacccctaccggtccctcaggcaaggaatttcatgcctccaaccctcaacaggctcataaacaaaaatcatgaacctgcccctcaacatgtcataacatcaggctaaaacaagcggaaaaatatgtaccaattgaaaccaattttgccgtcaaaccaccggcttttttccaaatgacaaccgcgaattctcaaatccctgaatgaacaactgcgtccccgttgcgggcaatggcaaccatggacctccaggtgccacaacttcctttaggagggcctttgcaattgggacaagggcttggtttg

SEQ ID NO: 5038 - DNA, 680 bp, Oryza sativa
  Predicted polypeptide sequence is orthologous to G1789
tttttttttttttttttttttttttttttttctagcaggcacaactttataatcactagcacacaagtacagaagtcttacatcactgatgtttactacataatttagctggaaggtttaacaaccacacacaatgccaaaggcaggctagtttctgcaaaatcgacactgatttgctttacaacctaaagtatgtacaaacaaggcttttcttcttttatttataaccaagcgaccacaatctttttaggcaataacaatatcaatatacttccttgattccttcagtaacttagccacagctagcagggaatataatttatatgggaatttttttcctgttgtcgggaacctcaaatgcttccacccctatcagttccatgctccctgggtattgtacttggggaacgggactcttcttgcctctatcagcttgaggtcgccctcgaggatctcataggggcggcacacctcatcggctgtcttggtgcctcccatggcgcgagacaccttgtgaaagaggtcaggcgcaccctcgccgtattaggcaagagcctcctcgaacagcttgttctcctttttgctcactctgagcccatgttgacactgttgctgttgcgggaggagctgtttgacctagaaaaatccttggattggactacggcttttctttggaagga

SEQ ID NO: 5039 - DNA, 598 bp, Oryza sativa
  Predicted polypeptide sequence is orthologous to G1789
aatatcaaaacacagcagagatcgatagatctcttctgaagtccaaaaaaaacttcagtctagctgcacactagttagcaagttacttagcgttcaacttccaaagaagacagtagctagctagtttaatcaaatccaagctgcaggatgtcttctgctgggtcacgtagctcgtcccgcaacagcaacatggcgtcagagtggagcaaagaggagaacaagctgttcgagcaggccattgcctactacggcgagggcgcgcctgatctctggcacaaggtgtcccgcgccatgaggggcaccaagacagccgacgaggtgcgcctccacttcgagatcctcgtggacgatatcaagctgattgaggcaaggcgagtcccgttccccaagtacaatacacagggagcatggaactgaccgactgaggggtggaagcatctgaggttccagcaaggaaataactccaatataaactatattccttcctgtggctagttgttgaaggaaagcatattgatatattgttactgtgttaagaagattgtggtcgattgcttggttataaataaaagaagaaagggattgtctgtatatactt

SEQ ID NO: 5040 - DNA, 282 bp, Oryza sativa
  Predicted polypeptide sequence is orthologous to G1789
atggcatccagctccaaggcctcgtcctcgtcgtcggcgtcggcggcgtcgtcggagtggacgaagcagcagaacaagcagttcgagcgcgccctggcggtgtacgacaccgacgccccggaccggtggcacaacgtcgcccgctacatgggcggcgccaagtccgccgaggaggtgcgccgccactacgagcggctccaggcggatgtcgagcagattgaggccggcggcgtgccgttctccttgggctacggcgccacgccacaggccggccgccgctag

SEQ ID NO: 5041 - DNA, 666 bp, Oryza sativa
  Predicted polypeptide sequence is orthologous to G1789
atggactcagagtggagcaaaaaggagaacaagctgttcgaggaggctcttgcctactacggcgagggcgcgcctgacctctttcacaaggtgtctcgcgccatgggaggcaccaagacagccgatgaggtgcgccgccactatgagatcctcgaggacgacctcaagctgatagaggcaagaagagtcccgttccccaatggtatgcacgatgcaccattttgtgattattggtttgcacataggctgcgcgacgaggccgcgggcgaccggcggtggcggtggcggtggcggtggcggtgcgccccttcacctgcggcggattcgcccttgccgggacgacttttgagccgcccaaccaccgagcgcccaaggcctgatgggcttatttctcccaacggcccatataccttcacgggccgtcctgcttcgctggaccaccggatgggtcacgtcgccggccccgctaaactcggtgacggcgacaaaagctcctcaaaggatgccatgggccggggtgctagcttgccgacaacactcctcgtccgatgggcagtgacatgtaccaccaccaccactcgcaggagaaatgatcaggcatacagtcgcggcgcgccgtatcggatccccgtggcgttggccattgccattgccatcctgggttaa

SEQ ID NO: 5042 - DNA, 919 bp, Oryza sativa
  misc_feature (919)..(919): n is a, c, g, or t
  Predicted polypeptide sequence is orthologous to G1789
atcggccatttggccgggggctgcaaacactcgataaccagttcagaaagagaattgctgtgtgagactcgatggcgtcgatgtcggtgagctcgtcgagggcgccgcagtggacggcgaggcagaacgagcagttcgagcgggcgctggcggtgtacgacagggacacgccggagcggtggcacaacatcgcgcgcgccgttgcggggaagtccgccgacgaggtgaagctctactacgacctgctcgtggaggacgtcaagcgcatcgagaccgggaaggtgcccttccccgcgtacaggtgccccccgcccgcgattgcaggctgaaagcacctcgatctgaacgactgcacctggagatctagctatgcggcatgaataatatcctagtctgcactctgtactacgttgatcaatcgatctcccgcgagcgtgcttatttgtaaatttatgcacgcgtgcaataatgtaattaatatatgtgtaatagcatatttgggggtaatgaatgacactcctaaagctattaagttgaagtgccaaaaaaacacgaccgagcacgcacacaacatgtcggacgtctcggaccaggcgagtctaactccaggcaagataatgctatgggacgacattcaactccctgggcaaacgccccatatgagcggcccaccaaccaggcgcgcgtacaaccgcgcgagggaaagtggccattcaattaccggatagtaccgtcagggtcacatagagacgaatctactacgaagctagtgaggagcgtaaccagtatacgtacagaacacagagacatactaacatgatgtcatttctttcttttttgccgcctctcattctcttctctctctccctcgtcatgatggctagcaatagagagaaggcaacaacaaaaggtaagacan

SEQ ID NO: 5043 - DNA, 577 bp, Oryza sativa
  Predicted polypeptide sequence is orthologous to G1789
cgtcgaagacacagcaagatctttacattagagctttcagtagtcagtgtcttaccaaggccactcttgaagatgtctgggtcccggagctcctcccccaactcgaagtctgagtggagcaggaaggagaacaagatgttcgaggaggcgctcgcctactacggcgaggacacgcccaaccggtgggacaaggtggccagcgccatgggaggcatcaagtccgctgaggagatccgctgccactacgaagacctcaccgatgacgtctagacgatcgagtccgggcgagtgcagttccccaagtacaagacgcagggatactggacctgaggatgaaccattggaagctccgatagacagaagatgaagttgtataaactagatccctaagaaagacttgctctaggaggaaccaaattaagtaatccagcattgcttagagaataaaggaagagaaggggtgtgtatgcatatagtattgggttatgagcaaggttaagtccccatgctgttgtagattctcgtctacattcgtcaactgcagtattcattaactctgtgaactaaattatgaagt

SEQ ID NO: 5044 - DNA, 1251 bp, Oryza sativa
  Predicted polypeptide sequence is orthologous to G1804
ggtttccatgaacatggacgagtttgtggctaacatatggaatgctgaagaattccaggctaccaccggaggttgcaagggtgccatggaggaagccaaggtggtagacagtggaagcggaagcggtggtgcaggaggaagcggtttatgtcggcagggatcattttccttgccgctaccgctgtgccagaagacggtggaggaggtgtggactgagatcaaccaagcccctgcacacacctccgctccggcctccgcgctccagccacatgccgggagcggtggtgttgcagctaacgaccgacaggtaacactaggtgagatgacacttgaggatttcttggtaaaggccggggtggtccgagggtcctttaccgggcaagcggccatgggatctggcatggtcaacgggccggtgaaccccatgcagcagggccaaggcggtcctatgatgttcccagtaggaccggtaaacgccatgtatccggtgatgggtgatggcatggggtaccccggtgggtacaacgggatggcgattgtgccaccgccacctcccgcccaaggtgccatggttgtcgtgagtcctggatcatcagatgggatgagtgccatgacacatgctgatatgatgaattgtattgggaatgggatgatgattgagaatggaacaagaaagcgtccccacagagaggatggctgcgccgagaagacggtggagcgccgccaacggcgcatgatcaagaaccgtgagtcagctgcacggtcccgtgctagaaagcaggcttatacggtggagctcgaagctgaactgaactatctcaagcaggagaacgctcgtctcaaagaggcagagaagacggttctactgacaaagaagcaaatgctggttgagaaaatgatggagcagtccaaggagaagatgaatgcaaataggggtggcagccagctgcgccgcagcggcagctgcatgtggtgaaacgggcatagcggtgaccggcgagtggcacactcatcctgcttctggtgtggcactagcctctgaggctctgaagaggatttgcacattaagtcttctttcagactaagtgatgtgaaggtattatggtagtagttgatatacatatatgctgtgatgcttgtaaacctgcctggacccacatgtcttgccatcgtgttcaccggtccttgctgcttatatggttacatgtcgctgtttgtacaaaacaacgatgaataaaattatacaatagt

SEQ ID NO: 5045 - DNA, 1078 bp, Oryza sativa
  Predicted polypeptide sequence is orthologous to G1821
aatggaggccggctacccgggcacggcggcgaacggcgctgccgccgacgggaacggtggcgcgcagcaggcggcggccgcgccggctatacgtgagcaggaccggctgatgccgatcgcgaacgtgatccgcatcatgcgccgcgtgctcccggcgcacgccaagatctcggacgacgccaaggagacgatccaggagtgcgtgtcggagtacatcagcttcatcaccggggaggccaacgagcggtgccagcgcgagcagcgcaagaccatcaccgccgaggacgtgctctgggccatgagccgcctcggcttcgacgactacgtcgagcccctcggcgtctacctccaccgctaccgcgagttcgagggggagtcccgcggcgtcggcgtcggcgtcggcgccgcgcgcggcgaccaccaccatggtcacgtcggtgggatgctcaagtcccgcgcgcagggctccatggtgacgcaccacgacatgcagatgcacgccgccatgtacggtggcggcgcggtgccgccgccgccgcatcctcctccgcaccaccacgcgttccaccagctcatgccgccgcaccacggccagtacgcgccgccgtacgacatgtacggcggcgagcacgggatggcggcgtactacggcgggatgtacgcgcccggcagcggcggcgacgggagcggcagcagcggcagcggtggcgccggcacgccgcagaccgtcaacttcgagcaccagcatccgttcggatacaagtagtaacagcagcagaatggcgatcggtctgcacctgcatgcacacgtatcgcatgcagatcgagctagtagtgcaactggctaacttgaaccagttaaaaacttaagacttagtgatcgtgtgtggtttaattaatttgctacgttcaggtagtgatcgatgagattttaatttcctactgtcagtttaattcaccgttcatgtactcgatccagctagtactactcctagttacccttgttctaatcttaacgcaattgtgtcgatcggacgatcgcacgtttatcttcaagtggaatttgtcttataacact

SEQ ID NO: 5046 - DNA, 1072 bp, Oryza sativa
  Predicted polypeptide sequence is orthologous to G1821
gtcgacccacgcgtccgaatggagcccgcatttcccaacggaggtgcggctgctccaccaccgcccatggcggcggagcagctgccgccggcggcggcggtggtccgggagcaggaccgcctgatgccgatcgcgaacgtgatccgcatcatgcggcgcgtgctcccgccgcacgccaagatctccgacgacgccaaggaggtgatccaggagtgcgtgtcggagttcatcagcttcgtcaccggcgaggccaacgaccggtgccaccgcgagcaccgcaagacggtcaccgccgaggacctcgtctgggccatggaccgcctcggcttcgacgactacgtcccgccgctcaccgcctacctccgccgcatgcgcgagtacgagggcggcggatcaggtggtggtggtggtggtgaccgtggcgccgccgccgcccccgccgtcgtgccgccgccgccgccgccgcctcccgaggacgcgttccgctacgtgcaggtccatcatcccgtgtacgcggcgccaggtgagccggtgcaggggtacggttaccccgtggccatgtcgtctgctctgccggcgccgcacgtgcacgtcggcgtccgcggcggcgggcagcacgaggtgttcggtggcgggccggcgcccctggctgtctactacggaggagcgccgtacggcgaggccagcagccgcggcggctgctctgccgccgacgaggggagctcgtcgtcgagcgcctcgccggcgccggtcggccccaactatgagtaaaaacaaaagaagaagaaaatcaaactcttccccggctgacaggtgatcgagctcgtcgtctacaaattatcaatcgtctgtcgatcgattagcatgtaatctaataaaaaaacttaagctagcttaagacttaattagacatgttctgttcatctttccgccaccgtttcatcgaaagagattaagaatgtggtagtagctagaaatcatttcgagctcgaattacttaatcgtgttgattaattgcaatgatgaactaacaagaggaaatgatgtagtagtattaaaaaaaaaaaaaaaa

SEQ ID NO: 5047 - DNA, 932 bp, Oryza sativa
  misc_feature (190)..(190): n is a, c, g, or t
  Predicted polypeptide sequence is orthologous to G1821
ctgcaggtacggtctggaatcccgggttgagacttgagagagcatggcaggaacaaaaagcgtggtggcaggaacatggatcaggtcgagaaggcggcagtgagatcggatggggtgggaggtagtgcgaccaacgccgagctgccgatggccaacctcgtacgcctgatgaagaaggtgctcccagggnaaagcgaagatcgggggagcagccaagggtctcacccatgattgcgcggtggagttcgtcgggttcgtcggcgacgaggcctccgagaaggccaaggcagagcaccgccgcaccgttgcgccggaagactacttgggctcattcggcgaccttggcttcgatcgctacgtcgaccccatggatgcctacatccatggttaccgtgagtttgagagggctggtgggaataggagggtggcgccgcctcctccggcggcagctacaccgctgacgcccggtggaccgacattcaccgacgcagagctgcagtttctccggtcggtgatcccctccagaagtgatgatgaatatagcggctcatcaccagccataggcggctatggctatggatatggctatggcaaaaatatgtgaacaacttgatgcatgtgtgtgtgtacactgcatgcatgcgtggagggtcaaacagagtcaagactcttgtggtggtgtcataagtctctagtgaacatataagttgtgtatcgtgttccttgtaaaaaaagtcagtatgtgtgtgctcacgggaacctacggggtgggtatggaaaagaatgcgtgctaaaaaacaagggcgctaggcaagagacttgagaagcttaggcgaaaacggcgaagagagacggcactcggacctagggaacgacaggtggggttgttcctctttttgaagtgcacaaagcaccacagcaaacgagacgac

SEQ ID NO: 5048 - DNA, 1660 bp, Oryza sativa
  Predicted polypeptide sequence is orthologous to G1838
agtctcctttcgtttttttttcctccactcctccgcctcttcttccgccgccgcgacgcgccgttgataggtctacgacgatgtcgccgccgacgaacggcgccatctcgctcgcgttcccgcccatggggccgctgccggcggacgcgctgatctacccgttcgacggcctctcctacgacgacttcgtcctccctgtcgccgccgcaccgcagcatccgctccccgtcgccgtcgccgaccccgcgcccctcctcctcctgccgccgccgtcctcctgcacctgcaacggcgccagcagcggcatgggcgccgttgcgccgcgcacgttggctctgggcgccaccaccgacggcagcgtgatgacccccaccagctggggcagcgacggcggcggcggcggctcctcctccgcgcgggccgtgcgctcgccgtcgccggtgctgccgctggtgcagggcaccggccagaggacctcctgctaccgcggcgtgaccaggcacaggtggacggggcgatacgaggcgcacctgtgggacaacacgtgccggcgagaaggccagaagcgcaagggccgccaagtttacttgggtggctatgacatagaagataaggctgctagggcatatgaccttgctgctctgaaatattggggtgctaatgctaccactaacttccctaaagaaagttacgtgaaagagattgaggagatgcaaaagatgagcaagcaggagcttgtagcctcactaaggaggaagagcagtggcttttctagaggtgcatcgatctacagaggtgtaacaggcaccaccaacatggccgctggcaggcaagaattggtcgtgttgcaggcaacaaggacttgtatctcggcacctttgcgaccgaagaagaagcagcggaggcgtatgacgttgcagcgctgaagttcaggggcgccaacgccgtcaccaacttcgagccaagccggtacaacctggaagcgatctctcagagcgacctcccgatcagcgtgtccgggaggcggcacaacagcagcagcaacagcaacaatccagcaccagaagcaggaggccaaatcactctgatgagcagcccgccgatctcccagcagtcgagcagcgcgccaccgtatctcatccacaacctcctgcagttccagccatgtggtcccccatacgcaccaccaccaccaccaccaccaccaccaccaccacaggctcttccgctgccaggatcgtacaactttgcagagccagtaggcttctactggccctacggcgatggggaggagcagaaggttcagctcaacagcaacatggttggaatggctagtggtggctttcttcatctggccaatgctgccaactgatcccagcgtctgcaattgctggtgttgtgtggttcttgtggagattccgagggagtgagattttgggtggatataggaagggggtcttttggcttttgctgctgccatggactaacaacctgaacatagataacagctggagtagtgaacttgactatgctcgttacaacaacagtgggtctaagctcaaaatgagcttgtggtatgccccagatatgcttagttgttaattaatggtttattttgaacaaaagtggttcatactttctaccatgttgtatccttttt

SEQ ID NO: 5049 - DNA, 1756 bp, Oryza sativa
  Predicted polypeptide sequence is orthologous to G1850
aaagacttccggtccgtaccttcgttttcacacgcgaaaactgcctttcttccggcatctggaagctactactactacggtcggtcctcgccggatcagatccggccgcctccccggcggatggcggagcagggggcgggcgaggcggatgcgggcggcggggagccgccgccggcggcggtgatgacggcggcggcggaggcgttggcggggcagaggtcgctgccgacgccgttcctgacgaagacgtaccagctggtggaggacccggcggtggacgacgtgatctcgtggaacgaggacgggtcgacgttcgtggtgtggcggccggcggagttcgcgcgggacctcctccccaagtacttcaagcacaacaacttctccagcctcgtgcgtcagctcaacacctatggatttaggaagatcgtgccggaccggtgggagttcgccaacgactgcttccggcgaggggagaagcgtttgttgtgtgatatacaccgccggaaggtggtggcggcggctgccgcggcgccgccgccgccgtcgccgggatggcgacggcagctgccgcggtggcttcgggagctgtgacggtggccgcggcgccgatacctatggcgctgccggtgacgcgggcgggctcgccggcgcactcctcggaggaacaggtgctgtcgtcaaactctgggtcgggggaggagcaccggcaagcgtctgggtccggctctgcgcccggcggcggcggcggcggctccgcgtccggcggcgacatgggcgaggagaacgagcggctccggcgggagaacgcgcggctgacgcgggagctcggccacatgaagaagctctgtaacaacatcctcctcctcatgtccaagtacgccgccacccagcacgtggagggctccgcggggatatcctccatagcgaactgctccggcgagtcgtcggaggccgttcccccgccgccgcctctccccccggcgatactcgatctaatgccctcgtgccccgccctggccaccgccgccgccgctgcggggctcgccatagacggcgagcccgacccgagcgcgcggctgttcggcgtctccatcggcctgaagcggacgcgagacgacgccgccgccgccgccgacgaagacggcggcggcgaggatcaggccgagcacggcggcgcggacgtgaagccggaggcggcggatccgcatcccgccggcggcggcggcggaagcagcacggaggcgtcgccggagtcgcacccgtggcccatataccggccaacccccatgtaccacgcggtcaggctcacttgcaacgggccggacagggccgggtccgaccaagacgggtccagctccagccaaacgatgggacctggtgaattcgacgatctgcaaaagatgatggtggtgcaacagagcaacttcgtgatgcactggggacgctcggaatgcggtagtggcgtaaggggttttggatggtgatggcagacaacagcaaatggtgttgtgatccacggaggcggagatggtgcggtgatgggtagctgggactagttccaattctccctttccatcctctcgggttgcggcggaaagttcaagtcatcgttgaaggtttaaagctaactcttcaagctttgtgtgtgtgttggtgtgtttgtgtgttttcctctgcatgaggattggagtctaagaacttgtatgttatggttgtgtgatatagaggctagattaataaaaaaaattcattatct

SEQ ID NO: 5050 - DNA, 1938 bp, Oryza sativa
  Predicted polypeptide sequence is orthologous to G1850
atctgccatgaaaggaagcaggcttgcggtgaaagaaagttgtctgccgatgacgatgccaatgccagagactttcgcacagtacagtaatccattgcggtcaactagggcctacggtcaactctgcagggtgccaggccggcggcggcacgcgtgcgtcgacggctgggggcaggaccgcgcccgcacgaggggagacgacggccagcggcgctatgcgcagtgccgcggtggctggggagatatttggagatggggaggctacattacatgcgggtcaccgcgggagacggggatggtgaatggtgcaccgtccccgcccccgccatccccgatggtgatgagttttggaccattagattcaccatgggtgaagcaaccagacaccacggtgtatccaggccagatctgcgcggccgccggcggcggcggtggcatggctgaccagaccgctgctgccgttgtcgtcggaggaggagcggcggcgacgatgggggagccatctccacctccgccggcgccggcagcggaggcggcgggggtgggggtggggcagcagcagaggacggtgccgacgccgttcctgaccaagacgtaccagctggtggatgacccggcggtcgacgacgtcatctcctggaacgacgacggctccaccttcgtcgtgtggcgccccgccgagttcgcccgcgacctcctccccaagtacttcaagcacaacaacttctccagcttcgtccgccagctcaacacctacggatttaggaagattgtcccggacaggtgggagttcgccaacgactgcttccgccgaggggaacggcggctgctctgcgagatacaccgccggaaggtgacgccgccggcgccagcggcgacgacggcggcggtcgcggccgcgatcccgatggcgctgccggtgacgacgacgcgggatggctccccggtgctgtccggcgaggagcaggtcatatcctccagctcgtcccccgagcccccgctcgtgctgccgcaggcgccgtccggctccggctccggcggcgtcgcgtccggcgacgtgggggacgagaacgagcggctgcggcgggagaacgcgcagctcgcgcgggagctcagccagatgaggaagctctgcaacaacatcctcctcctcatgtccaagtacgcctccacccagcagctcgacgccgccaacgcctcctccgccgccgggaacaacaacaacaacaactgctccggcgaatccgccgaggcggccacgccgctcccgctccccgccgtcctcgacctcatgccttcctgccccggcgccgcctccgccgccgcgcccgtatcagacaacgaggagggaatgatgagcgcgaagctcttcggcgtctccatcggccggaagcgaatgcggcacgacggcggcggcgacgacgaccacgcggcgacggtgaaggcggagccgatggacgggcggccgcacggcaaggacgaacaatcggcggagacgcaggcctggcccatttaccggcccaggcccgtttaccagcccatccgggcctgcaacggatacgagtacgaccgagccggcagtgaccaagacgagtgtggagccaagccgagcaaccaggacaagaaagatcttcttcgacggtgggttgttctgatttctgaatctctgcaactgcacggccgtcaagttgtgggggctgtgcaagaatggcggcgcgaccgtcgtggccatcgacggcctcctgcaggtcacgttcagttgcgtacttgcgtcaacaacctcctggtcaccggcgccggcaccctcgacgctggacgagagtacgagaccaactccctacccaggccacgacggtgagatcttagggtttgtttagttactgaagtttgaagttaaaagttcggaaaaaaaagttaaaagtttatgtgtgtagaaaa

SEQ ID NO: 5051 - DNA, 1172 bp, Oryza sativa
  Predicted polypeptide sequence is orthologous to G1850
ctctctggatcttcttctccgtctcctccccggtctcgtgtgagcgctactcccggcccacaggttcttcatggcgtcgccggcggcggggacgccgccgttcttgacgaagacgtacgcgatggtggaggacccgagcaccgatgagaccatctcgtggaacgactccggcacggccttcgtggtgtggcgccccgccgagttcgcccgcgacctcctccccaagcacttcaagcacagcaacttctcctccttcgtgcgccagctcaacacctacggattcaagaaggtggtggcggataggtgggagttcgccaacgactgcttcaggagaggggagaagcacctgctcggtgggatacagaggcggaaggggtctgggaccggaggcgcgggggcggcgccggcggggggcataccgacggcgataccgatctcgtccccgccgacgagctccggcggggagcccgcggtgtcgtcgtcgccgccgcgcggggcggcggggatcgcggcgggggtgagcggcgcggtggccgagctggaggaggagaacgcccggctgcggcgagagaacgcgaggctggcgcgggagctggcacgcgcgcggcgggtctgcgacggcgtgcggcgcctcgtgtcgcggtacgaccacgaccacggcggcggggaggaggaagcgggggagggcgacgtgaagccgatgctgttcggcgtggcgatcggcggcaaaagatcgcgcgaggagaacggggaagacgaggaggaggaggaggaggaaggggctgacgaggacggcgaagacgatgaggtggaggaagacgacgaggagagagagaggcacgcggcgcggcgggtccccgtgagggaggggaaggtcaggaggacgacggagctgtcggatctggacgtgctcgcgctgtccgtgcgggcggcggccgcggcgaggccgggcggggcctcccgtgaccgcaagagctcggtctcgtaacggttgttgacttgctgttgattttatatgcggcgtaaaactgagaaaattggatggcacatgagccaaattgaattgtagttcgtaccagtaccaagcaaactgcagccactttacagggtactaaactatactttcgggagtagtaggaacattgtagccttggttgtcatgatgatgtaaa

SEQ ID NO: 5052 - DNA, 1559 bp, Oryza sativa
  Predicted polypeptide sequence is orthologous to G1863, G2334
aagctgaaagattttacttgcgtcagctccggctaccgtggtcaatgtgcacaatatttcatttggtcctcacctcagccctgtaggcatgcaggcagcaggccttcagttactgcatcccttcggaatcgttaaatgaacagtattcaagcagccgcaggagtatgtgtccggtgtcccactgacaccgataagcagcgacaacgtcgacactcaacatatcccatcccttccttatcccaacgacctgcacgctgcattttcatcactagcatcagtgtattcaaacctgcagcttacactgaagagtgaagactgaactccacagatatgttggccgagggaaggcaagtctacttgccgccgccgccgccgtccaagcttcctcgtctctccggcaccgatccaaccgacggcgtggtgacgatggcagcgccgtcgccgctggttcttgggctgggtctcggtctgggcggcagcggcagcgacagcagtgggagcgacgcggaagcgtctgcggccaccgtgcgggaggcgcggccgccgtcggcgctgacgttcatgcagcggcaggagctggagcagcaggtgctcatctaccgctacttcgccgccggcgcgcctgtgccggttcacctcgtgctgcccatatggaagagcatcgccgccgcctcctcgttcggcccgcaaagctttccctccctgacgggcctggggagcctgtgcttcgactacaggagcagcatggagccggagccggggcggtgccggcgcacggacggcaagaagtggcggtgctcgcgcgacgtggtgccggggcacaagtattgcgagcggcacgtccaccgtggccacggccgttcaagaaagcctatggaagcctctgcagcagtcgctcccacatatctcccggtccggccggcactccacaccgtcgccaccctcgccaccagcgcgccatcgctgtcgcacctcggtttctcctccgccagcaaagtgctcctcgcccacaccaccaccggcaccacgcgcgctacttgatctcattgttatctccgaggattatgccggtgcactgtctgtaacctttttctcgtaatcacgcctcggtttgttcccaatgcatcgtcacgcattgctagtttgacagtttgctaccgctgcctctgtgtgtgcctgtgcgtgtggcagccgaggtgtttttgtttggttgggtggtgggaggcgcgccccggtgcggtggtgggcgtggcccccggctacctagtgctggttcctgcgtgtgcctgtcgaacctgtggagcgtggtcggaagtacggtacgcactgtccggtctcatatgccggggcagaggggttcggtccagtgtggtgcaggcgtgcggattgggatcacatgcagtggctactgcaacttatgcagtcctaaagacaccattgaattataaattaacgtcctagatctttccttgatactgttcacaaataacagtgaaaagttccttcctgtagcaggtactatagcaattactgtttaaaataactgtagcatttgtttc

SEQ ID NO: 5053 - DNA, 894 bp, Oryza sativa
  Predicted polypeptide sequence is orthologous to G1863, G2334
gacaactcactgccccccgtcttctttcttcattcctcttcccaccaagaaccccaaaccttacctccattgagttcgaaaccgaggagcgaggagctacaagccgagttgtcagaatggatgaggagaaggaagccgactcgccgcagccaccgtccaagctgcctcgcctctccggcgctgacccgaatgccggagtggtgaccatggcagcacccccgccgccggtgggtcttgggctggggcttggactcggcggcgacagccgcggcgagcgtgacgtggaagcgtcggcggcggcggcgcacaaggcgacggcgctgacgttcatgcagcagcaggagctggagcaccaggtgctcatctaccgctacttcgccgcgggcgcgcccgtgccggtgcacctcgtgctccccatctggaagagcgtcgcgtcctcctccttcggcccgcaccgcttcccttccctggcagtgatggggttggggaacctgtgcttcgactaccggagcagcatggagccggacccagggcggtgcaggcgcacggacggcaagaagtggcggtgctcgcgcgacgtggtgccggggcacaagtactgcgagcggcacgtccaccgcggacgcggccgttcaagaaagcctgtggaagcctccgcggccgccaccccggcgaacaacggcggcggcggtggcatcgtcttctcccccaccagcgtcctcctcgcccacggcaccgcgcgcgccacctgaccagtgaccagaccggcgcctgtttgtttgtttgtctcggcgcatgggaaaacccaaatccgcagggattatgtcatgtcctgtaactctttttttcctcgcaacttttgaagccaaaacaattctcaccgtgttcgatggc

SEQ ID NO: 5054 - DNA, 414 bp, Oryza sativa
  Predicted polypeptide sequence is orthologous to G1863
ggatggagtatatttggaaaacccccttgtgttatacctcggaccacggcgcctgcaactaggctgttcttttcactttgaatgtcttcttttctactgtcctcacttattgttgttcttcgctttatctattaccctcgggaaaaccgcgagatttgattcgaataaggtttctcaccctctggcgaagtggcataacgcccgacgacccggtgtggctgtgggcctgagttttcgaggaaacgtgctcgtagacctgcgagcaggctgggctttgtgtggaaggggttgtattttgtcaatggatctgggttggccaggtgcagatatgaacagtaccaagcaagctgtagttacaacgacaagggataaggtatccctttgacctagtgaacacgatgattattggaatac

SEQ ID NO: 5055 - DNA, 1380 bp, Oryza sativa
  Predicted polypeptide sequence is orthologous to G1888
gagcttattatatttccctccacttcgtcctcttcttcctcctccatccccatcctccatcggatgcactagtagctggccttgtaccctacctagcttagctacccacccatgtcctcctcctcgtctcctctcgctgtctgcctttgacttggagacctagctcgtcgatcgccggccatgcgggtgcagtgcgacgtctgcgccgccgagccggccgcggtgctctgctgcgccgacgaggccgcgctctgctccgcctgcgaccgccgcgtccaccgcgccaaccgcctcgccagcaagcaccgccgcctcccgctcgtccacccgtcctcctcctcctccggcgacggtggcgccgccgccgcgccgctgtgcgacgtgtgcagggagaagaggggcctcgtgttctgcgtcgaggaccgcgccatcctgtgcgccgactgcgacgagcccatccactccgccaacgacctcaccgccaagcacacccgcttcctcctcgtcggcgccaagctctcccccgccgcgctcgccgaacagccgctcccgtcctccgactgcagctccgacgacgacgccgccgccgccgccaccgaggaggagtaccactcctccgccgcatccaccggcgccgcagtgagcgcgcctcttgacgcctccagcaacggcgccggtggcggaggaggagtaggagggagcagcatctccgactacctcaccaccatctgccccggctggcgcgtcgaggacctcctccccgacgacgacgccttcgccgccgccgccgcgcaggcggggaaagagaaggacgagcgcgtgccgttcctcgacgccgacctgttcgacgtggtcgccggccggccggagaagaagggcggcgcgtgggcgccgcacgtgccgcacctgccggcgtggtgcctcgacgaggtgccggtcgtcgtcgccgcgtcggcggcgccagcggcgacacctgtaaaggcgaagcagggacacgtgcgggacagccactggagcgacagcgacgcgttcgccgtgccggagttctcgccgccgccgccgccggccaagagggcgcggcccagctcgcagttctggtgcttctgaacgccgccgccgccgtacaatctggccgccggcgagctcgacgaacacctcgatggatcgatcgaacacctgtgtaatcactcagctggtcactactacaagtagcaatcagcaagcttgatgtgccactgttactagctgctgctgtttaattagtgagtactaagctactactagttaattttggtgaaaactatgctactttgttactatataatgaagtatgtgtatcaaactaaactgagatgttggtaattaattatcgtattttgt

SEQ ID NO: 5056 - DNA, 1200 bp, Oryza sativa
  Predicted polypeptide sequence is orthologous to G1888
gatatcttttgtacacgggcgtactacgtgttacggctgaaccaatctatccccgtgctcgctgtgaggccattgaccagaggaaacggaggaggagagagcgatcgtggtcgtacgtacgttgggagagaagaagggacgcgcgcgcgcgcgccggagcggcagggcaggatgaaggtgcagtgcgacgtgtgcgcggccgaggcggcgtcggtgttctgctgcgccgacgaggccgcgctgtgcgacgcgtgcgaccaccgggtgcaccgggccaacaagctcgccgggaagcaccgccggttctcgctgctcaacccctcggcgtccggccgctcgccgacatcgacgacggcgccgctctgcgacatctgccaggagaagaggggtttcctgttctgcaaggaggaccgggcgatcctgtgccgcgagtgcgacgtgccggtgcacacggcgagcgagctcaccatgcgccacagccggtacctcctcaccggcgtgcggctctcctcggagcctgccgcgtccccggcgccgccgtcggaggaggagaacagcagcagcttctgctgcagcgccgacgacgccgtgccggccccggcggcgcccgccacgagccacggcgggagcagcggcagcagcagcatctccgagtacctcaccacgctgcccgggtggcacgtcgaggacttcctcgtcgacgacgccactgccgaggccgccgccgccgccgccgccacctcttccggcatctccgcgaacgggccgtgtcagggggtaacacggatcggagggctgcaagaatccgccggctaccctgcgtggatggcgcagcagcagctgtgctgcgacggcctcgtcgccggcgacgcgtcgccggctagccgggagcggtgggtgccgcagatgtacgcggatcagcttgccgccggcagcaagagatccaggacgtccactgcttcttcctactcctactggtgaaactaaagcaattgaggccatggtttgtacgtagtagatgttgtttcgggcttaattaatgactgcattttgcgcttccggacgggagtgtttgtgcgttatttttgaggcgcagaggaaaatctgagccttttgtatcccttcctttttgctcgtcacgactagtactgtatgttttttttctacgcaataacgagaatttttcctcttttccaatgc

SEQ ID NO: 5057 - DNA, 1220 bp, Oryza sativa
  Predicted polypeptide sequence is orthologous to G1888
accactcgtccactcctaataacctaccactctacttctccttgcaacatcgtcgttagtcctctaacccaaggcattgacctgagcttgttgtgcgcttctgccttatctgcatcccctcccggccgagacgcgaccatctttctttcccgcttcgttagctgtctctgccgatcgatcggactggacggggagacatgaaggtgcagtgcgacgtgtgcgcggccgaggccgcctcggtcttctgctgcgccgacgaggccgcgctgtgcgacgcgtgcgaccgccgcgtccacagcgcgaacaagctcgccgggaagcaccgccgattctccctcctccaaccgttggcgtcgtcgtcgtccgcccagaagccaccgctctgcgacatctgtcaggagaagagggggttcttgttctgcaaggaggacagggcgatcctgtgccgggagtgcgacgtcacggtgcacaccacgagcgagctgacgaggcggcacggccggttcctcctcaccggcgtgcgcctctcgtcggcgccgatggactcccccgcgccgtcggaggaagaggaggaggaagcaggggaggactacagctgcagccccagcagcgtcgccggcaccgccgcggggagcgcgagcgacgggagcagcatctccgagtacctcaccaagacgctgcccggttggcacgtcgaggacttcctcgtcgacgaggccaccgccgcctcctcctcctcagacgggctatttcagggtgggctgctggctcagatcggtggggtgccggacggttacgcggcgtgggccggccgggagcagctgcacagtggcgtcgctgtcgccgccgacgagcgggccagccgcgagcggtgggtgccgcagatgaacgcggagtggggcgccggcagcaagcgacccagggcgtcgcctccctgcttgtactggtgaaaaaaaaacgtgcgcttatcagccacagccagtacgaaatgtacgatgcttgtgtaccagtgtactgaggtagtagcgttagaagattaggaatttagtagtggatgttgattttgagcttaacgcgtgtcttggatgaatccctgactcctgaatgtttggggaattaatgtgagtggtagtgtcctctttgggcggcaaagaattatacgccccttgcgaacatgtcgaactgtacggtctgccatttaatctgcacgttcacccctc

SEQ ID NO: 5058 - DNA, 1199 bp, Oryza sativa
  Predicted polypeptide sequence is orthologous to G1888
catatcttttgtacacgggcgtactacgtgttacggctgaaccaatctatccccgtgctcgctgtgaggccattgaccagaggaaacggaggaggagagagcgatcgtggtcgtacgtacgttgggagagaagaagggacgcgcgcgcgcgcgccggagcggcagggcaggatgaaggtgcagtgcgacgtgtgcgcggccgaggcggcgtcggtgttctgctgcgccgacgaggccgcgctgtgcgacgcgtgcgaccaccgggtgcaccgggccaacaagctcgccgggaagcaccgccggttctcgctgctcaacccctcggcgtccggccgctcgccgacatcgacgacggcgccgctctgcgacatctgccaggagaagaggggtttcctgttctgcaaggaggaccgggcgatcctgtgccgcgagtgcgacgtgccggtgcacacggcgagcgagctcaccatgcgccacagccggtacctcctcaccggcgtgcggctctcctcggagcctgccgcgtccccggcgccgccgtcggaggaggagaacagcagcagcttctgctgcagcgccgacgacgccgtgccggccccggcggcgcccgccacgagccacggcgggagcagcggcagcagcagcatctccgagtacctcaccacgctgcccgggtggcacgtcgaggacttcctcgtcgacgacgccactgccgaggccgccgccgccgccgccgccacctcttccggcatctccgcgaacgggccgtgtcagggggtaacacggatcggagggctgcaagaatccgccggctaccctgcgtggatggcgcagcagcagctgtgctgcgacggcctcgtcgccggcgacgcgtcgccggctagccgggagcggtgggtgccgcagatgtacgcggatcagcttgccgccggcagcaagagatccaggacgtccactgcttcttcctactcctactggtgaaactaaagcaattgaggccatggtttgtacgtagtagatgttgtttcgggcttaattaatgactgcattttgcgcttccggacgggagtgtttgtgcgttatttttgaggcgcagaggaaaatctgagccttttgtatcccttcctttttgctcgtcacgactagtactgtatgtttttcttctacgcaataacgagaatttttcctcttttccaatg

SEQ ID NO: 5059 - DNA, 1164 bp, Oryza sativa
  Predicted polypeptide sequence is orthologous to G19
acctcgctctcctcgtcaccgcgatcgatcgatcgccgccggtttagatttccttcctacgcggaccgcacccacgcgctaggtttagctagctagtttgcttgcgcgcaagcgtcgatcgagctagctagtgaagatagatatgtgcggcggcgccatcccgctgatcagcagccgcggccccggcggcaagaggagcctctccgccgccgatgagctctggccgccgccgccgcagcacgccagcgacgacccggccgagcaagcggcggcggatgaggaggagcaggagcagcagccggcggcgaggaggcagcggcgaggggagcggaggacgctgtaccggggcatccggcgcaggccgtgggggaaatgggcggcggagatccgcgacccggccaagggcgcccgcgtctggctcggcaccttcgccaccgccgaggctgccgcgcgggcctacgaccgcgccgcccgccgcatccgcggcaccaaggccaaggtcaacttccccaacgaggacaacgccttcgccgccgcgccgccgccgtaccacctcgccgcctactacggcgacgcctcctccacctcctacctctacccgatggccatgacgcccgccgccgccggactgagggagcagcagctgatgacgacgacggcggtggagtacagcgttaatgacgccgtcgacgtggccagcgtttacttccagccgccgccgccggcggttgcttacgagttcagcgccgtcggcggtggcgccgtcgtcgtgccggtgtcggcggtggcgccggcgatgacgtacggacagagccaagaggtggcggctccgctcatgtggaatttcgatgacatcacggccatgccaatgtgattgtcttaccgtggagattaaggcatttaaaggcttatagataacataaatttgccatgtatgatcaatggttaattcctattgctcaagggcttatattaagggttacctacacggcatggctagcttagcctacaatttatgtttcttgcatttctttctctttttttgagatgagctagtgtgttatactatttgttcatcttttctggtagtggtggatacattttcgccggctagggttggaatttgtaaatagaagatggtcaataataagattgtttctggct

SEQ ID NO: 5060 - DNA, 1050 bp, Oryza sativa
  Predicted polypeptide sequence is orthologous to G19
gagaagaaaagccttgtgagttggtaattgatagtagcaagacaatgtgtgggggagcgatcatcgccgacttcgtcccgcccgccggcgcccgccgcgccgctgcctccgacatctccgacaacgccgtcctctccgctgccggtgccggtgacgagtcgttcgcggcggccaaggcgccggcgccggggaggaagacggcgtaccgcggcatccggcgccggccgtggggacgctgggcggcggagatccgcgacccgaggaagggcgcccgcgtctggctcggcacctacgccaccgccgaggaggccgcccgcgcctacgacgtcgcggcgcgcgacatccgcggcgccaaggccaagctcaacttccccccgaccatcggcgccgccgccgcgccaccgccgcccaagaagcgacgcaaagccgccgccgcggcgaaccaccaccaccaccaccaccagcaggagagctcaggctcctcgtcggcgtcgtcgctgcctcccaccccgccgccggccgccgagcaccagctccgcgagtgcatgtccgggctggaggcgttcttgggcctcgaggaggaggaggacgacggcggcgccggtgagccatgggacgccgtcgacatgatgctcgagtaggctcgccgggaatggcagcgttgccatgctcatgcatccaagcttattcatgcatgcagcagcaagatatacaactttagtactactactatgttaattactacttactgcgtaggtaaatgaaataaaatggggttggttaattagggtgttcttctgggaatccttggctttgctaattgctagtactactatgtactttggcgttaagcattgcattgccaggtgatgcatgtcatgtaatcgtggtaattatatggccgtcctcctagagctagctagcagattagatttactatataaagtggtagtagaaatatatgtcctcctagagctaactagtgtcttgtaatgatttcagacttcttgggcaacatgagcaatgcatttcgacttccactttacatct

SEQ ID NO: 5061 - DNA, 1077 bp, Oryza sativa
  Predicted polypeptide sequence is orthologous to G190
atgcaggcgcaatcccgcctcgctgctgccgcgagcggcggcagcggcagtggaattagcgggagcggtggcattagcaggttgggtggtggagcgggggaggagcacgaggcggtggtgagggagctgacgcgcgggcacgagctgacggcgcggctgcgggcggaggcgctgcgggcgctgcgcgggcaggggcaggccgaggccaccgctacattcatcctcggggaggtctcccgcgccttcaccgtctgcctctccatcatggccagcgcctccccgtccgcctcgccgccacaaccggacgagacgccgccggccgactcagccgtctcgccaccaccaccgcgcgcggcgagagaggacaacgtcccgcgaaagagattattgacagcctctccttacgacgatgggtaccagtggaggaagtacggtcaaaagaagatcaacaacaccaacttcccaaggagctactacaggtgcagttaccaccgggagcgcagatgccccgcgcagaagcacgtgcagcagcgcgacggcgacgacgtcccggcgctgcacgtcgtcgtctacacccacgagcacacgtgcctgcagggggcgcccgccgagcttcccgacgcggcgacgaacggtggcgccgccgccgccgcgtcgccggactacttccccgccggcggcgagacgccgtcgtcgctgcggcggctccggggcgtcggcggcggcggcctgcagcctcagttcgtggaccaccgcgccgccatggaggagcgcgagcgccaggtgctcgtctcgtccctcgcccgcgtgctgcaggggcggcagtgctacgacgacgacgacgacgacgacaccgacgtcgcctccctcggcgccgtgcacgcgcgcgcgcctgcggcggcggcgccggtcgccgcgtcgtcgtcgtcgtccgggcccgtcgacgctgccggcgaggagctggacgtcatggactacgacatgacggacgcgctgttctgggggcctttcggcacggacagcaactcgtacgacggaaacctgacgtcgacacgctgttttgatctaattaattaa

SEQ ID NO: 5062 - DNA, 840 bp, Oryza sativa
  Predicted polypeptide sequence is orthologous to G190
atggcgtcgccgcggctgaagagggagcagtcgttcgacttcgaggaggcgagcgcgcaggaagccgtgggatccgcgtcggcgtcgtacagccctcccgggggcggcggcgtctttggcatctcgccgccggagtcctcgccgcgcgacggccggaagagaaggaaggatagaccatcattggtgaaacatacgttcacacctcattttgatggtcatttgtggaggaagtatggccagaagaacatcaaggactctgctttccctagatgctcttaccgtgaggacagacagtgccttgcctccaagctggtgcagcaggagaacgacgacgacccgccactgtacagggtcacctacacgtacgagcacacctgcaacaccacgcccgtcccgacccccgacgtcgtggccgagcagccgccgccgggcgccgccggcgacgcgtacctcctcaggttcggctcctccgctggcggcggcggcggcggcgctcatcagcagcagaccgagcgagaacgacagcagcaaaatacagcgagaagaaggccattcatgatgctgagcttcgattctagtagcagccatcagctgcacgagcagccgcacgcgttccctcccgacggccagctgccggccacggccgcggccgcgtcgccgtcgtcgttcacggcagccgaggcgttggcggcgccgccgctcacgacgacgatgaacgacggaggcgacctgttctcgacgtgggacgcgctcaggtatggtttggactatgaccacgggcaccttggtaaccatgtttatctccctgatgactgtaatggtggtgatgataattactga

SEQ ID NO: 5063 - DNA, 402 bp, Oryza sativa
  Predicted polypeptide sequence is orthologous to G1903
ctgcgtgctgctccgaccaacagagcttcgtcgagaacggcttcccgggcatgagctactttgagacgtcgggctcgtcggtggtgtacccgcactaccacaagtcgacggacctgcctgagtacgtggactttgagcagatgggcctcatcaccaaggccgccgcggcagcgctggccaccttcgcccagcccttgtaaggatgatggtcgtgatgtgattgtacgttttttatatgttctttcggctgtcttgatcgatgctgcagcgcccaccagcgagctcacccgccctatcgctgcgtggctgtgtgacccacaacgttgagttcgaacgcaggctctcatgttttggtgtttgttgttgtgtacaagaagaaaagaggccgttctttttacaacc

SEQ ID NO: 5064 - DNA, 693 bp, Oryza sativa
  Predicted polypeptide sequence is orthologous to G1917, G383
tttttttttttttttttttttttttttttttttttttttttttttcccctttcaaaaatggcgggaaaattcattcatttcaaacatttttcaggggcctatcgaaaactaacaactcacccggatggaaggaataaacccaatttattctctcccatcaccccggggttaaaaaaataaaatctataaccctaggaaaaaagggtggcaaaacaaaaacaaaattaaaaaggaaaggggagtaggaaaaaataaataaaaggaataattcccccccatccttttatattgcccgaaaatgggggcttgaacaacccttaaaaaccacggcagtagttaaccatatgggaaaaaattccccgatgggggggctggggattaccaacccaactttatttcttccaactgttcttccacctttatgggggcccccggggggcctaaacggggcccactaactcttcggggggcaccccctctttgttcaccctcctggggaaagggcccttgctttacacaacccttttggggggcgccaacccttccgccagaatgggcaacaaagatcgccgttcgctcactcgccggcaaaactgtgcgccccctcgcccttgcccccccccccaggggaacgcggaccacccccacttatccttccgaggtaaaaccccgggggagaatctggcgcacctt

SEQ ID NO: 5065 - DNA, 1149 bp, Oryza sativa
  Predicted polypeptide sequence is orthologous to G1917, G383
gtgtagagtgttgtgaatagccagttcagttcatcagttgataggagccatgcttcaccattactacagcggcggcgccggccatcatcaggacgtcgctgcagctggtagccccggcgacatggcttcctccaccttctcgctcttcttcccgatgtccaatgggcagtgttggccgccgtcgacggtggaggagtccgcggcctacgacgaccacagcaccgtcaccacctctccttcctcgccttcgtcgtcctccaccggctccgtcgactgcacgctctcgctcggcacgccgtcgtctcgccgcgccgagcccgtcgcggcggcggcgccagcggcaaaccatggggcgcccgtgccggcgcattatccgtcgctgtcagcggcgaccgtgtcctgggacgcgactgccgagtcgtactattgtggccagcaggggaggccggccaccggcgccgccaagtgcgccgccggcgccgggcacgacgcgctcctcgaccgccgctgcgccaactgcggcaccgcgtccacgccgctctggaggaacggccctcgcggacccaagtcgctgtgcaacgcgtgcgggatcaggtacaagaaggaggagcggcgcgcggcggcgacgacgacgacggccgacggcgccgccggatgcggcttcatcaccgcgcagcgtggacgcgggtcgaccgcggccaaggcggcgcccgccgtgacgacgtgcggcgaggagacgtcaccgtacgtcgtcggcggcggcggcggcggcggcgaggtcgcggacgcggcgtatctcgcctggcggctcaacgtcgtcccaccggcggcgacggcgacggcgttctcggtgtggccggagcgagctagcctctaccactacaactagctataggcgattaactagtgtagcattagcgttggggagaagggaagctgcaccgtttttttggggaacattttgtacggtcgcacgctcccggattgatcgaactgtatgcatctgctgtgctgtgttgcacgctagctagctagatgactctgatcttgaaacgaaccgtgatcatttcattcatttggaatgaacatgtagctgtgcaaggtcatcttgctcggaaaattcataatcttccaatctcttgtgctgcc

SEQ ID NO: 5066 - DNA, 996 bp, Oryza sativa
  Predicted polypeptide sequence is orthologous to G1917
ccaaagctaaagctgttcggcttccacacctccaagcaggagacgatggattagcacaagcacggctaggagcaggacaggagtagtactcgactgagcgtctgagccggagaacgcgccggccggtctgcggcaacggagacggagctcgatcgcagaggaggagctaggcggccagcgatgacagagctagctcgtagacaatctgatggaggcgtgcccgctgctcattgagtaaagctcgagcttgcttccgccaagctcgacgaatgggtgcgccaaactcgcggtagtcatggcgctcgagctcctccccgcgcatgtatcttcggcgagctccgcctctccactcggagttgcttcgtccctgtgccgctgccttcgccggagaacgccgcccccactgccgcctccaccaccaccgccgtaggtgctggagctcgatttggttgcgcgcttgcggctgtcatcctctacggcggtggaatgggtattggaggacggtgtttgcaggcggcgaatctgcagctccgtcagggacgagatgtcgatgggtgtgcggtggtcctcgctgggcagatggatgagccatgcgcccatgccgaaggagagagagacagtggagaggaggaaggaggaccggactgatacatgggactaactaatctatacaggtggcatcctaatgtgcaaaaatagtgtagaaaaccactcgagggtgtcttttgtactgtattgaaagtttgagggggtcaaatgtctgtctggttttaaagttgtggggtgtgctttagacaagctaaagacttagagggtgtaaaatagacttatccctttaattctgagagagttctggatgttggtgtcggctgccgtagtgtctctagccagtgttggctgaaggaaatctgttattttggtttaagttctaacttgtaagctggaatgcccggcaaaatgctatatttgcttcaatagaagcagggtcattggctg

SEQ ID NO: 5067 - DNA, 528 bp, Oryza sativa
  Predicted polypeptide sequence is orthologous to G1936
tggtgcaaatcaaagaactgctcctcagtggatgttgcctttacttctaggcctgtacggaagtgttacttctgctctaaaagctgcggaattcctcgagcactgttggcctactggagcgctagacagatcgagacgtcctcatccacatatcttctctcgccatttctctcgctgactctgtactctctctttcctcatccacatatcttctacagcggagtcgacgggagaaggggcagcagccgccgggcggggtcgacggcggccgtcgggctggggaggcgacgacggcttgcggcaagtggaggactcgatttgggggtttctttgttttttaaaaaagaatttgtgattcattggatctgtgttatttgatatgtgatgtaattttttttagaatttgtgatgtatttttttgataatttttgacatgaatcttatgatttgtgatgttgttactttgatttggagatgtagggagcaactcgatttggaatttatgatgattttgtgattttgatgaaa

SEQ ID NO: 5068 - DNA, 673 bp, Oryza sativa
  misc_feature (72)..(72): n is a, c, g, or t
  misc_feature (130)..(130): n is a, c, g, or t
  misc_feature (294)..(294): n is a, c, g, or t
  misc_feature (351)..(351): n is a, c, g, or t
  Predicted polypeptide sequence is orthologous to G194
tgggcgccaaagtacggcaagaaagtccggtccaagaaacagccccaacccaaggaactactaccggtgctngacggaaggggtgcaacgtgaagaagagggtggaacggggacaaggacgacccgagcnacgtggtgacgacgtacgaggggacgcacaaccacgtgagccccagcacggtgtactacgccagccaggacaccgcctccggccgcttcttcgtcgccggcacgcagccgccaggttctctcaattaaccgcgcgcgtacggttaatttgatcgatcgggtcanccatgggacttttccaatgctagctagctaatagtgtaggtgttctgggccggattnttgatcgagatagcagcctcttgattgagatgcccagatgggtcattttggatgtagctggatctttttttccccttttcttctctcgatctctgtcccgtcctttttgcctgtttcgatcattggaaggccgggccggcctggctggtttgcagcgatagtgatcaaatgctgtgctgctgtgtttctgtgctcttgaggatcctcccaactatcccccttgagcctaggtaatatagccatgggaaatgtaacatatatatactgtttaaccgtgcaataaaaatgtacagagcttgaaaaaaaaaaaaaaaaaaaaaaa

SEQ ID NO: 5069 - DNA, 1776 bp, Oryza sativa
  Predicted polypeptide sequence is orthologous to G194
cgcctttgcaaaactcctctcatttcatttcctcccaagagtcaagctagcccttcttgcttgctccgttcaacgcctcttccccagcttcacagtactccatgtctggacctggaggaggaggtcatggcctctacgaggatcatcctgcagccgccggcttcctccccttcgaccacgacgacgacgtggtggccagcttcttctttggcagatcggcggcgtccggaggaggagccggcgccggcgccggcgctggagacgatgatggtgttgggctcatcacgccctactccagcatcacggattatctgcaaggcttcctgcaggaccccgtgtacgcgtcgtccccgttgggcggcgatgctgccgtgaagcacgaaacggtggtggatcatcccagtcaggccggcggcgtggcggcggcgccggccacgccgaactcgtcggtgctgtcgtcgtccagcgaggcggctggaggggacgatctgcgccggtgcaagaaaggtcgtcggccggaggacgaggaggaggaggagattgacgatgagggatcggccgttcagagttgcacgaacaaaatgaagaataaaaaaggggcgaagaaggagcgtgagccacgtgtggcgttcatgaccaagagcgaggtcgaccacctcgaggacggctaccggtggcgcaagtacggccagaaagccgtcaagaacagctcctacccaagctactaccggtgcacggcgccgcggtgcggggtgaagaagcgggtggagaggtcggagcaggacccgtccatggtgatcaccacatacgaagggcagcacacgcacccgagccccgtgagctaccacatgcacaggcagcaggggctcatgcatgtgagcgcgcgcggtgtcatgcccggcgccgccggcgcctaccagttcggcgcgccgccgccgccgctccttggcttcgacgaagccctcgccgctcggtcccaggacacagtgctggtatcacaggaagacagattatcacagcaacagaggtctctttattatagagtagatgtacagtcatgttgggctgcggacagatcccgagctcacaactgcattacaaaagggaaacggaagccgggacttggaccaaacaacacaggcgcgacttgggaactaggccgaaaccctaaaactcatcgtagccggcttgctcctggaagaactcctcatcagcaggatccgcttcgtcttcttcagcgactggggggggattatttatatagagcaaggaggggggtacactttacccacacgacattactaacccggatcacccagcccgtggggatcagccacgtcgggagacctccaagctttcatgacaaggcatttccaaagccgatacaggtttaccatatgccgacgagaggggtcccagaccaacaacaggaatcggttcttaagtgcgagagcgggaaaaccgtacacccggctcaagatgttcaaaggtggcttgccttgctcgagatctggagcttgatcctcgaaatcctcgcactgcgggtcttcgggctccggaactacacgcgaaacgggacaactcaacaaacggcgaaaatgaagccctaataatgacctctaagcgtgccattagatagatctcgagatttgaggaattttggaagttgaacggagtcaaacggatctacggttgggaagatattgaatttctaagattattggatttttggtctaaaggaaaaggatttaattaaatcctttttggaaaagaaaa

SEQ ID NO: 5070 - DNA, 1847 bp, Oryza sativa
  Predicted polypeptide sequence is orthologous to G1944
ggctcttgctgctcctcttctcctcgcttcgtcttcttcctcctctcgcctcttcgttgcgagtagagagatttttgttgtgatttttgagggaatatttttggatttttggtttatttttgtgtgggtttttttggaggtgtatttattttgtttttttggtggtgatttatttttgagaggttttaagggattaagggaggtgtgtgaggaagatggggttagtgtgtgtgagctccaatggcgagagctcgtggcggaaaccctactaggttgaggaggaggaggaggtcgtcgtcgcgctcgcgtgtggaccatggaggccaagtcgggggaagcgagcgttgcgccggtggccgtggcgaccgaggcaacggcggcgacggtgagcttccagccgcaggcggcggtggccgagcagggtagctcgagcggtggtgtgctggtgccgccgccgcctatggcggcgggaggaggaggagttgtggtggcggcggcgccggtggcgggggtggtgaaggtggggaagaagagggggaggccgaggaagtatgggccggacgggagcctgatccggccgctgaacgcgacgccgatctcggcgtcggtacccatggcggcctccgcggtggggccctacacgccggcgtcggcggtgggcgccgccatgaagcgcgggaggggtcgccccctcgacttcgcctccacggccaagctccatcaccaccaccaacaccagcaccatcaccagcagcagcagttcggcttccacttcgactccattggtgaaatggtggcttgttctgctggtgcgaattttactcctcacatcatcactgttgctcctggagaggatgtgactatgaaggtcatatcattttctcaacaaggaccacgagctatctgtattctatctgctaatggtgtgatatcaaacgttacactgcgtcaacctgattcctcgggtggcacattaacttacgagggacgttttgagttgctatctttgtctggatcgtttatgcctactgaaaacagcggaacacggagtcggtcaggtgggatgagcgtttctcttgccagcccagatggccgtgttgtcggtggtggagttgctggccttctggtggcagcaagtcctgttcagattgttgtcggaagcttcctaccaagctatcaaatggaacagaagaataagaagcctagggtggaagcggcacccgcccttgcacagactcctcctgctgttccaatctctagtaccgatacgcacagcagcgagcaagggcagcacagctccgtcgccccaagaacaacaaacatcgtaacctcagcatacaacccagaccagagctgggcatctcctgctcagtcgatacctgacagcgcgagaacaccatcgggcgatgtgaaggtcaccgcctctggagcctgaaactgagatgaactgaccaggatccatgaaattcctggtctgtcactgctgcagccgcacaccatgatcgccggtggcggccaaagatggcttcatttctttctgacttgtaaaagatgtatctgagttccagtaggttttccatcttcaggcagaagagtctaactgcaattgctgtagctgtcccgatattagtcactgtttaagcatcaggctaccctgcttccttgtaacaccatgtcggtcttattggagattggagagttctgtagttacaaaattgtactattagttctgtgtgtgtgtgtgtgtgtctctaggcttctttttcattttgttggattactccacttaatttgctcctggtgtaccccttattaaattagcattagaattttttttcactctaatt

SEQ ID NO: 5071 - DNA, 1167 bp, Oryza sativa
  Predicted polypeptide sequence is orthologous to G1944
atggagcccgcgacggagaccacggcgacttcgccggctgcggctgccgctgcgcagccggaggcggaggcggaggcggaggcggagtcggcggcgacgccggtggcagtggcggcggcggcggcggcaacctatcagccgccagcgccggtggttccagtcgccgtggcaggtgcggcggcggggagagggaacgggaagaggaagagggggaggccgaggaagtacgggccggacgggagcctgctccggccgctgaaggcgaccccgatctcggcgtcggtgccggacgactccggcggggggcagtacacgccggcggcggcggtgggggccgtcatgaagcgcggcaggggccgccccgtcgggttcgtcagccgcgcgtcgccggtgtccgtggccgtgacggccgccacgtccaccgccgcggtggtcgtctcgtctccggccacccacacccagacgccgctcgggccgctaggtgaattggtagcatgtgcttctggtgcaaacttcacacctcatatcattaacgttgctgctggcgaggatgttaatatgaaggtcatatctttctcccaacaaggtccaagggcaatttgcattctgtctgctaatggggtgatttcaaatgttacattgcgtcagcaagatactttaggtggtacagtgacttatgagggccggtttgagctgctctccttatccggatcattcacgccaactgatagcggtggaacgagaagccgctccggtggaatgagcgtctcgttggcggccacggatggccgtgtcatcggaggcggagttgccggcctccttgtggctgcaagccctgttcaggttgtggtaggaagcttcctgccgagctaccagctggaccagaacgccaccaagaagcccgtcatcgagatcacgacggtgccgccgccgccgccggccatcggcttcaccatctccagcggcgaccctatggaggactcctacagcggcagccatggccagcaccgctccggcgccgccgcggcgacgacgacgacggcgaaggccaactcgacgtcggcgttcagggtggagaactggacgccaccggcgccgccggcggcggaggcggcgaggacgaagacgccgtcgtcggaggccaaagtcccagtccccggagcctga

SEQ ID NO: 5072 - DNA, 719 bp, Oryza sativa
  Predicted polypeptide sequence is orthologous to G1950
ttttttttttttttttttttttatagatggaggtcttagttgcgcctccgtgagttggaggctttgcaaacactacagccgtacagtcgattctcggagtttggggttagttggatttacagttactttgacgtgcttagttcaaccgaaggagttactagtactgttacaggcataacgcaactcgatgaggtaattaaattgagcaggtaattccttaattctgatgaatcatctttaaaaacttattattttagttttgttcttttggcgcttatcaagctgaaattaaaagtatgcacttttgttttaccacatgtcaggaaatctactatcctatactttcacaaggcaatctgaaaaatgatcagtgcggattttcttttgcttgttacaagaaatgtgattttttttccaatgattccaataggcgctacgcctcttggctatgcaatttatggagggattggggatactgggagctatcttcttgatcatggtgcaaaaccagataagccaagtgaaaaagggtgtacccctctccatctagcagttgaacagggtcccatgtcagtgcatttaccttattgaacatgcgcatggctgcacaacacatgtgtttaccatattatttattgctaggagaactgcaacacttgaacgttctttaaaatgcacggtatccattagtatattcgaaataggacttgaccccggtg

SEQ ID NO: 5073 - DNA, 1010 bp, Oryza sativa
  Predicted polypeptide sequence is orthologous to G1950
tcggtatatggctcatttgagacgcgcacgagatgagcagagtccggagagaaacgcaaacctgaggctcgaagcgtatttctcttctgcgccttcgcttttgcctaagcacgatgtctgctacaatggacatcgacggcgccgccgccagcgccgccgcgggcggtgggagacattcggagaaggagctcttcagcgcggcggagtccggggacgccgcggccttctcctccctctcccccgccgacctcgccgccgcgctcgccctccgcgatgaggacggccggtccctcctccacgtcgccgccgcctccggccacgcccaggtggtgagagtgcttgccgcgatgggcggcgacgcggcggccagcgttgtgaacgggaaggacgaggaggggtgggcgccgatccacacggcggcgagcagcggaaaagctgagatcatctccatcctgctcgatcaaggtgctaatgttgatttgacaaccgatgctggccggactgctcttcattatgctgccagtaaaggacggcttaatatagcagaaacactaatagcgcacagtgcaaatgtcaacaagaaagataagtttgggtgcacacccttacatagagctgccagtacaggaaatgctgaactgtgtgaattcctaattgaggagggggctgatgttgatgcagttgacaaaacaggacaaacaccactaatgcatgctgttatttctgaggacaaagcggttgctcttctgctagttagacatggtgctgatgttgccattgaggacaaggaaggctataccgtacttggtcgagcatctgatagctttagacctgcactaattgatgcagccaaggcaatgcttgaaggctgaaaatgttatgctgcacaaaggttaacgaaggggaacaaattttggtatcgaaaacctgtactaattttttttggttgaatcctgtcttttttaagtatgaaccattctgatctagaatcagatttgatcaactggacc

SEQ ID NO: 5074 - DNA, 640 bp, Oryza sativa
  misc_feature (54)..(54): n is a, c, g, or t
  misc_feature (65)..(65): n is a, c, g, or t
  misc_feature (79)..(80): n is a, c, g, or t
  misc_feature (95)..(97): n is a, c, g, or t
  misc_feature (105)..(106): n is a, c, g, or t
  misc_feature (125)..(125): n is a, c, g, or t
  misc_feature (134)..(135): n is a, c, g, or t
  misc_feature (145)..(146): n is a, c, g, or t
  misc_feature (160)..(161): n is a, c, g, or t
  misc_feature (171)..(171): n is a, c, g, or t
  misc_feature (212)..(213): n is a, c, g, or t
  misc_feature (234)..(235): n is a, c, g, or t
  misc_feature (242)..(243): n is a, c, g, or t
  misc_feature (262)..(264): n is a, c, g, or t
  misc_feature (280)..(281): n is a, c, g, or t
  misc_feature (314)..(315): n is a, c, g, or t
  misc_feature (318)..(318): n is a, c, g, or t
  misc_feature (327)..(328): n is a, c, g, or t
  misc_feature (337)..(338): n is a, c, g, or t
  misc_feature (342)..(342): n is a, c, g, or t
  misc_feature (350)..(351): n is a, c, g, or t
  misc_feature (360)..(361): n is a, c, g, or t
  misc_feature (370)..(371): n is a, c, g, or t
  misc_feature (385)..(387): n is a, c, g, or t
  misc_feature (404)..(405): n is a, c, g, or t
  misc_feature (423)..(423): n is a, c, g, or t
  misc_feature (438)..(438): n is a, c, g, or t
  misc_feature (447)..(447): n is a, c, g, or t
  misc_feature (459)..(459): n is a, c, g, or t
  misc_feature (480)..(481): n is a, c, g, or t
  misc_feature (488)..(488): n is a, c, g, or t
  misc_feature (509)..(509): n is a, c, g, or t
  misc_feature (532)..(532): n is a, c, g, or t
  misc_feature (553)..(554): n is a, c, g, or t
  misc_feature (564)..(565): n is a, c, g, or t
  misc_feature (582)..(583): n is a, c, g, or t
  misc_feature (598)..(599): n is a, c, g, or t
  misc_feature (611)..(611): n is a, c, g, or t
  misc_feature (621)..(621): n is a, c, g, or t
  Predicted polypeptide sequence is orthologous to G1950
acaaccgatgctggccggactgctcttcattatgctgccagtaaaggacggctntaatatagcangaaacactaatagnncgcacacgtgcaaannngtcaacannagaaagatttaaggaaatnagctgaacnntgtgtgaatnntccttaattgaggnnagggggctgnaatagttgaatgcagttgaacacaaacacggacacaacacnncacttaatagcatagctgttnnatttctnngaggacccaaagcggttgnnnttctttctgctagttnnagacactggtgctggaatagttgccacttgagnngancaaggaagnngctataccnngtancttggtcnngagcatctnngatagcttnntagacctgcactannnattgatagcagccaagnngcaatgtcttgaaggctngaaaaatgttatgcntgcacaaanggttaacgaagngggaacaaattttggtatcgnnaaaaccntgtacgtaattttttttggtntgaatctctgtcgttttttaagntatgaacccattctgatctanngaatcagatnnttgatccaactggaccnnataattcatactagnnccaagaattatntgtagtaacntgtcatgtcaaaaaaaaaa

SEQ ID NO: 5075 - DNA, 649 bp, Oryza sativa
  Predicted polypeptide sequence is orthologous to G1950
cgacagggagatccccaacaacaacggcttcacgcccctcaacgccgccgccgtcaagggccacaccaaggtggtggagatcctgctgcaagcgggctgcaatctcaacgcgcgcaacacctacggctggacggcgctcaacgtggccgccgatcacggtcaccaccacatcgtggagctgctgctggcggccggctgccaggtcgacattcccaacaacagcggcttcaccccgctcaactcggcggcgctcaaaggccactctcgcgtggtgcagctgctgctgcacgccggcggcaacgtggagagctcctccagcaagggctcctccgtgctctattccgccgcttgcaagggcttcgaccaggtggtcgagtacctgctggcctggggctgcctgctcgatagccccaacaactccggcttcacgcccctccacgctgctgccagtaacggccacgtcaaagtcgtcgaactgctcttggctgctggcgctgacaaggaaacccccagcaagaatggctggactcccctcaccactgccgcttccaagggctacagtcgcatcatcgagctcattttaagttattaatctcatcttttcgaaaataaatcaacacatcaagatgagatgaaggatcaaaaatag

SEQ ID NO: 5076 - DNA, 1859 bp, Oryza sativa
  Predicted polypeptide sequence is orthologous to G1957
catggtcactttctctctctctcttcccaccatatccccaattccccatagcttagaagcgcacaagactcaatgcaaaccgctctgattcctcctctctctgctcttctccctctccctagctagagcttggcttgcttcctccaaacacagctcgagatcaataggaattcataggaacaacaatacaatacatacacgcatacataggtagatcatatccccctctctagtatcctatagcttacttctttgtaacagtgcctatcctcgaacatcttgcagaggaggaagaaggaagaagaagaaggaggagttgggagagaggagcaagaaatacagccaagaatttgaggaaatagtgatagttttctatggagttcactacaagcagtaggttttctaaagaagaggaggacgaggagcaggatgaggcgggaaggcgagagatccccttcatgacggccacggccgaagccgcgcctgcgcccacgtcgtcgtcgtcgtctcctgctcatcacgcggcttccgcgtcggcgtcggcgtctgcgtcagggagcagcactccctttcgctccgacgatggcgccggggcgtctgggagcggcggcggcggcggcggcggcggagaagcggaggtggtggagaaggagcacatgttcgacaaggtggtgacgccgagcgacgttgggaagctgaaccggctggtgatcccgaagcagtacgccgagaagtacttcccgctggacgcggcggcgaacgagaagggcctcctgctcaacttcgaggaccgcgcggggaagccatggcggttccgctactcctactggaacagcagccagagctacgtgatgaccaaggggtggagccgcttcgtcaaggagaagcgcctcgacgccggggacaccgtctccttctcccgcggcatcggcgacgaggcggcgcggcaccgcctcttcatcgactggaagcgccgcgccgacacccgcgacccgctccggctgccccgcgggctgccgctcccgatgccgctcacgtcgcactacgccccgtgggggatcggcggcggagggggattcttcgtgcagccctcgccgccggccacgctctacgagcaccgcctcaggcaaggcctcgacttccgcgccttcaaccccgccgccgcgatggggaggcaggtcctcctgttcggctcggcgaggattcctccgcaagcaccactgctggcgcgcgcgccgtcgccgctgcaccaccactacacgctgcagccgagcggcgatggtgtaagggcggcgggctcaccggtggtgctcgactcggttccggtcatcgagagccccacgacggccgcgaagcgcgtgcggctgttcggcgtgaacctcgacaacccgcatgccggcggcggcggcggcgccgccgccggcgagtcgagcaatcatggcaatgcactgtcattgcagacgcccgcgtggatgaggagggatccaacactgcggctgctggaattgcctcctcaccaccaccatggcgccgagtcgtccgctgcatcgtctccgtcgtcgtcgtcttcctccaagagggacgcgcattcggccttggatctcgatctgtagcgacctaaagagagaaaaacaaaggaaagttcatcaacgattcttttttcttcttctgttttgatttggtttgttcttcttctcgcagcaacatcgatctcactttctcttgtgattccattataacctgaaatttgatgacagcattaggatttgacatttttgttttgttggccacttaattggaatctttctgttggtttgagaagatatagagaattattaggaaacttgaaagttttcccc

SEQ ID NO: 5077 - DNA, 544 bp, Oryza sativa
  Predicted polypeptide sequence is orthologous to G1990
tgcaggaatcggcacgagggaagaagaagaaccaccgccgtggagacgtaggcgcagcgctcccgattccgcgcgccgccgtcgccgtagccgtcgccgccgctgccgcgccgcggtgtcgacgaaggagccctccgcttgcggccgcttgggtggtcggatctaacatctagggtatgtaccttgaatcctggatttccctgctccgatttcatcttcttggcgtcttcatctctgggacgaacccttgttttctgtatatatgtatataataatagtcagcccgcaatcgtttctgtgttgattagctgggggccagaatttggttggattactactattagtcctgatgttaaggtattattatatacgtcaatcttttgctgctgctgctgctgctaatatttggtttcgtgctgcttcgttaatcgtatttggttttaccttttcgccaatcattgagtttataatccttgtagctattgagtttaatatcaggccgaaatcttggctgctggataggatggcagattgtcctttcctg

SEQ ID NO: 5078 - DNA, 2649 bp, Oryza sativa
  Predicted polypeptide sequence is orthologous to G2
gactacgttctctccattccatctccccccaatcgctcgggcgcaatgcgcagcagcagcagcaaggccacacccacaacctcccctgcttttcgcgtcctctgctctcctcctaggttagcagcggctttgccaacgagatagataggcaaaagagaaagtacttgcatagcccaacaaggcaacagctgctgctaccctctctttcttttctctgcttctccttgctctctcttctcttcctttctttctttctatctcctgctcgttctttccattttcgagagctcaacggaggaagaaggagagagagagaggcaaaggggagcaaaagaagagcagcatggacgggtttggtattggattcgtcttgttttgggcatttcttgcttctgctccttttacctttcatagcaacatcttatcaagttattcttgccatactctctcctctctctctctctctctctctctctcttctcttctctcatcactcaccatcttcttgtcttctctctctcctctcatccttttgtgcaatgcagggattgtggcaagcaggtctatttgggtaagtttcattcatgtccatcttgtccataccccccatacttgggaactgctacaagcggcctccacgattggctcgccaattggagccgttttttctctatgggcgcggtttcgattcctcacaatggctgcctttgtgacgactgaatttgcaggcggatttgacactgctcatgcggcggctcggtaagttggactcaattcctcgtcttccaatcgctgacttctattccctgctcgcccaatcgaatccggcgctgtcaaaattctaatcttttttgttatgttcatttcccaatcgcagggcgtacgatcgggcggcgatcaagttccgcggcgtggaggccgacatcaatttcagcttggaggattacgaggatgacctgaagcaggtgagagcgcgatcgattattattacctgaactttcctttcttttcatgagtcgccacggtttcgttagatcatactactattactgtagctgcaagattaacgggatcattgcagatgagcaacctgaccaaggaggagttcgtccacgtgctccggcggcagagcacggggttcccccggggaagctccaagtacaggggcgtgacactccacaagtgcgggagatgggaggctcggatgggccaattcctcggcaagaagtatgtcctaatcgatcaccgtttcttcctctttcgttcgatcgttcgttcttgggcaatctcccgtaaatcatcttgtgggtttttggtgcactgcaggtacgtctacttggggctgttcgacaccgaggaggaagctgccaggtaaaattattgggccgcactgtgcgcgcgcgcggccattgttgttgaatgtcgagtgtggctgctgcgccgtttgcgagtttacgcttctgggttagatgggcgagcggtgatggtgattgatgtttcttgtctcttggccacagggcgtacgaccgcgctgccatcaagtgcaatggcaaggatgcggtgacgaacttcgatccaagcatttacgccggggagttcgagccgccgggtgggtgtgtcatgtgtgcgcttactgctcatggctaggctgttcgtttgtgagttgtgactgctcatccggacaaaatctgtcactgttttgcagcagcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaaggtaaaaaaagaatggggactttgctttccgcatcagccgattgtcttctcatcacgtaataaaaaggcttaaaaattcctcgttttcttgtctagttcgaccagaactcgaaccatccccagatgcctccggtcctgcaggtcacccacctgccattcagtcccaggcatcatcaccaagtgggtagctcactatacaactccactccacttcgctccatttgctgctgaatttctcgcgtttggtttcaccggtatccgtgagctgatgaattcttgatgtctgtgctgctagttcttgagcaatggtgatccggggacagcgggaggcctgtcactgacgatcggcgcaggcatggccgggcactggcctccccagcagcagcaagggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacctaagatgatcaaagatttaaaattcaagatcgctgcattcatcgtctcctcgtcgatcgatcatggcaaagatcgatggagagagagaggtgtgtgtcactgacgcagggaaaaactcaatgcagatttaccagcaagaacaagagctggatgctattcttttgctct

SEQ ID NO: 5079 - DNA, 1671 bp, Oryza sativa
  Predicted polypeptide sequence is orthologous to G2
gtatgtcctaatcgatcaccgtttcttcctctttcgttcgatcgttcgttcttgggcaatctcccaatcatcttgtgggtttttggtgcactgcaggtacgtctacttggggctgttcgacaccgaggaggaagctgccagggcgtacgaccgcgctgccatcaagtgcaatggcaaggatgcggtgacgaacttcgatccaagcatttacgccggggagttcgagccgccgggtgggtgtgtcatgtgtgcgcttactgctcatggctaggctgttcgtttgtgagttgtgactgctcatccggacaaaatctgtcactgttttgcagcagcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaagttcgaccagaactcgaaccatccccagatgcctccggtcctgcaggtcacccacctgccattcagtcccaggcatcatcaccaattcttgagcaatggtgatccggggacagcgggaggcctgtcactgacgatcggcgcaggcatggccgggcactggcctccccagcagcagcaggggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacctaagatgatcaaagatttaaaattcaagatcgctgcattcatcgtctcctcgtcgatcgatcatggcaaagatcgatggagagagagaggtgtgtgtcactgacgcagggaaaaactcaatgcagatttaccagcaagaacaagagctggatgctattcttttgctctaccttttttcttctctctttcttcttctctgtttcttgattgggcgagcgagatggagatggatctgatcatgaatgggacacaagtgggcatgtaaatgaggagctccctagaaggcgagagagattggccaagcgtcgcctcaagcagtgtaggagtatctatcttttgccgtttcgctcgctttctttccttcttttctttcaccatggccaacaacgatgactctgggtgtcaacatcacagctcattttgttcggtctcatgttgcatcattcactgcatgatgaccatgattcgggaaaatttgctccatgcacctccgcttggccgacaacacttgccctctagtaagcatccttaaacacccacggtttctactactattcatcgctttataaatcctacggagtgctagctttacgctactactactgtcatgtaatctatcatcatcaaaagagacgatcagattaacatatatgtcaactatttaagctttggctctttgctttccaagaaacgtaactgccgagatgtggagcatatagaagtattcgtccttctagatgttggtactaaagtaatgttctttcttttctccctct

SEQ ID NO: 5080 - DNA, 2001 bp, Oryza sativa
  Predicted polypeptide sequence is orthologous to G2
gacgtcccatccatccctccccccccttttccctcctcctccacctccactgccatggccgcctccgccgctcctctctcccgcgtggtagccgccgccggttgccgccgctaggggagcgcgacgggggaacggtaggggcgacccagctcgctctgtcgccccgcggctggtgggggtgcgcgcgggggagagcggttggttagtatggtgctggatctcaatgtggagtcgccgggtgggtcggcggcgacgtcgagctcgtccacgccgccgccgccgcccgacggtggcggcggggggtacttccggttcgacctgctcggcgggagccccgacgaggacgggtgctcctcgcctgtcatgacgcgccagctcttcccttcgccgtctgcggtggtggcgctggcgggggacgggtcgtcgacgccaccgctgacgatgccgatgccggcggcggctggggaggggccgtggccgcaccgcgcggcggatctcggggtggcgcagagccagaggtcccccgccggcgggaagaagagccgccgcggcccgaggtctcggagctcccagtacaggggcgtcaccttctacaggaggaccgggcgatgggagtcgcacatctgggactgcgggaagcaggtgtacctgggtggtttcgatacagctcataccgcagcgagggcctatgatcgcgcggcgatcaagttcagaggcctcgacgcggatatcaactttaatctgaatgactatgaggacgacttgaagcagatgcgcaattggaccaaggaggagtttgtgcacatacttcggcgccaaagcacaggatttgcaagggggagctcaaagtaccggggtgtgacactgcacaagtgtggccggtgggaagctcggatgggccagctgctcggcaagaagtacatctatctaggattgtttgacagtgaaattgaggctgcaagagcatatgaccgggcagctatccgcttcaatggaagggaagctgttactaattttgatcctagttcttatgatggagatgttctacctgaaaccgacaatgaagtggttgatggagacatcattgacttaaatctgagaatttcacagcctaacgttcatgagctgaaaagtgatggtaccctaactgggttccagttgaattgtgattctcctgaagcttcaagttctgttgttactcagccaataagtcctcagtggcctgtgcttcctcagggcacatcgatgtcccagcatccacatttatatgcatctccttgtccgggcttctttgtgaacctcagggaagtacctatggagaaaagacctgagttgggtccccagtcgttccctacttcgtggtcatggcaaatgcagggctcccctttgccattactccctactgcagcatcatcaggattctctacgggcaccgtcgccgacgccgcccgctcgccttcctcccgcccccatccatttcccggccaccaccagttctacttccccccgaccgcctgactgccacctattctggtggaggcgacacctcaccgtgcatccaccgccgcttgctgataacattcgtcgtttgtccagagagggaccttctccatatgatatccctctctatgttccacctggttatgatcagaattctcacgctcatgattcttttatcttcatttttgagtgcgaaaccacgaatcgtgaccatgctaccaggtaaacacccttgtacctctttgactctacaataaaattaatgtaagatattctggctaaaagtgattggccctccctactgtatttttacagagttgtaatttgaacagtgggcactaaagctggggcccactcgcaccagtgtctagtggagcgaagctttgcccttttcttgctatccagcaactattcctccgcctgcctccattgctgacagtggagatagcttcccagtggtcactgttccactgtactctgtcatagtttctgatcacccct

SEQ ID NO: 5081 - DNA, 1380 bp, Oryza sativa
  Predicted polypeptide sequence is orthologous to G2
atgtgggacctcaatgactcgccggcggccgaggccgcgccgccgccgctgtcgccgtccgccgacgactccggcgcctcctcgtcctcggccgccgccgtcgtcgagatacccgacgacgccgacgacgactcggccgctgtggttgtcgtcacgcgccagttcttccctccggccgtcccgggcggcggcggcgaccccgcccccgggaacgcgcgcgccgggtggctccgcctggccggagccgccccgccggtcgctgcaacggggccggcggcgtcggcggcggtgtccaagaagagccggcgcgggccgcggtcgcgcagctcgcagtaccgcggcgtcacgttctaccgccgcaccgggcgatgggaatcgcacatatgggattgtggcaagcaggtctatttgggcggatttgacactgctcatgcggcggctcgggcgtacgatcgggcggcgatcaagttccgcggcgtggaggccgacatcaatttcagcttggaggattacgaggatgacctgaagcagatgagcaacctgaccaaggaggagttcgtccacgtgctccggcggcagagcacggggttcccccggggaagctccaagtacaggggcgtgacgctccacaagtgcgggagatgggaggctcggatgggccaattcctcggcaagaagtacgtctacttggggctgttcgacaccgaggaggaagctgccagggcgtacgaccgcgctgccatcaagtgcaatggcaaggatgcggtgacgaacttcgatccaagcatttacgccggggagttcgagccgccggcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaagttcgaccagaactcgaaccatccccagatgcctccggtcctgcaggtcacccacctgccattcagtcccaggcatcatcaccaattcttgagcaatggtgatccggggacagcgggaggcctgtcactgacgatcggcgcaggcatggccgggcactggcctccccagcagcagcaggggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacctaa

SEQ ID NO: 5082 - DNA, 1342 bp, Oryza sativa
  Predicted polypeptide sequence is orthologous to G2
gtgtttggttgggttgccggtgtggtgaggattggagatgttgttggatctcaatgtggagtcgccggaacggtccggcacgtcgagctcctcggtgctaaactccggggacgccggaggcggcggtggcggtggcggtggcggaggattattccggttcgacctcctcgcgagcagccccgacgacgacgagtgctccggggagcagcatcagttgccggccgcctcggggatcgtgacgcgtcagctcctcccgcctccgcctcccgcggcgccgtcgccggcgccggcgtggcagccgccgcgccgcgcggcggaggatgccgccctcgcgcagcggccggtggtcgcgaagaagacgcggcgcgggccgaggtcgcggagctcgcagtacaggggcgtcaccttctacaggaggaccggccgctgggagtcgcacatatgggattgcgggaagcaagtctacctaggtggtttcgacacggcgcacgcggcagcaagggcttacgatcgcgctgcgatcaagttccggggactggaggctgacatcaacttcaacctgagcgactacgaggacgatctgaagcagatgaggaactggaccaaggaggagttcgtgcacatactccggcgacagagcacgggattcgcgagggggagctccaagttccgcggcgtcacgctgcacaagtgcggccgctgggaggcacgcatgggccaacttcttggcaagaagtacatataccttgggctctttgacaccgaagttgaagctgcaagagcatatgacagggcagctattcgcttcaatgggagggaagctgttaccaacttcgagcctgcatcctacaatgtggatgctttaccagacgccggaaatgaggcaattgttgatggcgatcttgatttggatttgcggatttcgcaacctaatgcgcgtgactccaaaagcgatgtcgccacaactggcctccagttaacttgtgattcccctgaatcttcaaatattacagtccaccagccaatgggctcgtctccccaatggactgtgcatcaccaaagcacaccactgccccctcagcatcaacgtttgtacccatctcattgtcttggcttcctcccgaacctacaggagaggccaatggacagaaggcctgagctgggtcccatgccgttcccaacacaggcttggcaaatgcaggccccttctcacttgccattgctccacgctgcagcatcatcaggattctctgccggcgccggcgccggcgtcgccgccgccacccgccggcagccgccgttcccggcggatcaccccttctacttcccgccaaccgcctga

SEQ ID NO: 5083 - DNA, 759 bp, Oryza sativa
  Predicted polypeptide sequence is orthologous to G2
ggattgtgggaagcaggtgtacttgggtggattcgatacggcacaggctgctgcaagggcttatgaccaggctgcaatcaagttccgtggagtggaggcagacatcaacttcaccctggatgactacaaggaggacataaagaagatgaacaacttcagcaaggaggagttcgttcaggttctccggcgacagggcgccggcttcgtcagggggagctcgcggttcagaggtgtcaccctgcacaagtgcggcaaatgggaggccaggatcggccagctcatgggcaagaagtacgtgtaccttggcctgtatgacacggagatggaggctgccaaggcttatgacaaagcggcgatcaagtgctgtggcaaggaggctgtgaccaactttgacacccaagcgtacgaggacgagctcaacctgcaatcttgggatagcgagcttgatcttgagctcagcctcgggtgctccggtggcgaacgggccgccggcgaggtcctccactctgcaccaagcaaccagaggacgagcctgacgttcatgctgccggaggaggaggagatgaccgcctgccaccgtcagaggagcatctgggctaggccttccttggctccggcgatgccggacggcggcgcggtcatccgccctgatcagcatcagcatcaccccagtagccggaacatgctcctgatggtatgtatgcttactgacagtggtgttcctacattgatcttcctgagatcacgggccctgagtag

SEQ ID NO: 5084 - DNA, 1305 bp, Oryza sativa
  Predicted polypeptide sequence is orthologous to G2
atgttgttggatctcaatgtggagtcgccggaacggtccggcacgtcgagctcctcggtgctaaactccggggacgccggaggcggcggtggcggtggcggtggcggaggattattccggttcgacctcctcgcgagcagccccgacgacgacgagtgctccggggagcagcatcagttgccggccgcctcggggatcgtgacgcgtcagctcctcccgcctccgcctcccgcggcgccgtcgccggcgccggcgtggcagccgccgcgccgcgcggcggaggatgccgccctcgcgcagcggccggtggtcgcgaagaagacgcggcgcgggccgaggtcgcggagctcgcagtacaggggcgtcaccttctacaggaggaccggccgctgggagtcgcacatatgggattgcgggaagcaagtctacctaggtggtttcgacacggcgcacgcggcagcaagggcttacgatcgcgctgcgatcaagttccggggactggaggctgacatcaacttcaacctgagcgactacgaggacgatctgaagcagatgaggaactggaccaaggaggagttcgtgcacatactccggcgacagagcacgggattcgcgagggggagctccaagttccgcggcgtcacgctgcacaagtgcggccgctgggaggcacgcatgggccaacttcttggcaagaagtacatataccttgggctctttgacaccgaagttgaagctgcaagagcatatgacagggcagctattcgcttcaatgggagggaagctgttaccaacttcgagcctgcatcctacaatgtggatgctttaccagacgccggaaatgaggcaattgttgatggcgatcttgatttggatttgcggatttcgcaacctaatgcgcgtgactccaaaagcgatgtcgccacaactggcctccagttaacttgtgattcccctgaatcttcaaatattacagtccaccagccaatgggctcgtctccccaatggactgtgcatcaccaaagcacaccactgccccctcagcatcaacgtttgtacccatctcattgtcttggcttcctcccgaacctacaggagaggccaatggacagaaggcctgagctgggtcccatgccgttcccaacacaggcttggcaaatgcaggccccttctcacttgccattgctccacgctgcagcatcatcaggattctctgccggcgccggcgccggcgtcgccgccgccacccgccggcagccgccgttcccggcggatcaccccttctacttcccgccaaccgcctga

SEQ ID NO: 5085 - DNA, 1236 bp, Oryza sativa
  Predicted polypeptide sequence is orthologous to G20
aggtgcatatgatgatgaagaggctgcagcaagagctatgaccttgctgcattgaaatactggggagctgggacacaaataaactttcctgtctctgattatgcaagagatcttgaggaaatgcagatgatctccaaggaggattatcttgtgtctcttcggagaaagagcagtgccttttccaggggtttaccaaaatatcgcggccttcctaggcagctccataattccagatgggatgcttctttgggacacttgcttggcaatgactacatgagcctagggaaggacatcacgctggatgggaaatttgcaggaacctttggcttagagaggaaaattgatctgacaaattacataaggtggtggctcccaaaaaagacacggcagtcagatacatctaaaatggaagaggttactgatgaaatccgtgctattgaaagttcaatgcaacggactgagccttataagtttccttcccttggcctccattctaactcaaagccctcttccgtggtcctatcagcatgtgatatcttatctcagtctgatgccttcaaaagcttctcagaaaaatctacaaaactatctgaagaatgtacttttagcaaagaaatggatgaaggaaagacagttaccccagtacctgcaactggacatgacacaactgcagttaacatgaacgtgaatgggttgcttgtgcaaagagctccatacacattgccctctgttactgcacaaatgaaaaatacctggaaccctgctgatccttctgcggaccctcttttctggaccaacttcatcctgccagcaagtcaacctgtcacgatggcaacaatagcaacaacaacgtttgcaaagaatgaggtgagttcaagtgatccattccatggtcaagagtgaccgtacgagcttaccaaagtgcatgcaggatttgctttttggcttggtgggtgataacatcctgcacgtctatgggtttccttcttcctagcttttgaggtgacccgtgaacaaataccctttgtatccatagttcataagccatgaatagaaggtaagagaagtacaaccatagttatgtaatatatacagtgcctagtggcctagtgccccgttaatgatatttagttatagagctgtctgtacatatcgcggttcttatttcagctacttggttggttctatagaatgaagagaacagaagaacacgaatttttcaaagcttaattgttt

SEQ ID NO: 5086 - DNA, 4669 bp, Oryza sativa
  Predicted polypeptide sequence is orthologous to G2007
ggtcttcctcctcactcacctcgcgtcccttgcccccacggggtcggtgatcacagcgccaagacgagagcaaaattctcatccgggagggacgcatcggggaggggacaggtcacaggttgaggttgcaatcggggggcgctcgtgcgcggggcagcattttgggttcactgtcgcgtccatccccatgctgttccccccttcaggcgcagcagccgcgtggaaggtcgctcgctggtggccacgggggaatcccctgatgcgaggtcgtcgtcatggagacatccgctgctggtcagttctgttcctcaccaaggcggagcaagctggaccaacccgattaattggctcgtgtagaattaacttgacaatttgactgacatggatgatagccatagtggtgtcccatttaagccaaattattggttaggacagggccaagtaaggttttgggtgttttatgagtgagatctgacctggctgggtttagatcatcctcttttagttcgaacgcccaacaggcaacaacaaaggcgtgatgtagcagcatataggaactactaataagcaaactaacaagttcagatgataacggcgattggctaattttggacccacggtatgtagtcattgcttgagaaatcgaacttactcggccccaaaatcctggacattagtttaagatcttatggtctaagcgtcgtggaatgacatacgatgcttgattgaaaaggaagatatgaatccactcggtcttgctagctaccaatgatttcctagatcccaatatcctgtggcagtgaaattaattggtcatatatacatacatatatatatttctactgtatcatcgtacaacttgcaggggtagttagaactcgtggtaaattattccattgtctcatcatcgtagcttgttgttttgaaagagttagcctagttagattagaacctttctggatataacttctcaccattcatggtcatatttcagaatcaaaccccatgaaggcataggagtagtgcgccaacttctgtatgattcctgcagagacaaatgaattgaattgttccaatagaatacgctctgtctgtcaaagaaaaatactcatgaataatttagtaggcactagaagttacattttcctggcagttcaatattccagttgattgctgcagtctgtgcctttacgtgaacttgcgataagtcactaagtctgtgcctttatagggatgtcttactgagggaacctgtattcaagatgcaagaagctaggagtggagaactagatgaaacttgaccttttcctacctaatccattacgctataatcaaactcagattggattacgcgttttccagctgcaaagttgataatccaggttgttattcagtggatttagctgattggaaatgtcggacctgtttcaattatatttgttgaatttttctaactgatcatgaactgaatccgtttggtccgatattaacctgaagctttaggaaattgctgtacttagctgctcgatattgtattttaatcttattactcttgttggtaagtacataagcactagatagtagttgctgctatgttatccatatgagcatatacattgactggcagaaccttctagagttgtagggattaaacccctgacaattgagagcatgaacgtaatatggtttgaaattcaaaagataggactgaacatatttttatataacatggttcaggaaattagttacatgaagacacctcgttaaagtacagtttttcctttcaaatgaccgctgaaaataaaacagtaaaatacgtatgttaaaagacacgaatattagggaaggacataatgtcaaataattagaagaggtgaagcttcgaacccaggtcgtctagcccaccatcttgtgacgctagccggaagaccccggggtgtttttcaaaaaaaaaaaaaaaactgtgttaaagtacagtttttcctgtcaagtgaccactgaaaatagaacagtattatcaattgattattgcctttcattcatgcaatcaacatagatgtggggttgcaaggaattaaacatatttgaaatgcacaccttgcttgtctatgtcttagatcttgtggtgtaagtcttggaagacaggatggaattgacctaccacctagaagaatctcattcttatagtgccatcagtactgaaagtaatgtttccttctcattattcttttttgtaaatttgattgtgcaccacatgtaaaaatgcatgatgattttggccggttattcatgctcttaagtttgttgtctttacccttcaaaagagtatgcagtaggatcgtcaatcttaaattcaaaatggaaaatctcgttcagatttccagtgcttcattatctctgcgaatcactagtttgtgttaaaattgctaatttattatatataattctatattattaaagggtgtctcactctgccactctctgtttgcttcttctgttccttgggtgaaattttgaattttagtcattagtctggacaagtggaaactctcatgtctctatttttttcccacaaacactcatctgtctatttgatttacatttggtatattcatattttcactatgctcaagtacctttctcatactaagaggtccactgttattcattgactacggatcttgacaaagcaaatttatacactgtatagtctacgcaggctaatccagcaaaacccatattatatggtggcaaaataacactgtttctttctcactccagatcagttctattagctgaaagaatctattaaaacgtccatcaatgcaaatagcattctagcagtccagcatttcattgccaacatcagataccttattaccattagtatctaaataggttcgtatcctacacaagattacatattcctgggatttgccaagatatgatttagactagctcatgatctgccacattagttgacacatttggcacaaaatatttgttgagagttaattcccacttcaattttctgaagcgcagaacactgatttgacgttactttttttgttacagagaacggtcatttcattaccttgtcggagaatcagttatatacctgcagatggttacttttgtctgttgacgtcattcctgagcagaaataagcacatggatgtctggcattggttggattgccaattttaggatgtcaattagtactacagtatgcaggttctatggaggtgttcgctaagtatggctgatatgtcaccttgtttctccgtggttcttcgcaccttccaacttcgcatcaagtaaatttgaacaacggttggccggctgtcttgcctgttaattacagcaagtcaatcagtcagtaactacaggccggaggaaggtgacactctgacggatcgtatcggtatggctgacacgagacgtctggctgcagctgtggttcgtcgagtcttctttcccgggccagaggtcgccgtcgtacaaagcatgtacccgttccggccatctggacacacggctgagcgaggttgcttgctcatggcgaccgtctacgacgtcgacgacgatgccacttgctccgaggaggttggctgggctgcatgctgagcgctgcgagttgcaggcttgcattgcatctaccactttgcatgcctgttctgccggggccgtggttttttgtggctgacggaatggttgatgggatcattgcgtaagggcgcaaccacggcaaggtgggcgggcaggcagacatgcaaccgtggggaacggaagtggcaaagccttcagcgacaccggactgtagcttttgtgtggtggaggagagcgtcgatcgaggaacagtctccaggccgggcggggtgcatgcagcactgcaagtggtggtggtgtttagccttgtgggcgcagctaagtcagcgagctgcctccgtcgccgccgtcgccatcaccggagattaaaaagagcttggagaaggagggcctacctatatatacgcccttgcacccgcaggctccggttgcagccgcgagcggatcgggctcgccgaggtcgacttccccggaggcgatcaccggcagaggaggaggagcagtacgtgtgtatatataaaggatggggaggcagccgtgctgcgacaagctgggggtgaagagggggccgtggacggcggaggaggacaagaagctgatgagcttcatcctgaccaacggccattgctgctggcgcgccgtgccgaagctcgccgggctgctccgctgcggcaagagctgccgcctccggtggacaaactacctccgccccgacctcaagcgcggcctcctcaccgacgccgaggagcagctcgtcatcgacctccacgccaagctcggcaacagatggtccaagattgctgccaagctaccgggcaggacggacaacgagatcaagaaccactggaacacgcacatcaagaagaagctcatcaagatgggcatcgacccggtgacgcacgagcccctcgaccggaagcaggagagcccggccaccacctcgcagtccaccgtcacggcggagtcgtccaagtccggcgaggcgaccaggcagcaaagccggcagcttgacgacgccgtcgtcagggacatgtccgtgtctgccggtggcgacagcccg

SEQ ID NO: 5087 - DNA, 1807 bp, Oryza sativa
  Predicted polypeptide sequence is orthologous to G2011
ggcccgtcgccctcgcacagtatgtcggtttcgaacccgaagcctataaattccgcgccaccaccacctcctcctccacaatggaccacaacaccgaccctcctccgaccaccatggtggacgccgcggcggcgctgctgctggagcccaagctggaggggtacgacgacgacggcggcggcgagccgctgcagccggccccgttcgtctctccgctggaccagctgatgcagccgccgcggccgctggaggcgctgctgcaggggccgcagctgccgccgttcctgtccaagacgtacgacctggtgtgcgagccggagctggacggggtcatctcctggggccacgccggcaacagcttcgtcgtctgggacccctccgccttcgcgcgcgacgtgctcccccaccacttcaagcacaacaacttctccagcttcgtccggcagctcaacacctatggttttcgcaaggttcatgctgatagatgggagtttgctcatgaggatttcctacgacatagcaaacatttgttgaagaagattgtccggcgcaggtcctcaccaacacaacaaagtggtcttcagcctggctcttctggtgaatccggtttagaccctgaactcaacacactgagaagggagaagagtgcattgcttcaggaggtgaccaggctgaagcaagagcaccttcagacaattgaacaaatgagcacgctgaatcagaggctagaatcagcggaagatcggcagaaacagatggtctctttcttggccaagctcctccagaacccaactttcctgaggcaacttaagatgcacagacagcaaaaggaaatcgactccaccagagtgaaaaggaaattcctcaagcatgtaccacatggcaacattgactcaggtgagtccagctcacaacacactggagagagcaatttagatttctcccctacgtccctggaccttccagccacgcacagtgacatcttagaccttcagaattttcttttggaagatggggacctcaatcttgccatgctgccagagaacataggacttgatggaatcgaagcaccagacgacatcggggcgttggttcagggatttgacacacaggaggaacttgagcttggtagcggagttgagctactggaaatacctccagcttctggtcctcgtggccaagatcccacgattggcagatccaagggaaagaatgtattgtctccaggattggatgctacctcttctgaagctgattgcctcggatcattttctgacaatatggggatgctttctgactccatgttacaaacagcgggtaaattgatggatgcagatgatgacgagcgaatttggggcgtcgatgcttcgtcggctttacaaagttcttgcagtggcactagtcagcaagcatatggtagtcttgttagtgatccctatctgatggagatggctaataagcctgaaaaattctgggagctcgattttcaggcactggatgatggagatctgcagctggacaagtgtgttatcgatgaccctgctcttcagcaacagagaggaaatatgaattcgtagatcaaacgcagcttgggagagtaggacctgatgttttatctacctaaaaactatagttcactatgaacattgctatagttatttgatattcaggaggcttgttaactcctgaatatgcgcactatggcattaagaagtagcagtagcagcagtagtatggttatgctttttgttttccattcattcaccctgctgtttttgaatggaaattgttgttgtgtggttttctc

SEQ ID NO: 5088 - DNA, 614 bp, Oryza sativa
  misc_feature (41)..(41): n is a, c, g, or t
  misc_feature (196)..(196): n is a, c, g, or t
  misc_feature (313)..(313): n is a, c, g, or t
  misc_feature (391)..(391): n is a, c, g, or t
  misc_feature (399)..(399): n is a, c, g, or t
  misc_feature (531)..(531): n is a, c, g, or t
  misc_feature (557)..(557): n is a, c, g, or t
  misc_feature (559)..(559): n is a, c, g, or t
  misc_feature (573)..(573): n is a, c, g, or t
  Predicted polypeptide sequence is orthologous to G2057
gaccgacggagaatgttgagaatggactggatggagtgccntggggactagacattgcttttgggctgcaagcaccaaggagtttgcatgggggaacctggatatacgggctacatgactgctttgcttgatgaaacccttggctggaaaagatagttggatggtgctgctgctcgacatgttgttgcgatgagtntgatgacaggtgtgatgcatgtgttgattgaccacactggcctgggcacctggataatatacgaagattcataattagatataaagtgtggaatggaaagacccattgcaactgttnagatgatgtattatgggtgggaatgcttgccggtgagggcaatgaaaagaaatatggaccgagttgttgtgggaacgntgctgatnagcggggcataaaatcccccagggtgttgctgtggtgtggtgccttgtgtgtgatgtgttctgttctttggtttatgcgtacaggttgtaccaatcctgggataatggtcttatttaaagtttaccatgtanaaaaatatgcttgtactggaaccgtncnggctctgagtaatntttttgttttggtttagacacaaaaaaaaaaaaaataaaaa

SEQ ID NO: 5089 - DNA, 1674 bp, Oryza sativa
  Predicted polypeptide sequence is orthologous to G2057
tcttgttttaattttcgctcttctcctttccggttaactgtgggtgagagggagctcaagctggaggaagacaagaaccagttgtccaagggcttagacccttggacgagcaaccctaccgccagcgcgagcaccttgcactacctgctccaggagaaggagagggcgcagcaagcgcatgagcagcttcagatctaccagcagcagcagggattcggcagcttcctgcaacaccggatcaggcagccggcgagccgggggccgggaggtggaggcggcggcggcgatggcggcggcagcagcggcgagtcgacgcccgtcgaagcgctggccactgcattcggggcaggccgcatcgtgcggtccgcggccgggcgcaaggaccggcacagcaaggtgtgcacggcgcgcgggctgcgggaccggcgcgtccgcctcgccgcgcacaccgccatccggttctacgacgtgcaggaccgcctcggctacgaccggcccagcaaggccgtcgactggctcatgcgcaacgccaaggccgccatcgacgagctccccgaccgcgccgaggccccgccgccgcccgccgcggcgtcgacggagcagcccgaggccaccgagcaggcgacctcgacgtcctacgggttcggcaacactaccggcggcaccatgaccagcgccgcgtcggccgctgctggctccttccttccacattcgctgggggcagatcgagtctccgacagcgtcaagtccctgttcccctcctcgtccacagccagcggcgccgcctccgccggacacgacgagtacaggggatccccgccggacctcctgtcgcgcacgacaagcaaccagcagccgcaggagctgtgcctcaccctacagtcgaaccagcaccagatcttcagccatgtctcgtcgaaccaccacggtatgatctcgagtgcaggcgttccaggttggcccgaccacagccagagaatgcaggcatggcatgccccggagaacagcacaggagacggccgcggcggcggcaatggcgacggctacatgttcgccatgccgtcgcggcaagggctggaccagagccagctcttctcgcatggggaaccccttcagtccagcggtcgcgggtgggcgtcagcccgcgcatggctagaccccctcgcagtcgcagccatccaccaccagccgtcgacaatggctgccggacaggtcggcttcggccatctcgttggcggcgccggtggcggcggcgggtttatggggtttctcgcgccggcggcgcagcggcttgagggcgaggaggagcacggaagtgaggtgatcaggtgatgagaagagactgaagaattgatgcatggcgcgcatgcaggaggtgtgtgctttctattaattaacacacttcactgatctgcttaagggtacgtgtatgtcatttcatgtaggattttggctgatgaaatttccctcattattatctgctgtcttcatgcatgtgtaaccaaggcttaattaattattaagagtacgttcccttggaactaggcagctgttgctgttgcattagttgctattgctgttttcccctttattctcggcatggacaagatgtgatgatgaagagatgatatggtctaaaaaaaaaaaaaaaaaaaaaaaaaaaaaaaaaaaaaa

SEQ ID NO: 5090 - DNA, 2442 bp, Oryza sativa
  Predicted polypeptide sequence is orthologous to G2057
cgagcggccgcccgggcaggtcacaaacccaacaagagagtgagagaggagcaaaagctttggctggccgtcccccctgttaaaatgtgatgtccaatccatgggattgcgtctagtttagtcccccactcctctcctggttatgggatccggcgaggtggatggacgcgcattggagcagcaacagtagcggcggggaagaaggcggcgggggatctggatccgaggcaccaccaccaccgggtcacccacggcggcgacggcggcggcgtaggaggaggaggaagcgggggacaggaggaggcagatgagcagcagcagcagcagcacgaccaccaccggcttctccagctccaccaccaccagggtgtgcagcaggaccaagaaccgccgcctgttcccgtcttccacctccagccggcgtccgtgaggcagctgtcgggctcctccgccgagtatgcccttctctcgcccatgggcgacgccggcggccactcccaccaccaccaacacggcttccagcctcagctcctctccttcggtggcgtcggccaccaccaccacctgcatcagttcacggcgcagccacagccccccgccgcgtcccacactcggggtcgtggaggtggaggtgagattgtccccgcgacgacaactccacggtcgaggggcggaggcggcggcggcggcggggagatcgtggcggtgcagggcgggcacattgtgcggtcgacagggcggaaggaccggcacagcaaggtctgcacggcgcgcgggccgcgcgaccgccgcgtgcggctgtcggcgcacaccgccatccagttctacgacgtgcaggaccggctgggctacgaccgcccgagcaaggcggtggactggctcatcaagaacgccaaggacgccatcgacaagctcgacgtgctgccggcgtggcagcccactgccggcggcgcaggcgcgggcaatgccgccgcgccgccgtcctcctcgacccaccccgactccgccgagaactccgacgaccaggcgcaggccatcaccgtcgcgcacaccgccttcgacttcgccggcgggggcagcggcgggaccagcttcctcccgccgtcgctcgactcggacgccatagccgacacgatcaagtccttcttccccatgggtggcaccgcaggcggggaggcatcgtcgtccaccacggcggcgcagtcgtcggccatgggtttccagagctacacgcctgacctcctgtcccgcaccggcagccagagccaggagctccggctgtcgctgcagtccttaccagaccccatgttccaccaccagcaacatcgccatggcggcggcggcggcggcggcaatggcaccacgcagcaggcgctcttctccggcgccgccaattactcgttcggcggcggagccatgtgggccaccgagcagcaggcgcagaaccagcgcatgctgccgtggaacgtgcccgaccccggcggcggcggcggcgccgcctacctgttcaacgtgtcgcagcaagcggcgcatatgcaggcggcggctgcggcgctgggtggccaccagagccagttcttcttccagaggggaccccttcagtccagtaaccagccctccgagcgaggatggccggagaccgtcgaagccgacaaccagatgagccaccaccaaggagggctgagcccctccgtgtcggcggccatcggttttgccgctcccggcatcggcttctccggcttccgcctccccgcgaggatacagggcgacgaggagcacaacggcggcggcggcggcaatggcgacaagccgccgccgccgtcgtctgtctcctcggcttctcaccactgaccgcagcagtggcgagcagatgacttcaccaccaccaatccaccatgagcaaacaccacaccatgtaccagactatcagctagctcctccacttccatcacggaattgtcgattgcattcgggaggagcaaagtttggaggtagcacaagtgcactactactgatgctactacatatcggttggttggttggttggttttccatcgatctcttctgctgctgcgcatgtcattggtttttgtttcaagaattcactcggagcttcttagaattaggcttgtgagaatgcagcaacacgatggcaagctttagcttagcttagcaagcctctgtgtctgttggctgttgcgttgcgctaggtgtagttgatcgatgtaggttcgagcttgctttgctttgttttgatttttactcttttgttgctgatgcatggacatgcttttgcttcctcctgtgggttcaggagcagttgctactagaccgatgttgttctcaaaactgataagtgggatggtgatggattgggagaggagcctatctttcatcttttccaaaaaaaaaaaaaaaaaaaaaaaaaaaaaaaaaaaaaaa

SEQ ID NO: 5091 - DNA, 516 bp, Oryza sativa
  Predicted polypeptide sequence is orthologous to G2057
cggcgccatgaccagtgccgcgtccgctgctggctccttccttccacattcgctgggcgcagatcgagtctccgacaacatcgagtccctgttcccctcctcgtccacagccagcggcgccgcctccgccggacgcgacgagtacaggggatccccgccggaccttctgtcgcgatgacaagcaaccagcagacgcagtcacgcaggagctatgcctcaatctggtgagcaattttaggaccgacgaagtgacacttctctgtgttggctgcctctacaggggtttggatattctgcaaaatatgtaactagaagtatatatgcaagtgatgtatagttcctgtaggttcttttgtaagtactctgggagtgattgaattatgatgaaagtgatataaaggtcctctgtgcttttattaagtactctgtaagtgattttccaaatgcaatcaaaagctgcctcaaataatttgtttccaaaaaaaaaaaaaaaaaaaaaaaaaaaaaaaaaaaaaa

SEQ ID NO: 5092 - DNA, 1497 bp, Oryza sativa
  Predicted polypeptide sequence is orthologous to G2071
ggattaaacctgatttccccttgctaattcgggccatcgcatcactcccccaactaatcacactcctctcttctccgcttcctcttctcgtatatttataaccccacttcccttttcttcctctttcttctcatcttggtttcttcctagtttcgggagaggattttagtgagggatttgaaggattttgaggtgggagaggagatggagttgccggcggatgggagcgcgctggcgaggcaggggtcgatctactcgctgacgttcgacgagttccagagcgcgctgggaagcgccgagaaggatttcgggtcgatgaacatggatgagctgctgcgcaacatctggacggcggaggagtcgcaggccatagcgccggcggcggcggctgcttcggcggcggcggtggttggggacgcgcagcagcagcagcagccgatccagaggcaggggtcgctgacgctgccacgcacgctgagccagaagacggtggacgaggtgtggcgcgacatcatgggcttgggcggcagcgacgacgaagaccccgcggcggcggcggctgcggcggcgcccgcgcagcggcagccgacgctgggggagatgacgctggaggagttcctggtgcgggccggcgtcgtgcgggaggacatggggcagaccatcgtgctgccgccgcaggcgcaggcgttgttccccgggagcaatgtggtcgccccggccatgcagctcgccaacgggatgctgcctggtgtcgtcggcgtcgcccccggcgccgccgccgcgatgacggtggcggcgccggccacgccggtggtgctgaacgggctggggaaggtggagggcggggatctctcgtcgctctcgccggtgccttacccattcgacaccgcgctcagggtgaggaagggccctaccgtcgagaaggtggtggagaggcggcagaggcggatgatcaagaacagggagtccgctgctaggtctcgcgcgcggaagcaggcttatataatggagttggaagctgaggtggcaaaactgaaggaacagaaggctgaattgcagaaaaagcaggtggaaatgatacagaagcaaaatgatgaggtcatggagagaatcactcagcaacttggaccaaaggcaaagagattttgcctccgacgaacactgactggtccatgctgaagccagagtctccggtttcgccgtggcgctcagcttcagagttgcttctctccttgttggtgaatggtgatggctcagtctcttggacggtcgaatgctggcgtcgattactcactaggtttagctgcgagatcgttgcgtgagcaaaggcatactatctaatctgtttaactccttatttagggaaatctggcatggtgaaaacggggcatgccatctgtgtttgttgtttttgtgcagctgttgcatctgctctgtatgttgctgttgcgttgacatgtcatcccgtttacagttcagtgattctgttctgtaccc

SEQ ID NO: 5093 - DNA, 1331 bp, Oryza sativa
  Predicted polypeptide sequence is orthologous to G2094
accaccattccctcttcttctcctcctccttgcttctcccgccccttaacccctactgctccctcccagtagccggtgctaaccctagcttgctagctagattgctctctctggtagtagtagatccgtggagtggagatctgcccgcggatcgagcggcggcggcagagcaccagccgtgtctgcggcgcggtgtgcgcgggtgttgcggagcggcggctgagcggaggtgtgggaggagggggagtgctgcggcttccggggtgttagatccgccgatcctggcgccggagatggattcctcgtcggtcgagaaggtgaagcttccgatccgtgggttcttggggggctcgatctgtggctggaatggcgccttggctgggtggttttttgacgctcgatctgtgggttgcaggggagtgggtcgatagatccggacgagcgcacggcctccggcgagcccaaggcgtgcaccgactgccacaccaccaagactccgctctggcgcggcggcccctccggccccaaggtgagatgagatccgatctgctcctcctgctcttccctttctcgatctgtgcatttttttcgcctgggttttcggtggttgatccgcccgatctgtgtttttttttttgctttgatccagtcgctgtgcaacgcgtgcgggatccggtaccggaagaagagacgggaggcgctggggctcgacgccggcgagggcggcgcggagcggcaggagaagaagaagagcaagagggagagaggggaggaggtgaccatggagctccgcatggtggggttcgggaaggaggtggtcctgaagcagcggcggcggatgcggcggaggagacgcctcggcgaggaggagaaggcggccatcctcctcatggccctctcctccggagtcatctacgcctgaaccaccaccctacctacctacccacctagcaacagcaagagagagagaagcagaggaaaggaggcagccatgggaaagagtgatttgcttgcttaacatgcatgatctcaaccgggagagactagacagatctctaccctttttttttcttctcccctgcttagtttttccagctaattagttcgatcaaagtggaagccaagttaataatgatgatgatgatgtagtagctgctgttcttcctgttactgttacttgttcttgcctagctgtaatgttactagtagtgtttttagtagagcgtgtaacgttgcaatgtaagaaagagcttatgatccatcttctttctcttgttctttgcaagagattagctcctggatctgcaccaagtaatgcagtttttcagctg

SEQ ID NO: 5094 - DNA, 434 bp, Oryza sativa
  Predicted polypeptide sequence is orthologous to G2094
ggcggatgcgccgcaggaaatgccttggcgaggaggagagggccgccatcctggtcatggcactctcctcgggcgtcatctacgcctgaacctccaaccgaatcaacctctggcgccatggcaggaagaagaagcagcgattccttcccctctctttttttccctccccccggcgctatggcagtcaccgaagctagctaataatcaatcttgtcttgtggtgtagtagctcttgttgttcttgccttaagctgtaacgacgtctgtaatgcgactctttgtctgtgtctctgtactagtactagtagtagtagtttaccgcctaacattcaagtttggtttctctgcaatgtaacaagagaagaagaagaagaggaagaagaagaaaaaaagagctaaagctggagcttgagcttgagctttggttattgatc

SEQ ID NO: 5095 - DNA, 1038 bp, Oryza sativa
  Predicted polypeptide sequence is orthologous to G21
accacacaccacgccactcgcctcgcctcgcacagtcgctcgctcgcccgctctagctagctcacagctcgctcactcgctctcctcttccaaccaactccaccaccaccaccagtccaccacagcgcgcggcgccatggacgactcgtcgttcggttccgagccgaccacgtcctcctcgggcggggaggcgccggcctccccgccgtccaccgcgtcgtcgtcctcagacggcgccggcggcaagaagaagcggccgcgcaaggacgggcaccacccgacgtaccgcggggtgcgcatgcggagctggggcaagtgggtgtcggagatcagggagccgcggaagaagtcgcgcatctggctgggcaccttcgccaccgccgagatggccgcgcgcgcgcacgacgtcgccgcgctcgccatcaagggccgcgccgcgcacctcaacttcccggacctcgcccacgagctgccgcgcccggccaccgcggcgcccaaggacgtccaggccgcagccgcgctcgccgccgccgccgacttcccggcctcctccgccaatgcgggcgccagcaataaccccgacggatcggacgacgcgagcgccgggtccgcctcgccgcccccgccgccggacgccgctgacgacgcgctgttcgacctccccgacctcctcctcgacctcagatacggcccgcccagctcgggcctctcgtgcgcgtcgtcttgggaagacgaagtgggcttaatctccggcgccggtgccgccgccgccggcgtgttccgcctggaggagccacttctgtgggagtactaaaagccaaagcgccgccggtaaaacactcgtcagtgctaaaatcgagcagcctgcatgtacaacccgtaattttccacgcatgaccaaaagaattcatgcatgcaagccagctacggcctacggcgcacagaaacttgagccaaaaaatcagcgtcgttttgtcctgcgtttgcgtcgccaaatttgggaagcagaccatgtataaaaaatcatccttcttttcc

SEQ ID NO: 5096 - DNA, 1109 bp, Oryza sativa
  Predicted polypeptide sequence is orthologous to G21
cctggaaggaagcgcatctccttcctgcggtattctgtgtgcctctctctctctctcctccaccttgtcgtagagaggaggcggccatggaagctgccgcgatccatgcgcccaccaccaccacctcctccgactccggctcgtgcgtcaccaatggcacgcgagagaagcgcgagatctctaagcacaagcagctcaagcggaagaggagcacctctcctgctcctcctcccggctgcggcggcggccaaggacaggaagcggcggtggagactgacgctgacgctggcgccgccggcgaggaggagagcagcagctgcggtggcgctggcgccggcgagggcgagcgcaagaggggtgacgccggcaggcacccgtcgtaccgcggcgtgaggcggcggagctggggcaagtgggtgtcggagatccgcgagccgcgcaagaagtcgcgcatctggctcggcaccttcccgacggcggagatggccgcgcgcgcgcacgacgtggccgcgctcgccatcaagggccgcgccgcgcacctcaacttcccgagcctcgcccacacgctcccgcgcccggcctccacctcaccctccgacatccaggccgccgccgccctcgccgcagctgcagccgccaccgaccaatgcgagtcctcctcctctgccgtcgccgccgccaccgccaccgacgccgaggcggcggagtccacctcgtcggccgcggccagcccgtgcgccgccaccagcagcgtcgaggagaacgcgctgttcgacctgcccgaccttctcctcgacctgagcgacgggctctggtgctcacccgtctggacgacagcgccggccgatcagtacgacgccggcgacgacggcgacgacgccgcggcgccgctcctgtgggccgagcagtgctggatggacgccccagcggcgcccgtgcagcctgactaattaagccaatccacctgctccgactcgccggccggccattgcaccggttgggttggtcgcagcagtcaacctatcgacaccatgggcgtctttttcttttctctctgtttttttttcttttttggacagagtaataaggaaaaaaatatagattaaaaa

SEQ ID NO: 5097 - DNA, 870 bp, Oryza sativa
  Predicted polypeptide sequence is orthologous to G21
atggccatggcgaaggagctccaagaaacctcctcgtcttcgtcctcctcggctgcctccacgtcctcctgctcctccgccgtcacggacgcgtggtcgtcgccggccagacccaatgctgtggccggggggaagaggaagaaggaggtggtaggagaggctgatgaggctgcaggcggcggcgcaggagaggaggaagaggaggaggcggaggcggcggcggcggggaagtcgtcggcggcgacgaagaagaggaagcggagcagcgacgggaagcacccggtgtaccgcggcgtgcggatgcgggcgtgggggaagtgggtgtcggagatccgcgagccgcggaagaagtcgcgcatctggctcggcacgttccccaccgccgacatggccgcgcgcgcccacgacgtcgccgcgctcgccatcaagggccgcgccgcgcacctcaacttcccggacctcgccggcgtcctcccgcgcgccgcctccgcctcgcccaaggacgtccaggccgccgccgcattggccgccgcgttcaccacgtccccgtcctcgtcgccctcctcctccttgtcggccgacgacgtcgcgccatgcgtcgtccacgccgacgccgacgagcagcctgccgctgccgccaagaacgacgacgacgacggctcaaccaccgcgccggtggcggcggcggcggcggcggcggcggcggatgagcagcagctgttcgacctgccggacttgctgttcgacatccaggacgggccgttcgggttcccggcgatgtgggcgccgctcgccgacgtcgacgaggtcaatgcggagctccggcttgaggagccattgctttgggacttgggagtaacagatgcttaa

SEQ ID NO: 5098 - DNA, 904 bp, Oryza sativa
  Predicted polypeptide sequence is orthologous to G2107
actgcttgagacgtcgcacacgtcatggagaagaacaccgccgccagcgggcaattgatgacctcctccgcggaggcgacgccgtcgtcgccgaagcggccggcggggcgaaccaagttccaggagacgaggcacctagtgttccgtggggtgcgatggcgtgggtgcgcggggcggtgggtgtgcaaggtgcgtgtcccgggcagccgcggtgaccgtttctggataggcacgtctgacaccgccgaggagaccgcgcgcacgcacgacgccgccatgctcgccttgtgcggggcctccgccagcctcaacttcgccgactctgcctggctgctccacgtcccgcgcgcccccgtcgtctccggactccggccaccagctgcccgatgtgcaacgcgctgcctgcaaggccatcgccgagttccagcgccgggccgggggagcaccgccactgccactgccacctccggcgatgctgcatcgaccgctcctccgtcggcacccgttctgtcagccaaacaatgcgaattcatctttctttcttcactagattgttggatgttaatgtcaaagcttatcagcagtagcagagcaaaaggatcgttgtgcctgcgaaaaaatcccatttcattttgcatggttacaaattcttacactgctcttttgctcgaatacattatattgcagatgaattcaatgatcgttttaatccacgaattatcaaaatatcaagtctttctgctactaaccatgataacacaccacctttttcaatggaggaggtaggcgcggacgccctcgccatcatcgtcgatgtcgccactgatgacgaggtccgcgccgctcaccagctcgcacgcctcgtcgtcgtccatgctcgccacctcggtccagcagctgaacc

SEQ ID NO: 5099 - DNA, 194 bp, Oryza sativa
  Predicted polypeptide sequence is orthologous to G2107
gagagagtcatccatggaggtggaggaggcggcgtacaggacggggagggcggaaaacacttatgatgtcggcgggaaggaccaagttcagggagacgaggcacccggtgtaccgcggcgtgcggcggcgcggggggcggccgggcgcggcggggaggtgggtgtgccacgtgcgggtgcccggggcgcgcggc

SEQ ID NO: 5100 - DNA, 1272 bp, Oryza sativa
  Predicted polypeptide sequence is orthologous to G2107
agaattcaaaccggatcaacctcgctcgcttactcgtgtttaggcatggacgtttctgctgcgctcagcagcgactactcgtcggggacgccgtcgccggtggcggccgacgccgacgacggctcctccgcctacatgacggtgtcgtcggcgccgcccaagcggcgagcggggcggaccaagttcaaggagacgcggcaccccgtgttcaagggcgtgcgccggaggaaccccgggaggtgggtgtgcgaggtgcgcgagccgcacggcaagcagcggatatggctcgggacgttcgagacagcagagatggcggcgcgcgcgcacgacgtcgccgcgctcgcgctccgcggccgcgccgcctgcctcaacttcgccgactcgccgaggcgcctccgcgtcccgcccatcggcgcaagccacgacgacatacggagggcggcggctgaggcggccgaggcattccggccgccaccagatgagagcaatgcggccaccgaggtggcagccgccgcatcgggcgccactaattcgaacgccgaacagttcgcctcccacccgtactacgaggtcatggacgatgggctggacttggggatgcagggctatctcgacatggcgcaagggatgctcattgacccgcctccaatggccggtgatcctgccgtaggtagcggcgaagacgacaacgatggcgaggtccagctatggagctactgatcctgcgcgtttgaactcaacttggtttggcgcgaagagatcgcatgtacagcttaagggagtcgagtacaagtacctcaggtgtactccactcgttgcccctttcccttccctttcgtttttcttgagcttatctgcagggtaatgttatgtattgctgctcttctgatgaaatgtgatcggaagaagcggaaggccagatcgagcttatgggttctgaagacggtgaaggcttgtcgagtgttgtgagcatatattcagaaagtcaggcactgtgaaagtatgaatcagatcagccttgttacgaatgagagtgatcgaccttgttcagtgtttataattgaaccacttgtgtgtaataagcagcaaagccatgttgcttgcttgatctgactcttgggaatggtatatttctcaaagaatgcaggattgactactcagaatttgacattttgcagtgaaatgataggattgttaaattaacattggaggagaggcatgtgtatatatgttaagaaacattagtaatgatgagcctatgatacttcgatc

SEQ ID NO: 5101 - DNA, 840 bp, Oryza sativa
  Predicted polypeptide sequence is orthologous to G2107
ccctcctctcatcgcaccaccacgccactgagctcaagctaagctaagtgctaacctaggtgttcgaccatggacaccgaggacacgtcgtcggcttcgtcctcgtcggtgtcgccgccgtcgtcgccgggcggcgggcaccaccaccggctgccgccgaagcggcgggcggggcggaagaaattccgggagacgcggcacccggtgtaccgcggcgtgcgcgcgcgggcgggggggagcaggtgggtgtgcgaggtgcgcgagccgcaggcgcaggcgcgcatctggctcggcacctacccgacgccggagatggcggcgcgcgcgcacgacgtcgcggccatcgccctccgcggcgagcgcggcgccgagctcaacttcccggactccccctccacgctcccgcgcgcgcgcacggcgtcgcccgaggacatccgcctcgccgccgcgcaggccgccgagctgtaccgccgcccgccgccgccgctggcattgccggaggatccgcaggaaggcacgagcggcggcggcgccaccgccacctcggggcgtccggctgccgtgttcgtggacgaggacgccatcttcgacatgccggggctgatcgacgacatggcgagggggatgatgctgacgccgccggcgattgggagatctctcgacgactgggccgccatcgacgacgacgatgaccattaccacatggactacaagctatggatggactgacatgtatacacacatatcgttcgagtatatatgcttacagatatagataatactccatcagttcctactaaatacggagtatatatttttagataaaggatttatataaaa

SEQ ID NO: 5102 - DNA, 711 bp, Oryza sativa
  Predicted polypeptide sequence is orthologous to G2107
atggagaagaacaccaccgccatggggcaattgatgagctcctccgcgacgacggcggcgacggcgacggggccggcgtcgccgaagcggccggcggggcggaccaagttccaggagacgaggcacccggtgttccgcggggtgcggcggcgcgggcgcgcggggcggtgggtgtgcgaggtgcgcgtcccgggcagccgcggcgaccgcctgtgggtcggcacgttcgacaccgccgaggaggccgcgcgcgcgcacgacgccgccatgctcgccctgtgcggggcctccgccagcctcaacttcgccgactccgcctggctgctccacgtcccccgcgcccccgtcgcctccggccatgaccagctgcccgacgtgcagcgcgccgccagcgaggccgtcgccgagttccagcgccggggaagtactgccgccactgccaccgccacctccggcgacgccgcatccaccgctcctccgtcgtcgtcgcccgttctgtcacccaacgacgacaatgcctcgtcggcgtccactcctgcggtggcggcggcgttggaccacggcgacatgttcggtggcatgcgcaccgatctgtacttcgcgagcttggcgcagggtctgctcatcgagccgccgccgccgccgaccaccgctgagggtttctgcgacgacgaaggatgcggcggcgctgaaatggagctgtggagctag

SEQ ID NO: 5103 - DNA, 967 bp, Oryza sativa
  misc_feature (836)..(836): n is a, c, g, or t
  Predicted polypeptide sequence is orthologous to G2107
gcccacgcgtcgcacactcgagcagagcagagcagagcaaatacagttcaggaatcaggagcaagcagaaacacacacacaaatccgaagatgtgcgggatcaagcaggagatgagcggcgagtcgtcggggtcgccgtgcagctcggcgtcggcggagcggcagcaccagacggtgtggacggcgccgccgaagaggccggcggggcggaccaagttcagggagacgagggacccggtgttccgcggcgtgcggcggaggggcaatgccgggaggtgggtgtgcgaggtgcgggtgcccgggcggcgcggctgcaggctctggctcggcacgttcgacaccgccgagggcgcggcgcgcgcgcacgacgccgccatgctcgccatcaacgccggcggcggcggcggcgggggagcatgctgcctcaacttcgccgactccgcgtggctcctcgccgtgccgcgctcctaccgcaccctcgccgacgtccgccacgccgtcgccgaggccgtcgaggacttcttccggcgccgcctcgccgacgacgcgctgtccgccacgtcgtcgtcctcgacgacgccgtcccacccacgcaccgacgacgacgaggagtccgccgccaccgacggcgacgagtctcctccccggcagcgactggcgtcgaatggacgtcctggtgaatgggtgggcctgtttaggagctggcagggatcctggcccacgcgggctgaaaggtacacttccagtcctgggctacccaaggaccgggtccctgtggccggtagataagaacaaaaaaagagaccgcgtcttctttcttcctcgcctttgtgtgnaaaagaaaaatacagaggtatgcctagtacggcagcagcaacaacagagaacaagagcgcaacaaaaatccgcgagactggaacacaagaacagtacagcagtaagcacgagatagcgcagagcgcagtgt

SEQ ID NO: 5104 - DNA, 961 bp, Oryza sativa
  Predicted polypeptide sequence is orthologous to G2107
ggtcctgaggtacggccggaattccgggtcaccacgcgtcgctcaagctcgccggcgaagtaaccagagagagtcatccatggaggtggaggaggcggcgtacaggacggtgtggtcggagccgccgaagaggccggcgggaaggaccaagttcagggagacgaggcacccggtgtaccgcggcgtgcggcggcgcggggggcggccgggcgcggcggggaggtgggtgtgcgaggtgcgggtgcccggggcgcgcggctccaggctgtggctcggcacgttcgccaccgccgaggcggcggcgcgcgcgcacgacgccgccgcgctggcgctccgcggcagggccgcctgcctcaacttcgccgactccgcgtggcggatgccgcccgtccccgcgtccgccgcgctcgccggcgcgaggggggtcagggacgccgtcgccgtggccgtcgaggcgttccagcgccagtcggccgcgccgtcgtctccggcggagaccttcgccgacgatggcgacgaagaagaagacaacaaggacgtgttgccggtggcggcggcggaggtgttcgacgcgggggcgttcgagctcgacgacgggttcaggttcggcgggatggacgccgggtcgtactacgcgagcttggggcaggggctgatcgtcgagccggcggggcgccggaggttgttggaggagggagagatgccgggtcgaaaatggggtcggagagtaatattcaaatttggactggaaagtgtggaccatttgggatttcgcaaactggcgggaaagagaaggagtttggggaattaagagagtggcgggaatgggataggtacttgtattggaagggcagatgcccctaggaacgatatagaggagcaggaacggaattctcttcaaggaacgaaaaaaagggggcaaaacgaggaggggacctatgacaaggggtggagagacatc

SEQ ID NO: 5105 - DNA, 1021 bp, Oryza sativa
  Predicted polypeptide sequence is orthologous to G2107
cgcgtaggtcggcggaatccgggtgaccacgcgtcgccacgcgtcgcacttcttcctcttcttcttcttccagcagcagcaacacacactactgacatggagtactacgagcaggaggagtacgcgacggtgacgtcggcgccgccgaagcggccggcggggaggaccaagttcaggaagacgaggcacccggtgtaccgcggcgtgcggcggcgggggcccgcggggcggtgggtgtgcgaggtcagggagcccaacaagaagtcccgcatctggctcggcaccttcgccaccgccgaggccgccgcgcgcgcccacgacgtcgccgcgctcgccctccgcggccgcggcgcgtgcctcaacttcgccgactcggcccgcctcctccgcgtcgacccggccaccctcgccacccccgacgacatccgccgcgccgccatcgagctcgccgagtcatgcccgcacgacgccgccgccgccgccgcctccagctccgccgccgccgtcgaggcctccgccgccgccgcgcccgccatgatgatgcagtaccaggacgacatggcggcgacgccgtccagctacgactacgcgtactacgggcaacatggacttcgaaccagccggtctactactacgacgggataggcggcggcggcgagtacagagctggagatgacggcgagacgatggttgcgcggggggtacgggggggaagtcccttggactatgatgatggattgggtaaggtttggctacggttgtctcataagtatatgggggaattgggcattccgctattgtaattccgaaagggaggggctaagggcagaccagtaactggaggaggattgcccctccggggaacgcgtattacggagagtttaggccagaagagatagagctacatgtgagaatcgacgagaggagctagagacttgaactacttttgacgagagctacgcatcagttctactatatcgcgcgaattaatcactagcgctcgagatctatgacgagttaa

SEQ ID NO: 5106 - DNA, 737 bp, Oryza sativa
  Predicted polypeptide sequence is orthologous to G2107
gcgcgcgcacgacgtcgcggcgatggcgctgcgcggccgcgccgcctgcctcaacttcgccgactcgccgcgcaggctccgcgtgccgccgctgggggccgggcacgaggagatacgccgcgccgcggtcgaggccgccgagctgttccgcccggcgcccgggcagcacaatgcggctgccgaggcggcggccgctgtcgctgcgcaggcaaccgcggcgagcgcggagctctttgccgacttcccttgctacccgatggacggactggaattcgaaatgcaggggtacctcgacatggcacagggaatgctcatcgagccgccgccattggcagggcaatcgacgtgggccgaggaggactacgactgcgaggtcaatctatggagctactgatgatcgcccgtgcacctgaaccgaaccagccctgatgagcaggaggactcaatgtacagcttattatggtatataatcaagtacgaaccgtacttatggtgtgccgtttccctgctattctgacgaaaatggaatgcgatcagaaggagcagaggagtgtcctttaggttggtagggggggctccatgctcgtgcgacactggcaatgggggccaaaaattttattggcgccagaaatagcacttgctgcggatgatccctttagtttctgtagtaacaagcctcacctcccaggcttgtctaataagcagctaagtttgctgcatatttgacttgcaaaaaa

SEQ ID NO: 5107 - DNA, 616 bp, Oryza sativa
  misc_feature (424)..(424): n is a, c, g, or t
  misc_feature (450)..(450): n is a, c, g, or t
  Predicted polypeptide sequence is orthologous to G211
ctgatcgccgggaggctgccggggaggacggacaacgagatcaagaactactggaacacgcacatcaagcgcaagctcctcgcccgcggcgtcgacccgcagacgcaccgcccgctcaatgccgccgccgaccaccaccagcagcagcagctccaggcgccacggcggttcgccgccgcgccagccggccaccaccaccaccaccctgaccatttcgccgtcctctccaactcgccggaggcctgcagccacagcagcgacgacgagcccagctccgccacgccgccgccgccgccgcgtcacctcggcatcgacctcaacctttccatcagcctagctccttaccagccgcaggatcagaccagcgagccgatgaagcaggaggaggacgacgaagcgtcagcgacggcgaacggcgccggcnatgcagcgatgacgacgacggcaacnacggcggcggtgtgcctgtgcttgaaccgcctcgggctccacggcggcaaggtgtgcagctgcggaagcggcggcgccccctccatgcaggccagcacacacatgtttagattcatcacgccgcctggaggaagccaccacaacagtagtagcacaaccatgacct

SEQ ID NO: 5108 - DNA, 1031 bp, Oryza sativa
  Predicted polypeptide sequence is orthologous to G211
aagctagctcgcgcgcaaattaatcgccgatcgatcctacgatgaagcggaagcggccggcggcgctgcgcggcggggaggaggcggcggcggcggcgctgaagcgtgggccgtggacgcccgaggaggacgaggtgctggcgcggttcgtggcgcgggaggggtgcgaccggtggcgcacgctgccgcggcgcgcgggcctgctgcgctgcggcaagagctgccgcctccggtggatgaactacctccgccccgacatcaagcgctgccccatcgccgacgacgaggaggacctcatcctccgcctccaccgcctcctcggcaaccggtggtcgctgatcgccgggaggttgccggggcgcacggacaacgagatcaagaactactggaactcgcatctcagcaagaagctcatcgcgcagggcatcgacccgcggacgcacaagccgctgacggccgccgccgatcactccaacgccgccgctgccgtcgccgccacttcttacaagaaggcggtgccggccaagccgccgaggacggcatcctcgccggccgctggcattgagtgcagcgacgatcgtgcccgaccggccgacggtggcggtgacttcgcagcgatggtgagcgccgccgatgccgagggattcgaaggaggatttggcgatcagttctgtgccgaggatgcagttcatggtggcttcgacatgggttccgcttccgccatggtgggtgacgacgacttctcctcgtttcttgattctctgatcaacgacgagcagttaggcgatctcttcgtcgtcgagggcaacgatcacgagcatggcaatggtgagattggtcatggagacgtcatggaatccaaacagtaatctttcgggagattgatcagggaataagttgaccatgagaaaacatgtaagaacagcttgtctgctgagtcatgaccggtgatgtgtatgtgatggaagaaaacgtatgtacgacttaatgcttgcacctatactactgctgtgtgcattattcgagtgatc

SEQ ID NO: 5109 - DNA, 3299 bp, Oryza sativa
  Predicted polypeptide sequence is orthologous to G2129
attgcaacagcatcgcaggcgtgtgcgagaggttctacaagcttagcagagagtgtgtctgcaatggctgaaagcaatcctatgaatcgcagcttttctgttgatgatctggtgggcggcatattcaggcttggccaggcgggggcagcttttggcagaaccgattctgaagcagcatttcaggagttcctcaagcgcatccccagcgcgaccaacctagcagccaaccagcagtatgagcccagccagctgcaacagcaggcccagcagctgctggccagcggcagtgcaggggcaaacaacgtgccagcaagcctgcctgaagcaggacaagccggagaaggcggcatgcccagagtgccctcgttggacgtattgcggcagctggtgatgcagaatccaggcttctcagcgccacccgtcagcgtgaaggcagaggggtctgcaggcatgctggcacccccgtctgcagctacaccgcctgctctatcggccccactgccggcgctgtcaatggcgcctgcggtagacccagcctcgctgtcagcggcagtggaccctagcacgttgtcagtgctgggcggagtgccgggcctagcagcagcagcagcagcagccaacccagcacttatggtgaacccagcagctgccgccgcagccgcactgcagctgcagcaattacaagcgccactgcgcatgggcacagtgtctgggcatgacaagtcggactatgataagtcagagacaaggcggcagcgcaggatgctgtccaaccgcgagagcgcacgccgctcccgcaaacgcaagcaggagcacatgcaccttctggagctgcagatagaggatcttgcggagcagaagcgtgagaaggaggccattgcagacatggctgagcgcaagtgccgcaccctggaggatgagaaccagcgcctcagggaggagaatgacaggctgagggacgagctgcgcttcctacgctctgagctgactgagcgcaaggagcgcaatggctactacaggcgtgaacacagttcagacggtgagcaggaggcggagaacggcaaggcgtaccatgcaggcagcaagcggcagcggccatcagaagcagcagctgcagacagcaagggcgctgaggtgctgtacaaccagcagaacggcaagcagcatggcgttggtgagggccaccccacagaccccgctgtggagggtgcacagcagccggtgggcgaggacgatctgcagtaacgtcgcgccagctagcactgctgctgcagctgctgagggctgctggcatgcgtggcttgcacgggtgtgttggatattgcgggcagtgtcagcaaaattgattgtcgcatctgcaacagcagcagctgatgcttgcatatggccatccgttggtgcgggtagtgggcgccctgccactgaagctgctgtgcaacatgcagcacgcaataaaagcgacatgtaggcaccataggccgagcagcctgctgagcagcagctgctgcgcttgcgttgtgagtggtgttgtggtttttcccctgcccaacagctcacttgcctgccttttattgttatttgtgaggacagttattgttttgtatgtgcatatgtggtagtgggcataaggggtgcagcctcagcagcatgtgtttacttagcgcgttgaccatatatctgtgagtgtgatgctgcttggctgtgtgcaaagtggggcgtgctggcaatgccttcgagtgttcctgccctgggcatctgctgttttttcttctttgttgtgactgtgattaacaagctgctagccaaccgcccagcagagtaattggcaattttgtgctccagctttttggggagttgtggggtggaacgcgtgtggcgggttccaagctggacagtgtttatgaccctggtgtgttgggacagtgaccagaacagctagggtggtggtaggcgggacgcagatcatgctgtgcatgcacagcataggaagctgctgatgctccatggatgcttcctggccccaacaacagagattgcgggggcgtggctgctatggttgtgcatgtgtcttttgtgacgttggcgcatcaattgtccgttgctggacgctgcttttgcagctgtgacactctcagcaacagcacagcaacacagcgagcgactcatgcacctactgctacatttactgcaagatgacacgaatggcagcggcacattggtgatcagtggcaggtcgcgtgatggctactgtagatgcagcactctgtgcggtttaccgaccgctgcgtgcgcgctgctgtgtttgatgcacactgaccaactggtcacgtccatggacttgactgatgctcactgcactacatgtgcgggagctcctcaacccacttgctaggttcttttgcgctgatgctacttgtggggtcagcgcggtggcaaagcgttgtcagtgtactgccatgctggcagcacagtttgtaagctggcaggactagcgcccttggcgcacgtgcgtgtgtgcggatgtgtgatgtgtgtgcacgtgcatgcgtgtgttattcctcagctgccttgcgtgcgtagtgggcttttgcacgtgggcgcctgcttgtagcagcatcaacagcagtgcatgctgtggcgcagcaggtgccagtcaccaaacgattgtcttgggggttacactgtgagcacatctcatctataactgtgtgtgcatgatgttaagcaagcaacatactgttagccatggcttggagtcctccgacttttcatacatgttggaggcttctttcccgctgctcaacgctgctgcaatgcagcttctcagtgcggccatgccatggttggtgtgcgactcgcgtgtcactatcgaccgtctgcattgcactgcaccggcggtgagccttcacactgggtgtgtttgtgaggcacgtatgtggtagaggcatacagggtgggtgcatcaacctaccactgcaggattcagagcaggctgacagagattttcccattgtgctgctgggctgcgtgtctagagcacaactctgttggccgtctaacgtacttctgtgtcttatacatactgtgcttcttttgcgtgcgatgcttgtgtcaaccttattggttgtggagcatgtgacagcagcagggatgttgctggctgaatgccggagggtgcaggggttttgagcgttgggcaaccgcttgcagctgtatgggcgattgggcccttgacacggcgactgatgctgacctgttgatgtaacatgggggtgagtaacatgctgatgtaaaaaaac

SEQ ID NO: 5110 - DNA, 1218 bp, Oryza sativa; identical to SEQ ID NO: 2409
  Predicted polypeptide sequence is orthologous to G2130

SEQ ID NO: 5111 - DNA, 628 bp, Oryza sativa
  misc_feature (441)..(441): n is a, c, g, or t
  misc_feature (468)..(468): n is a, c, g, or t
  Predicted polypeptide sequence is orthologous to G2132
tggagatccgatcatccatgcatggctgcttctcccctgcgcctcctcgccatcggcgccgctgctgtacctttcatgcgtggtagccgccacccgccgaggacgaccgagcccgacgccgtgtctaggccgccgagatcatcgtccttcctctgccaagcagttcgccgagcgagccgccgggatccgccggccggtggcggcgccgacggcggccgccgaagaagaagaggaggaagaaggaataaaaaacccttggggggccccccgccatgttccaagaagggggtccggcgaaccggccaaaacgccggaaggccggttgccgggaaaaccctgacccccaaggcaaaaagggggaactggaaggaacctcaccgttcaagagaattttccttcgccggttaagtgtaacttttcttagaaaaaacggggggcaanaatggcggccgggaatcccctgggacnacccccaaacttagaaccgcgaaaatctcttccccgaagggggtaaaactcctcaaaattagaaaaaataatacgggaaattttctggaaggggaaaaaaaaaagagccgtggtgtggggggtgtaaaaaaaaaaaaaaaaaaaccccaagggggggccc

SEQ ID NO: 5112 - DNA, 2323 bp, Oryza sativa
  Predicted polypeptide sequence is orthologous to G2141
gaaactgatcagatcacacacttcagactacagtcaaacagagcccttgcttgctttgcttgtgtcttcaacttcagagaccccctcctaccctcaaaaaatttcccctttcttttcctccgtttcttgcagcgacaagagaaatactaatactcctcctcctactactgctactgtgcaaggggaaggacacgacgacgaattggagagcggcgtcctctctgatccttttttttcctttattgcatctctctctctctctcgccatttttcttctaggttggtctctggatcaggccattgagggggaaagaaaaggtgcgggttttggggggaggttgttcttgcgggaggccgttgatttcgccgtgtgatcggagggagtgaaaaggagatgaatgagaaggacgccactgatttggaggagaggagtgaggccagtgagcacggccaagctctgagtttccatggtggtgccatgttcttgcaagaggctcagattgcttctcctgcagctgcaaataatgcattgacctccatggcgaatcctttccctatccctcctgggttgtggaatccaccttcacacaacatgggtttaggcgaaaccagtttttcatccttgttggggatgctgtcggccggcgcgccgccaccgtttgtggctactcccgggtttgtagattccacggcggggtttccttgctacaatggaggcaatcttggagccatgatcaatcaccctttccctggtatccaccagcctttgggtgatttccaaaacggcgtcgagccatgtagggagattgaggatattgagattgaaggatccaagaatgtgtcacaaactggtgagaagcagcaaggggatggtgagacaacgcatgccgtcgattcctcctccaaggagctaagcatgccagggcgcaatggtggcgctggccatgatgaggggactagggtgtcttgttccaagaagaggaaaagatcaggacaggatggtggggtgaagcatgcagaaggtggtgagcaattagcaactgtcggttcagcgcagaagaatgaggatgatgaaaagggtgaaccagagaggtcttctgtggcgtccgggaaatccagtgggaagcaaataaaggataatgcaggttcaccaaaggaagactatatacatgtaagagcacggcgcggtcaggctacaaacagccatagtcttgccgaaagggttaggagggagaagatcagtgaaaggatgaaatatcttcaggatcttgttcctggttgtagtaaagtaactggtaaggctgttatgctggatgagataattaactatgttcaatcattacagaggcaggttgagtttttgtcgatgaagctagcaagtgtcaatccaacactggacttcaacatagaacgcattttatctaaagatatttttcaatgtcgaggcactactgcatcatctgcctttggcttcttcccagacattgttcatccccgattacacccaccaaaatatacacaagttgggatgcccagcattgtgaaccccactgatgcatttggaagagtaatccatgctccattaggaactaacagtgcattcaaagaacctaaacatcagatgcccaacaatttgaatggagagttccaggacgtcattgagatgccttttactcatgaccatcatggatcaaatgatcaaccctgagattgattccacaactgaagcaagagatcaatatgtgccatgggctttcagcaaaactgtgatatatgagcatgttgatatcatggtactagctcacggctgatcactgaagtataagcatccaaaatgcttagttagtgctatttttctcatgttcatagcagcaattgacctcctgtggaagcctctctttggatgttccatttgctgttatagaaagttgggagataaaaaaaaaaggatgttcacatggagatctcaagcaatttgttctccactgaagtagtctacagtcttgaaatggcgagaagcttcattttgcaagaaggtgatttttctgtggtctcgtcaaccccaggattattacatacactagctagcattgtgaggctacagaaattgttctttgttgtacttgcttagcccatgttccatctgacaagcaacataggcagaaatgcagtcactgattttgtatttgttgaaaaaaaaaataaatgggcttggcctgatgtagcaagcatttgaattttgcaacgggtgcctattggcacagatgtttttattccagcaaagctgtgaattctgaaagagaagaaaagagaactgtgatcc

SEQ ID NO: 5113 - DNA, 2140 bp, Oryza sativa
  Predicted polypeptide sequence is orthologous to G2141
gaatatgaaattttcttgattcttgaaggatggtggggtgaagcatgcagaaggtggtgagcaattagcaactgtcggttcagcgcagaagaatgaggatgatgaaaagggtgaaccaaagaggtcttctgtggcgtccgggaaatccagtgggaagcaaataaaggataatgcaggttcaccaaaggaagactatatacatgtaagagcacggcgcggtcaggctacaaacagccatagtcttgccgaaagggttaggagggagaagatcagtgaaaggatgaaatatcttcaggatcttgttcctggttgtagtaaagtaactggtaaggctgttatgctggatgagataattaactatgttcaatcattacagaggcaggttgaggtatgatgtttgtaaaacttgtagggccattttcagttttacttgcatagtcctgctgcgatgtaatctggtatacccaatgtgtgcatgttgggcagtttttgtcgatgaagctagcaagtgtcaatccaacactggacttcaacatagaacgcattttatctaaagatatttttcaatgtcgaggcactactgcatcatctgcctttggcttcttcccagacattgttcatccccgattacacccaccaaaatatacacaagttgggatgcccagcattgtgaaccccactgatgcatttggaagagtaatccatgctccattaggaactaacagtgcattcaaagaacctaaacatcaggtttgtaccatcacttgcatttggctaaatggccattttcatttcatgctctttataccaaatactgtgttcatgaaaaataggacaagtttctgcaagatgttccaagacctaatttagtgttatatggcttggtgtttcgagaatactgctccacagatagtcgttgaaaagaatgtccacataatattttaaaccaagaaaagctagtcccctttatatccttttgctgggtcttgcttcactacccatctttccaaaaagttcgtgggtcttaaaagcaaagcaaactagataacataactaaactgagacattttagacaacaaacaaaattcctactatctgtttttcataactagccagattgtgcctgattcttttggccatgcaagctgtttgaacctagtccatcaatcagtctctttagcttctgactcattaaccctcttcaacctgattttagtgggaagagcattgttgatgttaaccgacattgtaacctcagtagcactaaccatttcactagtaaaccaactaaaaatgtacaaatgcagcttgttatatatctaattgtatcttcatcactacatatttgccttcacagttatctaaaacatatgctttcatattcataaacatttttttggaaagcggagtaccaaagcactgttttagtattttgcaatcctcttattacttgtgcattggacagatgcccaacaatttgaatggagagttccaggacgtcattgagatgccttttactcatgaccatcatggatcaaatgatcaaccctgagattgattccacaactgaagcaagagatcaatatgtgccatgggctttcagcaaaactgtgatatatgagcatgttgatatcatggtactagctcacagctgatcactgaagtataagcatccaaaatgcttagttagtgctatttttctcatgttcatagcagcaattgacctcctgtggaagcctctctttggatgttccatttgctgttatagaaagttgggagataaaaaaaaaaggatgttcacatggagatctcaagcaatttgttctccactgaagtagtctacagtcttgaaatggcgagaagcttcattttgcaagaaggtgatttttctgtggtctcgtcaaccccaggattattacatacactagctagcattgtgaggctacagaaattgttctttgttgtacttgcttagcccatgttccatctgacaagcaacataggcagaaatgcagtcactgattttgtatttgttgaaaaaaaaaataaatgggcttggcctgatgtagcaagcatttgaattttgcaacgggtgcatattggcacagatgtttttattccagcaaagctgtgaattctg

SEQ ID NO: 5114 - DNA, 2079 bp, Oryza sativa
  Predicted polypeptide sequence is orthologous to G2141
gagtggtagtctatgatcttctacctctcttctccctcttgctggaacatatagcatcagaatcctcactgggcatctttccttttcttgccatatctggccataggctacaataagagttcttgcttgcttctcctcctcctcctatcgcattgttcatacagctctgatcaagctctctaagcatcgatcacttggttcttgctcatcatctttcgcttgctcgtcagctaggaattcgtagtcttgagccgaggttgggtgattcgatggacatgagcgagagcagtgagaaaggaatggagagcaatgcgtcgtctggccctggcaatggcatcccggtggagtggcagagccaattcagcagcgccttcgcgtgccagccgtcggtggcggcgcagcaccagcagcacgccatgatggactccttcgcggcggcgtccgccggcctgtgggcgtcctccgacgtcgtcagcgccatgtcatcggccgcgccgccgcggggcgcggggttcttggcgccggtgcccgggttcctccagcaggggctcggccatttcccggtggactccggcttcatcgagcgcgcagcgcggtcgacgtgcttcggcggcgggatgatggccggcggcccatacggcgcagctgaccaggccatgggcgacgctttcggtggcaccgcggagggtctcatggatcatcacaggaacgttggcaacgacaaggccgaggagttcgccggcaacggccacgacgaggtgccgagctcggaggtagccggtggagactgctcctccaaaggttcagactccaagaagaggagaaggcctaacgaggtgatgggaaccgatcaagtccattcttccaacttgccatctgattctgcgaacgagagtgttcacagcaaagacaaaggcgaggagagcagcccggcgacgacgaacggcggcaagtcgaaagggaagggagcaaaggagacctctgagtcacagaaagaagagtacattcatgtccgggctcggcgtggccaggcaaccaacagccacagcttagcagaaaggttgagaagggagaagatcagtgagaggatgaaacttcttcaggacctagttcctggctgcagcaaggtcaccggaaaagcggtgatgcttgacgagatcatcaactatgttcagtccctgcaaagacaagttgagttcttatcgatgaagcttgcgacagtaaacccaaggcttgacctcaacatagaagggcttctttcaaaagaccttcttcgcttccctggagttccttcatcctctatcggattctccccagaaatgatgcatcctcaactacaattgtcacaaccaggactgattcatggtggtaccgctggcatggccaaccccgatgtgttcagacgaataatacaagcgcaattaggtgcaaaggatggatctcagatgccccactcattgaatggatcattcagtgacgtttcccaaatggcgtacccgtccctcggttctcaggacctaagcatcaggccatctcaggatgggtttcaaatgtgaagaagacgaagaagaagaagatgatgatgatgagggggccaattccatgtacgtgcaattgcttctggcatctggtgaacaagggcaggcacacgcacatgactgaagcttgctactactgctggagaagcagcgtttgcagtgctgctagctcatcgcgtaactgaagtctgaagggcttttaattccttccgtggctagctgtatatccatcgaggttttattgtgttcagaactgaaactgaaaggcttttgagccccacgtacagggacgctggaaacgaaaaatctgcgtccttgatggctggaaattctgtctggggagcgtgcatttacactgcagcacgaggagcagcaggcaggcagctgaatttgctgcagggctggcacaatgcaagatcactcatccggtggctttgttaagttacttccgattcattgttggttgcgaaaacgattaaacaactcatcataaacgtggcgctgaatggtgttaatgttaagatcaaacacatttgactcc

SEQ ID NO: 5115 - DNA, 1098 bp, Oryza sativa
  Predicted polypeptide sequence is orthologous to G2141
atggatgctaatggcggcaatgggtttggagtagagagcaacgcttcggctgtccatggtggcatggcgatggcttggcaatggcatggcggccagatgagcggcggcagctcgtgcgctgcggcgccgccgccggtgcaacagccggcgatggattctctcgcgtggtcgtcgacggtctcgccgagcaccggcgctgccacggcggcgagcggcgccggcttcttgctgccaccggcagccgtgcgcggcggcttcggcagtttcccggtcaactccggcggcatcgtcgagccggccggtgactgctcgtcggagtccaagaagaggagatcagacgagattgctggaacggatcacgcgaacgcatcgaacgcgcttgccgattctgggaacgagaccgagtgtagcaaagatgtcaacggcgaagtgatcggcccgccggcgacggcggcggccggcggcaagtcgaaagggaagggagccaaggacgccggcgaggcgcagaaggaagggtacagccatgtcagagctcggaaggggcaggcaaccaacaaccacagcttagcagagaggctgagaagggagaagatcagcgagaggatgaagctcctgcaagaccttgtccctggctgcagcaaagtcaccgggaaggcgttgatgctcgacgagatcatcaactatgttcagtccctgcaaagacaagtcgagtttctgtcgatgaagctctcggcagtcaacccaagaatcgatctcgacattgaatcacttgtcaacaattccaaggatgttcttcgttttcccgggcagccttcctctgctcccatgggattctccttctccacggagatgatgccggggctacaattatcacgaccgggcatccttcagggaggtgtccatggcatgatcaatccagatgtgttcaccagcctcatgcagaagcagcagcaaaatgacaagggagcattcagagagcctcagatgcatcagactttggatggatcattccgtaacaccgcacaaatgccgtatccacaggtcatgagttcagaagagctaagcatcaggcaagatcaagatgggtttcacatgtga

SEQ ID NO: 5116 - DNA, 1003 bp, Oryza sativa
  Predicted polypeptide sequence is orthologous to G2144
ggcgagaagagggcaagccaccgacagccacagcctcgccgagcgggcgagacgcgagaagatcaatgcgaggatggagcttctcaaggagctggtccccggatgcagtaaggtatcaggaacagcactggtactggatgagatcatcaatcatgtccaatctcttcaaaggcaagttgagtacttgtcaatgaggctcgcagctgtaaatccgagggtcgactttggtgggctagacaacttcttgactacggagtgtggaaggataacaggcttgaactacaagaatggaatggatttggagcaggtcacctggccagacatgggcgtccatggagcaaggaatctcatgcaactacaacagcagttctggcatggtgatttagcacacccgctccagccgccttcacagtgggaaaagcggacggataccaatccccctgtctttagcaattcaagttcctccctcttcggctatgatctagcaagctctggagcgccggcccagacaggcaacaagctaaagacggagctgtgagcctgtgaccaacggtggtggtagtgatagcaagcaggtcagcagagcaagccaaacaaacatacgtgagctgtggacaatggcggctggatgtcaggagagctagctagctagctaggcgtgagctgtggactgacggctgctgctgctgctgctgctgctgtggatggttggcaacgtcttgtgcagtgcagcagtgcggtgcatgggactttcattgattttggaggccggattctgagacgatgtacatatggaatgcaagatatagagagatactgttgttgctgttgttggagactcttggagctggaggtgatggatatggaggttttactgctgctatctttttttgtagagatgagcgagagatactgtggattcttttcttgctgatgtattcttggtgtatgcctgactacgatggtttaatgtcaaggttatatgagcagcatttatttggtg

SEQ ID NO: 5117 - DNA, 491 bp, Oryza sativa
  Predicted polypeptide sequence is orthologous to G2150
ctagtggatccccgggctgcaggttttttttaagggtagaaaaaatctgagtgatttttggttagaaatcatccgacaaagggatagacagttccagtcagaaaaataaaaagaaaatgaaagaaatgaaggcctcgaagcctcgtcgtcatcgctgcttgacggagaccgccgctcgccgttcttgattcttcccctggtgccccgccgttctcggctcttccccctggcgcctcgccgttcaccaccgtcgtcagagtttgaggccgctgaatccagatcctttggagccatggccaccggatctggcccgtcgcaccttgtgaaggacagaggtgcagtggtggctagcgaggaacacatcaccggcaatagcaagaccgaggggaagacaatggaggcggcagcaacatcttccatcaagtgccgagatccgggtattctcgtcaagcccttcttcgtcctgtcctcttcttcctcctggatctgtc

SEQ ID NO: 5118 - DNA, 538 bp, Oryza sativa
  Predicted polypeptide sequence is orthologous to G2156
ttcctcgagcactgttggcctactggatgcgatggtcgcggctagcgaacgccaagcggatcgaacgccgaggcggcgaggcgcagcagtattacgagtacgtgttgatcgagcgcgaacgccaccgcccgcggccaccgggcagccagatgatcgcagcggcgagaggcagcgaagaggggaacgccgagacggcgaacggccgagccctagtggctgggggctagccgtggctggctctccgcctctgcctcctcgttgtcatctcctcatcctcaactatgcaatcttcatcagctgcgatcatatctgctcaaagtctcgacctggcgattgaaaactagaccgtaacatcggtaatttcgagcaattagcaattaccatgattttaattttctgattaattattgcattttaaatgatcgattcgattgattatggaattaatcaattatcgaaagtaatgtgaatgtattttctttttgcttaaaacatgaagacatttatttccttaatccttgccacgccttctaaaaaa

SEQ ID NO: 5119 - DNA, 3483 bp, Oryza sativa
  Predicted polypeptide sequence is orthologous to G217
gccactccccctccccctccgccgccgccgccgccgccgcccatccccgcccgcatccgcatccacatccgcatccttcccccacctcgatccccgccctccacttagccctagaacccactctgcccgccgccccggcgaaaccctagcagcctcgtccgggcggggcggggggtgggggtgggggaggggagaagcatcgggggccctccggcgaggaggagaaaaccagcttcggggaggtgagcgaaggagaggggaggcaagatgaggatcatgataaagggcggggtgtggaagaacacggaggacgagatcctcaaggccgccgtgatgaagtacggcaagaaccagtgggcgcgcatctcgtccctcctcgtccgcaagtccgccaagcagtgcaaggcccgctggtacgagtggctcgacccctccatcaagaagactgaatggacaagggaagaggatgagaagttactgcatcttgctaaactcatgcctacgcagtggaggacaattgcacctattgttggtcgaacaccatctcagtgccttgagcgttatgagaaacttcttgatgctgcctgtgcaaaggatgagaattatgagcctaatgatgatccaaggaagttacggcctggtgagattgacccgaaccccgagtcaaaacctgcacgtcctgatcctgttgatatggatgaagatgaaaaggagatgctttctgaggcaagggctcgcttagctaacaccaggggtaaaaaggcaaagcggaaggcaagagagaaacaacttgaagaggcaaggcgacttgcctcactgcagaaaaggagagaattaaaggcggctggtattgatacacggcagaggaagagaaagagaaagggtatcgattataatgctgagattccttttgaaaagaggccgcctccaggtttttatgatactgttggtgaggacaggccacttgagcatgtacagttcccaaccactattgaggagcttgaaggtaagagaagagtagacatagaggcacaattaagaaaacaagacattgccaggaacaagattctccagaggcaggatgctcctgctgcaattatgcaggcaaatagactcaacgatccagaagctgtcacaaagaggtccaaattaatgcttccaccaccccaaatctctgatcatgagctagaagagatagcaaagatgggtaatgctggtgatccttctttagttgaggaacttggcgaaggtagtactgccacaagagcattgctttctagttattcccaaactccaagacttggaatgacaccattgcggacgccacaacgaactccagctgggaagggtgatgctattatgatggaggcagaaaatctagcgcgtctaagggagtctcagacccctcttttaggaggggataacccggagcttcacccatcagatttctctggtgttacaccacgtaagaaggaaatgcagactccaaatccaatggcaacacctttggcaagccctggccctggtgctactccaagaattggaatgacaccctccagagatggaagttcttttggtttaactccaaaaagtactcctttccgagatgagcttcgcataaatgaagaggtggatatgcaagatactgctaaacttgagcttcgtaggcaagctgaattgagaaaaagcctacgatctgggtttgcttctattccacagcctaagaatgagtaccagatagttatgccacctatcacggaggaggagaaggaagaagctgaagagaaaattgaggatatgtcagacaggcttgcacgagagagggctgaggaacaagcaaggcaggaagccttgctcagaaagagatccaaagttttgcagaggagcttgccaaggccaccggcagcttctatagaaattctccgacaaactctaattaagggtggtgaaagcagaagcaggagcaccttcgtgcctcctacatcacttgaacaagctgacgaactaataaatgaggagcttcttcggctccttgagcatgataatgctaaatatcctctagatgagaaaactcaaaaggataaaaagaaaggaagcaagcgccaggcgaatgggactccttctgtacctgagattgaagattttgatgaagacgaattaaaagaggccaattctatgcttgaggaggaggttcaataccttcgtgtcgccatgggacatgaaagtgaatctttggaagattttgtgaaagcacatgatgcatgccaagaggaccttatgttttttccaaataacaacagctatggtcttgccagcgttgctggaaattctgataagatagctgctttgcaatatgagtttgaaattgtgaagaagagaatggatgatgaagctaagtaggcttcgcggcttgagcagaaaatcaagcttctgacacaaggataccaggtacgagctggtaaactctggtcacaggttcaagatacattcaagcagatggacacttcagcaacagagcttgaatgctttcaagagctgcagaagcaggaacagatggctgcatcttatcgtataagaaatttgactgaagaagtaaacaaacagaaagcattagaacggactctccaaagccgctatggtgatctgttaactagttacaagaggatccaagagcagcttgaggagcataagaggcaactgatgatacaggaggaaatggaagcacagaagcgtgctcaggaggaggaggaaatggaagcacagaagcgtacgcaggcagaggaagaaaaagaagcggcgaaagctgaagaggaagcaagaaagatggatagggctgctgatgaagaagcggcaggaagcaaacaagtcaatgaggatcagatggatgttgacaactctaatgctgatggtgatgaattcgtaggtccgattcccccaggaccaggtactcaaggtgacgacaatgtggtggcggtcgaagagaactctagctcgcagagcggtgatactgctaccacggaagatggatcttgtggcatgatcgacgcatcaaaatcaggaggtcaggatcacatcgacagcaaggatgaacttcccactgttggtgccagtctagatgatggaagtgctgctgcatcttctgatcaagatgtctcaactgaggtgaatgccactgtccctgaatagaatgtcatttcttgtacttcatcttcgagggcggcacagagaaagctaagagggacggataccttgagagaaaaaaaagaagaggcaaattgaatgtccaaagctgtgcactgaatttttattcgctgcttgattgttagtgaacgacaaaatgcgggactaagcttgttgtacaatgttaattttgtcaattcccatcgaggactctcagctcttagaattgctacgaaagaatgttagttcgatgtactatctgagaaattgaacttgaaaaaagaaaaaagaaacaatgccgat

SEQ ID NO: 5120 - DNA, 741 bp, Oryza sativa
  Predicted polypeptide sequence is orthologous to G22
tcaatcacataagttagttccctttaaacctattcttgaaatctagtactgttagatggtttaactctatagctaaacattagagttgatttattctatagcttctgctatattagttagccacaagtttgtaaatacccatgtatcttataataatatctcctctggagccttgttcaaatttatgcaatgaagatccagattattgaacctgtatcaatctactgatccagggcttgatacagtctaaatatgtcgattaccgaattattagttttgggacccgacaaggggaagtaggagccgtcggacaggagtaccgtcggcacaagcaccgctctgaccgaactgccatcactgtcaccggtctctcgttcggtcaccgccaatgatgcaatttgggagaagggcattgggagagaataatttggggacttgggttttgctccaccccttccaccagcgacttcacccgcacgaaagaaatatcagcaatccattagatcagacggctcaccatctcctcgtgttgggtcgtcgccgttggtgggtcacttggctcttgggccatagaatttgattagaatttttacattaccgtgatattatttttttgttacttcttcccaacggtgatgtgatttaggacattaatgtctttagctaatcatttctgcccaacgatgacttgattttgattgtaagtaatttcatttaatgtttccttcgttttgtcaaaaa

SEQ ID NO: 5121 - DNA, 1326 bp, Oryza sativa
  Predicted polypeptide sequence is orthologous to G2213
atggagatgcacgagtgctgctactacggcggcagcatcggcggcgactggctcaacccactcgccgccatcccgccgccgtgttcttcctcttcttcttcgtggtcgtcgcagcttctcctcctcagtgatcacgatgacgtactcttgcactccgccggcgatcatggcggcgcggtggccggaataggcggcgcctgcatgaccgccgatctcgttgtcagggacgaggagatggagatggccgccggctacctgccggtggccgcgtcggccgccgccgccgccgacgtcgaccactacatgtaccagcagtttcagctcgagcctgatcagttcgtctcgacgttgcccgcggtggcggtggcggtggcggcgacggcgggcggcggcagccacgacgacgagctcctgaggatgcccttcaccgacatcgacctcgacgcgttcgccgacgcgcgcgacgtcgtcgtcggcgtcggcgagcccaagcccagtccccagcacactctcgacgcggcgatcgcgctcccggcggtcggcggcggcggcgcccaccacttcggcacgcaggacgacgacgtcaagttcgacgtgaccaagcaacgcaacgacgccgccctcgccggcgacgactccctgtccatggtgatcgtcgagagctacgagatgggcatgcgacgtcacgccgccgagcaggagcaggagcagaagccaaagatcatcacatcagccgcaacgacattgacgcctcttcctcttcctccaccgccgccgccgccgccgcgcgtgacgaggagccgccgcgacggatcatcggcggcgacggcgggcgggaagactcggctggaccacatcggattcgaggacctgaggcggtacttctacatgccaatcaccaaggcggcgagggagatgaacgtggggctgaccgtgctcaagaagcgctgccgcgagctcggcgtcgcccggtggcctcaccggaagatgaagagcctcaagtccctcatcctcaacgagatggggagcaaggggatgtcggcggcggcgatgcggcgggagctggaggcgctggagaattgctgcgcgctgatggagaggaacccggcggtggagctgacggagaggaccaagaagctgaggcaggcgtgcttcaaggagaattacaagcggaggagggcggctgccgtcgacgtgctcgacctcgaccactgcttcagcttcgccgccggtcattgccaccgccaccaccaccagcagctggctctgccgccgccgccagctgccgccgccgaccaccgtaggagagatttcttcggctactga

SEQ ID NO: 5122 - DNA, 1074 bp, Oryza sativa
  Predicted polypeptide sequence is orthologous to G222
atgggaagagagtcggcggcggcgtgctcgccgaagccgaagctgaggagggggctgtggtcgccggaggaggacgagaagctgttcaaccacatcagccgctatggcgtcggctgctggagctccgtcccaaagctcgccggattggagaggtgtggcaagagttgcaggctgagatggatcaactacctgaggcctgatctcaagagaggcagcttctcccagcaggaggaggagctcatcatcagcctccataaaatccttggcaacaggtggtcccagattgcggcgcagctgcccggccggacggacaacgagatcaagaacttctggaactcgtgcctcaagaagaagctccggcagcgcggcatcgatccggccacccacaagccgctcaacgacggcggcgccggcgccggagaagagcaccacgacgacggcgacaagcagcagctaatggacgacgtcgacgactgcttcgccatcggcggcggcgggagcagcgactccctggcgccgccgcactcgccggccgtcagcttcgacccgctgtccgtgaccaacgtgccgacgacgatgatgcagtcgtcgtcgtctccctacggcgccgccggcggcgagcactcgtcgttccggtcggacaccctctgcgactacggcgggagcggcggcggcgtcgacgtcgtgtccgacgccggcacgtacagcgcctacaccggcgacagctccagcaacagcaacagcacggcgtggacatgcggcagcgtcgtcgtcggcggcgcgggcgagctgccgccgccgccgctgctgccgcacatggacatgttcggccgggtcgacgccgagccgccgccgtacccgccgttcgacgtccaggccaggttcagcccctggcaccaccaccaccaccaccaccacgagccgacgctgccgacgccgccgcaaaggctggacggcggcggcggcgccgcggcgagcttcccgatccggtcgctgtcgcgggacatgccggagtcctgcttcgacctcggccgcggcgcgctcgacgacgagttcggcgtcgacttcctctga

SEQ ID NO: 5123 - DNA, 1514 bp, Oryza sativa
  Predicted polypeptide sequence is orthologous to G222
gacacagagaagaggagtactaggtagagagacgcttggctccgtggctcgttggttgattgcttaaaggccacttgatcgctgctcgatctgctgcctccctcgcgcgcgcgcaccgtacgtgtgtgtgtgcagtagttctcggcacgcttccccatatataccccctggatcgggcgcccagccggccgcctcgatcgacagagagatcgatagacagatacacgccggcaagggcaacgaacccagcggcaggtagctgctcgcgtgtcgggcgggaatgggacggcacgcgtgctctgccgccggtgtccagcagaagctgcgcaaggggctctggtctcccgaggaagacgagaagctctacaatcacatctaccgctacggcgtcggttgctggagctccgttcccaagctcgcagggctccagaggtgcggcaagagctgcaggctgcggtggatcaactacctgcgccccgacctgaagcggggcagcttctcgcagcaggaggaggacgccatcgtcggcctgcatgagatcctaggcaacaggtggtcgcaaatcgcgtcgcacttgccggggaggacggacaacgagatcaagaacttctggaacagctgcctcaagaagaagctgaggcagcgcggcatcgaccccagcacccaccagcccatctccacggctgctgctgctgcggcggcggcattggacacgtcgacgcaggaccagaagccgccggccaccgccgacggcttcgccctgaagcagcagcagcaggtgttcgacccgttcccggtgatcgacagcttcggcagcgggttcgacgccacgggcatgccattgtacggccacctcggcggcaaggacgcggccgggttcgtggactacagcagcgtgcttgacgtgtcggagaacctgggctacggcgagagctccagcaacagcagcaactggaactgcggcgtgggcgcgccggaggtgaacaatgcgctcgagagcgagccgctgcattgggccaccgagagcaaggtcgagcctttcgtgggctacggcgagggggacgccatggagcacaagttcgggctgccctgccatgggcagcaagagcagggcatgacacatttcgacttcgacgtcagccggagcatggtggtcggcgacttcaacttcgagtacttccgatgaggttcttgtgaattaagccattatcgtatatacaatattcttccaaggcattttacacagagggcatgaccaaccgggagagtagagactgtactctgttaattttcactagtccatactccttaattaacacctttttatgatttctgcatgggtaaaaatataaataaagggtatagaaatgtgaacactgtgtagttaattactactatgagattttgtaagaataattaagtttcttacacttgtactctgtaagttgctgccactgggaggactgtgtaacgtgtattcctctcctgaagaaggaacaatcaaggttctcact

SEQ ID NO: 5124 - DNA, 582 bp, Oryza sativa
  Predicted polypeptide sequence is orthologous to G2226
ccacctcgctcccccgtaaaacccgaaattacaatcaggtcctcggcggacgccacccccaaatctgaaaccctcgccgccgccgccgccgcgcgatcccccccggaattccatcggatcggcccccgcctctccggcgagatgggcatctcgagcatgccggcgcccaaggacagcgtggtggcgtacctgctgtacaacacggcggtgtcgatcgccatcctggcggacatggtgcgggcggcgctggtgttcctcggcctccccgtgccgccctcggcgtgggaggacggcgacgaccagctggcggcgatcgcggcggccgccgcggccgcggccgcggcggcggggggcccgagcctggcggacaggttccggagcaggttcaggccggcgaggttcgggcggcggcgaggcgggggcgcgggcgcggcctactgccgcgtctgcctcacgcggttcgagccggaatcggtggtgaaccgcatcccctgcggccacctcttccaccgcaactgcctcaagaagtggctcgactacgaccacgccacctgcccgctctgccgccaccgcatcctcccc

SEQ ID NO: 5125 - DNA, 609 bp, Oryza sativa
  Predicted polypeptide sequence is orthologous to G2226
gggggggaggacgcggccgtggccgtgtcggtctccgcggcggcggcggcggcggggcccagcctggcggacacgttcagggcgaggttccgaccggcgcggttcggccaccggcgctgcggcggcggcgcgacggcggactgccgcgtctgcctggtgcggttcgaggcggaggcggtggtgaaccgcctcccctgcggtcacatcttccaccgcgcctgcctcgagacatggcttgactacgaccacgccacctgcccgctctgccgctcccgcctcctcgccgcctcctcctcgccgccggccgccgccgccgccttggcccggacttagcgagtggattcgattcgactcgattcgattctccgacgagccgccccgcgctggctacgcgccaccgtctccgggtggcctccccgtgtgggcgtaggaaactagagagagagctctttgccttttttgcactttcacccctcactttgtcccttttttttccgtttcgggcggtttgtgcctgtaccgtgtaaatacctcgcagcaagagagtgctcctacgggtgtagcactttttgtgagctttgtgtataaaaccttctcggaatagcaacc

SEQ ID NO: 5126 - DNA, 992 bp, Oryza sativa
  Predicted polypeptide sequence is orthologous to G2226
gtaccatctcccgtgtcctcctcccacctcgctcccccgtaaaacccgaaattacaatcaggtcctcggcggacgccacccccaaatctgaaaccctcgccgccgccgccgccgcgcgatcccccccggaattccatcggatcggcccccgcctctccggcgagatgggcatctcgagcatgccggcgcccaaggacagcgtggtggcgtacctgctgtacaacacggcggtgtcgatcgccatcctggcggacatggtgcgggcggcgctggtgttcctcggcctccccgtgccgccctcggcgtgggaggacggcgacgaccagctggcggcgatcgcggcggccgccgcggccgcggccgcggcggcggggggcccgagcctggcggacaggttccggagcaggttcaggccggcgaggttcgggcggcggcgaggcgggggcgcgggcgcggccgactgccgcgtctgcctcgcgcggttcgagccggagtcggtggtgaaccgcctcccctgcggccacctcttccaccgcgcctgcctcgagaagtggctcgactacgaccacgccacctgcccgctctgccgccaccgcctcctccccgccaccaccgagtccccctcgccgtcgccggcgacggcgaccccccatttcgcccggatttagagagatctccccccttcaatccgccactgggccgtgtgcgcgtaggaaaattgagaggatcatttagctctagtgctagctccatttagtgctcctttttccccccactttcttaatttttttttcacctctttgcagtgtttttttttaccatcttcgagtggccttttcttttcttttctttctttttttacttctttgtgttgctgctgtaccattgtaaatatttgcagagtgctccgatcgatggagaggtgtagcacttgtgtacagggcttttggaaagcgaagagatgagaaggagagaaaaaaaaatcattgccc

SEQ ID NO: 5127 - DNA, 1312 bp, Oryza sativa
  Predicted polypeptide sequence is orthologous to G2239
atcactttgccgccgccgccgccgtttcctcctcctccctttccgagagagatggggcggcgcgcgcgctgcctctgcctcctcctcctcctcctcctcgtcgtaggtggcggtttccacgtggccaacgcgcaggcgtcgccggcgccgccacagacgggcacgagggcggtcaaccgcgccgtgtccaccgtcatcaccgtcgtcatcggcgtcttcttcgtcctcgtcttcgtatgcgtcatcgtcaaccagtgctgcgactgcgactcctccgctggcgctggggctgggcaagggcagtcgtcggctgctcggcgccgccgcgggctcgacccggcggcggtggcggcgatcccggtcgtgccgtacgcggaggtcaggaagcacaggagcggcggcggcggcgcgctggagtgcgccgtgtgcctcaccgtgttcgacgacggggacgacctccgcctcctcccgcagtgctcccacgcgttccaccccgactgcatcgacccctggctcgagggccacgtcacctgcccgctgtgccgcgccaacctcgagaagcagccagcgccgtcgccgcctgccgtggagttctcctcctcgcctgctgcggccgcggcggcggcggaggagtcgcgtacgcccgaggccgcggcggtgcgggttgaggaggtggcggaggcgagcgacgaagaggagacgaggaggagggaggaggaggccgtggagctggagagtctgcgcgccgtgcggcgggcggcgaggatgccgaggtcgaactcgacggggcactcgctgtgcgcgctgccggcgccgcgcgcgccggggccgggcgacggcggtgaccacgagaggttcacggtgcggctgccgccgcacgtccgggaggaggtgctcaagtcgaggcgcctccggcacgccacgagcctcgtcctcggcatcaggggatcgagccgcgagggcagctcgaggggcggcggcgggagctggcacggcgcgcggcggtggccgtccttcctggcaaggacggtgtcgtgggcgcgcggcggcgtgggagcggacaccagcgcgaaggagacgccatgccgtgatgcggtctgatccgtgcaaagccggcgagattttgtgaaaaaaaatttctctttttatgtagaggaattaatttaatttgttcgcgtgcgaaggctgaaaaaccttgtacatacaccaggttgtttgccatttgaaattattataattttgcttattagtagtaatcgcgtgcacgtaatgtacaaaccgtggcaaatatatttgaaatttcgtttgtttt

SEQ ID NO: 5128 - DNA, 1700 bp, Oryza sativa
  Predicted polypeptide sequence is orthologous to G2239
aaacgcaacgcaaacactcgctcgatcgccacatgccgacgcctcgtcctcgccaccgccaccatgcgctcccgctcgcgctcgcgctcgccgcgccgctgctgctgctagccgcggcggacgggcagccgaacgagtcgagggacaagaacaacggcggcggggaggtgggttcatggcgcccagcggcggaggcggcggcatgggctctcagtcgccgagcttcagtgcgcccatggtggtgctcctcgtggcgctcatcgcggccttcttcttcatcgggttcttctccatctatatccggcggtgcggcggcgaggcctccacggggccgaccatcccggccgcggcgctggcggcgctgtcgcggcaggagcagcggagccggcggcagcgcgggctcgaccccgccgtggtcgagtcgttccccaccatgaagtacgccgaggcgagggagctccgcgacggcggcaaggacgccgtgctcgagtgcgccgtctgcctcagcgagttcgacgacgacgaggagctccggttgctgcccaagtgcagccacgccttccacccggactgcatcggggagtggctcgccggccacgtcacctgccctgtctgtcgatgcaaccttgcgcccgacgcggcggcggcggaagcgaacgtcgtctccggcgaggtggatggggagcagcaggaggaggaggtggtggtggccatcgacgtggaccgcgagggcgaggaggaggacgaggagaggcggagggaggcgatggagctcgagaggatcggcagccagcgccgcgcggtgcggtcgaggtcggggcggccgctgccgctgccgcggtcgcactcgacgggccactccctcgccacgacgcggctcggcgacgccggcgacctcgagcggttcacgctgcgcctgccggagcacgtgcgcagggagatggtcgccgccgccggcgaggagagcctgcgccgcaccgccgtccgggaaggccgcgtcggcggcggcgcccggagcgcgcggatcgggcggtccgaccggtggccgtcgttcatcgcgaggaccttctcctcgaggatcccgttctggtctgcgtcgaggagggtactcgacgccgcggaggccggagctgacgccgccgccaccaccaccaccacgacgccaacgtcaacggcgaggaccaagcgtgacaagacggccgccgccgcagatggctccgtgagctcagccaagggcagcgtccgcttcgactgtctcggcggcggcggcggcggcggcggcccgagcaacagagtcgtcgccttcgccaacgacgacgaggaggatgacgacgagaagccaatcgcccggcaagtttgagctcgcgccatgcgcggtggcggcgccagtgcatgcatcatctgatcagaaaaccaatccgcggcggcttctcgcagcgatccgccatggctggaccttcgatgaatcagctcgtgcacggacacagatcactagaaaagatcatcaatttgagttgaaaataccactcctaaattagtactagattgttaattatacatttttctctccattgcttctttggatagagaagtggcgtggaaacgttcaaagatccaatttttcttcccctccgttgaaaaactggagcggggttgtacttgtaccggcactgtattcaaatattcatgtgattattcgt

SEQ ID NO: 5129 - DNA, 1735 bp, Oryza sativa
  Predicted polypeptide sequence is orthologous to G2239
gactagccaaggcgccctcgcctcccgccgccgaccacgcgcgctatctgcatgccaagttgccgagctaggatgcacgcgcaccagcaccagcacgcgctgctcgcggcgctcctcgcgtgcgcgctcgcggcgtcgtcgtcgacggccggagcgcagccggcggggcagcaggggtatgcctacggcgacgtgtccgggcagcaggtgcacgtcagcacgacgatgatcgtgctgctggccgccgtcgtcggggttttcctgttcatcgcgatctccaccatctacctccgccactgcaccggttacgaccccgcgacggagggcggcggcgtcggcgggagccgttccatgatcctccctgccaacagcttcgtctcgaggcggcagcggcggccgcgcgggctcgactcgtcggtggtccggatgttccccaccatgaagtacgccgaggcgaaggcgctgcgggtggggaaggtcgccggcgccgcgctggagtgcgcggtgtgcctcagcgagttcgaggacgacgagatgctcaggttcctgcccaagtgcagccacgccttccacccggactgcatcggccagtggctcgccagccacgtgacctgccccgtctgccgccgcaatctcgaccctaacaaggacaccaccgaagaggtgatcatcccggccgccgccgccgccgatccgaacagcacctccagtgaaatagttgtgatacggcaagaagacggggcgcacccagcagccgtggtgatcgacgtggtcaccgaggaggacgacgaggagcggaggaaggaggagctagagcttcaggcgataggcacccagctccgcgcgatgcggtcacggtcggggctgcggccaaagacgtcggcggcgaagcttccccggtcgcactccactggccactccctcgccgtccggctcgacggcgacctagagcggtacacgctgcggctgccggagcacgtacacagggagatggtcgcggcgggggagcagagcgtgcgccgcgggaggagactcggggaaggggtcggcatgggcgctcggtgcagcccccggttttcgcggtcgggcagatggtcatcttttctctcaaattctttgtcaggaaagctgtctttcctctccccgtcgtcgaggagaacgccggatagcacccaggtggaagtgtcatcatcctcgtcgtcgtcggtgacgaaggtgaaagggaagcgcgtggccgccgtcgatgttgccgacgacggttctgctcatgggactgcacagtaccctggttgcactgtggccagctcggcggcggcggcggctgtggacgtggagaaggcagctaccaggcaagttcgaacatagaaaacgaacagaagttttgagtgagaaacttgaacagttgaacttgacgtcatgcattttcccacatgaaagaaagaaatggtctttttttgtcggtgggactgtattctgtactctgtactaggtatattatcaacgccgatatgcccaaatattatgggagcacctattgatcaatcaggtgactgcagaatagcaaaggcgaaataatatacatactaggttgaagaaacttagatgcttttttttttttggaactagaaacttaggctgtgtttgagggagaggggattgagaagattggaaagatacgtaaaacgaggtgagtcattagtgcatgattaattgagtattaactattttaaattcc

SEQ ID NO: 5130 - DNA, 1249 bp, Oryza sativa
  Predicted polypeptide sequence is orthologous to G2239
actccattccttccaaaagaaaactcgaaacctccccctctccggccgccggcgagcggctcatccatccaccccaccttggccggagacggcggcaatggctcaccgccggatcgcgctcgccgtcctcgtgacgctgctcttgtcggcgttccgcccttgcctggcgcaacagagcaacgacgacacgagcaaacaccaccggagcgccacggccggcgggttcacgccgaccaccgtcgtcgtgctcgtggctctcatcaccgccttcgtcctcctcaccgtgttctccgtcctcatcaaccgctgcgcccaggcgcgcgctcccccgcgccgggcgttccgcagcacggcgtcccatcagcccgtcggcggcgccgccgccgcgtcccgcgcctcgcgtggcctcgacaaggaggtcgtggaggcgttccccacggcggtctacggcgacgtgaaggcgcgcatggcggcgaagtcggggccgctcgagtgcgccgtgtgcctcgccgagttcgcggacagcgacgagctacgggtgctcccggcgtgctgtcacgtgttccacccggactgcatcgacccctggctcgccgccgccgtcacgtgcccgctctgccgcgccaacctcacggcgccaccggtgtcgctcgccgccgccgagagctccgacctgacggcgccggaggaggcggtgcaggaggaagagtcggaggagctcgacgaggcgtccctgatggccaccttcacgccggaatccgtcatcgacttcggcgcgacgcacgaccatgaattcgacagagcagggtaccctcactaccggaggacgcagtcggccatggacgccgcgccggaccggcacacgctgaggctaccggagcacgtcatgaaggagctcgccgccgaccgcaggcaccggcgcgccgcgagcctcgccgggtacccggacagcgtggagaggacgccgaggtggctgacgtcgctctggcgatcggtgtcgtggcagaggcagagccgggcggactgggacgccggagaggagcacggcggcagcaaaagggttcacccggtcgccggagctcaggacgagacacccagcgggtccggctccgatgggagcaaggagaactccgattctgacgcgttaaaccgagtttgaattttgttttctcctcttctttttttttcttgtgcttcgttctaattgtgcagcggtgtagtaatacaaattaacgataaactaccttgc

SEQ ID NO: 5131 - DNA, 1242 bp, Oryza sativa
  Predicted polypeptide sequence is orthologous to G2239
atggggtcgccgcgaggacgccgccgcggcgacaatggccgcctcctcctcctcgccgccgccgccgtcgtcattgcctcgctggtcggcggcggcgcggcgcagccgacgacgtccgggcccggcccgaactacttcaaccccaagagcttcaacccgtccatggccgtcgtgatcgtggtcttggtcaccgccttcttcttcctcgggttcttctcgatctacatccggcgatgcgccggcgggccgttgggtgggcccggggggtatggcgtcggcggcggcggcggtggacgtgtgggtggtgggttcacgtttgcggcggcgcggtcgaggagggtgagggggcttgaccccgccgtgctgggcgcgttcccgaccatggcgtacgccgacgtgaaggcgcacaaggccggcaagggcgcgctcgagtgcgccgtgtgcctcagcgagttcgacgacgacgagacgctccggctgctgcccaggtgctcccacgcgttccacgccgactgcatcgacgcgtggctggcgtcccacgtcacgtgccccgtctgccgcgccaacctcgccttcgacgccggcgtcccgccgccgccgctggcgccgccgcatgcgttgaccaccgggcaagatgttgcggctgcgccgccgcagccggcggcgccagagcaggtgacggtggacgtcgtcgtcgcggatgccgaggagacggaggagaggatcaggagggaggaggcggccgagctgatgcggatcggaagcgtgaagcgcgcgctgcggagcaagtccggccgccggccgccgcagttcccgcggtcgcacaccacggggcactcgctcgccgccgccgccgccgtgcccgccaccgccgacgacgccgcggagcggtacacgctgaggctccccgatcacgtgctccgggaaatcgtcacctcggcgaggctacgccgcacgacgagcctccaatcgttccgcaccaccgccgccgccggcggcggcgcccgcgccgggaggagcgtccggctcggccagtccgggaggtggtccaacgtgtcgtcgctgatgcgcacgttctcggccaggctgccggcgtggggctccgctcgacgcggcgccgaagccgactctccggggaaggacggcgccaaggtcgccggcgactgcaccgcctccgtggagcaacactgcgacggcggcggcggcggcgcgtgcccacgtccacttggtgaccatgtatga

SEQ ID NO: 5132 - DNA, 1164 bp, Oryza sativa
  Predicted polypeptide sequence is orthologous to G2239
atggggacgcgcgagctcctcgtcgttcttgccgtcgtcgtcatggccgccgtcggcgccggcgcgcagtcttcttcggcgtcgccggcgccggcgacgtcgcaggcaccgacggtgcggcagcagacgccgttcgggcggaccatgtcgaccgtcatcacggtgtccatcagcgtgttcttcttcctgctcttcttctgcgcgtacatcaaccagtgtcgcctcgccgaggccggggacgccagggccgcggcggcggcggcggccggcgggggagccggaggagggccgtccaggagagggaagcgcgggctggacccggcggtggtggccacgttcccgatcgtgccgtacagggaggtggtgaagcacaagatcggcaagagcgtgctggagtgcgccgtgtgcctgacgtcgttcgacgacggcgacgacctccggctgctgccgcactgctcgcacgcgttccacccggagtgcatcgacccctggctggagtcccgggtcacgtgcccgctgtgccgcgccaacctcgagaagcctccgccgccgccaccgccgccgccggcggcggcggcggcgtccccttcgccggagcggtcgccgcggtgccagccttcgccgccgccgccgccgccgccgcacgccctggtgataccggtggaggacgaggaagacgacagcgacgaggacgacaggaaggaggaggccgtggagctcgagatgctgcgcagcgagcggcgcgccgcgaggctgccgaggtcgcactcgacggggcactcgctggtcgcgtcggcggccgccgccgccgagtccggcgaccacgagcggttcacgctgcggctgccgcagcacgtgcgggacgaggtgctccggtcgctccgcctccgccacgccgccagcctggtcaacctctcggacatgagctccgaggggagctcgaggggaggacggcgtgcattaggcctcgccttcggcaacggcggcgggagcagccacggcggccgccggtggcaggcgttcttggcgaggacggtgtcatgggcgcgaggcggaggcgacggctcggtgcgcaggggctgggacggctcgacgagaagaggaaaagatgacgccgagtcgagcagaaagggggcgacctcaccggcggccggccggccgtga

SEQ ID NO: 5133 - DNA, 1179 bp, Oryza sativa
  Predicted polypeptide sequence is orthologous to G2239
atggcgccagctcgagtccacagcaatggccgcctcctcatgcttctcctcctgctcgccgtcgccggctttgcggcggcgcagccgagccaggacaatcctccggcgggctactacgcgaccaacttcagcccgtccatggccatcgtcatcgtcgtcctcatcgccgccttcttcttcctcggcttcttctccatctacgtccgccactgctacggcggccgcggcgactactcgaccaccccgctgccccggtccggcgccgcgcggtcgcggcggcagcgcgggctcgaccagtccgtgctcgcgacgttcccgaccatggcgtacgccgacgtgaaggcgcacaagtccgtcaagggcgcgctcgagtgcgccgtctgcatcagcgagttcgacgacgacgagacgctgcggctgctgcccaagtgctcccacgtcttccaccaggactgcatcgacacgtggctcgcgtcgcacgccacctgcccggtctgccgcgccaacctcgtcgacggcgcgtccgagccggcgagcgatgtcgccgccgagctaccgacggcgcccgctccgcgcccggaaggcgcgacgccgtccgaggcagcagcgccagggggggaggcgccggcggcggcggcggcggcggcggtggtgatcgacgtggaggagaccgaggaagagaggatcataagagaggaggcggccgagctaacgcgcatcggcagcctgaagcgcgcgctgcgctcgaagtccggccgcgcgcccgccgcgcgtttcccgcgctcgcattcgacggggcactcgctctcctcctccgccgcggcgagcgccggcgccgagaggttcacgctgcggctgcccgagcacgtgctccgggaggtcatcgcggcggggcagctccagcgaacgacgagcctcgtggcgttccgcgccggccgccaggggagcacgcgccgtggcctcaggtcgggaggcggcggcggcggcggtgaaggcagcagccgcgccgggagaagcgtccggctcggccagtctggacggtggccgtcgttcctgccgcggacgttctcggcgaggctgccggcgtggggatcaaggtcgacgcggaggggcgacggcgacgggtccagcaagggcggcaggactgccggctccggcgccggcgccggcggcaagtaa

SEQ ID NO: 5134 - DNA, 638 bp, Oryza sativa
  Predicted polypeptide sequence is orthologous to G2239
tgcggagcaagtccggccgccggccgccgcagttcccgcggtcgcacaccacggggcactcgctctccgccgccgccgccgtgcccgccaccgccgacgacgccgcggagcggtacacgctgaggctccccgatcacgtgctccgggaaatcgtcacctcggcgaggctacgccgcacgacgagcctccaatcgttccgcaccaccgccgccgccggcggcggcgcccgcgccgggaggagcgtccggctcggccagtccgggaggtggtccaacgtgtcgtcgctgatgcgcacgttctcggccaggctgccggcgtggggctccgctcgacgcggcgccgaagccgactctccggggaaggacggcgccaaggtcgccggcgactgcaccgcctccgtggagcaacactgcgacggcggcggcggcggcgcgtgcccacgtccacttggtgaccatgtatgatgacgtgtcccgctgattgttagtcaaagtattagaagtactccactaatattaggaaggcgtccttgtcgtcaccgttaattctcttctcttttcggcggcaatttgtgtgtacataaagtcacaaactttattcttcttcgattacaaagtcgcaaaaaaattatgtggttg

SEQ ID NO: 5135 - DNA, 1262 bp, Oryza sativa
  Predicted polypeptide sequence is orthologous to G225, G682
agagaagggccctagaaaacataaggtcataacaagggtctgaggatcttagctagcacaagatctcaactcggcatttcattggagtttttcacgcctaatggatagcagcagtggtagccagggaaagaattccaaaaccagtgatggttgtgaaacaaaaggtttgcatatcttgaatttctgtttgtttcctgttagccttttcacctttgcttctcttaacaataggtatatagctttttcatttcctaattcctatcatcatgttcaataaggaaacaaatgaagaagtgtcatttagttaatacctagcgacatttaacctgtatattgtcatattctgcatcttgatgctttacttgattatgtcaatggagaaaacaaagagaaacgagaagtcaggaagtaatagtcagagcatactcgcaaagtagcaaggaactttgtaactacataaactgcaagaaagtatacatgcaaacttgataatcagttgcctatcatcagtcctgatagctaataggaacagattaacataatgaataaggcatattccagctttgtttacttccaggcttccagcataagaataaatccccaccagggcagattgcaaattctaatggaggctagtagtttgcaaaatatttgagatggttggctactgagttattttgcttattttggtgaccagtttttttaataaattttgcagaagttaataacactgcacagaattttgttcatttcacggaagaagaggaagatctcgttttcagaatgcacaggcttgttgggaacaggtatcctaatacacatattacatatctgtaatgtgcatcaagtgaaaatgaagacaaattgtatttttacattattagcttgtactatgattgtttcagaagtttggcaaattcatgaaacccatatgtctgtttcaaaaaaatacattatttgcagttccctaactttgctccttgtatggagttatgcaggtgggaacttatagctggaagaatccctggaagaacagcaaaagaggtagaaatgttctgggcagtaaagcaccagaatacataaggggggaaaaagggtgtatgccctaaaagtagcgtacaatttagaagcaaacttttttagaaaaggatttaggccctaaaagtaggctataatttagataaattgtgttgcctcagtcttatgcctgatgcaaaaggggaggaaaaactgaatgcaaaattaatgtgtttattccatag

SEQ ID NO: 5136 - DNA, 1223 bp, Oryza sativa
  Predicted polypeptide sequence is orthologous to G2251
ctctctctctctctctctctctctaaagattccatctttgatttcgtttctctctctagaaggaaggaaggaggtcgccggcggcgatggggttcccgtcggtgtgctactgcgtgatactgccgcagccgctggtgctggtgctgcagctgctcgacctgctgcgccacgccttcctgctctgcctctccgcgctcggcctcgccgcgccgccgctcccggacgaacaccccgcctacgcgccgcccccgccgccgccggcgtcgatggcggccctccccgccgacctcgtctgggcgttccagcccgcgccggagccggccgccatcaaggcgcgcctccccgccgtccgctacgccgacttcgtcaggtgccgccgcgccgccgcggcggccgcggcgtcgtgcgtcgtgtgcctcggcgcgctcgaggcgcgtcaccgggtgcgcgagctcggcaactgcgcgcacgcgttccacaaggcgtgcatcgacaagtgggtcgacaagggccaggccacctgcccgctctgccgcgccgccctcctcccctccgccgacgacgccgacgccgccgccatcgccgccaccaccaggcaccacctcccctccttctgatccatgtcgccaagaacccatcttgcttagcacccaacacccccttccaccccaagagcaacaagggttccctcctcctttctccaccaatggatcaaatccaatcaaaatggaagaacacacaacacaagagaagagagatagagagagaaatcaatggaggaagaagatgagaggagagagagggggtgtgtgtggtggaggagtattattggtaggtgaggcactaattatgaggaggacaaggatggctacctgcactgcattggatctggtgaatttcagccctagctagctatagatccaacatctcctctcttcccttctcttctcttctcttcacttcacttcacatcaactttttctttgcttttcttttttctactttactttcttcttttgttgccttcacctcctttttgaaattttgctttctttctctttaatttttctccctctttttccttcttttttttgagggtttcctctccccttgtcattaacttaatttgtaaggggggattaagagagagagatgtgtacatacctgcctccactttgacaaatatcggaataataatttataatgatgatgatgatgatgat

SEQ ID NO: 5137 - DNA, 1039 bp, Oryza sativa
  Predicted polypeptide sequence is orthologous to G2251
gtcactcgtcaccatcctccccctttgctttccacgactctctttcgccgcagtctctgcttccgtgcatccatcggcgttcggcgactcggtgtatagtagtattgccaactgtgcgtagcaagctcgatacagcggcgatcatggggttccctctggtgtgctactgcatggcgatccccaagccgctcatcgccttggccaagctcctcgccgccatcagggaggccctccagctgatgctcttcgtcgtcgggatctgccaccacccggagcgatcgggccgcccggctgccgtcgacgccccgctgcccgacgaggtgaaggaccgcctcccgcccctcgagttcgcccagctgctcgcggcctcggagcacggctgtcatggctgcgacgacgacgaggcggtggcggggtgcatcgtgtgcctggagaggctggaggcggatgacgtggtgcggcggctgggcaactgcgcgcacgcgttccaccgcggctgcatcgaccggtggatcgacctcggctggttgacgtgcccgctgtgccgctccaccctgctgccgcgcgcgcgccccgccgccggcccgcgcgggcgactgggccgcctcgccacccgcctcacgggcgtcgtttggtgaatcaatatttggcccgcgcgaccgcgacgcgacacgggatcggttgggtgggagggcagtcgcgccatttcacagcctaagctagcttactgctgctgttaatcaacggagacaaagctctctttccctttcgtttcctttttctttttctgccgaggattatccagctggaggagagtggtacgtgtcggaatgcggtggaatatatcgatgattagacggtaggaacaattaattagaagcaggcaagcagctggttggttggcccggcctggcacctggcatgatcattgggaggttcatgtaattactgcgatgattagatactgcatgtaagtaaatcatgtcatagagataatacacctgtgtacagtggtataatgataaacggttcatttggt

SEQ ID NO: 5138 - DNA, 838 bp, Oryza sativa; identical to SEQ ID NO: 2353
  Predicted polypeptide sequence is orthologous to G227, G242

SEQ ID NO: 5139 - DNA, 1591 bp, Oryza sativa
  Predicted polypeptide sequence is orthologous to G227, G242
gctactgacttaatttagctccgcctccattcacgcattcacactagcatagcatataagatagcacttgtagagaggagatactagtacacatagagaagaggagaggagattgatcggtgagggaggatgatggcgtcttgtcggagaggagggggaggggatgtggataggataaaggggccgtggagtccggaggaggacgaggcgctgcagcggctggtggggcggcacggggcgcgcaactggtcgctgataagcaagtccatcccggggaggtcggggaagtcgtgccggctgcggtggtgcaaccagctgtcgccgcaggtggagcaccggcccttcactcccgaggaggacgacaccatcctccgcgcccacgcccgcttcggcaacaagtgggccaccatcgccaggctcctcgccggccgcaccgacaacgccatcaagaaccactggaactccaccctcaagcgcaagcaccactcttctctcctcgccgacgacctccgccctctcaagcggacaaccagcgacggccacccgacgctctcctccgccgccgcccccgggagcccctccggctccgacctcagcgactccagccaccatagcctcccctcccagatgccctcctcacccccacacctcctcctccctcagcacgtctaccgcccggtcgcgagggccggcggggtcgtcgtccctcctcctcctcccccgccgcctccggcgacctcgctctccctctctctctcccttcccggcctggatcacccacaccccgatccctccaccccgtcggagcctgcggtacagttgcagccgcctccaccgtctcagatgccgccaccaacaccatcttgtgtacgccaagagccgcctcagatgccgttccagctgcagcccccaccgccgccgcgcccatcggcgccgttcagcgcggagttcttggccatgatgcaggagatgatccggatcgaggtccggaattacatgtccggctccgccgccgtggatcctcggtcgtcgcccgacaacggcgtgcgcgccgccagccgcatcatgggcatggccaagatcgagtaatcaaccagccgcagcagcatacggaatgatcgagtaatcaagctcagattgatgcactgcaagcaagaaagcagagcaagaagcagaggcgccggcgcggcaagtgaagagacgacgaccatcaacgtttggatcctccttttctattctgctatagtcttcttcttccccaataattccttgtctagttttaatttttttttctcttcaatttttactcctccaatccaagttgaagttgtcactagtagagttctccagagagagaggagatgaagcaacaacaaggagctgtgtctgcctgtctggaggaactaataccaaaccaaaataagcagagtgtgtgctgctgtgccacaatcagcaccaccaccgtggcaccacccactagcttagcttagctagctagttcaaagttctttttgtatatacttataagaggaaaaagaaaaaagagagctgatcagtgaaaattcagaatgcatcagtgaagagaattgcc

SEQ ID NO: 5140 - DNA, 525 bp, Oryza sativa
  Predicted polypeptide sequence is orthologous to G227, G242
atgaggatcatcctccgcattaggctctcgccggcgtggacgcccgaagaggacgcgtgcctggagcgcctcgccagggggtacggcttccgccactggcgccgcgtcgccgaggagatgcagccgagggagcggcgccgctcgcccaagcagtgccgcgacaggtggcgggaccacctcgcccgcgacgtctaccaccgccccttcaccgccgacgacgacgccgagctcgcccacctccgcctccgcggcggcggcggcgaccggtggaaggacatcagcagggccgcccactgccgcacctcgcgcgccatgaggcgccggtggagggagctccgcaagagcgacgcgttcctcagggcgctgtactggcatcccgaccagccggtgccaccgctacttgacgacgcgttgtcgtgcagcgacgtcctcgactccagcgtggcctcctaccgtggtggctgcgacgccgtggccggcggcggcacgatcgttgcaccagggttcgcctgcttcgccgcatag

SEQ ID NO: 5141 - DNA, 1369 bp, Oryza sativa; identical to SEQ ID NO: 2349
  Predicted polypeptide sequence is orthologous to G227, G242

SEQ ID NO: 5142 - DNA, 1217 bp, Oryza sativa
  Predicted polypeptide sequence is orthologous to G229
ccagatcgctcagtctcacaccgcacagagacagagaagagctctagagagaacgagagagagagacagagagagagagagagagggagaatggggaggagagcttgctgcgcaaaggaagggatgaagagaggggcatggacgagcaaggaggacgacgtgcttgcctcctacatcaagtcccatggcgaaggcaagtggcgcgaggtcccccaacgagctggtttgaggcggtgcggcaagagctgcaggctccggtggctcaactatctccggcctaacatcaagcgcggcaacatcgacgacgacgaggaggagctcatcgtcaggctccacaccctcctcggcaacaggtggtctctcattgcaggcaggctgccgggccgaacagacaatgaaatcaagaactactggaacagcacgctcagccgcaagatcggcaccgccgccaccgccgccgccggcagccgcggtggcagcacgccggacaccgccagagcgacggacgcggcgtcgtccagctccgtcgtgccgccgggccagcagcagcagccagcctcccgcgccgacaccgacacagcaacggcagcggcggcggcggcggcgacgacgaccaccgtgtgggcgcccaaggccgtgcggtgcacgcgcgggttcttcttccacgaccgtgaaacggcgccgctcgccgcggcggcgccggcgccggcaggggaattaggagacggcgatgacgtcgactgcgactactactgcagcggcagcagctcggcggcgacgacgacgtcgtcgagctcattaccggcggtcgtcgagccgtgcttctccgccggcgacgactggatggacgacgtgagagccttggcgtcgtttcttgacaccgacgacgcctggaacttgtgtgcgtgacattagttcgtcgtccgtacgtacctacgtatatgcatgtgtgcgtctcatagaatgaatataaaataatattttctccatctattttaagtgcagttgcgggtttccgtatataaaattaacgattttgctatatatttgtcgataaattttctcctaaaaatttgacagatgtaattacagtacaatcgtagtataattacactgtaactttcatgtaattacactgtaactatagtgtaacttgtatgtaactttcaaaaatctctttgtaatatgttatttcggtaaaaaaaaaaaaaaaaaaa

SEQ ID NO: 5143 - DNA, 795 bp, Oryza sativa
  misc_feature (102)..(102): n is a, c, g, or t
  Predicted polypeptide sequence is orthologous to G229
gacaaagctgggtaccgggccccccctcgagtttttttttccttttaagttagacttgcagtgtaagctctggacagcttccctacttacgatgttaatacnctttgtccacaaattacaagacgacattactgaactgtcagctatgggtcaagataagatgagtttcacattgcctactatatttaccaattatatttgagcagctgaaccaaggctctataaacagtaatccatcagcagagactatgggttgctattgatggggtaaaagtaagaaccattagccagatttctgcgctatcagactataaggatccaggctcacctccagataagaacttatgggcccaagcttcaaggtactccctacccatgttcatgaaaaagcttcgatgcacttcaaactctggtttacaaaggcaaattccaactgagagtctatcagcaggtgtcagtgggatttctttcagcatgttccatagaggagcatttgggtccgatgatgtcggtgctgctcgtattggttttgcaggggtgtcatggatcccagctaaggtactctttaccatatccgccttcctgccatcatgtggcacgggtgcctgcggttttgggtttggggttgtttttgttctgctgactactttgcacttcttcaatccaggcttgagagcagccattgtgctctcagcaaaggatccagatggctgggcagatggtgcactagtgtcagacatcacttcacaaggcactgcatcactacttgctgccacctcatgacagtcatcttca

SEQ ID NO: 5144 - DNA, 1372 bp, Oryza sativa
  Predicted polypeptide sequence is orthologous to G229
ttgcatccctatagttgttgtgccgggccaacccaccgtgcctagggtgcagcccaggcatggcccggttgttggatctggctagtacgggcacgaccccagtcgggtcatgccatgtttgggctgggccaaaatggcgtgccttgggccgggccatgggcctcgggccatatggccatctatacttaaaacttgtttactgctgtagatctgcaatacgtagcgaaccaaaacttttgtgttgttcttttctttttcaaatttggtcgaaattgcttcaattttaaaaacttggtaagacttgtatggaactatggatgcagatggtcgctgatagccgggaggctgccggggcgaacagacaatgaaatcaagaactactggaacagcaccctcagcaagcgggtcgccatgcaacggaccgccgccgccaccagcatgccggcggcggccaccaccagcagcaatgccgacgccgccggcgctgctgcacgacgccggcgatcgccggagccccgcacggtcgtcgtcagcccaatccggaccaaggcgctgcggtgcaacaacaacagcagcagcgggatagtggtggtgcagcaggcaggcgcctgcagccacggcggccgtccgccggagagcggcgcgccgggagacgcggcggctgataaggtggccacgccgcaggcggtgcagcagcagcagcagcaagagctggccggagcggaggatgacgacgacctgccggtgccggccgtctgtatcgaccttgacttggacgacatcgagctgggaggactcgacggcttcctgatcagcccgtggcgcggcggcggccacgacgacggtaacgccgccgccggagcggtgccgaatctgccgatgccgattggctatgagctcggcggcgccggtggcggtggcgaggctggagctgttgacctggaggcgttgctggggcagctggaagcagaggaagacgacgacggtgaccaccaccaccaccaccaccaccaccaccaccagtaggaggaggaggtgccttcttcgcttggggacgaagacgacgactacttggagttcgcgccatggctcctctgatagcggcatccatccatggatcattgtggaatcgaatcagtcgagctgagagttgagagttgagaaagatcgatgattgctttgctggtcgtgtgttcctgcgagtcggatcatcggcacgaagagagatctcatcgattaagtaggcgcggaaggcgtacgttgaagcttagctgctgaagaattactgacgtagtcagatgaccatttccttatatattgtacagattataatggagcagattaaataaatctaaacacaccgcatttgatc

SEQ ID NO: 5145 - DNA, 954 bp, Oryza sativa
  Predicted polypeptide sequence is orthologous to G229
atggggagggcgccgtgctgcgagaaggtggggttgaggagggggaggtggacgaaggaggaggacgagaagctggcgaggtacatacgggagaacggggaaggggcgtggaggtcgatgcccaagaatgccggcctgctgcgctgcggcaagagctgcaggcttcggtggatcaactacctccgggccgacctcaagagggggaacatctcgccccaggaggaggacatcatcctcaacctccacgccacactcggcaacaggtggtccctgatcgccggccacttgcccgggcggacggacaatgagatcaagaactactggaactcgcacctgagccggaagggatacgagttcctccgcggcggcggcggcggcgccgtcgtcgacgtcgacctcagcaagttgcccggcggcgggaagcggcgcggcggccggacgggccgcagcagcagcgggaaggagaagacgaggacgaaggagaaggacaaggcccccgctccagaagctgcgcacaatgacgacggcggcggcggcggcggcggcggcattgacaacgtctcggcagctagccacagccacagggaggagcaggcacaggcgagcgccagtggtctcacatcagatgggctcgaggagggcccactgggcctaagcgaggagatggtgagtgggcccgtgggaccggtgagcccaaagcctgaggtgggccaggatgggtcttctgcagagagtggctgctgtgggcctagtggatccagtggcccaaccgaggctgtgggccaggacatgggcgacaagtccatggactgggacctggtgggcctggacgatggcttcgccaacgatgacatgtggggctcactctcctgggactacggggagttggtgggcccggatggagttcatcagggcgaggtgctatccgacttgttcttcttgggcaacctgtag

SEQ ID NO: 5146 - DNA, 1276 bp, Oryza sativa
  Predicted polypeptide sequence is orthologous to G2290
accgcagttcactgcactctcctctacaagcggatcaccggagaagagatcgatcggtagccgtagcacggcacggtggttgatcggcggcggccatggccggagcggagtggtcgccgttcgacggggacgccgccttcgcggagtactcgtcggcggtgctggccgagctcggcgggtgggcggcgccgggcgaggaaggcggcgcggggatgatggtaccggcggcgctggatctgccggtggatgtggtgggggcggcggcgcgggaggaggaggaggaggaggaggaggcgccggcgagatcgggcgacggcgccgccgccgccgcgtcgtcgagctctagcggggagcccgccgcccccgacaagcgaccggccgccgccgaggcagcgccggcggcggcggcgacggcgacggcgacggcgaagaaggggcagaagagggcgaggcagccgcggttcgcgttcatgaccaagagcgagattgaccacctcgaggatggctacaggtggaggaagtatgggcaaaaggcggtcaagaacagcccattcccaaggagctactacaggtgcaccaacagcaagtgcactgtgaagaagcgcgtggagcggtcttccgacgacccttccgtcgtgatcaccacctacgagggccagcactgccaccacaccgcctccttccagcgcggcgtcggcggcgccgccgtcgcggcgcacatccacggcgcggcggccgtcgccctcgccgagcaaatgtcggcgttcgtctcgccgccgccacagccgcatatgctgtacggtttaccccggttgcacccgccgtcctccgagaccgccgtcagctgctcgatgccgacgacgacgtctttgcaggagctgaacaatagcgaggggctacaacgccctggctataataatagcccccaggcggcggtgaccatcgcgcagcggccgccgtcgccgtcggtgcctccggctgtttcgtttgacaaggggctacttgatgatattgtgcctcctggagttagacttggatgacaatactcaaatatacatgcatggtaagttggtaagtagctacacaatggacctcattaattagaattattagcagatgttaaattgtatatgttcttatgatactgctaacgaaatctggaagttggaactcacgaaaatttagacactcctaaattaagttgattcttactcctatgtaagagactgcacactaatagaatcaaattttataattgttcttactcgcataaaaa

SEQ ID NO: 5147 - DNA, 1070 bp, Oryza sativa
  Predicted polypeptide sequence is orthologous to G2290
gcactactagctagctgctgctcctccggctggccggccggccggagtgtgccatggccatggcgggcgccggcgactggccgttcgccgccgacgaagcgtacgccgactcgtcggccatattcgccgagctcggctgggccaacgggctcgccgtcgtcgacgccgtgggggagctactgccgccgctggatccaccgggcgagctggccacgccgccgccgccgccgctggatctgccggagacgccggccgggtcctccgcggacggcgccgcgtcgtcgtgctccaccgacgacgccgacggcgggaagccggccgccgcgtccaccgaggcagcgagcaagtcgctgacgcctgggaagaagagggcgcggcaaccgcggttcgcgttcatgacgaagagcgagatcgatcacctggaggatggctatcgctggagaaagtatggccagaaagccgtcaagaacagtccttttccaaggagctactacaggtgcacgaacagcaagtgcacggtgaagaagcgggtggagcgctcctccgacgacccctccgtcgtcatcaccacctacgagggccaacactcccaccacaccgtcaccttcccccgcgccgccgccaccgccgccggcttctcgcacatccacgccatggccgccctggccgccgcacccttctccgcgcaccaacaactgtacagcaacctgcagccgccgccgccgacgatgccgcttgctgctactactccggcgtcgtcgtcgtcgctgctacagctgcctctgcactgcaaccatgagctgcaggttgttgccagctgcggcggctacccgtcgtcgtcgtcgtcgccgccggcgagtgttcttcccgtcgacaaggggctccttgatgacatggtgcctagggcaatgaggcatgatgggtagtacaagcatgcacaccatcgatttaatttggggttaatttgtagcctaattattaatcttaattagctgcttcgatggattaattagcacggtaagtagttacttattcgtgttgagatcactggaaagataataataattaat

SEQ ID NO: 5148 - DNA, 658 bp, Oryza sativa
  misc_feature (19)..(19): n is a, c, g, or t
  misc_feature (111)..(111): n is a, c, g, or t
  misc_feature (155)..(155): n is a, c, g, or t
  misc_feature (159)..(159): n is a, c, g, or t
  misc_feature (183)..(183): n is a, c, g, or t
  misc_feature (200)..(200): n is a, c, g, or t
  misc_feature (240)..(240): n is a, c, g, or t
  misc_feature (243)..(243): n is a, c, g, or t
  misc_feature (247)..(247): n is a, c, g, or t
  misc_feature (254)..(254): n is a, c, g, or t
  misc_feature (281)..(281): n is a, c, g, or t
  misc_feature (326)..(327): n is a, c, g, or t
  misc_feature (494)..(494): n is a, c, g, or t
  misc_feature (573)..(573): n is a, c, g, or t
  Predicted polypeptide sequence is orthologous to G2296
tgagaatcttgtttcggantcgtacaggaacatgggtatgttgctacactgcgcggagggatttacgaacgtgcacgtccattttatccatgtgtataggaactttgatgnttggacattgtaccttcttgagggtgctcaaagtgctaacgccnaacntatctttggtatacggatgttacntaccattttctggaacngctttgcttatttgtggtcagccggtacattggactccgnccnttgngctgagnccccaaaagtattcctccagtggccancctgaaaaattccgtagtgtcgacgttatggtattttgtttctanncccggtagtcccgtccattgtgcgaccggtgaggcgcgaaagcgtatgtgtgtcctacaaatttgtgagtcaccatcccagttggtagctccggccaacctgcaaggacaggtcaagtatccagaggcgactgatcgtaccgtgagttgtccgcatggtagccttgntcactgtacccggattgttattggtgagagtcatttgtgcaccattcttgggcaacctgtgtacatagtcatgcatatntgtatggatcatatggcgtcagaatcatcagataatataattgagacgttttccagttaaaaaaaaaaaaaaaaaaaaaaaaaaa

SEQ ID NO: 5149 - DNA, 729 bp, Oryza sativa
  Predicted polypeptide sequence is orthologous to G2296
atgtggatgcaggaagggcatccaacatgtgtcaaccttacgcctataccacatacagatggccatctctggaggaagtatggagagaagaaaatcaagaactcatcgttcccaagacgttggtgtaaaactgtcgcgatctacaggctatactaccgatgctcttaccgggacgacaggaattgcatggcgaccaaggtggtgcagcaggagaacgacgccgacccgccactctacagggtcacctacattcacccgcacacctgcaacccatcgccgccggccccgacgccggcccatgtcttcaccgagccaccgccggccaaagcggaagtacaccacgcggtgttgttcaggttcagctccactgccggcggccacacggccaataatgcagtgcatcgtcagcagtggcagcctgcggcggctacgatggcggcgggggcccaggcgcagctgtcaatgacgatgagcgacgacgagcgggagcagccgccggcggccatccgttctgcgccgccggcacggcggctgtcgatgttccgcgccgtcgttgatggactcaggcagatgcggtcgtcggcgccgccaacaccgtcgtcgtcgatggtggtggacgacggatgggacacgttctcgtcgtttgatttggatacgtgcgaattcagtgtcgatgacgagttgctctgtggtgaccatatgtatttcccggacagtatgcagcaatag

SEQ ID NO: 5150 - DNA, 468 bp, Oryza sativa
  Predicted polypeptide sequence is orthologous to G2334
tttttttttttttttttatcgtcgactcgacccaaccggatcgagcgccgccgccgccaagccgccaccaattcaattcatcgatgattcgagtcacggatacattgagtgttttataccgtatcccttctctctctctctctctctctcttacagccaaacagtattacagctggcgaattctttcccctattacaagaaagatgttacttggcccacattggcccactatagcgagggttaggaacacgagctcgaatgggcttctttgctgtagcgcttgaagtctcttctatctcctgctctgctgctatctccagttctactgcattgttctcctgttctccatcaggcaagatttgaaggtcgagggggcaacggcgatggggacgactgtggagacatcggtagccctcttaagtcggcggtagcgtcgagggggttggctcctcagtaccatcggatgga

SEQ ID NO: 5151 - DNA, 1729 bp, Oryza sativa
  Predicted polypeptide sequence is orthologous to G2343
gaagagaaggtagctcatgcatattaaaagggctaaacaccaaccaaaccctttgctcctccatgacaacaatgtcatgttgctagcagctagatcaagaatatattcaagatagttaattgctgcatataggttttgcaagttgcagaacttgcagctatattgttgttacactagctgttcatatcttggattccagtgatatctagagtgcatgcatggggcatcactcttgctgcaaccagcagaaggtgaagaggggcctctggtctcctgaggaagatgagaagctcatcagatacatcaccacccatggctatggctgctggagcgaggtcccggagaaagccggtttgcagcgatgtgggaagagctgccggctccggtggatcaactacctgagaccggacatccggcgagggcggttcacggcggaggaggagaagctcatcatcagcctgcacgccattgttggcaacaggtgggcccacattgccagccacctgcctggccggaccgacaacgagatcaagaactactggaattcatggatcaagaagaagattcgcaagccggcggcggccgccgccgcggcgaccacgacgagcccgaacaacccgccgccgtgcagcacggcgacgtcggaccaccaccacctgccgccgccggcgttcggcggcgctgatcaccacctgcagctcgacgccatcatcaaccagaacctgatatcatccctgccgccgaagctcgccaccggcgacgactcgccgccggcggtgcccgggctgccgcaccactgcccgctcttcatgttcgacaccaccaccaccggcgccggcggcgccatcagcccgccgccgccgtcatcactgatcccaacccacctccaccaccaccaccacccgttcatcgccagcttcacggcggcgatggccgccgacacgccgagctacctgcccccgctggtcgacggcatggcagccatgggagcggccatggattgcagcttagaagatggccaaacagccgccgccatggccgccaccaatggctactaccagcatcatcagaagcatcagcagctggagattgagctggaggaggaggagcagaggcagctagggcatcatcatcatcagcatcaccatgagcatgagcatgaaaatcatcagtgggatgaagaagaagcacagcatctgctgatgtgggatcaagaagtactaacatcatccaacttggaggccatgcaaagtggtgctcattccctcctttttatgggaccaaatgaccatgattaagttggtaataataacctatgtctaccccccccccaattttttttctttttgggaaaaaaaaacttgcatgtgcatattttgcatctcacaacatctgatcccatctctgatctgatcttgatctccctttgatcaatctagctctcactactaccccatctgatctgtctatacatgaaataatgaggttttgcaaattaaaggcgcgcgtaatttattgtgttttggattttttttctatctctctccaagagcttttattttggtttttttacttttttttttggattggagtgtgaagactgaatagtgtgtgtcaattgggttttttgtaaagagaccaccttgtatgagtgcatggcatggcactttggagtgtgtaatttgattgatgtatctaagtgaatttataataaacacaggaggatgac

SEQ ID NO: 5152 - DNA, 1312 bp, Oryza sativa
  Predicted polypeptide sequence is orthologous to G2344, G929
gcttctcatctcatctccctctcctctcctctcgccgtcgccgtcgccgtcgccgccgctcgccgccggcggggatagagttcgccgggatcgcctcgccgggagagttccctcaccatcccgcacctccgctcgcctggcctcttcctcccggaagtgtggtgtgctgcaagctcctgtctctcctacaaggtttcaaaaccaaaatatgcctgaagcacacggaaagctggggtgattaacgtctgtttcttttgactacaatcatcctgattctgcttctgtctgcaaaaacaaccaagccatgacgtctgtagttcatgatgtttcaggcaaccatggagctgatgagcggcaaaaacagcaaaggcaaggtgaacctgaggaccagcaagaagcctcagttactagtacagatagccatacaatggtagcaacaccttcaacagattatgcgacaccctatgcccatcacgatatggcccatgcaatgggccaaattgcttacgcaaatattgatccatattacggaagcctttatgcagcttatggtggacagcctatgatgcatccaccattggtcgggatgcatccagctggactaccactgcctaccgatgcaattgaagagcctgtctatgttaatgcaaaacagtacaatgccatattaaggcgtcgacaatctcgagccaaagctgagtctgaaaagaagcttgtcaagggccgtaagccatatctccatgagtcacggcatcaacatgccctgaaaagggctaggggagctggaggccgatttcttaattcaaaatcggatgacaaggaagagcattctgattccagttccagagataaacaggatggagttgcaccccgtgatagtggccaaccgtctacctctccgtcttcaaagggtgcatcatcagctaaacaaaataagaagtcaaaaaccagtaactaaacgggatttaaacacctggtgtgaaacatggaaacagttttgtacagtacatgctagcgatcgacaaagaatggtgtcattgggtgttgtaggataatgctccatagagaatatatagacagggcaacagattttgcagcctttggttcggtctgctcagtttctttaccttcttgtacaatgagtagttttcgtcagttgtgctttgtcatggggatagctgaatttcttcaggaagtcttgtagttttaaagagttcattagcttgccaattgtttgctttggattggattggtctcttactgcctttgcatcatcatctgcagtgcacagaataaaacattggctatgtgt

SEQ ID NO: 5153 - DNA, 927 bp, Oryza sativa
  Predicted polypeptide sequence is orthologous to G2344, G929
atcttcgagagattcctcccaatcccgagcagaatcccccgccccggcgaatccgcgcggcgctcgagtgaatttgactagctagtagccacgcatgaagccagatggtgaaactcagcttcgtcctacagctgctggacatccagatcctggtttgggcacatcatctgcagaatacgtggcctctctaggaccagctacagctccagtatcttatccatatatcagtacctattatggaggcacttatggtgcttatagtggacaacctctggttaacgctgctttaatggcaatgcctccgcattctgtgcccttggtgaccgatgctgttgtagagcccatatatgtcaatgcaaggcagtatcatggtatattaaggcggcgccaatctcgtgcaaaagctgaatcagaaaataaggccaacaaaatccgcaagccttacctacatgagtcccgccatctgcatgctttgaaaagggcaagggggtccggtggtcgatttctcaactctaaggctgtggaggggaagcaagacactaaatctgtagataaaaaggatggagctgtgccatctgaggagaagagagacaagaagttggcaaatagcattatcaaattggagaactcgagcccaacaacacaaccaggtgcagatgcgtccgatgttgtatgatgcaaatttagccaatccctccctaatccaaccaaattgccagaatcgatcgaattgtgtgcttgctttctgttcgtgacagtttaagtctgtacatagctgttagttttgatgattggataaatccatgatagtatagtgaacatgttgtgggagcagttcagtgctagggtttgttgctgagtgtagattatgaaccttgtgtcactgttgtgttttgcttctgttaatgaatggtagcttacaatggg

SEQ ID NO: 5154 - DNA, 1195 bp, Oryza sativa
  Predicted polypeptide sequence is orthologous to G2371
acacaacacaccatcatcatcttcatctcctacctcctctcctctcctctcctcttctccactacccaacttttgctcccaacacatctttgtttcgatcgaccgatcgatcagctctagctcagccgctactcctacgtcaaggagaagcgcctcgacgccggcgacgtcgtccacttcgagcgcgtccgcggcctcggcgccgccgaccgcctcttcatcggctgcaggcgccgcggcgagagcgcgcccgcgccgccgcccgccgttcgcgtcacgccgcagccgcctgccctcaacggcggcgagcagcagccgtggagcccaatgtgttacagcacgtcgggctcgtcctacgaccctaccagccctgccaattcatatgcctaccatcgctccgtagaccaagatcacagcgacatactacacgcaggagagtcgcagagagaagcagacgccaagagcagcagcgcggcgtcggcgccgccgccgtcgaggcggctcaggctgttcggcgttaacctcgactgcggcccggagccggaggcggatcaggcgacggcaatgtacggctacatgcaccaccagagcccctacgccgcagtgtctacagtgccaaattactggggcagctagttgatgagatgatgaggagatctgaggcctttgcttgcagaatcctaaccaccaacagtgaaactagttactactaccaccagcctactactactacactctgaaccaagtgacaggttcgattgaattgacctgttggaagggaaaaaagaagaaggaagtggggggagatcccttgtttcccgggcaatcttccttccatgaatcatcagagtgccccttttcctgggttttttttacattcttgtcttccagaaaccctacttacagtacgggggcccttgcagcaggtggggaggtttcaggaaacatcaggttgaaaaggagagggaggagagagatggtgacacaccatgagaaacaaacaggagagagagagagagaggaaaaattgacatgttttgcaagtatgtatgtgtcatctgtagtatgtgactgtgagtgggtccatgaacaaactgtgaagttgatgtatccttctcctgctgcctcccctgaacctgaagaaacaaagtaataccccaatggggattttgttctcttccccttttcttctacc

SEQ ID NO: 5155 - DNA, 1642 bp, Oryza sativa
  Predicted polypeptide sequence is orthologous to G2371
gtctctacaccgcacaccatccctgctatccctctccagcactagcagcaaaagcttttgccacaaaagagaagtaagctagcagaaatggccatgaaccaccctctcttctcccaggagcaaccccagtcctggccatggggtgtggccatgtacgccaacttccactaccaccaccactacgagaaggagcacatgtttgagaagcccctgacgcccagtgacgtggggaagctgaaccggctggtgatccccaagcagcacgccgagaggtacttccccctcggcgccggcgacgccgccgacaagggcctgatcctgtcgttcgaggacgaggccggcgcgccgtggcggttcaggtactcctactggacgagcagccagagctacgtgctcaccaagggctggagccgctacgtcaaggagaagcgcctcgacgccggcgacgtcgtgcacttcgagagggtgcgcggctccttcggcgtcggcgaccgtctcttcatcggctgcaggcgccgcggcgacgccgccgccgcgcaaacacccgcaccgccgcccgccgtgcgcgtcgccccggctgcacagaacgccggcgagcagcagccgtggagcccaatgtgttacagcacgtcgggcggcggctcataccctaccagcccagccaactcctacgcctaccgccgcgcagcagatcatgatcacggggacatgcaccatgcagacgagtctccgcgcgacacggacagcccaagcttcagtgcaggctcggcgccatcgaggcggctcaggctgttcggcgtcaacctcgactgcgggccagagccggaggcagacaccacggcagcggcaacaatgtacggctacatgcaccagcagagctcctatgctgccatgtctgcagtacccagttactggggcaattcataagaagattgactatgagatctgatctgaggccatgcctgcatgatcataattcataagtcctagcaagcaacagtggaagaactagttgctactgctctgcattcagtgacaggtttaaattgtgacttgtggaaggacaaggaaggaagtgggggggaactcccttgtttcccgggcaaatgcatattccttccatccccatagtgccttttttctaggttattttcttcttcatcttggcttccagaaaccctacttactgtatgggcccctggcagcagacatggatggggaggtttcaggaaacatcaagttgaaaaggagaggggaattgaagagacaggcagagagctgtatgtatgtcagtatgtgtcatctgtctgtatagtgggtccaagaacaaaccctgaagctgatgtattcactcctgcctcctcaggaaacataactttatccccatttcacctcttctactgtgcttgacctgatgcaatcaattgttgatggaccagatgcaattatgcaatgcttccatttgttgcaatccaataggttcaccgattacactgtgtaagaaattaaggagtgcatgtgcaatttattccaactttttagaaatgacttacatggtaatttgtctgaataaatcactatgatgttaatagtatgactaaagaaaactcccgcaaacgacaagcagtaaagaaattacgtt

SEQ ID NO: 5156 - DNA, 237 bp, Oryza sativa
  Predicted polypeptide sequence is orthologous to G2371
atggcacatcagattttggttaatgaatcacaagcaagcaatgtagcaggtggcgctagcactggtacggcagtgaccagcggagacaggaggccagatccatacatgagtgcatgtgaagccatgatgggtatattcctcattgttgtctacaccaatgagatcctagcatttaacagtcgtcaaaggctagacagttttaaagaatctcaaaaatgtgttggtcatgatctataa

SEQ ID NO: 5157 - DNA, 2106 bp, Oryza sativa
  Predicted polypeptide sequence is orthologous to G2394
gggggagaagaaagcgtaagaaaaataaaaggagaaaaaggaatagagaaattggggaagagagctacctcgaatcgaagctgcgatctccacctggtgaaataggagaattgatgaattgctgagatttggtgattagagggacctttgctgctgaggcattgaggtacactaaaagcaagggtgtgaaaaaggcaacttcaattgaaaacatctacatatctaggaatgtcctgaaactaatgtgtggagtaaacttctagtttattgctgtccgtcctgttgggccacagtgcgaaggtcaggcagatagtcatccattactgatgggggactctggaaatgccagtcatcgtgatcacacgatcgacatactgagaaatgatgcaactttcccatcaacatctcatcaggataatcataataacttggatgagttgcaccaaactagagggcctctaaatgatgttcctcatgtcccagaaagttctgctagtgcaactcctgcatctatctcccgaaacgcttcttttgcaagaagagatcaaggacaccgtcaaccaaatcctttgaattctggcttctggatctcaattgagcttattgtaagtttaagccagattatagcagctattactgtcctgtcagtatcaaggaacgagcatcctcatgctcctttggctcagtggcttattggttatacgataggttgtgttgctactcttcctcacctttattggcgatttctccaccgcaatcggcagaacacagagcaagaatcaacaaatcaggtttcatctgaaagggacgtatatgagcctaattcttatgtagtagtttcgtctgctcatggatcagaagttgtggacagtggtaataatggtggagtagcaaggattgcaagtccaagggtctacgcattggttgcgtgcttcaaattggctctggattgtttctttgctgtgtggtttgttgttgggaatgtgtggatattcgggggccgtacttctctccatgacgctcctaacttgtacaggctgtgcatagtattccttgcattcggcttcatcggctatgccctgcctttcatcctatgtacaatgatatgctgctgcctaccctgcattatctccatgatgggcatccacgaggatttggattttaacagaggcgctactgcagaagcaatcgatgccttggtggcatacaagttccaatcgaaaaagtttcaagatggagaagcgggagaagataatggtggagtattggcagctggaacagacaaagagcgaactatttctgcagaagacgctgtatgctgcatctgcttgtcaaagttctcaaacaacgaagatctacgggagcttccctgcaatcatgttttccacttggaatgcgtcgataaatggctcaagataaacgcactgtgccctctttgcaaggctgacttaggcggctcgacgaatgctccggactcgagctccaggagcagccatgacagcaacaacagcagagtcaggaacgacgtcgagtcacaacagtagctgctctcatgccctttcccatgagcatggggatggaacacattcttgacaatctacaaattggcatgcaacttctcaagtcccttttttttcagacagacttgaatagagcatttgcctacactgctctctggtgttaacccagaaactcctatgaggctgaggctatggctatgagttgctgcctgcagtttgttctgaactgaagttgcctgtaaggctgtaacagattatagatggtgttggaatagttatcatgatgatcacctgagttgagcatattaggttgttgaggttaaccttcaaccggggaggttcaatgtaattatctccttgtttaggaaaaaatcccctcccctttgtatctgctcccttgtatagaaaacaaccatctccattgtatatcagatcaattttgcctgcattttgtaaattcagttagtaggcagagatctcccagcactcatcaagtgcttgagcaagtacagattagcagttgagtttattctactgtaatgcaacacttatagatgatattaccatgacataatcatttgagccc

SEQ ID NO: 5158 - DNA, 1869 bp, Oryza sativa
  Predicted polypeptide sequence is orthologous to G2394
gaggagtcaagtcgccgacttttggagttctcctcgccccagctcggtaaattccttcgctttttctccgctggttcggagatttccatgttcacttttgtttttttttttaattaagggctttgctttgatggaagggttgggtactggttccttccctccggatcaatcttgcttcttgcgctcacccaacctagtaattttttcctctcccgatttgtttaatgctaatctaggtggttgatgatgcttgcgagccaggcattgattcggctttaagcttgcctgcttgcttcgccgtcttgttctttgagttcttggttttcatggatccttgatccgatttaggggttgctgctgctagccgtggttggtgagacggttcttggagaagggggatttcttgaggtgcttttctgggaggtgtaaccaactaaattcctatgctaccttctggttgatggccgtccctcctgttgaatcagaaacaagaagtgaagaaacagataatttccctttacttgcagaccacatggaaaatactggacatcatgcacatgcagttgatatcccatgggattcttcaccatcgacatctcgccgagataatcataatggatttgatcaattacctcgtatcttagaaggttctcctgggacatctactccatctaactctcagaatggtcctctagcaagaagagatgataatcgtggtcgtcgtcagcctagtcccttgaattctggttgctggatctcagttgagctagttgtaaatgttagccagatcatagcagctatttgtgttctgtcagtatcaaggaatgagcatccacactctccgttatttgagtgggtcattggttatacagtaggttgtactgccacgctgcctcatctttactggcgctatctccatcgcaacctcccaaccactgggcaagagccaacagttcagaatatccctccaaacaacacccctgaagctaattcatatggagtaaccggcacaaatggagtctcaagaaacaatgaggcaacagtaaatccaaggttccaagcttttgctgatcacttcaaaatggctctggactgtttctttgctgtgtggttcgttgtgggaaatgtatgggtatttggtggacattcttctgctcacgacgcgcccaacttgtacaggttgtgtattgccttcctcacattcagctgcatcggctatgctatgcctttcatcctctgcgcattgatatgttgctgcctaccctgcataatctctatcttgggatttcgggaagatctaaaccaaaacagaggagctagtgcggaaacaatcaatgccttgggaacatgcaagttcaagtcaaagaaaactcgtgatggagatggaaacgaagttggtgtcggtgttgtggctgctggaacaaacaaggagcgagtcatttctgcagaagatgctgtctgctgcatctgcttggccagatatgtcgataacgatgatctccgagagctcccttgtgcgcacttcttccacaaggattgtgtggacaaatggctcaagataaacgcgctgtgccccctttgcaaggctgagatagatggtgtctccacaagtgctccagccattggctttgggcgtcgccacagcgacaacagggtaggaaacgacattgaatcacaactataactctcttcccacttcgttggcagcgtggatcacgcctttgatgaggccttccacacatcaacctgtaaattatagaggtagacatcaagatgtaaagggtcctcttacgatccaacaaagttcttttctgaatgactactgcctccactgtcagtatatattgcttccagcatttgtttcttctc

SEQ ID NO: 5159 - DNA, 2001 bp, Oryza sativa
  Predicted polypeptide sequence is orthologous to G2394
ggctttcgcgagagagggacacctgctctgcttccgcttccgcttccccctctcgagtctctcgcctctcccccgtggccaacccacacaccgcgggttggaggaggaggaggaggaggtaggggaaatccccgtcggccgtcggctcggcgccgaatcgatccgcttaggcttcttctgctgggctcttccatgaagcaaatgaagtttataatgcacatactaatgttcagtatattatactgagaatcaactttattctcagctgtatatacactagtatgccagccattggtagctacttgaaaggatggtgaaacgcatatgattacccatgatgagcatgtgtgttccctttttttattagtgctaagctggaaatcaataaatccaagatattcatggagcatgctacctgtgatgatgtgcatgagcatgctataaatgtatcacatggagaaactgcatcaacatcaaccagtcatcaagatttgcacagtgattcagatgattcacatcaggatgataggccttcaacaagcacacaaaccccatcaccacagtcttcagcatcaacttcgcccactgcatataacaccagaaatttatcctttcctagaagagatagtatgtatggtcatggaagaagtatttggaattctggtttgtggatctcgtttgaactggtcatatatgtagtacagattgtagctgctattttcgtccttgtcttttcaagagacgaacatccgcatgcccctttatttgcatggataattggttacacaattggctgcattgcaagcattcctcttatttgttggcgctgtgcccatcgaaacagaccttcggaacaagaacctgaacaaccacccgcagcctatcctaatttgacttcctctcaatcatcagaaggacgcaatcagcgtagcagtggtactgttttgcattttggatgtatcacaatttcgtgtccaaggcctagcatattggcttatcatttcaagacagctgtagactgtttctttgctgtatggtttgttgttggcaatgtgtggatttttggtgggcacagcactttgtcagattctcaggaagctcccaatatgtataggctatgcttagcattccttgcacttagttgtgttgggtatgctattcccttcgtcatgtgtgcagccatatgctgctgctttccatgcttaatttctcttctgcgccttcaagaggatttgggtcatactagaggagctactcaagaactaattgatgcactgccaacctacaaattcaagccaaaacgaagcaaaatgtgggttgaccatgcttcaagctcagagaatcttagcgagggtggcatcctgggcccaggaactaaaaaggaaaggattgtttcagctgaagatgctgtgtgctgcatctgtcttactaagtacggagatgatgatgagctccgtgagcttccttgcacccacttctttcatgtgcaatgtgtcgataaatggctcaagataaatgcagtgtgcccactctgcaagaccgagattgggggtgtggttcgatcattttttagcttgccctttggtcgccgacgtgttgataggatggcaggaagaggtatagctagctcgagattcactgtatagaacacgtcttcttctctagcatgtttgcttgtttcatctgctcatatgcacataaaagacgtgctcatggattgtagtttgttgatttgcaatgaaagcgataatctgctttcatcacccttgagttcaccaaagtgatgacagaaaagtggagacctgatgcttgcagtgacaagtttctgcagtacagtagaaacataagtatattctgatgtaacatttgatgtcaagattgtaaataaagagcacaaagttcacttcgggggtgtatatctgcatgtgtatgggaaaggaaagcctaattagttagtaactttgtaggcattttattgtgtgcaatcattgatcttgtttt

SEQ ID NO: 5160 - DNA, 1504 bp, Oryza sativa
  Predicted polypeptide sequence is orthologous to G2394
gtagaatcgtagataattcctgcactcagttttgagaaaactggaggtctcagaaatttagcagcttgcttctttctttgttgcatctaagaattgatgacctcagccttcaacgttacttgaaattcaaggtcataccgatatgcacgcttcgaggatggaacaaactacaggtgttagtggccatgagcacataattgatattccaagggacagtggtccatctacttcgacttcccatagtgttgctagagaaaaccatggagaaccaaatcctgttgatagatctgcaaccagagcgctagtacctgctttgcaggcaccatcagcagttggtgcacctatgttcgccggcacagaagccctttgaattctggactctggatttcaatagaagttcttgtcaatgtgagccaaattgtagctgctattgttgtgctttctctttcaagaaaggaacatccgcaagctccattatttgagtgggtcataggttatacagttggttgttttgctacactaccccatctttattggcgctatatacaccgcaatattgtcaatggtgaaaatgagccagcacatacacttcaaggctcctctcagaacaattcaactgagccttctgctagtgcatcagagcgtcgaaggaatgctgcacgaaatgcagtgctcgctaatccaaggattaatgctctttttgaccacttcaagatggccttggattgtttctttgctgtgtggtttgtcgtaggaaatgtgtggatatttggcgggcgttcttctgctgccgatgctccaaacttgtacaggttatgtattgtgttccttacctttagttgtattgggtatgccatgcctttcatcctctgtgcaatgatatgctgctgcctgccctgcatcatatctgttatgggatttagagaagatacaaacaatacaagaggggctacctcagaatccatcaattctcttccaacatacaaattcaaaaccaagaaacgccgtcatagttcaggaaatgaagctgaaggccaagatggtgggatagtagctgcagggactgacaaggagcggtcactatctgctgaggatgctgtttgttgcatctgtcttgcaaagtatgcacacaatgatgagcttcgtgaacttccctgcacacattgtttccacaaggaatgtgttgataaatggctgaagattaatgcactttgcccattgtgcaaatctgagatagcgagctcatctggaacatctgatactcgtcgctctgaccacacagatattcctgtgcaggagattgaaatgcattagggtgatctgctttctgaggtaatacggcagaatacagttacttgtggtgaccgtgtgcttgtataaagttcaagctttgatatgtggattgtaatgatgcatggggttatttttgttgctgttattttggagaagacagttctcactgtcaacatacacgaggaaatatacaatatctactcgttccatc

SEQ ID NO: 5161 - DNA, 1326 bp, Oryza sativa
  Predicted polypeptide sequence is orthologous to G241
gcagtcgcgtctcacccccatttgccgcacgttgcccaactcctcctcctcctcgtcatcgtctccgttccgatccgcgcccataaatacgcgccaccccgcccccaacctcgccgtccttgtcccccccaagaaccccccgtgcgccaccaccaccaccaccaccaccaccaccaccaccgaggaattctcgctgtcgccgccgccgacgacgacgaggagaaggagtatcgctcacaatcttccgggccgatggggagggcgccgtgctgcgagaaggaggggctgaggagaggggcgtggagccccgaggaggacgaccgcctcgtcgcctacatccgccgccacggccaccccaactggcgcgcgctccccaagcaagccgggcttctccgctgcgggaagagctgcaggctgcggtggatcaactacctccggccggacatcaagcgggggaacttcaccgccgacgaggaggacctcatcgtccgcctccacaactccctcggcaacaggtggtcagccatcgccgcccagatgccgggtcgcactgacaacgagatcaagaacgtgtggcacactcacctcaagaagaggctggacgacgaacggaagctcgccgccgccggcggtggcggtggccgccggccgcatacgcgcaagcagcccaaggcggcaaagagcgccgccgccgtcaagcgcgaggcgacgccgtccgtcagcgtcgacaccagtagcggcgtgacgtgctccacggtgaccgagtcgtcgccgtcgtcggccgacggcgaccaccggcggcagcagcagcaaacgcagcatgccgctgtcaaggaggagagcttcagctcgggcggcgagctgccggcggcggcggcggcgcccacggcagcggccgacatggacgagagcttctggtcgtcgacggaggtgaccgggatgatggccggcctcggcgacatggacgaggagctggccatcgccggcacgtcgtcggcggcggcggcgaggagcgacgacatggagttctggctcaagatgctcctcgagtccggcgacatgagggatttggccgtcttgtaatctatttaatttaatcatggcagaattaagcttgattaaattaattaactaccgggaagaattgatagtatctcttctctgttgtttttttttaccttcttttttcatcttttttttcccagtttccagtgagaaaacgatgggaaattcaggtgatattttcacctttgttagaaaaaggaatactgtagtagtagcaaaaatttctttggttcgttatcagctggcttcagaattagatgc

SEQ ID NO: 5162 - DNA, 1038 bp, Oryza sativa; identical to SEQ ID NO: 2421
  Predicted polypeptide sequence is orthologous to G241

SEQ ID NO: 5163 - DNA, 1836 bp, Oryza sativa
  Predicted polypeptide sequence is orthologous to G241
gactctgcagcctcggagcagccgcctcccttccaagaacacacaacgcaagaggagcagagcagttcagatcagagcagggaaggagcaagcacaatggggagggctccgtgctgcgagaagatggggctcaagaagggtccatggacgccggaggaggacaaggtcctcgtcgcccacatccagcgccacggccacggcaactggcgcgccctgcccaagcaagccggtgagtgacagcggctcgtgttcggttcaggtcgtgtacctttggcggcgccggtgaagcaaagctaaaatgggttttgatgtcgcagggctgctgcgttgcggcaagagctgccggctccggtggatcaactacctgcggccggacatcaagcggggcaacttctccaaggaggaggaggacaccatcatccatctccacgagctgcttggcaacaggtacacacgctgctctgctcctccttaattgcagacttatctgatctgatccccccaaatttcgctgctcctggtttggagcaatgattgttgcttgcttatgtgcttcaaatgctatgagagggaggtttattccttttttatttatttagttattattagttatttattaccattgtggaggggcatatactgatatgttatcctcctgggccacctgctctcgatgcaaatagagagaaaatatattgctagtcgtaggccacttttctgtagctaattacatcactgatgatgcgcgagatgtgctaaaagattccatcttgtttggctcttccggtgaccccccttgaattcagcgctgcaaaaacatgcgctttgcattaaacaaccgcatgtgatcccgacgagggaatcaaatcacgcgatgatagcaaagctctaaatcaaaatgaagtcatctgaaatagccaaacaattttttttttttgacaaaatgaaacatgaacttgggcactgatccgctctgaattctgtgctacgcaggtggtccgcaattgccgccaggttgcccgggaggacggacaacgagatcaagaacgtgtggcacacccacctcaagaagcgcctcgatgcgccggctcagggcggtcatgtcgcggcgagcggcggcaagaagcacaagaagccgaagagcgcgaagaagccagccgccgccgccgccgcgccgccggcgtcgcccgagcggtccgcctcgtcgtcggtgacggagtcctcgatggcctcgtcggtggcggaggagcacggcaacgccgggatcagctcggcgtccgcgtccgtgtgcgccaaggaggagagctccttcacctcggcttccgaggagttccagatcgacgacagcttctggtcggagacgctgtcgatgccgctggacgggtacgacgtgtccatggagcccggcgacgcgttcgtcgcgccgccatccgccgacgacatggactactggctcggagtgttcatggagtccggcgaagcgcaagacttgccgcagatctagagaaagagagagaattttaccgtttcttcggttaattgatttgttttttctctctctgccgccatcttgcaccggagggacatagctaacagacaagagtgtccatgagcgaatcatcaagcaggaagaacgcgaatcatgcgatgcgatgcgatgagatgcacccagtagctttgatagttaattttctttttttacctccttcctgtatgtatagaaacagaagagatcagtgatcgaaacctgagatcctttctcacaatgtgcaaactggatcatcagaaaacgggctctgcgtttctcatttgattaattaaattcaacttgcacgc

SEQ ID NO: 5164 - DNA, 1496 bp, Oryza sativa
  Predicted polypeptide sequence is orthologous to G2457
gacatgagccacaagaaataaaagcacttgctagctatgcactgtagcagcattgccgctttgctttgcttgcttgcccccacacgctctctctctctctcactagctaattagctgctactacatcttccatctctctcctctctctctctctctagaaataaggaaggagagaaagagaaagagagagaaaaccagaaaagaggaaagtgagatagctcaatttctccttccttcctctctccatctaatctacacatgcacaaatgttgcagctgatatatggcttagctagcatatgcaaagcaagccttcctgcagtctagtcacctctcaagctacatactcccagtactgcttcatctagctctctctagtagctagctctatcatcatcgatcatcctcctctcaccggccggccaacccaagaagagattattcctcttcatcttcttcttcctctctgttcatcactggcttcggcggcggcggccgcggcggcgatcgatcagctgtgagaagaagaagaagaagaagaagaagaaatgtctgcccagatcgctccggcagagcaagtgtgctatgtgcactgcaacttctgcaacacgattctcgcggtgagtgtcccaggaaacagcatgctgaacatcgtgaccgtccggtgtgggcactgcacgaatctgctgtcagtgaacttgagaggactgatgcactcagccccagcactacaagatcatcatcatcatcatctccaggagagtggtctgagcggatgcttccgtgatcaaagtggctatccggagtttggtttttctgcagcttcgtcgtcttccaagctcaggctgcctcctgctgctgctgccatggtttcctactcgcagcaaaaccagcagctcgagcaagctctccatgctcgccctccagagaagaggcaaagggtaccttcagcctataacagatttattaaggaagagatacgaaggatcaaagcaaacagccccgacattagccacagggaagccttcagcacagcagccaagaattgggcacattatccaaacatccattttggcctaagccctggccatgagggtggcaagaagctcgtcgacgtcgaccccatcccaactgctccatcttccaagaagatccaaggtttctactcatagattgaggggatcaatctgccgataccgataccgcaaataggaggaagagcatcaagagcacaaaacatatatatactgtgagtaaagaagcaaaggaaaaaagaaaagaaatgctgccaccttacctttgttcatgaccaaaaaacttgtgaagacgtatgtcataagtacatagaagaaatcaactcatatagagtgaaaaaaaacatacaaaaaatcaagctactatagctcatcgatcgactgaaaggctgaataaaccattcgaccataatgttgttacatgtataagtatgtttgaagctagctagctggctagttcttt

SEQ ID NO: 5165 - DNA, 1257 bp, Oryza sativa
  Predicted polypeptide sequence is orthologous to G2457
tcccgtttgcaccaccaccaatctctctctctctctaagatctctatctatctaaagatctgagctacaattaattaaaacctgataagaagaagaccctgagctcaatcccttcttattatactatatatatacttctgtatttgtgcacagtgttggtacaggtatctgcagacagccatatctatctttctagctaattggcaatatgcctgaagtccactgctcgtcctaagatttacttctccacccccccccctctcctttgcttcttcttcttcatcatcatcttcttcctcctcctgttaattaagttcttgatttctaagctagcaattgagcacacatcgatcgcgagagacgcagcggcgcccgtctaccgcggggctagaggaatgtcggcacagatcgtgccggcgccggagcatgtgtgctacgtgcactgcaacttctgcaacacaattttcgcggtcagtgttccaagcaatagcatgctaaacatcgtgaccgtccgttgtggccattgcactagcctgttgtcagtgaacttgcgaggattggtccaagcactcccagcagaagatcatttacaggacaatttgaagatgcacaatatgagcttccgcgaaaactactctgaatatggctcatcttccagatatggccgagtgccaatgatgttctcaaaaaatgacacagagcatatgctgcacgtgcgacctccagagaagaggcagcgggttccttcagcttataacagatttatcaaggaagagatccgggggataaaagcaaacaatcctgacataagccacagagaagccttcagtactgcagcaaagaattgggcgcatttcccgaacatccatttcgggttaggctcccatgagagcagcaagaagctcgatgaggccattggagctcctagtccccaaaaggttcaaaggctgtattgatcgagtacacatgatgatcgatggatcctacgtgcttgttgatctcatgttgtaagtaacttaattaagaaaaaaagtctacgcttatttatttcttaagtatcatcagttaaatttgtgagcgagtatatagatgagttgtcatgatcagtgagtgatcgtatgcatgcagtgctgagaattaaaggtgtatatgcatgagtaacgttacatgcagctagtgtcgacgcacgtatgacagactgaataaactcttcaccatgttgtttttttatgtttgaaatgaattaattaattgtcc

SEQ ID NO: 5166 - DNA, 1037 bp, Oryza sativa
  Predicted polypeptide sequence is orthologous to G2457
ccccgcaccaccgctcacacttgctcctcctcctcctcctcctccgcctcagtgctagggctagcttgcttgtcgccgtcgccgccgtcgtcgccgccgcaatggatctcgtgtcgccgtccgagcacctgtgctacgtgcgctgcacctactgcaacaccgtgctcgcggttggagtcccatgcaagaggctgatggacaccgtgaccgtgaaatgtggccactgcaacaacctctccttcctcagcccgcggccgccgatggtgcagccgctctccccaactgatcaccccttgggcccgtttcagggaccttgcactgactgcaggaggaaccagccgctgccgctggtctcgccgacatcaaatgagggtagcccaagagcacccttcgttgtgaagcccccagagaagaaacaccgcctcccatctgcttacaaccgcttcatgagggaggaaatacagcgtatcaaagctgccaagccagatatccctcacagggaggccttcagcatggctgccaagaactgggcgaagtgcgacccccgctgctcatcgacggtttccacctccaacagcaaccccgagcccagagtagtagctgctcccattcctcatcaggagagggccaacgagcaggtggtcgagagcttcgacatcttcaagcagatggagcgcagcggctagggcggcggcggcggccggagccggcggcgatctatatcggcggtgaagctcgtatgaagctagctagcctgcaggccggccactggggagagtaccaaatttcagatcccccttattatcaccgtcgtcagctcagctcatgcatgcatgctcatcgttcccctttagcatatatctgtgctcgttttgtgtttattagttaattatgtttgatcttgttaatttgttgttgcatggagtatgtaccccctataagacccagctgctgctaccgtacgatatacgtacgtatgctatatatatatatatatatatatatatatttgtcatctaaaaaaaaaaaaaaaaaaa

SEQ ID NO: 5167 - DNA, 1425 bp, Oryza sativa
  Predicted polypeptide sequence is orthologous to G2535, G961
tcgtccatccttctcccaatcaagcatccatccatcctccccaactatatataaaccccacacctttccctcgccaccgccctcgatcgtcttcttcctcctcctctcaatctcttcttccttctcctgcagccgccatttctagctagctatacgatcgatctatacatatatatcagaaggaaggaagaggctaattaagctagctgttgctagagctagcaagagcgaggagattgagcagctaggtaggtagcaagaaggagaagaagaagaagatcatcaatgagcatctcggtgaacgggcagtcgtgcgtgccgccggggttccggttccacccgacggaggaggagctgctcaactactacctccgcaagaaggtcgcctccgagcagatcgacctcgacgtcatccgcgacgtcgacctcaacaagctcgagccatgggacatccaagagaggtgtaagattgggtcagggccgcagaacgactggtacttcttcagccacaaggacaagaagtacccgacggggacgaggacgaacagggcgacggcggccgggttctggaaggccaccggccgcgacaaggccatctacaacgccgtccaccgcattggcatgcgcaagacgctcgtcttctacaagggccgcgccccccacggccagaagtccgactggatcatgcacgagtaccgcctcgacgaccccgccaccgacaccgccgccgccacacccacggttacttctgctgctgctgcggcggcggcgatggcggcggcggcggacggcgggcaggaggatggctgggtggtgtgcagggtgttcaagaagaagcaccaccacaaggaggccggcggcggcggcggcaagcacggcggcgacggcagcgccggcgccaaggcggcgcacgcttactcctccagcgacgacgcgctcgaccagatcctgcagtacatgggcaggtcgtgcaagcaggagcacgagctccccccgccgccgaccacctgctgctccaccaccaccaccgcacggactgggccatgatggaccgcctcgtcgcgtcgcacctcaacggcgccaactccgacgcgcccgacgaccagctctgcttcgacgccgccgacgacgacggcctcgcctactactccgccgccgccacgaggctgctcggcggtgccaacgccggcaccgacgacgacctgtggagcttcgcgcggtcggctgcgccgccaccgccgccgccgccgccgtcgtcggccacgccagagcgtctcagccacgtggcactgtaacacatgattcgtagctgtacgtacacgtacacgtatacgtacacgtcaggctacgtacgctcgagctgccaccctagctgctagtacagtaattacagagacaagacaagtaagaagaaaattgtaagtg

SEQ ID NO: 5168 - DNA, 1774 bp, Oryza sativa
  Predicted polypeptide sequence is orthologous to G2535, G961
cctgtttggtttgcactgagtgaacaagcaattaagcttggtagtagtagtagttgttgtattgatcgatcgatcgatctagagacgacgatgagcatatcggtgaacgggcagtcggtggtgccaccggggttccggttccacccaacggaggaggagctcctgacatactacctgaagaagaaggtggcctcggagcgcatcgacctcgacgtcatctgcgacgtcgacctcaacaagctcgagccatgggacatccaagagaggtgcaggattgggtcagggccgcaaaacgactggtacttcttcagccacaaggacaagaagtacccgacggggacgaggacgaaccgggcaacggcggccggcttctggaaggccaccggccgcgacaaggccatctactccagctccaaccgcatcggcatgcgcaaaaccctcgtcttctacaagggccgtgccccccacggccagaaatcagactggatcatgcacgagtaccgcctcgacgacccctcctccgcctccgcctccgtctccgtcaacctcccctcctactactcttcctcctcatcgtcatcttccccaatgcacggtgtcgccggagaccaaggagctcaggaggaaggctgggtgatctgcagggtgttcaagaagaagaacctcgtgcaccacggcggcggcgccgccgcggcgagccaccacgcggcggccaagctcgcggcggcggccatggagggcagcccgagcaactgctcgacggtgaccgttagcgaccacgtcaaggcgcagatgctgcactcgtccgccagcgacgacgccctcgaccacatcctccagtacatgggccgctccggctgcaagcaggagaccaagccggcggcgatgtcggcgtcgtcggcggcagcggcggcggcgctggagcagcacctcagtacgcctcagtacggcaagttcatgaagcttccgccgctcgagcacgtcgccggcggcgtgggcctcctggcggcggccggcggcggcggcgagtactgctccgccgccgacgcgtcggggatcgccgactgggacacgctggtccggctcgcggcgtcgtacgagctcaacggcgccctctccgacgtcgcctccggcaagaacatggccggcttcttcgacgtcgtcgatcagcccgccggcgccgccgccttctcctccggcgacggcgacctgtggagccttgcgcggtcggtgtcatcgtcgctacacgcagacttgacgaccatgaataacgtataataattggagacaagaggtgacgatggagatgatgcatctagacgtggatggcgtatgcgtgcactaactctactcttaatctggtcggtctacgcatattgcatgcatgcatggacgacggtattgtacgtacgtgatcaataattaattactagttagggttccagcgagagtacaagacgacgacgacgacacaatagctagctgagctggccatgtgagcaagctctagacactaggtcaagatctaaccgtcgatcgatctgagccgttgatcgatcgatcgacgatgatggtgttgatcgatcgaattatagtgcagtggtcgagcgagttgttgtgtcgatctgaaacaagagagaggaaaaaaagaattaaaaggacgtacggcgtggtaggagagagagagagagagcatatataaatattatgtatctatatattgttatatattgtacctatagcttattatatatcaaagacatttttctagtgc

SEQ ID NO: 5169 - DNA, 1176 bp, Oryza sativa
  Predicted polypeptide sequence is orthologous to G255, G664
ccgccgcggctcacctggaaactgggcagattggacaatcgctcgagcgagctagcgagagagagcgcgagagagcgaggcggcgcgcgcggtggttgcggatttgtagcttagagcgcggggccatggggaggtcgccgtgctgcgagaaggcgcacacgaacaagggggcgtggacgaaggaggaggaccagcggctcatcgcgtacatcagggcgcatggcgaaggctgctggcgctcgctgcccaaggcggcgggcctccttcgctgcggcaagagctgccgcctccggtggatgaactacctccgccccgacctcaagcgcggcaacttcaccgacgacgaggacgagctcatcatccgcctccacagcctcctcggcaacaagtggtctctgatcgccgggcagctgccggggaggacggacaacgagatcaagaactactggaacacgcacatcaagcgcaagctcctcgcccgcggcatcgacccgcagacgcaccgcccgctgctcagcggcggtgacggcatcgcggcgagcaacaagcggcaccaccgccgccgcatcccatatccgtcccggcgaaggcggcggccgcggcgatcttcgccgtgcgaagccgccgccgccgccgcgcccggtcgactcctcggacgacggctgccgcagcagcagcggcacaacgagcacgggggagccgcggtgccccgacctcaacctcgagctctcggtcgggccgacgccgagctcgccgccggcggagacgcccaccagcgcgcggccggtctgcctctgctaccacctcggcttccgcggcggggaggcgtgcagctgtcaggctgacagcaagggcccacacgagtttagatatttcaggccgttggaacaaggccagtacatatgagatatgaccatgagatgtgagatggcttaattagcttcaattcccaacatgtgtaacacagggagtttttctagtggacgacaatactgtttaatttcagaaaaaaaagggaaagaaaaaggttctaatctgttcatatttcttactattatccaatcttcatgatctcaatctctctctctctttattatttttctttgtagtaattaacttcatgttggttcctctaaaaaagattggtcgatgttattcagtgataaatattcctag

SEQ ID NO: 5170 - DNA, 1069 bp, Oryza sativa
  Predicted polypeptide sequence is orthologous to G255, G664
cgccatggcgccaccatgcatataaactcgagctccctctcctcctcttcttcctcctctccactctccaccatcgtcttcgtcgtcgtcttcctcagctcggagcgatggggaggtcgccgtgctgcgagaaggcgcacacgaacaagggcgcgtggaccaaggaggaggaccagcgcctcatcgcccacatcaaccagcacggcgagggctgctggaggtcgctccccaaggccgccgggttgctgcgttgcgggaagagctgccgcctccggtggatcaactacctccgccccgacctcaagcgcggcaacttcaccgacgaggaagacgagctcatcatcaagctccacgagctcctcggcaacaagtggtcgctgatcgccgggaggctgccggggaggacggacaacgagatcaagaactactggaacacccacatcaagcgcaagctcctcgcccgcggcctcgacccgttacgcaccgcccgctcaatgccgccgccgccgtcgccggccaccaccacctcgcgccggcggctccagctgctcgcccgacgcaacaagcggccacagcagctgcagcgacggcgacgagtaccgcggcggcatcgacctcaacctgtccataagcccgccgtcgtcgtcgtcccagccgtcttccccgccgccgccgccgcacgaagcagaggcgagacgcgccggagcgacggcgagctacacctaccaccaccactactcggagacgagggagaagatatgcctgtgcttgaaccacctcgggctgcacggcggcgacgagtgcagctgcggcggctcgtcggcctcttcctcctcctcgccgccgccggcgacggcgagctcgcgagcgttcacattcgccaatgcatcgtcgtcaacagtgtaaaacacagagaaattcagcgattttcagactaagagaattaatgagaggtagagcacatgcatgctgaattaattgaattaactcaatccaagcttgagctaggcatctagctaactttgtgatttgatcatgatcagctagcaaaatcatcataatcatcatc

SEQ ID NO: 5171 - DNA, 600 bp, Oryza sativa
  Predicted polypeptide sequence is orthologous to G255, G664
gccaacgcgaagctctcgtcgcgcacaaccaactcgacaccgcggcgaggccaaccaacgcgcggcgtgggcatggggaggtcgccatgctgcgagaaggcgcacacgaacaagggggcgtggacgaaggaggaggaccagcggctgatcgcctacatcaaggcgcacggcgagggttgctggcggtcgctgcccaaggcggcggggctcctccgctgcggcaagagctgccgcctccgctggatgaactacctccgccccgacctcaagcgcggcaacttcaccgacgacgacgacgagctcatcatcaagctccacgcccttctcggcaacaagtggtcgttgattgcggggcagctgccgggaggacggacacgagatcaagaactactggaacacgcacatcaagcgcaagctctgagccggggcattgacccgcagacgcaccggccggtcacgccggaacacgcccccccgggaaaacgggcttacacgacggcaacaccgcgcttttcgtccttggcccggggccgccgccgaagaagacaggctaaaacccgggcacgcccgggggccaacattgcagctttccaggtccgg

SEQ ID NO: 5172 - DNA, 1054 bp, Oryza sativa
  Predicted polypeptide sequence is orthologous to G255, G664
aacagcagcagcagcagcagcagcaacttccactgaaacaacccaccgaggcagcagaagaaaggaaagaatcaagaaagcttcatcgtcttcatggggaggtcaccgtgctgcgagaaggcacacaccaacaagggagcatggaccaaggaggaagatgaccggctcattgcctacatcaaggcgcacggcgaaggttgctggcgatcgctgcccaaggccgccggcctcctccgctgtggcaagagctgccgcctccggtggatcaactacctccggcctgacctcaagcgcggcaacttcaccgaggaggaggatgagctgatcatcaagcttcacagccttttaggcaacaaatggtctctgatagccgggaggttgccaggaagaacggacaacgagatcaagaactactggaacacgcacatcaggaggaagctgctgagccgtggcatcgacccggtgacacaccggccgatcaacgacagcgcgtccaacatcaccatatcattcgaggcggccgcggcggcggcgagggacgacaaggccgccgtgttccggcgagaggaccatcctcatcagccgaaggcggtgacagtggcacaggagcagcaggcagccgccgattggggccatgggaagccactcaagtgccctgacctcaatctggacctctgcatcagcctcccttcccaagaagagcccatgatgatgaagccggtgaagagggagaccggcgtctgcttcagctgcagcctggggctccccaagagcacagactgcaagtgcagcagcttcctgggactcaggacagccatgctcgacttcagaagcttggaaatgaaatgagcacctcctcctctgtagtttcttctttcgttttgtcacttggatattggttagcttttcttctaggtgaaaacacacagagagagagagagagagagagagagagagagataacatctcctctgctgctcttgctgctccattttgtctctgttgtaattaccatatattgactaatcatgacaaataatacttgatgctaagt

SEQ ID NO: 5173 - DNA, 1037 bp, Oryza sativa; identical to SEQ ID NO: 1949
  Predicted polypeptide sequence is orthologous to G255, G664

SEQ ID NO: 5174 - DNA, 2930 bp, Oryza sativa
  Predicted polypeptide sequence is orthologous to G255, G664
attttcaaaatctctcggggggcaatggagctcaccgccgccaccgcgggagcgacccgtgccaccggaggattcctcgggaccagccgtcgccggccgcaatcgtgggcttttcagttctgcagggatatacatcagcactgctcaaatgaagcatcaatgcgtaccacagatagattagaagtacatatataaaagagattactgttggctggagcaaatgcatctgtgtgatacgatagtggtaaggcactctggttcaggatgacctgagcagttagcatcttttggacacacctctttagaaaacacaacctctcccagaatctgagtttcctgcttctgctgtacagtatttatcttcatcaaatatttgagaaatattgtcctagcaaggtagcacccgtgatgcaatggcaaagattcatagaagcttccaatccatatcgagcctaccatatcttcaagcttttatcataccagagtggcttggtcactatgacctggtgtttgcgcgtcttgtagtccctgtggtttcctttttcaaggtacatcaaaattaaaggaatggtaatcaatagatttgtcaaagaccatgactttggaaagtttatggtacttggacgagcaccttcagatgctcctgcaaggttatatatgcttgcacgcatgtggtgatacttcctttccatacccccaggcatgcaccatgcttcgtacattttctgaagactccaacactcctacataaccagctcagttcctctatcatcttacgtctgcatagagaggcttacactacacctggaaacaaatgaggatggccggcatggaggcttacttgttgcctagaagctcatggagcttgatgatgaactcgtcctcctcctcggtgaaattacctcgcttgaggtccggtctcaggtagttgatccatcgcagccggcagcttttcccgcaccgcagcaaccctacacacaggaagggacacgagctagcccaaggttttcaattggtccaagggattgctgttgcttgatggaagaaaaagtctgagttggaaacaaacttcaatggctcaacacccacttccacgttagtagattttttggggcacacatcagcagcacatggcgatgcttaatgggctcacccaccgacatttttctagcaccccacgctagctccccctcctttctgagattctagaaaacccagcagcatgtctttgtgtgtgtgattgtgcaagaaagaaagcaaagaaagggaaagggtgaagcaagaaaggggagaatctgatcaatttggtgagctaccccctccttccttcccgctcctaattcccctccctcttgatatggaggaagttgtgcacttgtttaacccgttactttattcttggttggtgtacatgttgtaaggttagggtaggccgagtattccatgtactcatgcttgctgcatcggaattcacacatccagctgttgcgacaacagtatcatcacgagtgtattacgtcaattttatggctattttgtttgttgtttggttaagtttgtatagtgaaatggtcatgatggtggcaggactgttcgaactagtcttgctgcaatatttgaattctaaagaggaaggttccttttttttaaaaaaaaaacccgaatatagaggaaggttggactgtttccatttccatgaggacatcctggagtcttgagtcttgagaggacaaaatacaggtaatcctagtagagtaagctcagctgttcatgttcaaacaaaagaaatattttaatggtttaatctccaacgagtatccttaagaattgtaaactcattcggggtttggtggtgacattgattacagtgctaaagaatatttttcgtggtactccggtccagtcagctgccccccttttggtgccatgaaacctcactctttgcattctttctgttgcatgagtccaaagataataccaccagatctactacagttaaaagtgcttatctgctccatcaaaaagagaactagtactacaagcatggtatccaaagcgatcaattgagacaataacaatcctgaaagattgttttcatagcagataagaaatgctccaaaacatgatgcagatctactgatgagaagaagaggaggcaaggcaaattgatggagattggagaggaggtgtatggagctgtggatgtagacctggtgtactcatggggcattcctaggaagggaagggaagccaagagaaggaaagggaagagaagagatgcagcaggcagcaggcagcagcagcagcaatggtggtgtaataataaaggtgtgtcaatgaatgagatgagatgctgctgagctactaccctccctccatgcaccttgggccaaatccaacaagagaaagaataacctgaaggaacgacttggccattcactcgttcaggccggtcaatgcagcatcacattaacaagacgaggcaacagtaacaaaagagcagttggtgcacaacttttcaagcgatgtccccattccaccggaaagttttccctagcggacacaacaaaagacaaacatttactctgccccttttttcctcttcgttgtcagacacgtcaccagtgaaaattaaattataaacatcgaaccttgttgttcatgcatggtacagtatggaggtgagtcaagagatggactagccgtagagactgtaggagaaaaaggaagaacagtgattgggaccaagatgactcgttcacccttatatttaattaatcagcaccgtttcttttatgaatcatgatgtaatggcgtcattagctacccttatttacccgccaggaatcgtgcacgcacatgtaagcgaggagggaatttgtggtactacactactactttgttcaatggaaaaagcttttattcgaatg

SEQ ID NO: 5175 - DNA, 455 bp, Oryza sativa
  misc_feature (346)..(346): n is a, c, g, or t
  Predicted polypeptide sequence is orthologous to G2574
aattatgattagatgaacgatgggtgtcagtggcggaaatacgggcagaaaatctcaaaggggaacccttgcccgcgcgcctattaccgttgcaccgttgcacccaactgccctgtacgcaagcaggtacgtatatacgcgtataaatacgtatttacgtttacaaatacgtatatgattcgaatgatgcgtacttaaattgaagcgaaaatttaaatttgtgttggttttgtgttaatcgatggatcaggtgcagagatgcgcggacgacatgtcgatcctgatcacgacgtacgagggcacgcacagccacccgctgccgccggcgggggggcggaatggcgtncacaacgtcggccgcggcggcgatgctgacgtcttggctcgaccaactccacgatgcaccggcagcggcggcgttcaccacaactgccgttcgcctcggccgttggggg

SEQ ID NO: 5176 - DNA, 1383 bp, Oryza sativa
  Predicted polypeptide sequence is orthologous to G2574
gctctctccatgcccaggcgagggagtccgccgcctcgcctcctcacgcgagccactgctgtcgccgcaccatcgtactgtcgtcgccatcctcctctcgctccggtcgatgcatccgccaacgaggaggccgggaccgtcggatccggtgaccccggcctcctcgtcggcggaggggagaccgactgtcaccctctctactcttctccttctacgtccggcaccgctacaacgacggccgcgcggatcgcgtgaggcaacgggtggctgctccctactcttctccctctccctctccattctcttcctttgcagatcggcggaggcttgcaacaacaacaacggctgcgtgggtgagcaatcgaggaggccaggaatcaccagatccggaaggacggcggcccggttcggagagggagcatcccgatctgtggcattgaggcccattgtaagtgtcgatggcggtcgttccttcacagtgatccagggccgctgggtctattgagctcggtatcgacggcagcagcagctcgggcaagatggaagaaatgtgtcagacactgcctcctccgagagcatacaccagcgacgaggccaaagtcgatcttccgcaaccccgtctggcattataacttaatcacttcagcttcagcttgcttggagcacgccggcgcagggtttcctcgacgggtcttggctctgccgtgccctcctcgcgccgccctttcatactgacagttgttcgaggttgcctcccccgctcatggcgacctccacctcagttggagttgggaagctcctttcccgacgtccccacaacacggtgaccttggcctcaacccggtgctgctacgctcagctcaacgattgctcaaactacaatgggcaataacaatattgcatttgagggcctcatttttggttgccctcacctgagcatatgtaggatacagcctgtgatgatgccgttagtacagagttgttccctctctcagcctcccaccatcttctcctgtctctctctgagcatcacctccattgctgtcaaggtgatgtttgagctcaatcggtcaaagaaggttgaatatgtaaataatttgccaacatgattttctcatattgggtggtttagtaagttaacacttaataccaatcacttcatttcagcttctcactaacaagcagccaaggtctcttcacggattattgtccatggatggccaagcttttcagcaaaatgaaaaggtgaaatataatgaaatattattcccttgctccataaagcttcagatgtggagtgagcttgctgctctgcaagctgacattccatttttaaatgtagagtgtgcttgaattaatcaaagaagcagatttatatacatc

SEQ ID NO: 5177 - DNA, 600 bp, Oryza sativa
  Predicted polypeptide sequence is orthologous to G2574
atgaaacttttgaagagaatggattacccggccaggcggtcaagcgaagaaagaaaaagttctgctgtcgaggttggcggcgaaagaggtgcgccgccgcccagcagcggcggctctgtcgtctcgcggaggggacgttgtggccccatgcacggcagcgacgcgcgcggctgcagccggcgtccggcggcaacgccgggcatgcacgagagacatcagccatcaagttgggccaaagctcgtgcggtggcgcatcccagatgcgagcgaagacagaggaaggtcgtgggcgtatcgctggcgtatcttgatttatttatttttttgcaaatcacaaatatgtgggatacgtacgggatacgtattggagcgtatccgatacgtatccgtatccgttgccgtatccgacacggatacgtgactatacaagcatatcaggatgggacaggcggcatcgcacccacgtcctaccctgtgtcaggcggcgtggggcaaggcgaaggacgacgctggggcccacctgaggacgagcggccaccttactttcggcctaaggcatgggcggtagctcgacccaggttgatgtgggcccctctctag

SEQ ID NO: 5178 - DNA, 483 bp, Oryza sativa
  misc_feature (297)..(297): n is a, c, g, or t
  Predicted polypeptide sequence is orthologous to G2574
ttttttttttttttttttgtcctttgaatcttatcgatctttaccgaagtggacatcccaggaccacaaaacccacagcatcttcagaacattcgacgaattcatgacatgttacactgagtatgaatcacacaaaactcttgactaacttataccggtaccttcccactcttataaccataacgagaaccagcacttaaggcggaactcccgacttcggtagtaagaattcttaatttggccaaaaggccaagtcccccactaatggaccaaaggggaatcaccaaatatacttgngctggaattctctcgatttattccaatcttcccgaggcggtccttaggtccgacgccctttggtaccctgctgtgctctgccctatagcgctccgaaacccgttagctttacgctaccctcctacgcacggtcaatctcgtcgcgccttgttggtccacactggttctcgccccccaccgttactc

SEQ ID NO: 5179 - DNA, 673 bp, Oryza sativa
  misc_feature (11)..(75): n is a, c, g, or t
  Predicted polypeptide sequence is orthologous to G2574
tgcgcgatgtnnnnnnnnnnnnnnnnnnnnnnnnnnnnnnnnnnnnnnnnnnnnnnnnnnnnnnnnnnnnnnnnnttttttttttcagtagatcatcaacttaatttacaggtggaaaattaaggcgagctatgtagttaaatgcccctatgtgatgtggtggcaaatcttgaccaacaaaaagaagaattcaaagaagaagaagacatattactggcttgatccatacatatagcacagccctagagcacagcctactacccgccggatcttgaatgtgcagcgccgtgcgagcgacccgacactgaacgaacagaacgagcacgtgacgcgaccccattgtgacccattctgtgcgaacatctggcacctcgaaatctaccttgacacagcatctactaccagactcacaccaacaccgaatatctagacaatccgtatacataggacaaagcggttataccaggaccatctgcacgcccatgcataccattactacgctcccatggacgtccaaggtccacagctccgaggcagcggctagcacgactgacgatcgatccttcgctacgagctgtctcgccgcacagcgcgatccaaggggccccttagacccccgcaccccggacccagcggttgacccccctctcggcacagaagaacagagcgagcg

SEQ ID NO: 5180 - DNA, 1524 bp, Oryza sativa
  Predicted polypeptide sequence is orthologous to G2574
atggacgtcgtcgtcgagagcccgccggtgagggacgagaagaaagtcgacgtcgccgcgattggaggcgcgcctccaatagtctttgagagttttgcaccatcgacgcagagagattcaaccatcatcaagaaggaggagaagatggaggcagcgaaggcggagatgggcgaggtgagggaggagaacgagcggctcaagacgatgctcacacgcatcgtcagcgactacaagtcgctgcacacgcacttcctcgacgtcgtcaaggtcaaggagcaaacggcggcggagctctccggagacgacgacgacgacgagcccgacgacctcgtctccctgagcctctgcacgaggcccaacgccgccgcgacgcgccggaagggccacgagaggacgccgtcgtccggcggcggcggcgacgacgggcggctgtccctcgggctgagctgcgctcgcggcggcgttgcctccgacgacgacgacgacaagcaggcgagccgccgcgcgttgccgccgatgcccgtgctgaacctcagctccgacagcagcggggacgccgccggcgccggcgccggcgagcctacccagccgaacaaagcgtccaggagctcgagcggcggcggcgatggcgccgacgacgaggtgctgcagcagcagcaggccaagaaggctagggtttccgtcagagtcaagtgcgacacccccacgatgaacgatgggtgtcagtggcggaaatacgggcagaaaatctcaaaggggaacccttgcccgcgcgcctattaccgttgcaccgttgcacccaactgccctgtacgcaagcaggtgcagagatgcgcggacgacatgtcgatcctgatcacgacgtacgagggcacgcacagccacccgctgccgccggcggcggcggcgatggcgtccacaacgtcggccgcggcggcgatgctgacgtctggctcgaccaactccacgatgcacggcagcggcggcgttcaccaccacctgccgttcgcctcggccgtcggcggcggcggcggcgtcgggctgctcggcccgaccaccatctccaccgccacgtcctgccccaccgtcacgctcgacctcaccgcgccgcactcgctcctgcacccgtcgtcggcgtcgccctacgccgccgccgccgcggggtacgagtccagcagggcgctgccggcggcgtggagcagcgggtacctggcgtacggcggcgcggcggcggcgcagccatactacgccaagggcgttgcgccgtcgccgttcggccatcatttcggcatgatgggcatggcggcggcggcggcgaggccggcgccggagcagctgttcggcggccagacgacgtcgccgtacctgcagagagccatcggcggcggcggcgtcgcgccggcggccgtgacggacacgatcgcgaaggcgatcacgtcggacccgagcttccagtcggttttggcggcggcgatcacgtcctacatggggcgcggcggcggcgcggcggcgccgaacaagtga

SEQ ID NO: 5181 - DNA, 1947 bp, Oryza sativa
  Predicted polypeptide sequence is orthologous to G2575
gagaggttgtggttagctagctcgaggcgcggacgcggtgttatgggcgttgccgtgcactggcggagggcgggcgattcgcttcacatggggggcgagccgcgcgcgcgcgcggaggcggcctgggcggctgcgttgcctgccgcgttggttgcgctggtgcgcgacacggctacatacacacgaatgatgcaccgtctccgaatggaaacgccacggggccccacctgccagcttgacccctgctgctgctgctgcactgcacatgttattccccctccgcctccggtgtcacgcacgcacgcgacgcgacgcgatgccgaggcgtccgtaccaccaccgccagcatcagcggccgtcagctcgagatcggacggcacgggacagatggcagcaggcgtcacgctggcgtgtgccgcccccccgccgctaagggccccacgtgccagcgatggaggcaggcgccgtggggtggtcaaagggggcgcggggacggacacgtgtcggtcgccgcaacgtctgaatgttcgaccgcgcgagagagagagggtgcgtgcgtgcgtgcgtgctagagccaagaaccacgagcacggccagcgtcggcgagaggcggcggtggatccggctatgtcgggcgagtaccagttccaggacgagctggcgccgctgttcgcgcggccggggggcggcgcgggggagatgcagatgctgccgtcgtcgtggttcgccgactacctgcaggcggggacgccgatgcagatggactacgacctgatgtgccgcgcgctggagctgccggtcggggaggacgtcaagagggaggtcggggtggtggacgtcgtcgcggccggcggcggcggggcgccgccgctgacgccgaacacgacgtcgtcgatgtcgacgtcgtcgagcgagggggttggtggaggaggtggaggcggcgccggcgccggcgccggggaggaggagtcgccggcaaggtgcaagaaggaggaggatgagaacaaagaggaaggcaagggagaagaagatgaaggacacaagaacaagaaagggtcggcggcgaagggagggaaggcggggaagggggagaagcgggcgaggcagccgcggttcgcgttcatgaccaagagcgaggtcgaccacctcgaggacggctaccggtggcgcaagtacggccagaaggccgtcaagaacagcccataccccaggagctactacaggtgcacgacgcagaagtgcccggtgaagaagcgggtggagcggtcgtaccaggacccggcggtggtgatcaccacgtacgagggcaagcacacgcaccccatcccggccacgctccgcggcagcacgcacctgctcgccgcgcacgcgcaggcggccgcggcggcggcggccgcgcaccagctgcaccaccaccacggccaccacggacaccacggcatggcgccgccgttgccgctgggctccggcgccgccgcgcagttcggccggtcgtccggcatcgacgtgctgagcagcttcctgccgcgcgccgccgccgcccaccacggcatgactacgatgggcggcgccgcggcgacgacgacgacgagccatggccttaacagtgcaatcagcggcggaggcggcgtctcgagcgagacgacgagcgcggtcaccgtcgccgcctcggctcagccgtcgtcaccggcggcgctccagatgcagcacttcatggcgcaagacttgggcctcctgcaggacatgctgctgccgtccttcatccacggcaccaaccagccttgacgcgacgaccaccatcaatctgaagctgaattaatcatcagactagctagacaagaggtcatttggctctcgatcgatcatgctgtttaattaattaacatctcgttacatctttttccccccaaatgatcacctctgtttcgtttcttgatttgttttttt

SEQ ID NO: 5182 - DNA, 1525 bp, Oryza sativa
  Predicted polypeptide sequence is orthologous to G2579
acacacaagctaagcttagctcgagctcattcatataccttagcttagctaaagcctagctcactctcactctcactcttgcattgcattgcaatattgcaatattgcattggtcatgaacactcgaggcagcggcagtagcagcagcagcagcagcagccaggccagcctgatggcgttctcggagccgccgaagccggcgagccagccgtcgccgccgtcgtcgccgatgagcgagcggccgccgtcggggcgcagcaggcggcgcgcgcaggagccagggaggttcctcggcgtgcggcggcggccgtgggggaggtacgctgccgagatacgcgacccgaccaccaaggagcggcactggctgggcacgttcgacacggcgcaggaggcggcgctggcgtacgaccgcgccgcgctgtccatgaagggcgcccaggcgcgcaccaacttcgtctacacccacgccgcctacaactacccgccgttcctcgcgccgttccacgcgccgcagtacgccgctgccgccgccgcgccgtcctcggtgcagtacggcggcggcgtgggcgcggcgccgcacattggctcgtacggtcaccaccaccaccaccaccaccaccacggacatggcgcggcgtcgggcgcgtcgtcggtgggcgagtgctcgacgatgccggtgatggtcccggttgatccccaccgctccagcatgtcgtcgtcgctgctggacatggacaggaacggccacgacttcctcttctccggcgccgacgacaactccgggtacctgagcagcgtggtgccggagagctgcctccggccgaggggcggcggcgccgcggccgatcatcaggacatgcggcgctactccgacgccgacgcctacggcatgatggggctccgggaggacgtcgacgacctcgcgcagatggtcgccggcttctggggcggcggcgacgcggcggaccagctcggcgcctgcgggttcccggcgagcggcggcgccgccgacatggtcgcctcgtcgcagggctccgactcctactctccattcagcttcctctcccattgatcgagttgcaccgggcattgcatggctaatcacgcactttgcctctgagcgatcatgcatatatcatttcctgtctaccatgatcagatcgagttgatcttgatcaatctgcgtttgatcgatcgagcaagagatcgagtagtatagcagcagcagcagcagcagctagcagtagatcgaacaagaagagtggcttggcgccatttctagttaattaagtagagcttcttcaaatatgtacttaggcagatgatctctctctctctctctctctctctctctctctctctctctcttctatattagcattagtacctacttagccatcatattcatgcatgcatgcatgatatattgcatggcacagcttgttaatttcttctagcatcttaatcaattaatccatgacctggttcaaaatgtccaattcgattttacattttacaactaacc

SEQ ID NO: 5183 - DNA, 1203 bp, Oryza sativa
  Predicted polypeptide sequence is orthologous to G258
atggggcaccactgctgcagcaagcagaaggtgaagcgagggctgtggtcgccggaggaggacgagaagctcgtccggtacatctccgagcacggccacagctgctggagctccgtccccaagcacgccgggttgcagcggtgcggcaagagctgccggctccggtggatcaactacctccggcccgacctcaagcgcggcaccttctccgagcaggaggagcgcaccatcatcgacgtccaccgcatcctcggcaaccggtgggcgcagatcgccaagcacctgccagggcgcacggacaacgaggtgaagaatttctggaactcgtgcatcaagaagaagctcatcgcgcaggggctcgaccccaagacgcacaacctcctgccggcgtcgaagacgctcctccatggcggtggcggtggcggcgctgcaaaccctagcggcaacggcctcgcgcagttccagtctaacaacggcgcggcggcggcgggcaccacgccgttcaccatcagctctccggccaaggcggccgcctacgatgtcgcgccgccggcgttgtacgacgtcgtcctccctgctaaccccgccggtggaatgctgatggcgcatgatcaccaccatcatcaccaggtcgccgcggcggcggcgccggtgggatacccctacgccgaccacggcggcaacggcggaggcgtgctgatgagcttcagggatcagaacgccggcgtccacggcgccgcctccatggacttcatgaacggctcctcctcgtcctcttccatggagcagctcggcggcggcggcggcatgtcgtcgaacggcaacggcagcttcagcgcgagcatggcggcgttcatggacgaggaggcggcaatgtgggccaccgccgtcgcgccgccgggcatgggcggcctcgccgggatggatcaggtggcgcagcagcagcagcagcagcaagtgctggtgcaggatgcggccgtgggcgttgcgccgacgacgctgatgatgcacggcggcggcgccgccaccgccggtgcaatggtggtggacaagagcgtggagatggtggacgtctcgtcggcggtgtacggcggcgcgacggcgacggcgttcgatctagacctgatggtggagtcgtgcgggatgttctgcggcggcggcggcgccggcaacgccatggagcagctgcagtgggactgctaa

SEQ ID NO: 5184 - DNA, 581 bp, Oryza sativa
  misc_feature (27)..(27): n is a, c, g, or t
  misc_feature (43)..(43): n is a, c, g, or t
  misc_feature (53)..(53): n is a, c, g, or t
  misc_feature (59)..(59): n is a, c, g, or t
  misc_feature (62)..(62): n is a, c, g, or t
  misc_feature (68)..(70): n is a, c, g, or t
  misc_feature (77)..(77): n is a, c, g, or t
  misc_feature (84)..(84): n is a, c, g, or t
  misc_feature (86)..(86): n is a, c, g, or t
  misc_feature (92)..(92): n is a, c, g, or t
  misc_feature (99)..(99): n is a, c, g, or t
  misc_feature (102)..(102): n is a, c, g, or t
  misc_feature (115)..(115): n is a, c, g, or t
  misc_feature (122)..(123): n is a, c, g, or t
  misc_feature (221)..(221): n is a, c, g, or t
  misc_feature (311)..(311): n is a, c, g, or t
  misc_feature (340)..(340): n is a, c, g, or t
  misc_feature (365)..(365): n is a, c, g, or t
  misc_feature (373)..(373): n is a, c, g, or t
  misc_feature (421)..(421): n is a, c, g, or t
  misc_feature (436)..(436): n is a, c, g, or t
  misc_feature (438)..(438): n is a, c, g, or t
  misc_feature (440)..(440): n is a, c, g, or t
  misc_feature (443)..(443): n is a, c, g, or t
  misc_feature (460)..(460): n is a, c, g, or t
  misc_feature (471)..(471): n is a, c, g, or t
  misc_feature (497)..(497): n is a, c, g, or t
  misc_feature (513)..(513): n is a, c, g, or t
  misc_feature (515)..(515): n is a, c, g, or t
  misc_feature (522)..(522): n is a, c, g, or t
  misc_feature (528)..(528): n is a, c, g, or t
  misc_feature (530)..(530): n is a, c, g, or t
  misc_feature (532)..(532): n is a, c, g, or t
  misc_feature (534)..(534): n is a, c, g, or t
  misc_feature (539)..(539): n is a, c, g, or t
  misc_feature (548)..(548): n is a, c, g, or t
  Predicted polypeptide sequence is orthologous to G2604
tttaaggtttttggcggggaaaggganagaccaacaacctccncccccggaanagtttnttnttaacnnncccgggngggcggnanaaaaanttggttngtntacaatggttctngctgtcnnctggctatggaagcaaatcaagttgcgcatgttaaactgcgggaactgccgtatgctgctcatgttccaatatggcgcaaggtctgtcaaatgcgcantctgcaattttgtgacatcagttgggggctcacctggtatagaccagaaagcccagcagctgaaactgctgaagtgccataaatattcanaaaagaacttctcaaaccgatgctttganttgcacatgtttagaattcttcccngaaacatnttttttctcccttttttatctccctttccccccaatttccaccttccntccttggatatgganananccngcgggaataaatgaaanttttgctaaanacctatgctcaaaattcgtccaatcntctgtttgaccgaacnanattgacnattatntncntnaaccnatgataatntttatgcattaaaaaaaaaaaaaaaaaaaaaaa

SEQ ID NO: 5185 - DNA, 832 bp, Oryza sativa
  Predicted polypeptide sequence is orthologous to G2604
gtgatttcagttgcctgactgttgctggaatctgtgaagcatctacaagcgatgccatcggttcaggcagctggcacagcaatgccggttccccttgccccatatccaactcctgtgccatttacacctcccaatggtatggattccaacttggcactgcaagaacacagctacattttgagttttttttccctgatgttggttggtcacctagaaatgttggtacatgccatagtgttcgccctgatgcattcttttggactagaaatcttatgaactgaatttcaatagacagctttttcttgaatcagatgttactgttcctggttcagaggttgcagtttattctgctcatagaaatcctgaaagtttagagagaactccttgttgagaaaatggaagtttttttactgctgagtttcgttgtctgaaatgaaaatgatgcatggaagatgcttttgttgtctgaaaatgaaaatgttagctgctgaaatgcgacattcagtcagtctctgaatttcaggggcccaaagccagctcgtttgctctgggtgccgtaatctgctcatgtatccagccggagcaacgtcgatttgctgcgcagtctgcagtaccgtgaccgtggtgcctgcccccgaaatctagctgcaatgttcacgaaaataaagagagattaaaggggaatacaaatggcttcagggctccgcaacagtgcgcgtgtcgcgttgatggtgtgcctgcactcaggtcgctcgagaagaagtacacactgaagttgctctggtcatatttacattattgtgtgtaactcttccttgtttgcttttcagtc

SEQ ID NO: 5186 - DNA, 1713 bp, Oryza sativa
  Predicted polypeptide sequence is orthologous to G2604
ggaacagatggcggtgctgtacgtcaccttcttgaggttgattgactaaaaaccttgaaaatactccctccgtttcacaatataagtcattctagcatttcccatattcatattgatgttaatgaatctatacatatatatatatctagattcattaacatcaatatgaatatgaaaaatgctagaatgacttacattatgaaacggaggaagtagttggcaagggaggtggatgtggggaggggttgagttgctctatgtgctcactggttgaagctgattgttgcgctcctatctacctcacttatttaccaggaggtgttaagctcattcggtgagaattttacctactcctttcactgcattttccttgaccacacttagattaaaattatagcttccttcctggtagtagcaaattgtggcaccaatgtggcacatatttattggttatctaaattattttcttatattgtgtcttgactctatttggtgttgtaaggcaggttagtggctgattaattagctgcattatgctaccccgttattactagcttaaataagttgatctgttcttgatgcaatttatacatctatgagctggtcacttcatcagctttactcaggtaggggtctttcctacatgagtggctattctctccaaactaataaaaattcatgtgagttttgttggtattttagcacaaaaaaaagtactcaaatagctgtttgcctggatgctatacccaccaatgaattttcaattatgggatggttcttattttttttgtacatgtaaacagaacctgaacatcagatttgatgagagattcaaccaagaagctaaaattttttgcgactgatgtgcattgctgaaccagttttctgttgcataaagagtcctgaaacttcttgttgcaaactgaagtggtgttctaaccagttttcttcttgctttctcattagcttctcttgaatctttctgtaggtttctttcctgtagggaaaggaaaggtgatttcagttgcctgactgttgctggaatctgtgaagcatctacaagcgatgccatcggttcaggcagctggcacagcaatgccggttccccttgccccatatccaactcctgtgccatttacacctcccaatggggcccaaagccagctcgtttgctctgggtgccgtaatctgctcatgtatccagccggagcaacgtcgatttgctgcgcagtctgcagtaccgtgaccgtggtgcctgcccccgaaatctagctgcaatgttcacgaaaataaagagagattaaaggggaatacaaatggcttcagggctccgcaacagtgcgcgtcgcgttgatggtgtgcctgcactcaggtcgctcgagaagaagtacacactgaagttgctctggtcatatttacattattgtgtgtaactcttccttgtttgcttttcagtctaggatagagatttacatgtcaaagagtcaagtgcacttttgaaagtgtaatgcgatgcaagtaaaaacaattttggacaagatcaaaaggatccatgtcatttgctgtcagaatagtaatgtttgttacttaatgaggtttgttacaaaccttaattacaggaatatcattgtagtagttcttaactttttacactcctatttgtagatgtacatatatttatgtacaattatcagatggactattttatacact

SEQ ID NO: 5187 - DNA, 1555 bp, Oryza sativa
  Predicted polypeptide sequence is orthologous to G2604
ttgcgccgtcccggttgccgaccgccgccgctgccgcctccgcctccccctcgcgccgccaccgccgccgccgctgagcgccatcgccgtcccccatcgcgctgccacctccgcctcccgccgtccccattgccgaccgcctccgcctccgcctccgccaaccctagccgccgctgccagtcccctcctcccttcggtgaggcgagcagccatctccgccttggccaccgccgtcgctgagcgctgccgcttccgcctccgcctcacgccgccgctaccaacagccgcctccggccgccggcgtccggatctgggctccatgtggccgcaggcgtacagatccgccctccgttgccgctgccatcaaagaaacgacggtggtgacgaagccggcatcaatgaaggcggtggctgcggcgagaagaggtgaaccgtacatcgccaggctgatctgccgacgagctcggcggcaacatggtcggtcaactggcgctacggtcgatctggatggctcactcacaaggcaagcctgtcatcacaatgtcctagagccgggtcgccccattgagggtctggtgctgcgtccctcctcatcctctccctcacgcagctacaagattggaatcactccggttaacgagaaacgcgtccagccaaccacttctcctcggtgactatttttctcttccctccagccctggcagcaatagagcaagctcatgtcaccgtagtcgcatgctcttgggggaggagatactagcagccggcctaaggaaatcttcaattcttcatcgccgtcgcttcctcaagttcaagaactggtgtaatagttgatagagctatacttgcagaagataaaaaacatggtggcttcaagagctccaaggagtgaatctccatggctaaagaagcccatgcatggagtttcaggctcaactgccatggctagcaccccatggagctcgatgccaccaagcagccattccctgggggcccaaagccagctcgtctgctctgggtgccgtaacctgctcatgtatccagccggagcaacgtcgatttgctgcgcagtctgcggtaccgtgaccgcggtgcctgcccccgagcagaaatctagctgcaatgttcacgaaaataaagagagattaaaggggaatacaaatggcttcagggctccgcaacggtgcgcgcgtcgcgttgatggtgcctgcactcaggtcgctcgagaagtacacactgaagttgctctggtcatatttacattgttgtgtgtaactcttcctggtttgcttttcagtctaggatagagatttacatgtcaaagagtcagtgcacttttgaaagtgtaatgcgatgcaagtaaaaacagttttggacaagatcgaaaggatccatgtcatttgctgtcagaatagtaatgtttgttacttaatgaggtttgttacaaaccttaattacaggaatagcattgtagtagttcttaactttttacactcctatttgtagatgtacaattatcagatggactattttatacactactttctccctctct

SEQ ID NO: 5188 - DNA, 1462 bp, Oryza sativa
  Predicted polypeptide sequence is orthologous to G2604
aagtaatgtggcatctgaaaattgagtttctttgcatctaaattttatagtagtttagaagtttatattgtaccctctgttttatttacaaaagtgagtagtttttggtttttagagcagaaatatagctgcaatgttcacaaaaatgtaaagagagattaaaggggatagcctgtcttcccttgaaatcgatgcatgagttttgcatttgctgaaattttgttctgaaatgcagttttgccaatgattttcctacctggaatttctgtgcaggaaccgagatggcgcagttagtttgcggaggatgccacactctcctgatgtatacacgcggtgcgacgagtgtgcaatgttcttgctgtcacactgtcaacctggctatggaaggtactaccaaaatttatcatcctcctcctctgttgcaattggtatattctgtggctttgattccagtatgcaaaatcctcctcctgaacagaatattttcctgtggctgaaagcaacagcaatcagtcggtagcaataaacatcgtcgagttggcttgtattccagtcatattcatgagagttggctatggttcagaaaacaaaaaagtttgacaaggatacactagatttaccagagtatgatgaaatatctcctacaattacaagatgtgctacagtagtatcctatacttactgaaggtctcacaaggacacctaatttagcatcaagttctgaagttccatataatttgttcagagttcagagttttctttaaggcagacttctgaaagatgagtgtttgttcatataatcttaaacacactgaataacaaatgattcccatgttcttgatggcagcaaatcaagttgcgcatgtaaactgcgggaactgccgtatgctgctcatgtaccagtatggcgcaaggtctgtcaaatgcgcagtctgcaattttgtgacatcagttggggtaagtgttcatcaacaggacacttcaatttcatatttagttcctttatctgaaaacattcaattttacagtagcatcatctaatggctaatattgcactgcaacctgatttttttcatgatgtgaccttagttgaagagtgtgttttttttctgaatcttttcaggcctcacctggtacagaccagaagcccagcagctgaactgctgaagtgccataaatattcagaaaagagcttctcaaaccgatgctttgagtgcacatgtatagagttcttccctgaagcattttttttcttccttttttatctccctttccccccaatttccaccttccttccttggatatggagagagcctgcggaataaatgagagttttgctaaatacctagtgctcaaaattcgtcgaatcgtctgtatgaccgaacaagattgacatattatatacataaacctatgataatatttatgcattgctcattgtttctgaatagttgaaacatgt

SEQ ID NO: 5189 - DNA, 1221 bp, Oryza sativa
  Predicted polypeptide sequence is orthologous to G2604
gtggtaagagagaggagatagagagagctgtactaactgatgaactgctctcatgcaagccagattaccataaagattgggtcataagcactgttgttaggttatcaatgggaaatagttttcatggacgttattggccgtgaatcccaagtggtgtggctaatctctccaaactaataaaagttcataatctgaacacaagatttgatgagagattcaaccaagaagctgaaattttttgcacctgatgtgcattgctgaaccaattttctgttgcataaagagtcctgaaacttcatgttgcaaactgaagcgtgatgttctaacatttttccattggagctttcactggtttcttcagaactgaaatctttcttgctttctcatcagcttctcatgcatctttctgcagggtttctttcatgtagggaaaggaaaggtgatttcagttgcctgactgctgccagaatctgcgaagcatctacaagcgacgccgtcgttcaggcagccggcacggcaatgccggttccccttgctccatacccaaccccgcctgtgccatttacacctcccaatggggctcaaagccagctcgtgtgctctgggtgccgtaatctgctcatgtatccagccggagcaacgtcggtttgctgcgcagtttgcagtaccgtgactgctgtgcctgctcctggaaccgagatggcgcagttagtttgcggaggatgccacactctcctgatgtatatacgcggtgcgacgagtgtgcaatgttcttgctgtcacactgtcaacctggctatggaagcaaatcaagttgcgcatgtaaactgcgggaactgccgtatgctgctcatgtaccagtatggcgcaaggtctgtcaaatgcgcagtctgcaattttgtgacatcagttggggcctcacctggtacagaccagaagcccagcagctgaactgctgaagtgccataaatattcagaaaagagcttctcaaaccgatgctttgagtgcacatgtatagagttcttccctgaagcattttttttcttccttttttatctccctttccccccaatttccaccttccttccttggatatggagagagcctgcggaataaatgagagttttgctaaatacctagtgctcaaaattcgtcgaatcgtctgtatgaccgaacaagattgacatattatttacataaacctatgataatatttatgc

SEQ ID NO: 5190 - DNA, 1983 bp, Oryza sativa
  Predicted polypeptide sequence is orthologous to G261
cgccctgcacccgttgccaccaccaccgccttctccgccgcgccgcctcctctcgcgtctcccgctcgtgcagggcgcgcgtcgtcgggcgagctgctgccgtctccgtggccgtggctgatcagaactagttggcgttcgatcggaaagtcgctgtcttttggcgactcggtgagaatttgcgccgcggttcaatgtgaaaaattttggcccgtggcgagttggatttggcgccgagtccattcaggtggttaagacttgttcgtgggagagcgaagctgcgcgcgttaagaccgggctccgttcttgcatcgtgcagagcagctgctggtttgagaattgagaggcgcggttgacatggagagttccaacctgggcggcggcggcggcggaggcggcggcggtgggccgccgccgttcttgatcaagacgtacgagatggtggaggacgcggcgaccaaccacgtcgtgtcgtgtggccccggcggcgccagcttcgtcgtgtggaacccgctcgacttctcccgtgacctgttgcccaagtacttcaagcacaacaacttctccagcttcatcaggcagctcaacacctacggtttccgaaaaatcgatcctgagagatgggagttcgcaaacgaggatttcataagagggcacacgcaccttctgaagaacatccatcgacgcaagcccgtgcacagccactccctccagaaccagataaacggaccactcgccgaatcggagaggcgcgagctcgaagaagagatcaaccggctcaagtacgagaagagcatcctcgtcgcggacctccagaggcagaaccagcagcagtacgtgatcaactggcagatgcaggcgatggaaggcaggctagtggcgatggagcaacggcagaagaacatcgtggcctccctgtgcgagatgctgcagagacgcggtggcgccgtgtcgagctcgctgctggagtccgaccatttcagcaagaagaggagggtcccgaagatggatctcttcgtcgacgattgcgcggcgggcgaagaacagaaggtgttccagttccagggaattgggacggatgcaccggccatgcctcccgtgcttcctgtgaccaatggtgaggcttttgacagggttgagctgagcctggtctccctggagaaactcttccagagagcaaatgatgcttgcacagctgctgaagaaatgtactcccatggtcatggtggtactgaacccagcactgctatatgtcctgaagagatgaacactgctccaatggagacaggcatcgatcttcagttaccagctagcctccatcccagctcacccaacacagggaatgcccatctccatttatccactgaactcacagagtctccaggttttgtgcagagtccagagctgccaatggcagagattcgtgaagatatccatgtgacaagatacccaacacaagctgatgtaaattctgagattgcctcctccactgatacttcacaagatggcacgtcagaaactgaagcttcgcatggaccgaccaacgatgtgttttgggagcggttcctcacagagactccacggtcatgtttggatgagtcagaaagacaagagtctcccaaggacgatgtaaaagcagaattaggctgcaatggcttccatcaccgggagaaggttgatcagatcaccgagcaaatggggcaccttgcttcagccgagcagactctgcatacctgatgcagtaataccatttgcgcggattcatagttcgtgtgtaaattagcgaagatgtaaattatagcttagatcggattagaggcttgcgtgttactttacagatttcaaccttttattagattacaataggtctttcacaatttatgattctgttctatccgctgactactgtgcataaattttttttagtagaccatatccatttttgtactccattgcccttctaagattcctcgttaaaatctc

SEQ ID NO: 5191 - DNA, 3008 bp, Oryza sativa
  Predicted polypeptide sequence is orthologous to G261
accatcgcatcttcgcttcgcatcgcatcgctcacatgcgctgccttcgtcacgctccttagcaatctcgcccgccatcatgtccaatcatcccgcttggcacgaccagcagccacagtacccaccccctccaccgcaaccaacgcgacatcactcgggcatggatgcctaccaaggaccatcgccctcgtcctctacacagcagccatcaccgtacaacagcgcgccccaacacactgcatcctatccgcacgcgcatcttccacccccagcagccagacataccccgcagcagcagcagcagcagcagcagcagcagcagcagcagcagcagcagcagcagcagcagcagcagcagcagcagcagcagcatccacaacaaccgcaatgggcgtccggcacgagtcaagactttggcggtcctagccccgccaactcggcgccgcgttccaacagcggatacacaggcttcgaccctccgtccgcgtccaacaacagcccgatgcgccaacatggaggctcgcacagctccgcttatacctcacactcgccctacgcaccctcacagtcgcacgctcccgacgccgccatgcatccccagcgctcctccatgccctcgcactacgactaccaaaacaactatccgcatccgcaccatccgcaaaacccacagatgccaccacaacaccatccgcatccgcatccgcatccgcatccgcatccgcatccgcatccgcatccgcatccgtctcaacaacaacaccaccaacaggcgcactggaacactggcccgctcccttcggtgcttcagccccagtccgcaccgctctcctcgacgcccagcagcaatcgcgggcccagcgctccgccgcctccgcagcaccacaccatggaccgtgcctaccccaacatcaagcacgacgacgacatggacgacgacgacactggcaactacgacgactttgaccccaagggcaaggcgcgcgccgctgccgatgccatgcaggccgccaacaagggcaccagcgatttcgtcaagaagctcttcagcatgctcgacgacaaggcgtacgacagtgtcgtcgcctggtcgccatccggcgagagcttcatcgtcaaggacatgaacgactttacaaaacacgtcctcccgcgcaactttcgccactccaactttgccagcttcgtgcgccagctcaacaagtacgacttccacaaggtcaagaatcccgaggacggcgccgccaccgtcggcgagcacgtgtgggagtttcagcatccagactttgtgcgtggccgcgacgacctgctcgaaaacgtcaaacgcaagatccccgcaaagaagaagcccgccaagcccggcctggtcgatgccgaccgcgacgacagccccgccatgcccgcgcccgtgcagatggaagcaccggaacgggcagagtcgaatgcagaactcagggcgcaggtggcccatctcaccgccgcgcaggaccagatgcagaaccacatcctcgcactcacaaaacagtaccagggcgtcatcggcgaaatgctcaccttccagcgcaacacgatccagcaggaccagctcatgcagaacctcatccaatacctcatcaacctcgaccaggaccgccgcgtggatggcgcacccgccccaccctccgcatccagcttcctcgcccacatgggcgccaatcagggcttcctcgccacacccgctcccgccagtgcgggcccgcatacggtgggggtgcccgcgcccgtgagcggtgccgacgctgggccatccagccatgctggggcggcgccgccgctgtcgcccaagagcgtcgcgtctccgctcgacgccacaggcagcacgcccgagatctcggcgcagctggcgtcgctgcgacagagcaatccgctggcgcccatgatgctgcatccgccccacctcgatgcggacccggccgatagctcgttggtgaatgcagcggcgagcgcggcgcgcaacccgagtctgtcgtcgttcgaaaaggcgggtctgcgcgtgtttaccgtgggaacgctgcagccgcgcgactcgcctggcgatcccacacccgccccgccacaggagcttgcgccggccgggctgcgcaacgggtcggcggggtcgtcgttcgacgtgcatgccaatggcaaaggcaaggaggctgctgacgacaagaagcgcacgcctacgcccggcgagggtcacccgagcaagcatctgcgcgtgcgccgatccacactggttcccggctgggcggtgcccccgcgtgtcctgctggtggatgatgacgaggtgtgtcggcgtctctcgagcaagttcctgcaggtgttcgggtgcagtatcgactatgcggtggatggcatgtcggcggtgaacaagatgaatctcgaaaagtacgatctggtgcttatggacattgtcatgcccaacctcgacggcatgccggcgacgtcgttgatccgacagtttgatccgcgcacgcccatcatcagcatgacgagcaacagtgggccttcggagctggtcaactacatgtcgagcggtatgacgggtatcctgcccaagccgtttaccaaggaggggctgttgaatatgctcgagaagcatctgttgcatctcaaggcggcgaggggtacggggcaggaatggcccaagggtgtttcacctgcgccggcggcgacgcccagtgggacagcgcagacgggtgcggatgatgggacgcttaacccgttggcggggatgggctttacggatgaagagtacgtcgccatgctgcagaacttgatcgctgcgggtactcaggatgacgaggcgtttggcatcgacctcaaggacggcaagaggatggcagacgagagtggcggcgagaacaagagacagcgctttgtcgattcgtagcatggttgtaccatcccacacaagtgtatagtagtctgggaccgtgcacatgtgcacacgcaagtgggaacacggataccattgtcagaatgcg

SEQ ID NO: 5192 - DNA, 1735 bp, Oryza sativa
  Predicted polypeptide sequence is orthologous to G261
aatccgagagggatttttcctcgcaaccaaccaaaccaaccaaacccccaaccaagcgagcaagccgccttcgccgggggggcccccaccctgacggcaaccctagccctccgatcaccggcgctgagactgatcccgccgccgtaggaggaggaggaggaggtggtggtggtggtggtgatggaggggggcggcgggggcgggtcgctgccgccgttcctgagcaagacgtacgagatggtggacgacccgtcgacggacgcggtggtggggtggacgcccgccggcaccagcttcgtcgtcgccaaccagcccgagttctgccgggatctgctccccaagtacttcaagcacaacaacttctccagcttcgtgcgacagctcaacacctatggctttaggaaagtagatccagaacaatgggaatttgcaaatgaggatttcataaaaggacagcggcaccggttgaaaaatatacatagacgcaaacctatattcagccattcatcacacagtcagggtgctggaccattaacagataatgaaaggaaagactatgaggaagaaatcgagaggctcaaatccgataatgcagcactgtcctcagagcttcaaaataatacgttgaagaaacttaatatggagaaacgaatgcaggctttggaagagaagctatttgttgtggaagatcagcagaggagtctgatatcatacgtcagagagattgtaaaggcaccaggatttctttctagctttgtacagcaacaagatcatcacaggaagaagaggagactgccaataccaatctccttccatgaggatgcaaatactcaggagaaccagatcatgccttgtgacttgaccaactcaccagctcagacattttacagagaatcatttgacaagatggaatcatccttgaactcattagaaaatttccttcgagaagcaagtgaagaatttggtaatgatatttcatatgatgatggtgtcccaggcccttcttcaactgttgttctcacagagctccattcacctggtgaaagtgatccccgtgtttcatcacctccaacaaggatgcgtacttcgtcagctggtgcaggagattcgcactcctctcgtgatgtagcagagtctaccagctgtgcagaaagtcctcctattcctcaaatgcattctcgtgtagatacacgagcgaaggtttctgaaatagatgttaattcagaacctgctgttacagaaactggtccatcaagagatcaacctgctgaagagcctcctgctgtcacacctggtgcaaacgatggcttctggcagcagtttcttaccgagcagcctggatcatcagatgcacatcaggaggctcaatcagaacggcgagatggaggaaacaaggtggatgagatgaaatcaggagatcgacaacatctttggtggggcaaaaggaacgttgagcagataacagaaaaacttggacttctcacctcaacggagaaaacctgacataattttgtttttctttttgtagatgaaaaactattaattcaggaacgctgacattggtgccttcctcagtgagatatgttgactaacatctatttcgcagtgtaccgtattttttccatcatgtaccgtaatgtatcatagtgccatacattcatctttggtccattgacactttctgatatcattgtgcgtgatttctaaaatattctcaagtttggttaaatgttac

SEQ ID NO: 5193 - DNA, 1959 bp, Oryza sativa; identical to SEQ ID NO: 2239
  Predicted polypeptide sequence is orthologous to G2632

SEQ ID NO: 5194 - DNA, 975 bp, Oryza sativa
  Predicted polypeptide sequence is orthologous to G2639, G2640
atgctgatgctgcggggcggcggcggcggcggaggcggaggcggaagcggcatggagggaacgagaatggcgggattcccgttaggaggcggcggagggaggcacggccgcgacgaccaccaccgacctcccgttaaccccaccgactccgccgccgcgttcctgtacccgagcaccgcgtcccgtggcgggttccagctatggcagcagcagccgccgccggccgcgcacccgttctacgcgcagaacatcatccgcttcgccgatgaccccgccgcgccgccctcctcgcgtggcgggaggggcggcggccccggtggctccggcggcggcggcaccatcagctgccaggactgcggcaaccaggcgaagaaggattgcacccacctccgctgccgcacctgctgcaagagccgcggcttcgactgcgccacccacgtcaagtccacctgggtccctgccgccaagcgccgcgagcgtcagaacctcctcgcctccgccgccgagtcctccaagcgcccccgcgactccgccgccgccgccacctccaccacgcccaccacctcctcaggggagcagcagcagatgatggtgggcgagaggttcccgcgggaggtgagctcggaggcggtgttccgctgcgtgcggctggggccggtcgaagaggccgacgccgaggtggcgtaccagaccaccgtcagcatcggcggccacgtcttcaagggcatcctccacgacgtcggcccggaacactcgtccggcggtggcggcggcatgggcggccgccacgcagccgcgggcgaggcgggctcctccccgagcacggccgcggcgccgcacggtggcggcgaaggcggcagcagcggcgtcgcggcggcggcggcggccgtgtcgtcatcggctgtggtgatggacccgtacccgacgcccggcccgttcggcggcgcgcacttcttccacggccacccgaggtga

SEQ ID NO: 5195 - DNA, 1846 bp, Oryza sativa
  Predicted polypeptide sequence is orthologous to G264
gtacctacaacgaccacgacgactcctctcctccctttctctctcttcacccgcagcacgcgcgccgccgtctccggcgatggaagttgccgccggcgcccgcggcggcggggccggcggaggagggggaggccccgcgccgttcctgctcaagacgtacgagatggtggacgacccgtcgacggacgcggtggtgtcgtggagcgacgcctccgacgcgagcttcgtcgtctggaaccacccggagttcgccgcccgcctgctgcccgcctacttcaagcacagcaacttctccagtttcatccgccagctcaacacctacggattccgtaaaatagatccagagcgatgggaatttgccaatgagtacttcatcaagggacaaaagcacctgctgaagaatatccacaggcgtaagcctatccacagccacagccatccaccaggtgctctgcccgataatgagcgtgcaatatttgaggatgagatcgaacggctttcacgagagaaatccaacctccaggctgacctctggaaatccaagcagcagcagtcgggaacgatgaaccagattgaagatcttgagcgacgagtgcttggcatggagcagcgacagaccaagatgattgccttcttgcagcaagctagtaagaaccctcagtttgtcaacaagcttgttaagatggcagaagcatcttcgattttcacggatgctttcaataagaagagaaggttacctggtttggattacagtatcgagaacacagaaaccacaagctcttatgatgaccatagcagcacttctaagcaagaaacaggcaatcttttaaatcagcacttctctgataagcttaggttggggctttgtcctgccatgacagagagcaatatcatcacgctaagcacgcaaagctcaaacgaagataacagaagccctcatggtaaacatccagagtgtgacatgatggggagggaatgtctcccgttggtgccgcagatgatggaactctccgataccggcacatctatctgcccctccaagagctcttgctttgcaccacctataagtgatgaaggcctcttaacatgccatctgagtctaactcttgcatcatgctcgatggatgttgacaaaagccaaggcctcaatgcaaatgggaccactatagacaacccaactgaggcagcaacagctaccatggaaaaggatgacaccattgacagaagcttcgatgacaaccaaaagaaatcagctgattctcgtacagcagatgccacaacaccacgagcggatgcacgagtagccagtgaggctcctgcagccccggctgcagtggtgaatgacaagttctgggagcagttcctaacagagcgacctggctgctctgaaactgaagaagcaagctctggcctaagaacagatacttccagggagcaaatggagaacaggcaggcatatgatcactcacggaatgacagagaagacgtggaacaactgaaactctgaatttactatagaattatacaatttacaagaagggatacaggcgtacagtgtaagatgtttagaatcaggaacctgctgttaaacatgacagatcaatgggtgtacaacatcacacaggtgtacatattttttttccctgaatgtttcggagggttaagattaatagttcgattaaccacaccagttgttgtaaaatcgatgtgtctgtctgtctggcatggtttctcatcttgttggtagtgatttatgttatgcagtgtcaagctgccacagcggagaatcaaaattagcatgtacattacccttaaatatccttttcgtaaaaatatttttacgatc

SEQ ID NO: 5196 - DNA, 1846 bp, Oryza sativa
  Predicted polypeptide sequence is orthologous to G264
caacctacaacgaccacgacgactcctctcctccctttctctctcttcacccgcagcacgcgcgccgccgtctccggcgatggaagttgccgccggcgcccgcggcggcggggccggcggaggagggggaggccccgcgccgttcctgctcaagacgtacgagatggtggacgacccgtcgacggacgcggtggtgtcgtggagcgacgcctccgacgcgagcttcgtcgtctggaaccacccggagttcgccgcccgcctgctgcccgcctacttcaagcacagcaacttctccagtttcatccgccagctcaacacctacggattccgtaaaatagatccagagcgatgggaatttgccaatgagtacttcatcaagggacaaaagcacctgctgaagaatatccacaggcgtaagcctatccacagccacagccatccaccaggtgctctgcccgataatgagcgtgcaatatttgaggatgagatcgaacggctttcacgagagaaatccaacctccaggctgacctctggaaatccaagcagcagcagtcgggaacgatgaaccagattgaagatcttgagcgacgagtgcttggcatggagcagcgacagaccaagatgattgccttcttgcagcaagctagtaagaaccctcagtttgtcaacaagcttgttaagatggcagaagcatcttcgattttcacggatgctttcaataagaagagaaggttacctggtttggattacagtatcgagaacacagaaaccacaagcttttatgatgaccatagcagcacttctaagcaagaaacaggcaatcttttaaatcagcacttctctgataagcttaggttgggactttgtcctgccatgacagagagcaatatcatcacgctaagcacgcaaagctcaaacgaagataacagaagccctcatggtaaacatccagagtgtgacatgatggggagggaatgtctcccgttggtgccgcagatgatggaactctccgataccggcacatctatctgcccctccaagagctcttgctttgcaccacctataagtgatgaaggcctcttaacatgccatctgagtctaactcttgcatcatgctcgatggatgttgacaaaagccaaggcctcaatgcaaatgggaccactatagacaacccaactgaggcagcaacagctaccatggaaaaggatgacaccattgacagaagcttcgatgacaaccaaaagaaatcagctgattctcgtacagcagatgccacaacaccacgagcggatgcacgagtagccagtgaggctcctgcagccccggctgcagtggtgaatgacaagttctgggagcagttcctaacagagcgacctggctgctctgaaactgaagaagcaagctctggcctaagaacagatacttccagggagcaaatggagaacaggcaggcatatgatcactcacggaatgacagagaagacgtggaacaactgaaactctgaatttactatagaattatacaatttacaagaagggatacaggcgtacagtgtaagatgtttagaatcaggaacctgctgttaaacatgacagatcaatgggtgtacaacatcacacaggtgtacatattttttttccctgaatgtttcggagggttaagattaatagttcgattaaccacaccagttgttgtaaaatcgatgtgtctgtctgtctggcatggtttctcatcttgttggtagtgatttatgttatgcagtgtcaagctgccacagcggagaatcaaaattagcatgtacattacccttaaatatccttttcgtaaaaatatttttacgatc

SEQ ID NO: 5197 - DNA, 1611 bp, Oryza sativa
  Predicted polypeptide sequence is orthologous to G2650
gttccacatccttctctccgacgacgctacctagctaagctgctgctctgtagctggcaggctagggtttacgctagctgatcggagctaccaccaacgccggtggttggtagctcggcggcggcgggatcttcttcttgctcgggttaattggcgagctatatatatatctagctcatcggcgggaaggggaaatctcggctgacttgaagggatcggaggaggccatatatatgcatggctgagttcttgtagctagctagctaggtggatcgaggactgacgatgggaggatgagctcgaggaggcgttgataaggatgatactaggaagcaaccaagcggccgccgccgcggctgcggcagctgcggcggaggaggaggcggcggagctagcgaggaagcacacggcggcggtggcgacgtcgcggcaatggtcggcgcagacggagtcgcggatcgtgcgcgtgtcgcgggtgttcggcggcaaggaccggcacagcaaggtgaagacggtgaaggggctgcgcgaccggcgggtgcggctgtcggtgccgacggcgatccagctgtacgacctgcaggaccggctggggctcaaccagcccagcaaggtggtggactggctgctcaacgcggcgcgccacgagatcgacaagctgccgccgctgcagttcccgccgcaggaccacctctgcatgggacaccaccaccacctgccgtcggccatgccgctgatgcaccaccacggccaccaccaccacgccgacgacgataagtaccacgtcgcggcggcggcggccgcgctggccgcggagaaggaggcggcggcggccggcggcggaggaggaggagggggagacgacgtcgacggcgggggcggcggcggagcggcgcacatagtggggaggttccccgccggtggctaccaccggttcatggggctgaacaacccgctggggatggtcaacagcgccgccggcgccgccatgccgttccactacgccggtgagtcatggaataatggcagcgtgcaagacagcggcgccggctcgccgcaggtggccgccgccgcggctcaccacacctcgccgttcccttcactgctttccttggctccagggccgcatcatcagctggtgttctactcctccgaggccaagcagttcacagtagacaaccttggctcgcagggcttgtccctgagctcggcgagagctttccatgatcagacaggaagctaagcaagctcgatctacacagtacacacactggaacaacactcttcgatcgtcgacaaggtaaggatcgatgagctctaccaaaagaacaaatctaagctagctagtgcaagtgtgtgcattgctttgatctatgtattaatttctttcaagggaacaattaagcttgtgggttaagatttaagaaggaagatactgccagctagctggctgctaatttcttttgctctgaaactagggcaagaaatatgcagggctttgctgcatatgcctgtgtgcaatacggatttgttacttctttttatatgcaaagaagtaattgatgtattggcttgtgtaataattaataagttctgaattttgaacctttc

SEQ ID NO: 5198 - DNA, 1539 bp, Oryza sativa
  Predicted polypeptide sequence is orthologous to G2650
gagtacacacactctgagctccactagctctctctcctctccctttccttccttattattcctcaccatcagctagctgagagctagggttcaattccctcttgctgctccctctctcccggccggcgacggcgacggcgacggcgaggctgttgggctcatcatcacctagctgaaaatcggccggcttgattaattccaagcttgcaggaggctaattgaggtgatctatatctccggggagagagaggagggagaagcgccctcttgctcatgcttgtctaatcatgagcagctcaagatgacaagcaataacagcacgaatgaggagctcggcggcggcggcaggaaggcggccgacaagccgagcggcggcggcggcgccgccgccgccgtggcgagctcgcggcactggtcggcgtcgacggagtcgcggatcgtgcgcgtgtcgagggtgttcggcggcaaggaccgtcacagcaaggtgaggacggtgaaggggctccgcgaccggcgggtgcggctgtcggtgccgacggcgatccagctctacgacctgcaggaccggctggggctcagccagccgagcaaggtggtcgactggctgatcaacgccgcccaggccgagatcgacaagcttccgccgctccagttcccgccgcacgaccacgacctcgtcgccgccgccgcctcgtccatggcgccgccgccgttcgcgaacggaggcgacggccaccacggcgcctccgcgtcgtcgatgctggaggacggcgacaaggccgccggcggcggcggcatgaaggcgttcatgagcctgagcaactccctcggcctgctcaacgccgccaccatgccggcgacgttggccgctcaccaccaccaccatcatcacgccgcggcgtactacgccgccgccgaatcttggggcaacggcggcaatggtggccaccaccatgatgtcagccatggcgtctcgccttcggctcacaactcgccgttcccgtcgctgctgtccttggcaccgggctctcatcatcagttcgtcttctactcgccggaaggcggcggattcgccgtgaaagaggctgcagccgagcagtttcctgtagatagcctcgaccactcgcaagggcagctcacactgagctcagcaagaagcttccttcactctggaagccagggatgatttgatcaattacaagagacaataatccctactccaataaggctggtacgttagaacaaattaaaaaaaattctaataacttcgtttgttgttccattttcaggtgtgtgtttaaggttgtgatcaatttggtattttatttaagcgcattatttggtacggccagatgattaagagttctagaactacttaattacagcatgcaaaagttaaaattcaaggttttgcagggtgtgcgatatgcaattcgttgcttcttcttttcttttcttttatatatatatatggaggtaattaattgttggtgtattattttgtcttgtgtaataacgatttgaggaattttggagcct

SEQ ID NO: 5199 - DNA, 1413 bp, Oryza sativa
  Predicted polypeptide sequence is orthologous to G2655
atcatcggagctcggtctgcccatggagatgacctagctagctagctagctagctatagcctctctctagacatctctctcttgtgtgtgggtggtttggtttcttgattggagcatggcgttggaggcggtggtgttctcggaaggatactacttcggatgcggcggtgccatggcggcggaagcagctgcaggaggagcttggagctggagccacgggtatggcggtggcgttgatcaggggaagggggcgatggagttagtggtggacgacggggtggtgaacgccttctgggacggcggcggaggcggcgcaagctcttccccggtgatggccgccgtctcggggtttattgaggagccggacggcggtaattcctccgtcgcagacgcagcgccgccgccggagcacggaggtgcgtctgtcgtcggacgggatggctccgcggcggcgccggcggcggccgcagggaggaggaagcggcggagggcgaggaccgtcaagaacagggaggaggtggagagccagcgcatgacccacatcgccgtcgagcgcaaccgccggaagcagatgaacgagtacctcgccgtgctccgctccctcatgccggcctcctacgtgcaaaggggcgaccaggcgtccataattggcggagcaatcaactacgtcaaggagatggagcagcttctccaatccctggaggcgcacagacacgcccgccgcgcacgcaccgacgccgccgccgcgttgccattcgcgggcttcttcacgttcccgcagtactccatgagcgccgtgcccacgacaaccaccaccactgtagcagcagcagcaacggaaaacggcaatgccgtcgccggcgccggcgcgggcgacgacgcggacgcggacgtgtcggggtcgaagccgtcctcggtggcggacatcgaggtgacgatggtggagagccacgccaacctgaaggtgctgtcgcggcggcggccgaggcagctgctgaggatggtggcagggctgcaacaccaccgcctcgccgtgctccacctcaacgtcgccagcgccggccacatggctctctactcccttagccttaaggtggaagaagactgccagctcacgtcggtggacgacatcgcggcggcggtacacgggatcgtcgagacgatcgagcaagagcagcagcagcagcagaagcagagctgtagctagatcagctagagtattttcttagaacatttagcaatggcaaaaatggtcaatattaatatgcgccaaccgtgtgtaatgtgtgcactttcgattcttctagaactctgtacgctggatgcacatgtaccgcagttactacacccacgtacatttctgtagttcatcttcacttcaattaatgcatcatggtctaccactctgtactt

SEQ ID NO: 5200 - DNA, 1312 bp, Oryza sativa
  Predicted polypeptide sequence is orthologous to G2655
aactcactctttaattcgcctccccctgaatcgtgtgcgtatcgtatcgtggcgtcgtcagttcgcgaaaaaaaacgcccgttcgttttgccgggtgcgtgcaggatggcgttagaggccgtggtgtttccgcagggccatttcggctacgggtgcggaagggactcgccggcgtacgggatgccgtggtgcgacgtcctggctgctgccggcggcggcggcggcttcggtgagttttacggagtggacgagtgggatgaccagctgcaggtcgcctccgtggatgagtgggaggtggcatccaaggataactcggatgcttccacggagggcaaggcggcggcggcggagcgggcggagccggtggccgccgggaggaggaaacggaggcggacgaaggtcgtcaagaacaaggaggagatcgagtgccagcggatgacccacattgccgtcgagcgcaaccgccgccgccagatgaacgagtacctcgccgtgctccgctccctcatgccggcgtcctactcgcagaggggtgatcaagcatcgatcgtcggaggagcaatcaactacgtgaaggagctggagcagctactgcagtcgctggaagtccaaaagagcctcaagaaccgcagcggcgccatggacgccgccggcgattcccctttcgccggcttcttcagcttcccacagtactccacgtcgcctcgcactggctgcagcgccgccgccagcgccgggagctccggcagtgcgagcagcgtcgtcatggacgacacggcgggctccgcggagagcggccggcagtcggcggccatcgccgacatcgaggtgaccatggtggaagggcacgcgagcctcaaggtgctcgcgcggcggcgaccgaagcagctgctgaagctggtcgtcgggctgcagcagctgcgcatcccgccgctgcatctcaacgtgaccaccgtcgacgccatggtcctctactccttcagcctcaaggtggaggatgattccaagctgggctctgtggaagacattgccaccgctgtgcatcagatcctgggcagcattcagcagcaggaggccgtcctctccatcagctgacgccgcgatcgatggagacgacaaccgagacggccgccatgtgaagcctctgcctcgtccgtcctggaaatggaaccatggcgcctcgatcgatagcttgttagcttgtaatgtgtgaatgtgattgtaccctagccaacagagtgctgcatgcatgcagtatctccggcgaccttaatgagaaatctataccaacattttgagctcttgtaaacgt

SEQ ID NO: 5201 - DNA, 1566 bp, Oryza sativa
  Predicted polypeptide sequence is orthologous to G2655
aaaaccacccaaaagcgtagcgacacacgagaagccaccagccaacgtagtacgcgccgagagctgaggccatccacgacacacgaacatgagcacactagtagacgcgctgtgcgctccctgcagcgacaccgcgctcatctacgacaccttcaacgcctccgccgccgcgagcttcctcttcgacaatgccgccgccttctgcgacgctgacatcctcggcgccacggcgacaggggagaaggaggcgacgtcgtcggccgcggccgcggccgcggaagccgccccgccgaggaagaagcggcggcggcgcgcgaagagctgcaagtcgcgggaggagacggagacccagcggatgacgcacatcgccgtggagcgcaaccgccggcgccagatgaacgagtacctcgccatcctccggtcgctcatgccggagccctacgtccagaggggcgaccaggcgtccattgtgggaggcgcaatcgagttcgtgaaggagctcgagcagcagctgcagtcgcttgaggcgcagaagcgaacgctgctccctcaccacaaggcgagatgcgacgacgcaacgccgatgcataacgccagcggcagcaacgtcggggccggcggctgcatggagcccacgacgataacgagcaactgcagcagcagcgtcaccgaggacgcgccgtccgccgacgcgcccccgttcgcgcagttcttcgcgtacccgcagtacgtgtggtgccactcgccgcgcgactccaccaccaccaccaccgcggcgtctgcgtcggcgtcggcttcggcgtcgtcgtcgtcgccggccacggtggcggcggcgctccagtcggagcaccgctccgggttggccgacatcgaggtgagcctggtcgagacgcacgccagcgtccgtgtcatgtcaccgcggcggccagggcagctgctcaagatgatcgccggcctgcaggccctccggctcaccgtgctgcacctcaacgtcaccacgctggactcccttgtgctctacaccctcagcgtcaaggtggaggaaggatgcagcctgacgacggtggacgacatcgcggcggcggtgcaccacgtgctctgcatcgtcgacgcggaggcggccgcctcggagcatctcctcgcggcggggcaactggccacgacggcgacggcggtggcgaagagagaactcgcgacgtacatgtactgagccgctccaagtgccttacatgtcgtcgtttgtgtggtcgcgtgtactgtatgccgcgctcccgtttttctcccctttttaggctcgtcacgtttttgctgtgtagtggcccggcaggttagatctagttctagttgtactagtagatgcaaaatgctatgtgtccagtagtcccagcctctcgacgagggcgtacttgtctgtttctcgttctgaaaacagaatgttgtattgctgtacctgtacagtatcctgcctcgcctttctgtaataagagcgactagcgagtagcgacattggaaggaacagttcgagattcgtattatccgaacagggccttatgagggtactagctt

SEQ ID NO: 5202 - DNA, 1343 bp, Oryza sativa
  Predicted polypeptide sequence is orthologous to G2655
atctccattggccacccaccaccattgtcttctcctcccatattcttcacctcgctcgtcgtcgtcttcctcccccgccgccggccggtgcgggctggtgttcgttcacacttaccggccagccaccgcacgccattgctggcattggaaggtgatggcgctggaggcggtggtttactcccacggcggccatttcggcgggtacggcggcgggctgatgggcggcgccccggcggcgccgtgggatgtcttcgcagccgccggtggcggcgggagctgggacgatcccggcctgttcgcggcagaggcgtctcttgatgtgatccagggcgtggatgagtgggaggtggatcaggatcagcatgcttcttcttcttctaaggtggcggcgcggccgcctgtgaaggcggcggcggcggcggggaagagaaagaggcggcgggcgaaggcggcgaagaaccgggaggagatcgagagccagcggatgacccacattgccgtcgagcgaaaccgccgccgccagatgaacgagtacctcgccgtgctccgctccctcatgccaccttcctacgcccaaaggggtgaccaagcatccatagttgggggagcaatcaactacgtgagggaactagagcagctgctccaaacactggaggcgagaaggaccatcaaggaccacatcgacggcggcgccggcgagtctccctcccccttcgccggcttcttcgccttcccacagtactccaccgccacctccggccatggcggcggcggcgatgcacacagcaggatcgtcgtcaagcctgcagagacgacgactacggccgccggtggcggcgccggcgcggcgatcgccgacatcgaggcgagcatggtggagagccacgccagcgtcaaggtgcaggcgcggcggcggccgaggcagctgctcaagctcgtcgccgggctccaccagctagggctcaccaccttgcatctcaacgtcaccaccgtcgccgccatggccatgtactccttcagcctcaaggtggaggatggatgtaagcttgggtctgtggaggagattgcaactgcagtgcatgagattctggagaggatgcaggaggagcaggcttttgctgatgccaaaactagcttgtgaattgtactgcctgcagctgcctactttcccagatgtgctccagctggggattctcttgtatgtaatggcacttggcagtgcaggcatcaaatgtttattgcgaactagtattagctagctagaaaatataatatttgagatatggtggttttggcatatattaagaagcagggagaggtttaattaactatatgtttggatc

SEQ ID NO: 5203 - DNA, 1056 bp, Oryza sativa
  Predicted polypeptide sequence is orthologous to G2655
atggcactggaggccgtgctgctctcgcgtggtgatctgtttggtcgtcgtcgttgcgccatggaaggaggaggaggtggttggagcagcccgttcagtggcttcgagggagtgatggatttggacggcggcaactgggacgccgccgcgtgctcatcgatgcttctgcatggcttccaggagctagagatccctgcggccgccgctgctgctgctgccatggcgccgccgccgccgccggtagagcctgctaattgcgcggagaatgcaggaggggttggtggtcatcaggaggatcaggctgcggtggcggcagcggcgacggcggtgcagtcggggaggaggaagcggcggcgggcgagggcggcgaagaacaaggaggaggtggagagccagcggatgacccacattgccgtcgagcgcaaccgccggaagcagatgaacgagtacctcgccgtgctccgctccctcatgccgccgtcctacgcgcaaaggggtgatcaggcgtccatcgtcggcggcgcaatcaacttcgtcaaggagctggagcagctgctccagtcgctggaggcgcggaagagttcccggcaatgcgcggcccacgacgcggcggcagcggcggcgccgttcgccagcttcttcaccttcccgcagtactcgatgagcgccgccgccgccgcggcgccggtggctcccgttgtgaacgagttgcacggccgtgacgacggcggagcaggcaccgccgaggccgaggcgtcagggtcgaagccgtcggcggtggccgacgtcgaggtgaccatggtggagagccacgccaacctgcgggtgctgtcacggcggcggccgaggcagctgctccggctggtggtggcgctgcagggccaccggctcaccgtgctccacctcaacatgaccagcgccggccacatggttctctactcgttcagcctcaaggtggaggatgattgccagcttacgtctgtggatgagattgcaaccgccgctcatcagatcattgagaagattcaagaagagcagggctgtagtttagattag

SEQ ID NO: 5204 - DNA, 719 bp, Oryza sativa
  Predicted polypeptide sequence is orthologous to G2655
gcgtcgatcgtcgccggcgccatcaacttcgtcaaggagctggagcagctgctccagtcgctagaggcccagaagcgtcgcgccgagcacgcgccgccggcgccgccgttcgccgggttcttcacgttccctcagtactctaccacagttggtgacaacaatgcggccggctctggcgccgccgacggcgagggcggctgcggcgcgcggcccggcgcggccgacatcgaggtggccatggcggagagccacgcgaacgtgagggtgctcgcgccgcggcggccgaggcagctgctgaggatggtggtggcgctgcaatgcctcggcatcaccgtgctccacctcaacgtcaccaccaccgccgaccatttggcgctctactccttcagcctcaagatggaggatgaatgccggctttcgtcagtcgacgagatcgccggcgccgtcaatcagatggtcacgaagatcgctggcgagtgcattagttagttaattagcttgaaaaaaaaagaggtgtttttgtgcgtgtatgtgtttgtagcaattaatcccgtcctagtacatggataattcaggcgatttgagccattgtcagggtagtacaatactagctgcccgccatgtttgcgtgcaagtaattaaacatgtatcaatcagcggatcagatctgcttaactgaattttcaaagtacatatgtaagcatccagctcgtcgagtc

SEQ ID NO: 5205 - DNA, 1080 bp, Oryza sativa
  Predicted polypeptide sequence is orthologous to G2661
tcaggggctgaaacaaacccagcacatttgtgtttgtacgcgcagctagctagccacgagcgcggatccatctcctagctagcgcaccatctatggatccataccacgactaaaacatgcatgacccacgcggcttccccatccacccgcagccgtaccacctccaccccacggccggcggcctcggcgagggcaggatgcggggcggcgggcggcggcgccccggcgccaagctctccaccgacccgcagagcgtggcggcgcgggagcggcggcaccggatcagcgaccgcttccgcgtgctccgcagcctcgtgccgggcggcagcaagatggacacggtgtccatgctggagcaggccatccactacgtcaagttcctcaaggcgcaggtcaccctgcaccaggccgcgctcgtgcagcacgaggagggctgccagcacgccgacgtcgccgcggcgttctccgccgccgacgccgatctggcccttgagctgaaccatcgccacggcggcgccggcgatgatgacgccgggatgacgacgctggagatggcgccgatgcaagaggcggtgggctacggcgacggcccggctcatcagatgatgcagcaagcgctcgatccagcggggcagctgatgatgggcggcgctcatcagctgcctcctttgccttgctgtgtcttcgtccaggagactgacccctcgtgctactcggtgtgcaatgtccacggtgaggagtctggtgcgcaaggatcttattagctagctagtgagacagtggcttgcttaggtagttaatttccttaagtatgctcgaatattggctctacccactagctgtctagctctacttagcttacctaggtcgtcaaccaatatattaccggttggtcatggtcccttaaattagctagactcttgatttctgtaagaatgcatatatgcatgcatggggttctgttggagcaatgcataacagagctttgttttacatgcatgcgtgcatgcttcctagatatcattctgaaatctgaacttgtttgctcgatcgcttaattgctatctcaccatttcggta

SEQ ID NO: 5206 - DNA, 2437 bp, Oryza sativa
  Predicted polypeptide sequence is orthologous to G268
gagtccccggcagtgcacgatcccatccctcccgcatcggcaaggcaccgccgcgccgaccgctctccgcaccgcgacgcgacgcgacgcgaggcgaggcgaggcgagcatgaagcccctgggcgcgcacggcgccgacctgctctgcggcccgcgcgtcctccgcgctgcggccctcgccttcgcctgcgccgccgccttcctcgtcggctaccactggtccgactcctccccgcgcctgctcttcttctcctccaccgcctcctcctcctcctcgccgctcctctccaccggctccccttccgtcgccgtctcccccaacgccaacctctccttcgacccctccctgatccccacccctgccgcctccacgccgcctgcttctcctactgccaatgcctcgcccccaccttcgctgccgccgcctcctcctcccctccgcccccctccccctcccgcccgcctcggcatcgtcggcgaggacggcgcgatgcgcgacgacttcgacgtcgtcgtcggcggcgccaacgacaccgatctggccgccaccgacgaggccctgccgcaggagccgaccgacgcgggccccgccgtcgggagcagggttcggattgggaggttcccggtttgtcctgagagcatgagggagtacataccctgcctcgacaacgaggaagagatcaggaggctgccctcgacggagcgtggcgagcggttcgagcggcactgccctgccaaggacaagggtctgagctgcctcgtgccggcacccaaggggtataaggcacccattccttggcctcggagcagagatgaggtatggtttagcaatgtacctcacacgcggttggttgatgacaaaggagggcagaattggattagtaaagctaaggataaatttagatttcctggaggaggaactcaatttatccatggagcaaatcaatacctggatcagatttctcaaatggtaccagatattgcatttggctctcacactagagttgccctggatgttggctgtggagtagcaagttttggtgcatacttactttcacgtgatgtgttgacattatccatagctcccaaagacgttcatgagaatcagatacagtttgctcttgagcgtggtgtgcctgcaatggcagcagcatttgcgacacaccgattactatatcccagtcaagcatttgacttaatccattgttcacgctgccgaataaattggacccacgatgatggaatcctgcttctggaggttaatagaatgctcagagccggcggttattttgcttgggcagcacagcctgtttataagcatgaagaggctcagcaagaagcatggaaagagatggaagacttcactgcaagactctgttgggagcttgtgaagaaagagggatatattgctatgtggaggaaaccattaaataactcatgctacatgaaccgtgaccctggggtcaaacctgcactttgtgatcctgatgataatccagatgatgtctggtatgtcaatctgaaagcatgtatcagccggcttcctgaaaacggtgatgggctgactccctttccatggcctgcacgtttaatggagccaccaaaaaggcttgaaggtgttgaaatggatgcacactcatcaaagaaggagcttttcaaagcagaaaccaaattttgggatgacattgttgaaggttatattcgtgtttttaagtggagaaagttcaaactccggaatgtattggacatgagggctggatttggagggtttgcagctgcattgattaatcgtaaacttgattgctgggtgatgaatgttgttcctgttagtgagccaaacacactgcctgtaatctatgaccggggacttcttggagtggctcatgactggtgtgaaccatttgatacatatccaaggacatatgatctgctccatgcgtttagcctattctcgaaggaacagaaaagatgtaacatctcaagtatcttgctggagatggatcgaatactcagaccaggcggtagggcttacattcgtgacctaaaacaagttgtacaggatgtcaaagagataacaaccgccatgggatggcgatccatcatgcgtgacaccgcagaaggcccgtatgctagcaggaaggttttgatgtgcgacaagccgatggtgcgttagccgatcaggctggtccagagcaatgatgcgagccctggttttgttttccggagccttttgaactgactaccacagctactacggactggagattgacatctgtttcaatacatagggataggtgaatgccaaagttgtaactaatcaatttgattcgtcattcgtttgtacaacgactgatgtagcccctaacgattggcttgtttttgttgtatcatccacacaacagtaattatgaataggagttaggaaggtttttgagcg

SEQ ID NO: 5207 - DNA, 292 bp, Oryza sativa
  Predicted polypeptide sequence is orthologous to G2682
aagctttttttttttaagaaacaaaagaaggatggtttattctgtaaatgtcacaaattatgttcatcggaaaaggtatgtgcttgtattaaagctaacagagcatgtactgaatattgttcttgccatgaagaaatgttccaatgtgagatcttcatcaacacccaaattacctagtactacgaatacatgttgtgtttccaagtgttgcaaagtagactcccctccagactttaaatgtcaacgatgtggaaatatgtgccatagctccacctgtactatgcccaagctt

SEQ ID NO: 5208 - DNA, 1545 bp, Oryza sativa
  Predicted polypeptide sequence is orthologous to G2699
gaatttgattggctcttgatcagcctccggatcgtgtagcgcagtggtggctagcacgtaggtagcaacaaagccatggacatggagcatgagctcaggggcggcggcgtcggggcggcggcgcatgggcatggctccatctgcttctccggcgggccggtgctcgtcgacgggcgacgcatccagcagctgctcctccactgcgccgccgcgctcgagtccaacgacgtgacgctggcgcagcaggccatgtgggtgctcaacaacatcgcctcctcgcagggggaccccagccagcggctcacgtcgtggctgctccgcgcgctcgtcgcccgcgcgtgccgtctctgcgcggcggcgccggcgggcgccgccgtggagtttctggagagaggccgggcaccgccgtgggggagggccatgtcggtgacggagctcgccgactacgtcgacctcaccccgtggcaccggttcggcttcacggcgtccaacgccgccatcctccgcgccgtggccggcgcatccgccgtgcacgtcgtcgacctcagcgtcacgcactgcatgcagtggccgacgctcatcgacgtgctgtccaagcggcccggtggcgcgccggcgatccggatcaccgtgccgtccgtgcgccccgccgtcccgccgcttctcgccgtgtcgagctcggagctcggagcccggctcgccatcttcgccaagtccaaaggcgtgcagctggagttcaacgtcgtcgagagcgcgacgacgacgtctccgaagaagacgtcgacgacgctgtgccaagaactcgcgtccgtgctgtccgacccgccgtcgctggggctaagggacggcgaggcggtcgtcgtgaactgccagagctggctccggcacgtcgcgccggacacgagggacctcttcctcgacacggtccgggcgctgaacccctgcctgctcaccgtcaccgacgaggacgccgacctgggctccccgagcctcgcgtcgcgcatggcgggctgcttcgacttccactggatcctgctcgacgcgctcgacatgtcggcgcccaaggacagcccgcggcggctggagcaggaggcggccgtcgggcggaagatcgagagcgtcatcggcgaggaagacggcgccgagcgctcggagcccggcgcgaggctcgccgagaggatgagccggaaagggttcgccggcgtcgtgttcgacgaggaggcggcggcggaggtgcgacgattgctgagcgagcacgccacggggtggggcgtgaagcgggaagacgacatgctggtgctgacgtggaaggggcacgccgccgtgttcaccggcgcttggacgcccaactagttgagcctagcttagcaatctacagtatacatcaagtgattaaagcttaagctggtgttagactgtctattagctcagaagtgacaacggagaatcaactgaggaggaatttctggttggatttagtggatcgttttaaacttctacttccatgacaagatatttcagttgaattcttgatgttttactccc

SEQ ID NO: 5209 - DNA, 1419 bp, Oryza sativa
  Predicted polypeptide sequence is orthologous to G2699
atgcagttcacgcacaccgcgccacctccaccgcctctgcaccctaatgggcatggactagggttagggttgtaccttgacgtcggcgcgacgaggggaggaggaggagcgcggccgtggtcgtcgtcgtcgtcgacgacgacgttgggtgggagcggctacttcccgtcgtcggcggcggcgtcgaagatctcgttggggaacctcaacagcacgggctgcatggagcagctgctggtgcactgcgccaacgccatcgaggccaacgacgccacgctgacgcagcagatcctgtgggtgctcaacaacatcgcgccggcggacggggactccaaccagcggctcacagcggcgttcctgtgcgcgctcgtgtcgcgggcgtccaggaccggggcgtgcaaggcggtgaccgcggcggtagcggacgccgtcgagtcggcggcgctccacgtgcaccggttcacggccgtcgagctcgccagcttcatcgacctcacgccgtggcaccggttcgggtacacggcggccaacgccgccatcgtcgaggccgtcgaggggttccccgtcgtgcacatcgtcgacctcagcacgacgcactgcatgcagatcccgacgctcatcgacatgctcgccggccgcgccgaggggcccccgatcctccgcctcaccgtcgccgacgtcgcgcccagcgcgccgccgccggcgctcgacatgccctacgaggagctgggcgcgaagctggtcaacttcgcgcggtcccgcaacatgtccatggacttccgggtggtgcccacctcgccggccgacgcgctcacgtccctcgtcgaccagctccgggtgcagcagctcgtctccgacggcggcgaggcgctggtcgtgaactgccacatgctcctccacaccgtcccggacgagacggccggctcggtcagcctgacgacggcgcagccgccggtgtccctccgtaccatgctcctcaaatctctccgggcgctcgacccgacgctggtggtggtggtggacgaggacgccgacttcaccgcgggcgacgtggtggggcggctgcgtgcggcgttcaacttcctgtggatcccgtacgacgccgtggacacgttcctccccaaggggagcgagcagcggcggtggtatgaggcggaggtggggtggaaggtggagaacgtgctggcgcaggaaggggtggagagggtggagcggcaggaggacaggacgaggtggggccagcggatgcgcgccgccgggttccgcgcggcggcgttcggcgaggaggccgccggcgaggtgaaggcgatgctgaacgaccacgcggccgggtgggggatgaagcgggaggacgacgacctcgtgctcacgtggaaggggcacaacgtcgtgttcgcctcggcatgggcgccgtcctga

SEQ ID NO: 5210 - DNA, 522 bp, Oryza sativa
  Predicted polypeptide sequence is orthologous to G2699
cggcgaggtgaaggcgatgctgaacgaccacgcggccgggtgggggatgaagcgggaggacgacgacctcgtgctcacgtggaaggggcacaacgtcgtgttcgcctcggcatgggcgccgtcctgatcagctcgggacgccgcgcgcgtggacggcatgccgcatgtgtacggccggcgacaagttgtgctattagatatcttctatgagctttatcgggaggcacagaaagaaaaaaaaaacttctcgtacgggtatttgatcagtacgtacgtctcacttccaagagtgcatcaagaaacagatacatataagtgtttctctttcaagatttacaaagtttcctgtaaactaaacgattttttttttcggtttgctactgtgtaattgatactctatgaacaaccagccggacaaagggtgtatgttatagttgatgtatggtgtgtgttgaactaccaaaattaatccaagatacgataatgtggaaaaaaaaaaaaaaaaaaaaaaaaaaaaaaaaa

SEQ ID NO: 5211 - DNA, 500 bp, Oryza sativa
  Predicted polypeptide sequence is orthologous to G2699
gtagaggctggagcggcaggaggacaggacgaggtggggccagcggatgcgcgccgccgggttccgcgcggcggcgttcggcgaggaggccgccggcgaggtgaaggcgatgctgaacgaccacgcggccgggtgggggatgaagcgggaggacgacgacctcgtgctcacgtggaaggggcacaacgtcgtgttcgcctcggcatgggcgccgtcctgatcagctcgggacgccgcgcgcgtggacggcatgccgcatgtgtacggccggcgacaaggtgagtggccgtgtaggcgtgtgtgcgtgcctacttttgcatggatatttggatttagggtttgtttttgtgtatgctcattgtggaaagatggtcttgttaagttggcttttacctgttgattttgcttagacgattcgtcgttttgatcatgtaatgagaatctctctctagttcttactgctagaatgaatgaatgaagaaaaaaaacttgcaatcaaa

SEQ ID NO: 5212 - DNA, 398 bp, Oryza sativa
  Predicted polypeptide sequence is orthologous to G2699
gggttttgcccattaatttgttttttaatcaccggaacaactaaccagaaaatattattttaatttgtggaatcaattttttccaaaatttaaaaaaccaagattttgttgcaaaacacccttcaaaaggttaaattatttcctgttgttttttttcaccaattttttccagtccaattgccattatttcaaccctttattcactgaagaagcaaccccctttgctaaaatttgttattttgacaaaatctgaccattttttttttttttttttcattttacctttttttaacctgttttactttttatttcattcggtttttccattactattttttttttttcaagaaaaaaaaaaaaaaaataataatttaaaattaaaaaaaaaaaaaaaaaag

SEQ ID NO: 5213 - DNA, 1394 bp, Oryza sativa
  Predicted polypeptide sequence is orthologous to G2719
aacgaacgaactagcaccaaccccacagcaccagccaccaccatgtcgtccgaaaccgccgcttcgccgccgccgccgccgccgaatccaccggccgccgactccacccattccagccccgcctccatgaccgacgagacgcacggcgcaggagcccatcccgacgagtcccaaccgcatcgctcctcatcgtcgtcctcctcccctcccgtggccgtcgacggcgagacgcgcgtcccactcccagtccggtccctgccccaacctagccacccatcgccgcctccttcgggggaggacgaggatgacgtcgtcatcaccggccaaatcgcagtgggtgacgccgcgggggcggcgatggaggagcgggtgaaggggccctggtcctcggatgaggacacgctgctgagcaatctggtggagaaactcgggccgaggaactggacgctgatagcgcgcgggatacccgggcgctccggcaagtcctgccgcctccgctggtgtaaccaactcgacccccaagtcaagcgcaagcccttcactgaggaggaagaccgcattataatggctgctcatgcaatccatggaaacaagtgggcggctattgcaaagcttttggttgggagaaccgataatgcaatcaagaatcattggaactctaccctgaggcgtcggcactgcactggtggccgatgcacacaaggtggtgttatgaagagagctattccggagaggcctaggtcggtttcagaagaaccttggccattgggcaatcttagttccttaaatgttagggaagcaatggaagctcccgcacaaacagtatctgaaagttatgttggggcatggcaaatcggggatcagagttgcaaaactgaagttgttgatccaccttatcttgcccgaccagttgcaaaggttggtgcattcaaaccatacaatgtaggacctgctcaatcatcacaaaaggaaatgctgagctttgccaccaagtttgactcaaaccttcatcctttcaagcctgaaaatggggtctgcaagtttgttgatcctacaagttttgctgctgaggtgccaaataaatgtgggcatggctgctgcagttctcatgggcaacttcgtaagaactcattgctgggtcccgagtttaatgagtttgaagatcatccaccaatttcagatagtagttttgcttcgttggtgtcagaaattagcagcattgcctggatgaaaagtggtttgcaaagcagtgacaccttagcgcggtctgttccaccagcttaacagattaggataatgtaaattagtgagatgaaacttttggagtcaatttttatatattaaggtgtaatcaagtcaaatcatggttattgttgtatttttggtagatggac

SEQ ID NO: 5214 - DNA, 3341 bp, Oryza sativa
  Predicted polypeptide sequence is orthologous to G2723
gaatcaggcatcattctttagctcctatgccacagatcaattatcaggtaccttttccagtttcctgctgggttccctacttttcatcaagtgcacatctatgttgggaatccaatctttgatgtgctatattagtatatggtgtggatcctgttcttatgatgtcaccgtcacataattacatgcttacttgcagaggtaaatacatgattaatcagaaaaatatcagaagtttttctttgggagtgctaggagtttggttcatttgatcataaattttcttagcttgtttcatctttcatattatttttctcaatgcaccacatatcatgacaggctgatattgttagtcaacgtgatcaggaaatccaatacccttggctggtaagtttgagttataaatattcaaataaatatttgagtccttttgttttcaagtaccaaatccatagaatagattattgccaagagagcaccctggtacttgactgtagagatttgtatcccatgtaatacaagaatcttggccacttgcatggtgggggttcttccccatcgtccacaccttaggatgttgacgatttgaattatcacgtgggagattcgcatatgtgcaggtgacttttgtttttgctgatgcgactgatgtaaaggagccagtaagtattttgtaatccacactttcaggcataacctatttctaaactctcatcatcataactggatgacctgttcctctctcttattaaaaacttgcagtttgtggcctagtcaactatttgatgttggccaaaatgtagacgtggcaggactttcattttaattggaagtcctgaggactaagatgaaagaacaaaaatctgaagtaaatgctaagaatttacaatgttaaaaaaaaaactgaactaccaaatcgcattttggcaggaacaaaccatttagaaatgttcagcgaattcattttgtatagcttttgaagttctcttgaacaattagtcctttgagaaaagaaagttatggaatgatgccattggaatgttcaccaagaaagagaaataaaacatgattttctacatggaatggaccattgttataataagtggtaatttcaccatcctacagggttaccagaaaagaaattccttagactgtttggatcatgcttggatcagatctgtcattttctttttatagaaaatctggaggttcatagtaccctgaactatctaccaatcactgtgctacggaaatcaaacatgtaagtatgtatcctctcgcataacatgcagttatcccatgaatctagttatggcacttcattgtacactagatcctatttacatattttttactagaataaacctatattgctcccaccagcaaggttagtgacattttgggatgactgcaattacattgaaaaaaaaggtttatgtaagtttttcttgaaaaatgtgttcatgatatatttatattccgtaaacatgttacagtagaaattaatggccaaacccaaacttacatgtcaatttccaaaatgtcaattatctgtgactggacatcaaagtgacttaatgtttgaatgaaatagctattttcaatatagtttctgtctatgaacattttgactgaatatctccagtatgtcgtcattatgcgcaaaggggttgaattctaggtgttgatatggattgtttttatctgttttgtttgactacatatcacagttgaataatatatctggtttgcatgtcattcttttctagcaccatgacagattagtttagttgaaatatgaaggggtagataagtacttctatcctttctggcgcaataaaagcttattttcctcaattagaggaagtccaaataggcatatatttaatgtgtgtccgttcctactcattttattggcatttcctttaaataggttcagtgaagctgcagagtgaaggttatagtgaagactggcctgctatatgtgcattgcacaagacaatctgcagtctttttgtcctcttgatttgaatataaaggttctaattctactaaaaatgaatataatacaagcattcaataaactgtttaggacttgcacatgtctcatcatttagattgtgataaaataaaaaaaaatatttgaacatttctgtttgagaggggaggatgttaatacaaatttctagtcttctgtttttacctggaaggcttcatagccacagcttctattccaaaaactatttgcttgtcgtaatcactgaattgatacacatttcatggtttctacagccattcagttgacttgaatcagtaccagaaatcacctttacttgaaacattctacaagttgttagtgccaataccttcacatagtgataacatattacctagcatatgttaaccatcaaatgcacccttaacacattgtcccaaacagggatcaaaggataaatgatctctctaaatagttctttttttcttcatatgtgtgttagggttggggtgtggcagagggggtattagaaggccaaacctctgtggtacacgtctatagattccaaataaatgatacagtacctctttggtactcccatcaacatggttcacaccacaccactacaccagtgacaccaccaccaccattacagggtatttttcttggcccctctgtataaatagcagcaccatgttcactctttgttccattgaaatacaagcaaccataaacagtagccatttctaggaccttggcctttcttgaaggaggatgagttcatcctggacaacaaagcagaataaggtgtttgagagggcgctggcaatatatgacagggatacgccagatcgctggcagaatgtggcacgggcagttggtggtggaaagtcagttgatgatgtgaagaggcactatgaaaagctgatcaaggacgtggatcgcattgactctacaggaggccatcaaggatcccattacaacagctccaatgctagcagcagcagcagcagcagcagcagcaactctcggggcagtgccaatgaggaccagaggaggaggtaccacaactttcagtgaatgtgacattgacatctcgaaagccgaaagcagcctgagttccagcaagaccgacacatatgatcgactgtccctgcagatgctaccttcactatttcgtttatgttttctattatgcgcgtgtgtgaatcagaactggccctaatagaccagtagttagtaacttagtttcaattgagctatgactggtttgctgaattatactgttgtattccatctgacgatgctgtatatgtaatatctgatggaaagtttataatcttctccg

SEQ ID NO: 5215 - DNA, 2371 bp, Oryza sativa
  Predicted polypeptide sequence is orthologous to G274
gggcgaaatattttccgcggcgccgcgcgtaccgttcgtccgtcgtcggtggagtggaggctgccgaactgtaaagctcacgggttgggcgaatctccactcctcactcgccccccactgaaatcgccaaaaacccaactgaaaaacccccccaccggaatcctcacgcacacacctcgccgcggaagctgtggcgtccgcgtaggagcagctgtttcttttttggatccaatccaatcggataagcagccatggctgtgaaggcgagttctgcagataacaggaccagaagcaccgtgtcactatgcatagtgattggcatgtgctgcttcttctacatccttggggcatggcagaagagcggatttggaaagggggacagcattgcgctggagatcacgaagcgaacggactgcacaatcttgcctaaccttagcttcgacacgcacctcgctaagcaggcaaggcctcgcgatctcgtttcgccggcgaagaagtttaagccgtgcccggatcgctacacggattataccccttgccaagatcagaacagagcgatgaagttccctcgggagaatatgaattacagggagcggcattgcccaccgcagaaagagaagctgcactgcctgataccgccacctaagggatatgttgctccattcccatggccgaaaagtcgggactatgttcctttcgcgaattgtccctataagagcttgacagtcgagaaagcgatccagaattgggttcagttcgaaggcaacgtcttcagattccctggtggaggaacacaattccctcaaggagctgataagtacatcgatcaacttgcatcagttgttccaatcgccaatggaactgtcaggactgcattggacactggctgtggggtggctagttggggagcttacttattaaagagaaatgtcttggcgatgtcatttgcgccaagagattcacacgaggcacaagtgcagtttgctctggagaggggtgtcccagctgttatcggtgttcttgggacgataaaactcccttacccatcaagagcctttgacatggcccattgttccaggtgtttgattccatggggagcaaatggtggaatatacatgatggaagttgatagggttctaagacctggtggatactgggtgctttcagggcctccgattaattggaaagtgaactacaagggttggcagcgtacaaagaaagatcttgaggcggagcagaatgaaatagaggaaattgctgaccttctttgttgggaaaaagtcaaagagattggtgagatggcaatatggaggaaaagattaaacactgagtcttgtccctctaggcaagatgaatcaagtgtgcagatgtgtgactcaacaaatgcagatgatgtctggtacaagaagatgaagccttgtgtgacacctattcctgatgtaaatgatccaagtgaagttgctggaggtgcaatcaagcccttcccaagcaggctcaatgcagttcctccaaggattgctaatggcctgattccaggtgtttcatctcaggcctaccagaaagacatcaaaatgtggaagaagcatgtcaaggcttatagcagtgtgaacaagtacctcctcactggaagatacagaaacattatggacatgaatgcaggttttggaggatttgctgctgccattgagtccccaaaatcttgggtgatgaatgccgtgcctacgatttcaaagatgtcaactctaggggctatttacgagcgaggattgattggcatataccacgactggtgcgaagctttctctacttacccaagaacgtatgatcttatccacgctagtggccttttcaccctgtacaaaaacaagtgcaacatggaagacatcctactggagatggaccgcgtcctgaggccagaaggcgccgtcataatgagggacgatgtcgatatcctgacgaaggtgaacaggctcgccctcggcatgaaatggaacacgaggctggtcgatcacgaggacggccccatggtgcgtgagaaggtgctgtatgctgtgaagcagtactgggtaggcggaaaccagactgcagcagctgcagcatgaagcaggcgtaaatcctaacacaaaagatggaagaactctgcaatccatcctgaactgacttccaggaaaggtaagatacgggagtcatttagtgagaggccaggtgatcttgtcggagtggcgatgaagaagcaacccgggctttcttggttgctctgatgatcggctggcgtatattgttgtaacaattttgtaatttcatttgtcactctctagtgttaactggttacgatgcttaattcaaggtttgcttgtcagttgtcacggtg

SEQ ID NO: 5216 - DNA, 2722 bp, Oryza sativa
  Predicted polypeptide sequence is orthologous to G274
ggcgggtgtagtatggccaccatggcggcatatggccccctttcacacgcacatcctcctctcctttatttatgaaaggggggttgggttagctgggaagaggaaggaagccgctgctgacatgtgacaccgtgtttggcatcacaccacttcactccactggctcagtggctgcctcactcactcaccaattcaccattgctagtgcaagagctcgcataaataggcagagctgctgctcctctcctctccctctcagcctctggaggaggaagagaagaggaggggtctctgcttcatctttcttcctgagctggcttctttactacagcagccatggctaaagagtatcctgcctcccccaaagctcagcagctgcaagaatccaagaagcagcggctcacctacatcctcgtggtgagcgcgctctgcgtcgccttctacgtcctcggtgcgtggcagaacaccacagtgcccaagccggcggcgagctcggcgatcaccaaggttggctgcgacccggcggcggcggggcagtcctccgccgtgccgtcgttcgggtcggcctcgcaggagtcactcgacttcgaggcgcaccaccagctcagcctcgacgacacgggcgccgaggcggcggtgcagccgttcccggcgtgcccgctcaacttcagcgagtacacgccgtgcgaagacaggaagcgcggccggcggttcgagcgcgcgatgctggtgtaccgggagcggcattgccccggcaaggacgaggagatccggtgcctcatcccggcaccgcccaagtacaggacgccgttcaagtggccgcagagcagggacttcgcctggttcaacaacatcccccacaaggagctcagcatcgagaaggccgtgcagaactggatccaggtggacggccagaggttccggttccccggtggcggcaccatgttcccgcgaggcgccgacgcctacattgacgacattggcaagctcatctcgttgacggacgggaagatcaggacggcgatcgacacaggttgcggggttgctagctggggtgcttacttgctgaagaggaacatccttgcaatgtcgtttgcaccgagggacacccatgaagctcaggtgcaattcgcgctggagcggggtgtgccggccatcatcggcgtgatgggaaagcaacggctgccttacccatctaggtcatttgatatggcacattgttcacgctgcttgattccttggcatgagtttgatggaatatacctagctgaagtcgacagaattctaaggcccgggggatactggattctctcgggtcctccgatcaattggaagacacactacaaggggtgggagaggactaaggaagacctcaaggaagagcaagacaatattgaggatgtcgcgaggagcctttgctggaacaaggtggttgagaagggggatctctccatctggcaaaagcctaagaaccaccttgaatgtgccaacatcaagaagaagtataagacaccccatatatgcaagagtgacaatcctgatgctgcctggtacaagcagatggaagcatgtgttactccattgcctgaagtaagcaaccagggtgagatcgcaggtggagctttggagagatggccacagagggcattcgcggtccctccaagggtgaagaggggtatgattccagggatagatgcgagtaaatttgaggaggacaagaagttgtgggaaaagagggtggcgtactacaagcgcaccctacccatagccgatgggagatacaaaaatgtcatggacatgatcgcaaacttgggcggatttgctgcttctttagtgaagtaccctgtgtgggtgatgaacgtcgttcccgtaaattcagaccgggacacgcttggagcaatttatgagcgaggattcattggcacgtaccaggactggtgtgaagctttctcgacgtatcccagaacctacgacctgttgcatgctgataatttgtttagcatctatcaggacaggtgtgacataaccaacatcctcttggagatggacaggatcctgaggcccgagggcacggcgatcatccgcgacacggtcgacgtcctcaccaaggtccaggcgatagcgaagcggatgcggtgggagagccgcatcttggaccatgaggacgggcccttcaacccggagaaggtccttgtggcggtcaagacatactggactgctgatgaatcagagcagcactagcacactgcacacagcacagaacacaggctcggctacctctctgaagactgaagaagtctgaacccccgattgttttcagagctgtgatgatggcatcggagttttgccatttcggtgtaacataacagaagatatcatctggtcacttgttttcttcctcctttcgctaattctttctatatcaaaggaaaagttatggatggtttttggggtgagattgggcatggttggatgatacatgagtttgttagcaaggggaagaaatgcaaatcttgcataggttcctgccccagtttcacgcatggagcagacagcagaggataggttttttagcttgtaatatgatggcgtccaagtatccaacagacactgttaatctatattgaggttaactaagataggtatttatctagtttatctgtgttagctcttggaattatcagtttattagttaattaagttcttgatgctccttaaaacg

SEQ ID NO: 5217 - DNA, 2438 bp, Oryza sativa
  Predicted polypeptide sequence is orthologous to G274
ggcgtcctctcttcttccgccgtggactcatcgtctccaacgccacacgacacgacgcgacgcgacgcgacgcgagaaaaagtcaaaagcagcagcagcggcggagcaaccaagcctacctccaccaaaatcttctccccccctctcctctcctctccacccgccggtgacccgagcccccccaccgcctcacgccgccgccgccgccgccgcggggagttccattccaccgggtcgccttccggccgtctcctgcagagaggttcatgaggggctcgaggatgaatccaggtgaccgtagaacgcggagcacgatgtccatcgtaattgtgatgagtttgtgctgcttcttttatatactaggagcttggcagaaaagtgggaccggaaggggggatagtattgcattgagggtgacaaaagagaccgactgtacaatcttgccaaacttgcactttgagacccatcatagcttaggtggtgttaatcctttggtcatgaccgataaagtctttgagccatgccatattcgatacagtgactatactccttgtcaggatcagaaccgagcaatgaactttcctagagaaaatatgaactaccgagagaggcattgtcctacagagactaagaaactgcgctgtctaatcccagcacccaaaggctatgtcaccccttttccttggcccaagagccgtgactatgttccatatgcaaatgcaccatataagaatttgacagttgagaaggctgttcagaactgggtccagtttgagggagatgtgtttagatttccaggaggggggacaatgtttcccaatggagcaaatgcctacattgatgagcttgcatccgtcattccatttactgatggcaccattaggactgcacttgatactggatgcggggttgccagctggggtgcttacctaatggacagaaatgtattaaccatgtcatttgcacctcgagactcacatgaagctcaggttcaatttgcattggagcgaggtgttcctgcagtaattggagtgcttggaactataaaactaccatacccctctggatcttttgatatggcccattgctcacgctgcttaatctcctggaagtcaaatgatgcgatgtacatgtttgaagtagatcgggttctgaggcctggtggctattggatattgtctggtcctcccatcaattggaagacaaatcaccaagcatggaaaagatccaaggaagacttagaggcagaacaaaatgtaatcgaaaaaattgctgaaatgttgtgctggggtaagattcatgagaagggagatactgttatttggcgcaaaaaggcagattcaaatgaatgtcataataaggatgaccatcctagcaagatgtgcaaaattcaagatgcagatgatgtctggtataagaaaatggaaggttgtataacacctttcccggaagaagcacagctacggaaattcccagagagactatttgctgcccctcccagaattctacagggtcgcaccccaggtgttacagaagaaatttttgaggaggataataagttgtggaagaagtatgtcagtacttacaagaggataaacaagctgataggttctttgaggtataggaatattatggacatgaacgcagggcttggaagttttgcggcaattattgattctccaatatcttgggtaatgaatgttgtgcccacaatatctgagaagaacactcttggtatcatttacgagcgaggtcttattggcatataccatgattggtgtgaagccttctctacatatcctaggacatacgacttgatacatgccaatggtctcttcagcttataccagaataagtgcaacatggaagacattcttctggagatggataggattttacgtcctgagggcgcagtcatactgcgggacaatgttgaggtgctgaacaaggttaggaggacagtgatggggatgcggtggaaatccaagttgcttgatcatgaagatgggcctcatatacctgagaagattttggtttcagtgaaaaagtattgggttggcaatgaagaagaaaacagttcatagataccctttttttatgttgtacctgttcatagatccggttcatacttcataggtacaggcctcaccattcccaatcaagatgacatacaggtagagtattttttatgtcctgcatattggttgtgcatatacagaagcagggcattaagggcaaacgttggtgatttgccaacacattttgtaggtaaagaggaagatagtttgtgctgagatgaacgtacccattgtattacagatccacacaggaacattttccgagtgaacaagtgttgccccatgtattttgtttgtgctgcttgtacaacatggaacattagcagtacatgtacaagtaacaaggagacaaggagttgt

SEQ ID NO: 5218 - DNA, 3063 bp, Oryza sativa
  Predicted polypeptide sequence is orthologous to G274
gagaaaggcgaatcgccccaatcccacaagaggcgaggggagagaggagagcgcgcagcgggagcagcagaagccgccagccagccatggcggtgggcgcgaccgccacgaagctgcacatgccgtccgcgggcggccgccgcccgtccctgttccacctcgcggccgtcgcggtgctctgcacggtgtcctacctcatcggcatctggcaccacggcggcttctccgcctccccggccggcggcgtcgcctcctccgtctccatcgccaccaccgcctccgtctcctgcgtctcccccaccccgacgctccttggcggcggcggcggcggcggcgactcctcgtcgtccgcgccgctcgacttcgcggcgcaccataccgcggaggggatggaggtggcgtcgggccaggtgcaccgcacgtacgaggcgtgcccggccaagtactccgagtacacgccgtgcgaggacgtcgagcgctcgctgcggttcccgcgggaccggctcgtgtaccgggagcggcactgcccgtcggagggcgagcggctccggtgcctcgtgccggcgccccaggggtaccgcaacccgttcccgtggccgaccagccgcgacgtcgcgtggttcgccaacgtgccgcacaaggagctcaccgtcgagaaggcggtgcagaactggatccgcgtcgaaggcgaaaagttccggttccccggcggcggcaccatgttcccccacggcgccggcgcgtacatcgacgacatcggcaagatcatccccctccacgatggatccatccgcaccgccctcgacaccggttgtggggtagcgagctggggcgcatacttgctgtcacgcaacatcctggccatgtccttcgcgccacgtgactctcacgaggcacaggttcaatttgcactggaacgtggtgtgccggcgatgatcggtgttctttcatccaaccggctcacctatccagctcgtgcctttgacatggcacattgctcccgctgcctcattccctggcagctctacgatgggctgtacttggctgaggtggatcgcattctgcggccaggagggtattggattttgtctggacctccaatcaactggaagaagcactggaaggggtggcagagaaccaaggaggacctgaatgcagagcagcaagcgattgaggcagtggccaagagtctttgctggaagaagatcacgctcaaggaggttggtgacattgccatctggcagaaacctactaaccacattcactgcaaggcctcccgcaaagtcgtcaagtccccacccttctgctcaaataaaaatccagatgctgcatggtacgataagatggaggcttgcataactcctctcccagaggttagtgacataaaagagattgcgggtggccagttgaagaaatggccagagaggctcactgcagtgccacccagaattgccagtggtagcattgagggtgtcactgatgaaatgttcgtggaagacaccaaactatggcagaagagggtcgggcactacaagtccgtgataagtcaatttggacagaaaggacggtaccgcaacttgcttgatatgaatgcgcgctttggcggcttcgctgcggcattggtggatgaccctgtgtgggtcatgaatatggtcccaactgttggcaattcaacaactcttggggttatatacgagcgtgggctcatcggaagctaccaagactggtgtgagggcatgtccacgtaccctcggacctacgacctcattcatgccgattcagtgttcacgctatacaaggacagatgccagatggacaacattctgctggaaatggacagaatactgaggcctgagggtacagtgattataagagatgatgttgatatgttggtgaaaataaagagcattaccgacggtatgagatggaacagccaaatcgttgatcacgaagatggcccgctcgtccgggagaagctcctccttgttgtaaagacatactggacactcggggaagaaaaggaatagcaataacgtgaaataaagtgttagaaaaaattgacatattgggcaaatatcgtaatcggcttaccatttgccttgtggatttgaagtttctttttccatttcattctttgggtggaatagttcacatatggagttcagccctcgatgtttaggtgtaaaagaggtgctgagaaggaaaccctgcaaagttttttacattaaaggacaaccaaagtattccaggtctggtttctacggtcagtagcattcttcatgcgctgtcatcaggcattttagtacggagtaccagtgtaccaccatagtacgcctactctccctagaacagtagaactaccgtggaatgtttacatggctagacgcaaattgtctgaactgcctttacgtttgctcgcacatgctactggagtgctgaactcaactactatgcctgtgaggtttgactctggattcagctgaaaatttggtggcccacactgagcgtaccatatgcattcgtctacactaactccagatcttgcaagtaatggactaacggctaattaaagagttcatcaccattggcatgcatgcaatgcgacggcaacagaacgcactggtccccgacaggaggagcagaagaaacaattcacttttgggcgatcggtgcatgtattgaaatgatgaggacacttgacagaccacgaggtccccctgtcacaaggattcatctgagatatcccccattatccaccggaagaacagtgatgcataccaccttacagctaaccaaagtgtcaatctcacctaacgctgcaataacagagctcttaacagtggcatctctgtatacaataggagggctactggttactggttagctcgcaacagtggttacttgttagctgttgagctagcaatggcaatcagtctatataggatgctagtggtagtggttaagaatcttctgtcaaggacatgcacggagaaaaaataattgacatttagtttgtggtaatgccataggccagagcaaataatacagtaaattttcatgtcc

SEQ ID NO: 5219 - DNA, 2289 bp, Oryza sativa
  Predicted polypeptide sequence is orthologous to G274
ggggcagcgtgacagtgtgtcccccccgcctcgccacctaaaaccccacaccacagagcgcagtgcacgactgcacggcccgcgccatagacagcacacgctccggggagctgaagcggagctgaggctgtctgtcggcatgggggtccgcccggcggccaccaagctgaacatctcccccgccgccgcgcggcgcccctcctccttcctgcccatcgccaccgtggcgctcctctgctccgcgtcctacttcctcggcgcgtggcagcacggtggcttctcctccccctccgcctccccatcctccgtctccgtcgccaccgctgtcgcctgcaccaccaccaccaccgccaccacccgctccgccacgcggccgcggaagcggacgcccgcggggcaggggcaggcgctcgacttctcggcgcaccacgcggcggccgcggacggcgccgtgctcagctcgtccggggattcggcggcgacgcggaggtaccaggcgtgcccggccaggtactcggagtacaccccgtgcgaggacgtgaagcggtcgctgcggtacccgcgggagtggctggtgtaccgggagcggcactgccccacggggcgggagcggctgcgctgcctcgtgccggcgccttccgggtaccgcaacccgttcccgtggcccgccagccgcgacgtcgcgtggttcgccaatgtgccgcacaaggagctcaccgtcgagaaggcggtgcagaactggattcgcgtcgacggcgacaagttcaggttcccaggcggcgggaccatgttcccccacggcgccgacgcgtacatcgacgacattgggaagctcatcccgctccacgacggctccgtccgcaccgcgctcgacaccggctgcggggtggcgagctggggcgcgtatctgctgtcccgcgacatcctggccatgtccttcgcgccgcgggactcccacgaggcgcaggtgcagttcgcgctggagcgcggcgtgccggccatgatcggcgtgctcgcctccaaccgcctcacctacccggcccgcgccttcgacatggcgcactgctcccgctgcctcatcccctggcacctctacgatgggttgtatctgatcgaggttgaccgtgttctgcggccgggagggtactggatcctgtccgggccgccgatcaactggaagaagtactggaaagggtgggagaggaccaaggaggacctgaacgccgagcagcaggctatcgaagccgtcgccaggagcctctgctggaagaagatcaaggaggctggcgacatcgctgtctggcagaagcctgccaaccacgccagctgcaaggcctcccgcaagtccccgcctttctgctcccacaaaaaccccgacgcggcatggtatgacaagatggaggcctgcgtgacgccgctcccggaggtctcagacgccagcgaggtcgctggtggcgcgctgaagaaatggccgcagcggctcaccgccgtgccgcccaggatatctagaggtagcatcaagggcgtgacatcgaaagcgtttgtgcaggacaccgagctgtggaggaagcggattcagcactacaagggggtgatcaatcagttcgagcagaaaggacgataccgcaatgtgctcgacatgaacgccggcctcggcggtttcgccgcggcattggccagcgaccccttgtgggtcatgaacatggtccctaccgttggtaactcctccacgcttggggtggtctacgagcgtgggctcattggaagctaccaggactggtgcgagggcatgtccacttatccacggacgtacgatctcatccatgcggactcggtcttcaccttgtacaagaacaggtgcgagatggatatcatcctgctggagatggacaggatcctgaggcccgagggcacggtgatcatcagagacgacgtggacatgctggtgaaggtgaagagcgccgcggacgggatgaggtgggacagccagatcgtcgaccatgaagatggcccgctcgtccgggagaagatcctcctggtcgtcaagacgtactggacagccaaggagcaagaccaatagcagcagtagtgtgaagaattgaattactgcaagccagcagcaacaacattgttgagaagttcccgtaatcgggtcgccatttctagctcgtttcttcagttaaggtttttttatgttcttttggactgtagcactatagaagatttgtactgcctggtaggtgtaatacagggcagaatatgggaaggggtggatattacaaagatttt

SEQ ID NO: 5220 - DNA, 1857 bp, Oryza sativa
  Predicted polypeptide sequence is orthologous to G274
atgctgctgcgtaccatgaagctcccgctccccgccatggccgccgtcgtggcgctctgcgccgcctcctacctcctcgccgtgtggacgcaccctgccccgccgctccccgcctcctccctcgccgccgtcccgtgcaacacgcggcagccaccggcgcccgcggcctcgaagaacgacaccgccctcgacttctcgatccaccacggcgcgtccgaggaggacgcggccgaggcgggggcgccgccatcgcgccgcgtcccggcgtgcgacgcggggtactcggagcacaccccgtgcgaggggcagcggtggtcgctgcgccagccgcggcggcggttcgcgtacagggagaggcactgccccccgccggccgagcggcggcggtgcctcgtcccggcgccgcggggctaccgcgcgccgctccggtggccgcggagccgcgacgcggcgtggtacgcgaacgcgccgcacgaggagctggtgacggagaagggcgtgcagaactggatcaggcgggacggcgacgtgctccgcttccccggcggcgggaccatgttcccgcacggcgccgaccggtacatcgacgacatcgccgcggcggccggcatcacgctgggcggcggcggcgcggtcaggacggcgctggacaccggctgcggggtcgcgagctggggagcgtacctgctgtcgcgcgacgtgctgacgatgtcgttcgcgcccaaggacacgcacgaggcgcaggtgctcttcgccctggagcgcggcgtcccggccatgctcggcatcatggccaccaagcgccttccttacccggctcgcgccttcgacatggcgcactgctcccgctgcctcatcccctggagcaagtacaacgggctctacatgattgaggtggaccgggttctccggcccggcgggtactgggtcctgtcagggccgccggtgaactgggagagacatttcaaggggtggaagaggacgccggaggacttgagctccgagcaatcggccattgaggccattgccaagagcctttgctggaccaaggtgcagcagatgggtgacattgctgtttggcagaaacaaatcaaccatgtcagctgcaaggctagcagaaatgagcttggtggtcttggtttctgcaattccaaccaagatcctgatgctggctggtatgtgaacatggaagagtgcatcactcccctaccggaggtgtccgggcccggagacgtcgccggaggggaggtcaagagatggccggagaggcttacatcgccgccgccgaggatcgccggcggcagccttggaagcagcgtcacggtggacacctttatcaaggattctgagatgtggaggagacgagtcgatcgctacaagggcgtcagcggcgggctggccgagaaaggccggtaccggaatctgctggacatgaacgccggcctcggcggcttcgcggcggcgctcgtcgacgatcctgtctgggtgatgaacgtcgtgccgacggccgccgttgccaacacgctcggcgtgatctacgagcgagggctcatcggaacgtaccaagattggtgtgaggcgatgtcaacttatcctaggacgtatgatctgatccatgcgtactccctgttcacaatgtacaaagacagatgtgaaatggaggacattttgctggagatggaccgtgtgctgaggccagaaggcacggtaatattcagagacgatgttgatgtcctggtgaagatcaagaacatcgcagacgggatgagatgggagagcaggatcgttgatcatgaggatgggccgatgcagagggagaagatccttgtgtctgtcaagtcttactggacagcctaa

SEQ ID NO: 5221 - DNA, 2310 bp, Oryza sativa
  Predicted polypeptide sequence is orthologous to G274
gatgaatccaagatccgcttctttctcctgcggttgctctgcgctctcagcaccaaccaaatccccctccaattcctcatctttcttgaccaattcttgaaatcaatcagacgcaataatcaaccactattcttattatagttggatcataattaatcaaggtttgaggtggatccatggcgatcaagggcggcggcgggtcggcggagaacagggggcggagcccgctcgccatggtggtcgccgtcggcctctgctgcttcttctacctgctcggcgcgtggcagcgcagcggctacggcaagggcgacagcatcgccatggccgtgaaccggcagacggcggcctgcggcggcgtggggctgagcttcgagacgcaccacggcggcgccggcgtggagaacgagaccatggcggcgccggcgccggagttcgcggcgtgcgcggcggcgatggcggaccacacgccgtgccacgaccaggagcgcgcgatgaggttcccgagggagaacatggtgtaccgggagcggcactgccccggcgacggcgagctggctgcggtgcctggtgccggcgccgccggggtacgtgacgccgttcccgtggccgcggagccgcgactacgtgccgttcgcgaacgcgccgtacaagagcctcaccgtggagaaggcggtgcagaactgggtgcgacacgagggccgcctcctccgcttccccggcggcggcacccagttccccggcggcgccgacaagtacatcgaccagctcgccaccgtcgtccccttcgccgacggctccgtccgcaccgtcctcgacaccggctgcggcgtggcgagcctgggcgcgtacctggacgcgaggggggtgatcgccatgtcgttcgcgccgcgggactcgcacgaggcgcaggtgcagttcgcgctggagcgcggcgtcccggcgttcatcggcgtcctcggctccatcaagctccccttccctccccgctccttcgacatggcgcactgctcccgctgcctcatcccctggtccgccaacggtgggatgtacatgatggagatcgaccgggtgctccgggcggatggctactgggtgctctccggcccgccgatcaactggcggaccaaccacaaggcgtgggagcgcacggaggcggacctcgctgccgagcagcagctgatcgaggagtacgccgcgatgctgtgctgggagaaactcgccgagatgggcgaggccgccgtgtggcgcaagcgccccgacgccgctgttgtgtcttgccccacggccacgccggcgccgccgaggacgtgcgacgccgccgccgccagccccgacgacgtctggtacaagaagatggagccgtgcatcacgccgccccaagcggccggcgaggtgatgctgcggccgttcccggagaggctgacggcggtgccaccgagggtggccgccggcgaggtgccggggctcaccggcgagtcgtacgcggaggagaacgcgcggtgggagaggcatgtggcggcgtacaggaaggtgaactaccggctcgacgccggcccggtaccggaacatcatggatatgaatgccggcgtcggcgggttcgccgccgccgtcttctcgcccaagtcgtgggtcatgaacgtcgtccccaccgccgccgagctctccacccttggcgtcgtctacgagaggggcctcatcggcatcttccatgactggtgtgaggcattctccacttacccaagaacatatgacctcatacatggcaatggtgtcttcactctctacaaggacaagtgcaagatggaggacatcctgctggagatggatcggatcctgcggccggagggcacggtgatcctccgggacgacattgaggtcctcctcaaggttcagaggatcgcgagcgggatgcggtggaagatgatcatggcgaaccacgaggacagcccccacataccggagaaggtgctctacgccgtcaagcggtactggaccgccgacgacaagagctcggagccggagccagagccggagaagatgaagaagaaggcggggagctcttcacaagagaggagctccgaggaggaggaggagagtacagcaagttcttcagaagagaagggttcagaggagtaagaggtgctgatcatgtgtgattattttcagttgttggggagttcaattcttttcagtgtgataggggagatcaggagttgtgttctttcgatttgatgattgtcttaggatgaacaatatgatgttcggtagcaggacttagcatttccatagattcaagaagcatatacttt

SEQ ID NO: 5222 - DNA, 2538 bp, Oryza sativa
  Predicted polypeptide sequence is orthologous to G274
tcgatcctggggggtctgagctaatgcgcgccgccccgatctcccgatccggtccgcgcgcgctcgatccccgcgcctgatttctcctccccgcccgtcgccgaggagagctccgtccagtgaggtatggcgcggagttcaactgagagcaggaccaggaccactgtatctgtagttgttttatttggcctttgttccttcttctatctcttgggtgtgtggcagagaagtggtttcggaagaggagacagcatagcagctgtggtgaacgaacagactaaatgcgtggttcttccaaacctgaattttgaaacccatcatagtgcttcagaccttcctaatgatactgggagtactgaggttaaaactttcgagccatgtgatgcacagtacacagattacactccctgtgaggagcaaaagcgtgcaatgaccttccctagggataatatgatatatcgggagaggcattgcccacctgaaaaggataagctctattgtctggttccagcaccaaagggttatgctgctccttttcattggccaaagagccgtgattatgttcattatgcaaatatccctcacaagagcctcacggttgagaaggctatccagaattgggttcactacgagggtaaagtgttcaggtttcctggtggtggaacacagtttcctcagggtgcagacaagtatatagaccatcttgcttctgttatcccaatagccaatgggaaagtgagaacagcactcgacactggttgtggggttgctagtctaggtgcttacctgttgaagaaaaatgttttgaccatgtcatttgcaccaagggataatcatgaggctcaagtacagtttgcactggagagaggtgttcccgcatatataggtgttctcggatcaatgaaactgtcattcccatcacgtgtctttgacatggcccactgctcaaggtgtttaattccatggagtggaaatgatggaatgtacatgatggaagttgatagggtactaaggcctggagggtattgggtactctcaggcccaccaattggctgaagattcactataagggatggcaatgaacaaaggatgatcttcaaagtgagcagagaagaatagaacaatttgcagaacttctttgttggaataagatttctgagaaggatggtattgctatatggagaaagagaataaacgacaaatcctgccccatgaaacaagaaaatccaaaagttgacaagtgtgagttggcatatgacaatgatgtatggtataagaaaatggaggtctgtgtaactccccttcccgaggttaaaaccatgacagaggttgctggtggtcaattagagccatttccccagagactcgatgcagtacctcccaggattacccatggttttgtacctgggttctcagtccagtcatatcaagatgacaataaactttggcagaaacatattaacgcttacaaaaagatcaataacttgcttgatactggaagataccgtaacataatggacatgaatgctggccttggtagttttgctgctgcattggagtccacgaagctgtgggtcatgaatgttgttccaaccattgcagatacttctacattaggtgtaatctacgagcggggattaataggaatgtatcatgattggtgtgaaggattttctacatatccaaggacatatgatctcatacatgctaacgctgtgttcagcttatatgagaataagtgtaaatttgaagatatactattggaaatggaccggatcttacgaccagagggcgcagttataatccgtgacaaggttgatgttcttgtaaaggtggagaaaatagctaacgccatgaggtggcagacaagattgactgatcatgagagtggccctcatgtgcctgagaagatactctttgcggttaaacaatactgggttgttgaaagcaagagcagctaattacatatgctgggttgtttttttccactgagctcccaacaagacctaagacatgacttaattacatatgaagggtatgcatcatctacctcctctgtaaacttatagccactgtagtcaggaatgaactcttggcagcttgagttttccgaaaagttagcacccttgcaatgtggccttgccagttcttttcaaggtaaattgcactgcaggtataaatctttttcaaaaccggctgcctcagtcttgacaatctcaaccacaggtttcatcttttgatgtaaatggcttggatttgaaagttcatgtatgcaaggcttgtcatgaccgtatttcttttagccagttttgtctagccttagctggtgcgacaatttgagaatgctcaaactggcctctaatcttgcttgtttggtgcatttgtgttctaaggaggtgtcgcactgtaatgaaactgagatccataagattctagtattctgatcgtctgaaccgaggtgaccaataatcaaatttagctacgtatgtaatagttttttttctgttggtaacagacgaacgatttatttttagtgct

SEQ ID NO: 5223 - DNA, 2322 bp, Oryza sativa
  Predicted polypeptide sequence is orthologous to G274
gggagtacccttcattcccttgcggcgtaaaagaaagagaaaaatctcccggggcgtctcgtcgtctcctccgctcctcgcgcaggacgagtcgcggctgccgatctccatctgcgccaggggaatcctggtgtaatggcaaaagagcagagtggatcccctaagcccaggcagccagtgttccaaaggatgcgagtaacgttaaccataggtgttattggcctctgtgttgcatcatacattcttggtgcttggcaaggcacttcaactactagtatacacccatccataatctacactaaaagccaatgtggtgaatccattttgcgcacctccagcaattcgtctggacggtcatcatcagacgctcgtcttgatttccaagcccaccatcaggtgagcttcaatgaatcttcacttgtcgccgaaaaattcccaccttgtcagctgaaatacagcgagtataccccttgccaagatccaaggagagccaggaaattcccaaagacaatgatgcagtacagggagagacactgccctcggaaagaagagcttttccggtgcttgattcctgcaccaccaaagtataagaatcccttcaagtggccacaatgtcgggattttgcttggtacgataacattcctcatcgggagcttagtatcgagaaagctgtccagaactggattcaagttgaggggaaacggtttagattccctggaggcggcacaatgttcccacatggtgctgatgcctatatcgatgacatcaacgctctcatatcattaacggacggcaacatcagaactgcgcttgatactggatgtggggtggcaagttggggcgcttatcttattaagaggaacatcatcactatgtcatttgcacctagagattcacatgaggcacaagtgcagtttgcattggagcggggagtgccggccatgattggagtgatatccacggaaagaatcccataccctgctagatcatttgacatggcacactgctctagatgtttgatcccatggaataagtttgatggtatctatctaattgaagtagacagagtaattagaccaggaggctactggatcctctctgggcctccaatccattggaagaagtacttcaagggctgggaaagaacagaagaagacctgaagcaagagcaagatgagattgaggatttggcaaagcgtctctgctggaagaaggtggtagagaaagatgatcttgctatatggcagaaacctatcaaccacatagagtgtgttaatagtcggaagatctatgaagcccctcagatttgcaagagcaatgatgttgactctgcttggtacaagaagatggagacatgcatatcacctcttccggatgtgaatagtgaagacgaggttgctggtggagctcttgagaaatggccaaaaagagcatttgctgtgcctccaagaataagtcgtggatcagtttcaggcctcaccacggagaaattccaagaagataataaggtgtgggcagagagagcggattactacaagaaattgattcctccactaaccaaggggcgatataggaacgtgatggatatgaatgcagggatggggggattcgcagctgcattgatgaagtatccactttgggtgatgaacgtggtaccttcaggctctgctcatgacacccttggtattatctatgagaggggattcattggaacctaccaagactggtgtgaggctttctcaacgtatccgaggacatatgacttcatccatgctgataaaatattcagcttttatcaggacaggtgtgacgtaacatacattctcctggagatggaccggattctaaggcctgaagggacagtgattttcagggacacggtggaggtgttagtgaagatacaatcaattacagaaggcatgcggtggaagagccaaataatggatcacgaatctggtccattcaaccctgagaagatacttgtggctgtcaagacttactggactggacaacccactcaaaagcagtagtggcttttcttttcagcagcagatgttcccttttggtttttccaattttcgtttagctccaggttcaggttgtgtgtaaatatgaggcgatgtgattgggatagtatcaccacgatcttgtggccttggttcattggctgcattgcattcttgtgagttgtgatgcttacatttctataataggcagataaaatgttctttttcttcagtaaaaagaacagggcaagcctgaccttgttattttccttgccaaagtttattgacaaaaaaaaagggtgctatggtacaacg

SEQ ID NO: 5224 - DNA, 410 bp, Oryza sativa
  Predicted polypeptide sequence is orthologous to G274
tttttaaccagagaaaatgattcatcgtaggtaattcgagccctcaaacagatttcataaagcttgagtatcttacttttttttgtacagggtgaaaaggccactagcgtggataagatcatactttcttgggcctgagatgaaacacctggaatcagcccattaacaatccttggaggaactgcattgagcctgcttgggaagggcttgattccacctccagcaacttcacttggatcatttacatcaggaatagttgtcacacaaggcttcatcttcttgtacctagtattacagtggtaagaaaaaaaaataggatgagaaagagattatacaatgtttaaaccagatcagtatgtttgtaatctattagtggacgtaattctacaaatgttatactatcataaatc

SEQ ID NO: 5225 - DNA, 1780 bp, Oryza sativa
  Predicted polypeptide sequence is orthologous to G2747
gctctagcccctctcttgttcaaacaccttcatctgaatctcttgagcctgaattttcccaacacaagcaagcactacaattgagctaagctatagcacacacacacacacacaaaccctgaattcccacttcctaagttcctatagctaagcatatagtagccacaaggagctagctaattcttattagctatagctccagatccctcacaattctaaatttccaatcccaaaagacccaattaaacaagagatagttgcctcctaatccatataataagccctcaaattaactggtagccatatactatcaatagtaacaaggcagcacaagcagcataccataagcatacatcgggtcaaagccgaggtcaagtccaccggcaggaggacaagccggcggccggggcccagaggaggagctgaggcatcatcgatcgatcgatcggcatagtgcacgtacatggagtccatcacgccaatcgtgaggccggcatcggcggcggcgggcggcggcgaggtgcaggagagtggtgggaggagcttggcggcggtggagaaggagcacatgttcgacaaggtggtgacgccgagcgacgtggggaagctgaaccggctggtgatcccgaagcagcacgcggagaagcacttcccgctggacgcggcgtccaacgagaaggggctcctgctcagcttcgaggaccgcacggggaagccatggcggttccgctactcctactggaacagcagccagagctacgtgatgaccaaggggtggagccgcttcgtcaaggagaagcgactcgacgccggggacaccgtctccttcggccgcggcgtcggcgaggccgcgcgcgggaggctcttcatcgactggcgccgccgccccgacgtcgtcgccgcgctccagccgcccacgcaccgcttcgcccaccacctcccttcctccatccccttcgctccctgggcgcaccaccacggacacggagccgccgccgccgccgccgccgccgccggcgccaggtttctcctgcctccctcctcgactcccatctacgaccaccaccgccgacacgcccacgccgtcgggtacgacgcgtacgccgcggccaccagcaggcaggtgctgttctaccggccgttgccgccgcagcagcagcatcatcccgcggtggtgctggagtcggtgccggtgcgcatgacggcggggcacgcggagccgccgtcggctccgtcgaagcgagttcggctgttcggggtgaacctcgactgcgcgaattccgaacaagaccacgccggcgtggtcgggaagacggcgccgccgccgctgccatcgccgccgtcatcatcgtcatcttcctccgggaaagcgaggtgctccttgaaccttgacttgtgaagagggtacggccgtacacgtacacgatctctgctactttatgcttcaattctgctactacgtactgacacaaatggaaatcgtcgacgaagagtgtgaccggagaagtaaacaaaggcggcgatggcggcgcgcagcggcggcggtggcggcggaggtggaggcgcttggagcatctagcgccttcgtatttcgtatatagctcatcatctctcttaaattagtcagtgcagtgtgagggggaacagtttaagaaaaaagaacgaagcagcaacgtacccaaaaaaaatattctttctaggttgatggttttttcttgcttcgatttgctttgcctttttctcttgtgcttaattataattaagttttcttagctgctcg

SEQ ID NO: 5226 - DNA, 939 bp, Oryza sativa
  Predicted polypeptide sequence is orthologous to G2747
atggagttcaccccaatttcgccgccgacgagggtcgccggcggtgaggaggattccgagaggggggcggcggcgtgggcggtggtggagaaggagcacatgtttgagaaggtcgtgacgccgagcgacgtggggaagctgaaccgattggtcatccccaagcagcacgccgagaggtacttcccgctcgacgccgcggcgggcgccggcggcggcggtggtggcggcggtggcggcggcggggggaaggggctggtgctgagcttcgaggacaggacggggaaggcgtggaggttccggtactcgtactggaacagcagccagagctacgtgatgaccaaagggtggagccgcttcgtcaaggagaagcgcctcggcgccggcgacaccgtgtcgttcggccgcggcctcggcgacgccgcccgcggccgcctcttcatcgacttccgccgccgccgccaggacgccggcagcttcatgttcccgccgacggcggcgccgccgtcgcactcgcaccaccatcatcagcgacaccacccgccgctcccgtccgtgcccctttgcccgtggcgagactacaccaccgcctatggcggcggctacggctacggctacggcggcggctccaccccggcgtccagccgccacgtgctgttcctccggccgcaggtgccggccgctgtggtgctcaagtcggtgccggtgcacgtcgcggccacctcggcggtgcaggaggcggcgacgacgacaaggccgaagcgtgtccggctgttcggggtgaacctcgactgcccggcggccatggacgacgacgacgacatcgccggagcggcgagccggacggcagcgtcgtctctcctgcagctcccctcgccgtcgtcctcgacgtcgtcgtcgacggcggggaagaagatgtgctccttggatcttgggttgtga

SEQ ID NO: 5227 - DNA, 1462 bp, Oryza sativa
  Predicted polypeptide sequence is orthologous to G2754
ctcttccccaatccacgccgccgccgcctccgctcctcccctcgagagtcgcaacctgccctttcccaatctcgccgccaaattctccggcgagacggccatggaggtcccaccttttgctcgccccaatcgagcctcgccgttggcttgggaagcggatttcctcgagaggacaaatctcaccatgtcgacggtggagtacgcgcttcctaccgcaatcatgacgtcgccatccttcgtcgcggaaggcgctggaggaagccagatttgcgccatgtattcctttcaagccttcagtgaaatgataaacgagaggaacgctgagcccgggatgatcgacgtcttcctactcccccatcttcccctcaatgacgtctccgatgtgtacgaccagatcggcagcggcgacgccccctaccgcatctcaaatggccccatgcttctcaacaaggtcaatgcttatcgcgagctgattcgcgtgggtaaagagctggcgcctctggagggtctcatgaaaagccttgaggacgagctgcttgtccgtcttaatagcattgtctctatactcaaatcagatggtgaagacatcccgttgccacttgacatgtctgcagcaactcagcttctattcaagtgggaatctgattttgtcgaggcctgtgagatggcaacgaaggccagacgccgcctcatgctggcaactcttctggcaatgttctggtcctccagtgacgactttgtggagaatgaattctcagtcagggagggtgatgcaatctccatgagtcatgtacaagagactctccaaaggttggctccagatctttaccagaatgtgtttggcgccctcaatgaggtacactatacagaggatggaaggccaccgaagagtgtagttgtttcgctcaagaggctaattacagagatcacatccgagatgacacctactgagttcgtagcattctcactggagacgagtcgcagggacttgattcaccagctaagtgatgtgtcccaccaggaatttcgcttgaaggtcttgaggtctcttcagtctgtggcatctgctttaatccacctccacatgctggataaagagatgttggagccccacctctcacggccaacactcttggggtgcaaagattattcaccgctaaaccaggatccatattggccccattttcaagttttatcagatgaggaattaagtgttgaagtccgtcgaggctccctgccaatgttctgaggtttgatttttgtgcaaaaggaggtgaagaactagaggaaagtgaagaggagagaaaagtcgatgttgtttgaaagcttcatgccatattgcgccccttccttctaaggcggatgaaggtggatgtagagcaaatgcttccatgaaagaaagagataatcatttatgctaacatgactgacaatcagaaacaaatccaaaatcacttggttg

SEQ ID NO: 5228 - DNA, 912 bp, Oryza sativa
  misc_feature (559)..(559): n is a, c, g, or t
  misc_feature (591)..(591): n is a, c, g, or t
  Predicted polypeptide sequence is orthologous to G2754
aaccgcatgcgttggtaccggggaatcggccattatggccgggggaattatcgagtactacttggaaacaaaaggccttcaggtttgccgaattgatggcagtgttaagttggaagagaggaggaggcagatagcggaatttaatgacttgaacagcagcatgaatatctttattctaagcacacgggctggtgggctgggtatcaatcttacttcggctgatacctgtatcctatatgatagtgactggaatcctcagatggatttgcaggccatggatcgatgccaccggattggtcaaacacgcccagttcacgtctaccggttggcaacatcacattctgttgagggccggatcatcaagaaagcatttggaaagttgaggctggaacatgtggtgatcgggaagggtcagtttgaacaagacagagccaaacctaatgcactagacgaggcggagttgctggcgctgctcagggacgagcaggacgaggaggaccggatgatccagacggacatcaccgacgaggatctcctgaaggtgatggaccggagcgancttacaggccctcctggcaacgccgacgccgnccctctcgcgcccctgaagggaaccggctgggacgtggtggtgcgacgaaaaacggggggggatgtcacgtcgtcacaggaagtgattcttaacgtcgtggcactaagcaaagctcatgatgagcggcatgggtcgagtggagtgccggaaagaaattgtgaccccattatacatggggtagagacgatcggagaagagaggcttcgcgagtaagggagaggaaaacagtatcaggagagagatagtaacacggctccaatcacggacgataccctgcgcacacgactcagacacagcacacaatcaagagagaaagaagc

SEQ ID NO: 5229 - DNA, 737 bp, Oryza sativa
  Predicted polypeptide sequence is orthologous to G2754
tggatcgatgtcaccggattggtcaaacacgcccagttcacgtctatcggttagcaacatcacattctcttgagggccggatcatcaagaaagcatttggcaagttgaggttggagcatgtggtgatcgggaagggtcagtttgaacaagacagagccaagcctaatgccctagatgaagcggagttgctggcgctgctcagggacgagcagggcgacgaggaccggatgatccagacggacatcagcgatgaggacctcctgaaggtgatggaccggagcgaccttacaggccctcctgccaatgccgacgccgcccctctcgtccccctgaagggacccggctgggaggtggtggtgccgacgaagagcggcggcggaatgctgacgtcgctcaccagttagcttcttcattcgctcgctgttgccgtctatgcatgccgaccgggtggggtgcctacttcacctgtgctgatgagacgatgcttttgtgatatacaatatcccccaagtaattgactgactgggcgttgcacttgcacctactgactaggagtaggaggtgatgtagtagtgtgcactgttataggctcagctgctggaattcattttgcaaggccagaagccttttccagcaagccgtgcaaggaagtggtttttgtcatgatacaattgtctacccagcttatgtgtaagcaagctatgcaatgcaatgctataaatagtttcttcaaggta

SEQ ID NO: 5230 - DNA, 438 bp, Oryza sativa
  Predicted polypeptide sequence is orthologous to G2754
gatgtttgacttttgttttcctcttttggactagggttttagcctcttttgtttcgaggggtttttacagattttgcaggagtggtggtggatgtggaatgttggctaggttttagatcgctgaggctgatttgtgggtgctgttccgtcagggcttgaattcggaggcggctcatggtggaaggaatggtggtcgctgtggcaaatgggacgaaggtggaagcagcaccggccgccggcgccggcgccgctgccaacgcggattcccctacatccgttctggaggatgagatttctgaatgtaagaatggggatgcctcggataccgtggaggcaattaagcaagaggatgatcatctcaaggtgcttgctgaggagagagctgatgattttgtggatgcaagttcatccctgactgtggaacttgcggccaacaac

SEQ ID NO: 5231 - DNA, 1241 bp, Oryza sativa
  Predicted polypeptide sequence is orthologous to G2766
tgggcccgcacggcggcggcggcggcggcggcggagggggcggagggcatgggcatcagctgcaggacgggagcgtggacttgctggcgcggcacagcagctcgccggccggattcttctccaacctcatggccagcaacggctttccaggctcaaaaggcgggggaggcagcggagccgaagcccaccaccacccttccatggccggcagcggcagcggcagcagcagcggcgggaggaagatgaagtcccagctgagcttcacggccgggccgccgcacctctcgcacatcgcggaggacggcgccttccccgaccgcgccggcgccgaggcctccgtgccccgcaccttctccgccggcggcagcagcggcggcggcgggttctccatcgtcgggccgtgggaggagtccagggacatcatctccaccctcggcgggtacgagtcccagttcggcggcatggcgagcacgtcggcgctggagatggccggcatggacaggtacctgcagctgcagcatgaccaggtgccgttcaaagtgcgggccaagcgcggctgcgcgacgcaccccaggagcatcgcggagagggtacgtacgcaatatcatgatcaaaacgcctctatatttgcttttgctttctcttcagatcttgacacatgagcatgtacgtcggtgtgatcgatgcgcgtccgtaggaacggaggacgagaattagcgagaagctcaggaagctgcaggagctggtgcccaacatggacaagcaaacaagcacagcggacatgttggaccttgcagttgagcacatcaagggtctgcagagccagctgcaggctctgaagcatgagcaggagaagtgcacttgctgcagcaggccttgattgatgaagcagtgagacggcgaaactgaaaggtatctatccttagtttggaaccctgattacggatgatactttcatatttccttgagagtaacgcatgcgtggatgcatgaaccaattaatgtcagtgacacaatccaaatcgaccgtgagcattttgtcgaaatgtgtaaattgttagataggacatggcaagggacatgtatatgcatgcctgcatgcatgagtgagtgcatggagctagctactccgaaatagcggggtgcagccattgtgatcccttaattaattctcgatccactgatgattaattagcttgtaattctgtctttaaaccttttttttaatgacgaggggagag

SEQ ID NO: 5232 - DNA, 1671 bp, Oryza sativa
  Predicted polypeptide sequence is orthologous to G2766
gagccgaagccgcaacctgcaaaaccaagtccacctccgcctccgcctccgcctccgcctccacccaccaccaccaccgccgccgccgcgccgccggagatgaacaggatgacggcgccgcacggggggatgccgccgccgccgatgccggcggcgggggggctggcgaggtacggctcggcgccggggtcgctgctggcgtcgatcgccgactcggtgatccggggccgcggggttggggttgtcgatcagctgcatcatcatcagcatcagcatcagcttccgccgccgccgccgccgcagcagcagcagatggtggggaggtacttctccgcggagtcgtcggggctcacctcctgcgagtccagctgccggacgacgacgacgacgtccacagcggcggcggccgatgtcgggcggcacccgctcgagcgcgcgtacggcggctccggcgagatccacgtcgacgcctcctccgccgccgtcccgctcttccgccacagcagctcccccgccggcctcctctcccgcctcatggctgacccgcacggcaatggcatggccgcgacgagagggatgggcggctactccggcggcggcggcgacgccggcgcgatggcgcacaggaggctgagctcgcagtggagcttctcgcggcaggacctgccgcagatatcggagatgggcggcctcatccccgacatcggggagagcatcgtcaccggcggcggcggcaacagctccagcgatggcgccggccacggcgcgcagtcctcctccttcctctcctccaggaacttctccatgagctcctgggacgacaccaactccatcatgttctcgcccccgagcagcagcaagaaggcccgcgtcgccgccgccgccgccggcgaccacggcgacgacatggtctccagcttcagcaacatcgactcccagtttggcttgtcgaagcagtcgtcgctggagatggccggcatggatgacttcttgcagctccagccagactccgtcgcctgcagggcccgggcaaagcgcggctgcgcgacgcacccgcggagcatcgctgagagggagaggagaacgaggattagcaagaggctgaagaagctgcaggatctcgtgccgaacatggacaagcaaacgaatacatcagacatgttggatattgctgtaacctacatcaaggagcttcagggccaagttgagaagctaaaacatgaccaagcaaactgcacttgctcaggcaagcacgattgctgaggctggagaaccagatctccgagctaatgttgtaatgatgtgattggtgaacccaaagttttgcttcagaagattagggtgtaaaagcacttcacatgtcaagtggcctccatgcctcgccctcccctttatcggttgtgttatggacagcgtcaatgacttgaagagtaggcggtgacaaagtagattaattgttgtattttaattgatgtaaggcagtggcttgtatgtaaaatcatccatttcaacgccaatgggattgcttcttattatcattgctcttattaaaagtatcctcctctttggcaccatttttgtgaattaccgactcattactgttgtttttgctgtaaatcaccttgtatgtctccttttcgtttttccaacaaacttattagttgttgtgtc

SEQ ID NO: 5233 - DNA, 1757 bp, Oryza sativa
  Predicted polypeptide sequence is orthologous to G2766
gagtcgctcgctcgctcgctggctgactgcgcccgcgcccgctttgctgcgctcccccggcacgcgacgacgaaaagaccggcctcaaaagcgacaccacgcagcagacgcagcgcccccgcgcggagaagctagctaggtactcctgtctggttagctagctagctatagctagaagcctagcacatgaacccggcgccgtcgagggcgccgcagcggcagcagcgcggaggggagatgtcggcgcgctacggcggcgggctgcagttcttcgctgacgccccgccggcgggggtggaggggggcgccgcgaccgcgcggacgttcttcccggtgccgggcgggggaggggagcagcagccgccggagcgcgcgatgaggcagcagcactacggcggcggcgggagtggtgcggccgagatctcgctggggcacggccacggccacggcggcaagcaccatttccatcagttcggcgtcgaggcgaaggacggtggcggcggcggcgaccagtcggggtttctgacgcggcacaacagctcgcctcccgggttcttctcgagccccgtcatggacaacggtttctcatcgagtgctagaccagcaggatcatcactcggtgaggttcgccatggcgccatgagcagcagcagcaacaacaacaagaagatgaaggccccactgagcttcgctagcagcaggcagggctccggcggcctctcccagatatccgaggacggcatcccggacctcactgacagcatccatggcgccgctcatcatcatgggcgctccgaggagaacgtctccacccacgaccacgtcgtccgctccttctcctccggtgggttctcgatcgggtcatgggaggactccaactccatcgtgttctccacgtcgacgggcaaatcaggagcgcacggcaacgacgacatcatcgccacccttagcaactacgaatctcagcttgttgcgcccagggagatggctggcgtagagaaatacctgcagatgcagcacgaccaggtgccattcagagtacgggccaagcgtggatgcgcgacgcacccacggagcatcgcagagagggagagaagaacgaggatcagcgagaagctcaggaagttgcaggccctggtgcccaacatggacaagcaaacgagtacttcagacatgctggacttagcagttgatcacatcaagggactgcagagccagctgcagactctgaaggaagacaaggagaaatgcacctgcagctgcaagcaagcatcaaggaacagaccagccgactaaaatgggatgtgaagcaaattgcagtgctggctagtttgatgacatttctccttggtcctcaaaacatgtttgcctggcgacaggaaattaaaggtatagcaggcagcatatagcgtgacaagagcaaagtaatggaggtcatcagtctcttccaaacgaaaggtcgaagtcgtctgatcaaacctttaccagtgaatcgatcagtccagtcttttttcttttgtcagtgtgaccaaccccttttgttgagctgtaaaattaattgaaactagactagaattgttccttcctttaacaaggagctctgctgctctggatgttaggcttctagctgtcctgttgctgtggtaaatagtgattggttcacccagcggttagcaaataatctggttgctggtttcagggtattctccggccaacattagacaagattcagtgatgtgttatgattcatacagatc

SEQ ID NO: 5234 - DNA, 3486 bp, Oryza sativa
  Predicted polypeptide sequence is orthologous to G2766
gtgtcccccactggcacatactccaggggcatatgtgctgttattactgtacacaagtaagcttaattaacttcaataatggtgctcgtgacagtgcaataatgcatctctggcaagaagtagaacaaaagaaatggaaaagaatcccatcctcgcacactgtatctagtgtactactcctatataagtgcatcaggtttatagttattagttcgaccgttatatttccaattgtagagcttgagtactgcctagcaagtttagtatgacttcctccgtttttccaaatacatgtaactgttaattagtattattatagcttcaatcactaataatttttaaatattttgactataaaaagtcatattgtttatatttaggatgttgatccaaaacacaacaacgacacagatttatagtaaaaaatgtccgttactaatgtaacttagggctaaatataggtagtctccagtaattacagctgaaggaatagtactaagcagcgtgacactgtcctatacattatgtgctgcaacatacttagtacaatgtacagtattatcaagttgatatgattaggctggtgcattgtatgttgccgacatgactgcgaccgtttattggcgcacttgctggcggccatctgcttgcagcgaacctggacacatgtcagtgtccgcagaattcatttcctaacaatgaagcacgtaccactcggttcactgcacctgctactaaacctctctctatcgcaccagaaaaataattttgttgtcgatcaaaacgggccccatggatttaatttttgatttattttcgaaggtgcaagataagtcccccaaaaatgccgttttcttatatttattcggaaggttaagataagtgattcttgttggtgcaggtaggagtatgatttaagataagtgtatcggttagtttaacctgctggctctgtcagctatgctccaatcatgcataatgcaaatgtcaccaacaaaaatatattgtttgtttttctatggtcatggttaattcagaagggataaaacgttatagtaatatcaggttctcgttgagtttgaaaagtcaatccatttttgttgattaatgtcaccatgcataaggtgagtgacagcaacggcagacatatcttgtcgtatgagtcatgctggggccaatagtatattcgagcaatactgcatcactgccttttttcagcatgataaaatagtttgaatataaaccaaggagtataaaggagttttttttttctgtaaagcaaaggttaaaaaaaatattaccagggacggcattaataattgctactgcatcgatcatggtaaattcattactgttgcaacttgcaacttttcatcatgggctgatatatcggatcagatgcattcacggataagatgtaaaggcgatgacaaatatccagcttgagtaatggccaggtgctatgctagatctagtttagattaagccttggctttagcttagcttttgtttatgccttcatggggtaggcttttagataatggatgccccatactgattgtctttactctttagccgatttacacagacatttgctgtttgatggggccaaaaatagtttcttcaccatctgtgtcgtttcttgcagtactgtttggtgtccttgctttctgaaaagaaaattgttcatttctagttttgtatcaatggttagaaccaaaagttgcaacaaaaggttcttgccaaaatcagtcacaaaagttaacttaactaactctgtttagtttcagataatgatgataattaagataagatttttatttttttagaatttttactaacataatgaaagaaactttcaaataaaatttaaaattttctattaaaaattaataacatacctaaaatttaaaattttcaaataaaaatttgaaactctaaactcagatttgaaaactttcaactcaaatttgaaactttcaacttaaattggaaaactttcaacttaaattttaaaaccttcaagtcaaatatttgaaaacacgtgtgctgcagattgaaaaaaaaatcgaaaagaacacgacaaaaattaaaccgcgcggaggagagacaacgcgaaaataggagaaaaatcacaaaaaaaaaaaatcagcaacgttatagttcggcacccttggtcccaaaacaaatttatttttcacctacttatacttattaataaaaaaaattagaataccttcacttatcaaatttaatgcaattatttgtctttttatctactccaaatgtatttatccactacttttataaattccgatgcaacaattattaaaaaataaagttaacttattttgggatgaaatagaggaaacaaatgaacttattctggaacggagggagtaactaatcttcgaggtactacctctatcccaaaatataagacataaccttatattttgggatggagggagtaccatactactgtagtactgtatcaccttgaaagatttttttttttggtaatataagagatttatcgtttatacagtagtttgttttaaagattggccaaaacttacaaaaactgacgtgattgttatgagttattagttatgaccactcactgacagaagaatctgttgcaaaaactgacgtgctgcctgtgatgaattgcaggcaatggcatggccgcgacgagagggatgggcggctactccggcggcggcggcgacgccggcgcgatggcgcacaggaggctgagctcgcagtggagcttctcgcggcaggacctgccgcagatatcggagatgggcggcctcatccccgacatcggggagagcatcgtcaccggcggcggcggcaacagctccagcgatggcgccggccacggcgcgcagtcctcctccttcctctcctccaggaacttctccatgagctcctgggacgacaccaactccatcatgttctcgcccccgagcagctccagccagactccgtcgcctgcagggcccgggcaaagcgcggctgcgcgacgcacccgcggagcatcgctgagagggttagtcataatttggcaattttcccttcacccatctttgcatatgatatgattatgatacgatcgatgttggatgctggtatggagatctcatgttttctctgtgctgttttaggagaggagaacgaggattagcaagaggctgaagaagctgcaggatctcgtgccgaacatggacaaggtaactcaatgaactgtttgggtcatttctaccaattgaacctgacaattctgaacctgattggagctgtgcttgtccctcggttataaatcgaaattagttcaaaatgtttgatgtgatatttactggattcttctcaaatatacagcaaacgaatacatcagacatgttggatattgctgtaacctacatcaaggagcttcagggccaagttgaggtatgctagctccacttcagaaatctcttc

SEQ ID NO: 5235 - DNA, 422 bp, Oryza sativa
  Predicted polypeptide sequence is orthologous to G2779
gaggtgtcattctcttctcaacggtcgacaaagtttcgaaatctacaccgatctatgagcattgctgttggctttgttgcgtgtccaaactcaaattttatttttccagactggccgactttaaaaggcagctgggcgtccgtgtcgaatctttgcctgttgcggtcttcctcccgttattgaaggcgatcgacgagagtatcctcaacgagtcaggctcaccctaccttagtttaagcgcctagcctgtgacgtcgaagtccaccagacatcaacaacctctactgcactctccttctcaacaaccaccgtcgcgaaacaacttccaacgcccaattatctccacaaacacctgaaccactttatcgacgactgcttctcaccagatgacctaggaactggtgagcgcgcaatgggtgggc

SEQ ID NO: 5236 - DNA, 313 bp, Oryza sativa
  misc_feature (73)..(73): n is a, c, g, or t
  misc_feature (97)..(97): n is a, c, g, or t
  misc_feature (235)..(235): n is a, c, g, or t
  Predicted polypeptide sequence is orthologous to G2789
acaatttggaattggaatttatgcccacattcccgggaggttcgatttgttccgactcagatgaccgatacgnaccagctggctggtggtgacgatnttgagcgatggagacgaggatttgtgaggtgtttgagcgagagatgtgacctgagagttgggattcgatccggtgtgtggtgttgtgacgagagtggccgatgacgagtgagcgcgagagtggtggtgggcgacttcnactcctgtttgttttgtgtaaccatacgagcatacagatgataaaactcttgttcacattttaaaaaaaaaaaaaaaa

SEQ ID NO: 5237 - DNA, 1476 bp, Oryza sativa
  Predicted polypeptide sequence is orthologous to G2790
gacccggtctatacatgcaaaacgagccagcaagcgtccctggtccccttccatctgaactccccactggcctgtctccaatcttgagcagttctctcttgcaaaactttaaaagttggaagaagcctttgagagttctgcactctgcacgcacagacaaacgccacagagcggctgcagctaatactagcgcgaaacttctttgacccgaagaaacatccccaactgctaggtatcatggtgaaggaggaggagatcatcacagaggcagcaggagcaagaggctacatggagatgcttgggcttggagaggaggccgccgactacctgatgtgcctgtctccttcttcctacctgtcttctcctgctgcttccaccaccacagctgtggcttctcctacctgtgcctcgtacttggctcctcacccttaccaccacctgctaagcttcagtggtcaggatcagtaccacggtgatgacgtctttgggttacagtattacggcggcgatcaagtaattccggcggtggttccgcagaagtccagcccgaccaccgagtgctcctcctccgtctcctccatgtcgtcctcgccgacggccaccgccatttccagctctaagtcaccggccttcaagaagaagggatcgagaggttgtgatcagaggaaggctactgctcctgctgctgccacaaccacaaacaagagacccagggtgaggagggagaggctcggagagaggatcatagcgctgcagcagctggtttctccgttcgggaagtctgatacggcctccgttcttcacgaggcgttgggatacatacgcttcctgcacgaccaggttcaggtcctgagctcgccgtacctgcagcgcctgcctccctctgctcgcgtcccggagcaggagagaggcacgccggcggcggaggagcaaccgccggcgctgcggccgagcgacctgaggagccgtgggctgtgcctggtgccgatctcgtgcaccgagcatgtcgccggcgccggcgccggcaccggccacggcaacggcgccgacctatggtcggtggcggcgggcatggcgaaggcgacggcgaccgtgacggccgccgtggagaggagcaaggaggcagccgccgccgccgccgccactgccgcattgctgcgtgctgatcgtccagggcagcagctggcctaatctgatgactgccatatactctactctactccactttcttcacagctgcagggttttagaactaagccagatcttttggggggctaatctgttttagaaatcgactagtactaccttttgctgttcttttggagaggctgctgctgagttcatgggaaattggaaagtggcgcagggatgcacattccatcgccagcaaagaactgaagtgtgtaaatggagggtggggttttagctgattaaagtacaagtactaatgctcctgcttaagctttttttaaggtt

SEQ ID NO: 5238 - DNA, 2200 bp, Oryza sativa
  Predicted polypeptide sequence is orthologous to G2791
gagaaggggtgtactagtaaacaaaacaaaaagaataggttgagactttcctgctatcgtcagcattttcagcccccctcccctgggctggctctgcatcatcattcatcatcagcagcagtcagtccatccaacgcgtcttcagtcctcacccgcagcaagaaagccacacttttcctcctcctcctcctcctcctcctccgcctcttcctcttcctcccccttcgttctccacacccactctcgggctgcggattctccggcttccgcgcctcttcctctgtcgggttaacaaagttactttcagcgtcagagggtatttcgtacaaaaaggaactgctgttggtacaggattatcagctgtgaacactttctgtttctagaggccattctctgtaacactttggagcatcaattttgtagcgtgctatcatggactactctgctggttcctacatgtggcctggcaattcaggttctgagaactataattttgttgacggttcgtcggaatcatatgcagaagaaggaagcctaccaccttcaggctatttcatgggagctggatcagatcgcagtttaaagatcacggagaatgaaaggaaccccactatgcttgcaaatggatgcttgccatacaacacccaggctcatccattatctggccagattctacctaagggtgagctccctaacaatcttctggatcttcaacagctacagaacagcagcaatctgcgaagcaattcaattcccccaggggttcttcagtgcaattcaacatctggaacatttgatgcgaaattggatacacctggtcttgcagaactgcctcatgctttgtccagttcaattgatagcaatggtagtgacatttctgcttttcttgctgatgtgcatgccgtttcttcagccccgacgttgtgttcagcattccaaaacgtttcctccttcatggaaccagtaaatctagatgctttcggtttccaaggggcacaaaatgttgctatgttgaacaaaacaagtcttccaaatgggaatccctcgctgtttgataatgctgccatagcatcactacatgatagcaaagagtttctcaatggtggttccatcccttcgtttggtactgtcctgcaggcactaggagcgggtggtttgaaggctgctcaacaggagcaaaatatccggaatatacctctccctacattcacatctggtagtcatttggcagttactgatgcacaagggccaccacttccttcaaagataccaccattgatccatgaccataatagtgagtaccctattaaccattcttctgatgtggaaccccaagcaaattcagctcctggaaatagtgccaatgcgaagccacgtacaagggctcgccgtggacaggcaactgatcctcacagtattgctgaacggcttcgccgagagaaaatttcagaaaggatgaaaaatctccaagtccttgtcccaaactccaataaggcagataaggcatcaatgcttgatgaaataattgattatgtgaaatttcttcagcttcaggtcaaggtattgagcatgagcaggctaggagctcctggagcagttcttccccttcttagggaatctcaaaccgagtgccatagtaatccatctctatcagcttcaaccatttcacaagggccaccagacatgccagactcagaagacagctctgcctttgagcaagaggtagtgaagctgatggaaacgagcatcatcagcgcgatgcagtatcttcagaacaagggtctctgcctgatgcccattgctctcgcttcggccatatccaaccagaaaggcatggctgctgctgctgcaatccctcctgaaaaatgaaaaaaaaaatgaaatcggaaaaatatggggggaacaactgcagaagacataataactcaacggctgcagaaatgtgctggacactgcaggttttgtgaatgaagtgaaatccaatccagggggtcataaaacataggaagttatctgactaattcaggcttatgacacaatctactctatagtctatagctattgtgtgcctgttgcacatcagttgatgtgtattcttttgttttttttgtattgcatccggatgctaattaggtagtagtgtttcctttgatgtacatgagtattatctatgcggttttatctaatgtgcatataaagc

SEQ ID NO: 5239 - DNA, 573 bp, Oryza sativa
  Predicted polypeptide sequence is orthologous to G2791
aaaggcatcggagaccaggagaatatggcgttaattaattaacccggtaggttagtatagcactctgcagttttccccgatcgacgacgtcgtcttctccgtcttcgtcgccgcgacaccggcgagatcatggagatgggcaaatacagcagcagcgagaggaagaagggccccgagaaggacacgtccatcaggtcggccaccgtgtccttctcgtcctcctcgtcgtcagccggtacacgcccttcttgctggcgtagcgtcgtgacgaccgcgaccgcgagacggcgctgctgcggcggcgacgagcacgacacggcggcgcgcgcctccgtcctccacggtgaccaccacctcggcggcatcggcaagaaggtggacgcgagcgcgggcgcgggtgtcaggacgctcgtcgagcgcaacgatttctactgccaggaatgcaacacgcacggcaaataggtgaaaggccaaacatcttgggtttctctcctgttttttttttccagctgctcttacatttctgcttgaacaatactccctccgtttaatattataaaactttttagtatt

SEQ ID NO: 5240 - DNA, 1575 bp, Oryza sativa; identical to SEQ ID NO: 2113
  Predicted polypeptide sequence is orthologous to G2791

SEQ ID NO: 5241 - DNA, 452 bp, Oryza sativa
  Predicted polypeptide sequence is orthologous to G28
cttcaaccacattgattatgctaacaagattggccatgagatagatatggaaatggcatgggacgatgatgtcctccaagacgatgaatcagctggatcatcaccattggagacaccggcaggtctagcacaaatcaataccgtgcatgtgaaggaggagatggatctaattgagatggtcacacgcacacaatcttgtggctagtggatgagaaaataagcagtgatgtaactatgtgtgctactaaatacacattacacgacctttcggagtgcaacctggggaacctatatggtgaagaaatattagaaaaataagaaaaacaaacatgtatgggttcgaacgaagcacttgattatatattatattgtaactaatattctaagtttttctcttcgtacttttggcatgcactctctctttaataagtactttatttttaccttttctc

SEQ ID NO: 5242 - DNA, 1049 bp, Oryza sativa
  Predicted polypeptide sequence is orthologous to G280
gtctagtcgtcttcttccctggatccaaatcgaaaatttctctccccctgttcacaccacgcctcactcccatggcgaccgaggaggacgcgtcgaccatggcggcggccgaggcggaccccaagcccgccgccaccccgtcttacccggagatgatactggcggcgatcgaggcgctggacgacaggaacgggtcgaacaagacggcgatctcgcagcacatcgaggggaagtacgaggggctcctcccccccgcgcacccgtcgctcctcacagcgcacctcgcccgcatgaagcagaccggcgagctcgccttctccaagaacaactacttccgcggcgacgacccgtccctcccgcccaagcgcggccgcggcaggccgcccaagcccaaggacgccgccgccgccgccgccgcaccggcgcccgcgcccgcggcgccggcggcctcctcgccgcgcccccgtggccgcccgcctaagcccaaggaccccctcgccgaggcggtcgcgaaggccaccagtggcatgccccgcgcgcgcggccgcccgcccaagaaggccaaggtcgaacaggaagaccccattggcgctcccgccgcagcttcggctcccgccgcggcggctgaggccgcgccgcctgtcaagcgcggccgtgggcgcccgcccaaggtgagacccgccgcgccggtcggggagccagccgctgcttgattagctccgattctccgcatcgccgcgatggcgacgatggtaagctcctttaggttgtaacgtagtcttcagattatgtctcgtactgattggaggcgcggctcgggttgctgcttattgtaagttaatcggatggtgggaggtttaggtgtgctggatggatcatccgttgctgagagttgtgattgaattcgtgttatcgcgtgctgattattatggtaatgttggtgactttcgtgtcgtttgtgttaattctagattggtggctgcatttagtgttatcaaatgatgttgaattgttctatgccatgccggacaaaaaaataagtctgattt

SEQ ID NO: 5243 - DNA, 763 bp, Oryza sativa
  Predicted polypeptide sequence is orthologous to G280
tgacgctgcaggtacggtcggaattccgggtcgaccacagcgtcgcacaaccccttctctctcagatcgcgtgcggcggcccaaatccacacgcgcacagcgcagcaccaacgccggaaggagacagcgcccctcgcccccgccaccccaaccctacgagagggagggagccagccagccagccagccaggcatggccacctccacttccactggccaccgcgccgccgacctcgtcctcccctcctaccccgagatgatcgtggaggcgatcgcgtcgctggcggaggagaacgggtctagccaggccgccatcgcgcgccgcatcgaggcggcccgcggcggcggcggcctcctcccgccgtcgcaccccgcgctcgtcgcggcgcacctctcccggatgtcagccgccggggagctcgtcgccgtcgcgggtgggaagtacgcgctccgcccgactcctccgccggcgccgccggcggatccggcggcggcggcggcggtggcggaggaagacgacgacgacgacgagttcttcggcgatgatgactcggccgacgacttacggccggctactcggccaagcgaagccggggcggccccgaaggtgcgcccccgagagtacagacgatccgccacgaaggaacgaacagacacagaagagaagaacgagaaacagcacaaacacggacagaagaaaaacggcgaggcaccacaaacagaaacaaggagaaacaacaaaaaaaagaacaagaaagccacga

SEQ ID NO: 5244 - DNA, 769 bp, Oryza sativa
  Predicted polypeptide sequence is orthologous to G2802
gcaccaatccattccacctccgttaaccccgttcgttttatttgcgtttacttcgtttcttgggaaggcacttccttcctcttcctaggaaggtaataaagaagagcctcctccttcctccatggatagatagatcaatgggagctctgcatttccttttctcgtctctgttctgttgttgggtgtgtgtgttcagtgttcttgctcacctagaactgtcggtggtgctgctgcataccgaaatgccggtaatggcgatgataatatgagcgctcatgctcatccatgctgccggaaggaacacgatgacggaatttttcttggactcgcgagtgattcgatcatggggggaggtcatgccaaaatttttctccgggttcatcggattcagagggggaggtgctgcctctgaatgcaattgagtgcacctgaaacagaaaaaagaaaaagaaactctgcttcctttttttctctctcttcatgctcgttcttgcgttaggggataataataagccgagatctagtgaatatttggggggtttagcgaacatgatcatcgataacgacatggtgagatctagtggtgatgatcttgcttctggatctgggggtttagttcagcaagcctgaaattctcacctgggtttaaggtttcttttatttttcttttttcatcagattgaagtggatagaatgctagatctagtaatgtcctatgattgtttctctttcacctgaatttttaaaagcatttttgatgatttctctc

SEQ ID NO: 5245 - DNA, 5601 bp, Oryza sativa
  Predicted polypeptide sequence is orthologous to G2802
ggttttgctcttctactgctcatcctcctcctctactactcgtcctctttgctctattcacagctagcaacaagaaggaggcttacacatgcatgtgcacggtctctgccggacgcatatgaatcaggcatgaatagggggcacatcagcagctcggagctcatcgacgccaagctcgaggaacgccggatctccacggccaagcactgccccagctgcggcaacaagctcgactgcaaaccggattgggtggggctaccggcaggagtcaagttcgatccgacggaccaggagttgatcgagcacctcgaggccaaagtgagggaagaaggctcaagatctcatcctctcatcgatgagttcatacccacgatagaaggggaggacggcatatgctacacccaccctgagaaacttccaggtgagagtgagagagctaaggtagctatagctcaaaacattgcaccccccgcattgttttgatacagatatattcctggctttttgcaaaactttatcgggttttttttgctttccatggagtgatatatattgtatgctgggattgtttcgccatgaattatgggtcgtggttttggattttgggatatggcatatattcccttgttgttcttgatgtgctctcccccctctctattcttattactagtgtttctctacatgtgctcttggccggtatatgcaaagagaattattgtttatggaaagttgtgcctagtctcatctcccactctctcctctctgtcatgatggtaagatgcttctgaagtttccaaataggtttctttcctctcttcctctttttcagagaggtttgttgcatctgtcaagaagcataggccacccactccacactatactcttggatctcacaaaactctctatactaccttgatcctgctaattattctgtttgtgctgatcgatcgatggagcaggtgtgacaagggacggcctgagcaagcacttcttccaccggccgtcgaaggcgtacacgacggggacgaggaagcggcggaagatccagacggagtgcgacgtgcagaagggggagacgaggtggcacaagaccggcaagacccggccggtgatggtgagcggccggcagaaggggtgcaagaagatactggtcctctacaccaacttcggcaagcaccgcaagccggagaagaccaactgggtgatgcaccagtaccacctcggcgacctcgaggaggagaaggaaggggagctcgtcgtctgcaagatcttctaccagacgcagcctcggcagtgcagctggtcctccgaccgcggcggcggcgccgccgccaccgcatccgccgtgacgacggcggcggtgcagcaggatcagcagcgcaggagggacagcggcagcggcagctgctcgtcgacgagggaccacgaggtgtcggcgacgtcctactcgacggccgggtacgccgtcgccgccgccgtcgagatgcagcatttgaagcatgccgccgaccatttcagcttcgcgcctttcaggaagagtttcgaggaggttggtataagtggtgatcaggtacactccaatcagcttgggaggtcggagcagcagcatgctggccaggaacaacagccgcaccggccgttgcttgcaaccacgacggcggtgcctgccacggccttcctgatcagccggccgacgaaccctgtatcaaatatagtgccaccagcaatgcagcatgcatctgtcgttcttgatcatgatcagttccacgtgccagcaatccttctccaccacgacaaatttcaggtgtgatttcatctcatcttatacattttctcctcaaataaaacatttccattatctaaaataattccctaaaattaatactaatttctctttttctagcagctgggtaatagattgggcacggtagctgttgaaaaaaaaaactataggaacacatatatgcatgcatttatgaagaatattctttacatattcagaatgttaaatttaagtaaggagtaacaaaccatctccaacaaaaaacaatttcagcttgaaaacaagcaatggactcgctaggcagtacatttcatacttcccatctagacaaacttaattagtacggcttggtctaaagtccacattttcctccttcaagctaagagtttcttgctatcataggatccctttgaattctctaaaaataaactaaaaaccattctcagctttcaatttcaataaaaagaatcaaggatttgtgataatcttaagtgtcaaaattagtcatttttagttggtcatactaaacatattgggcaataatttatacaaataattgtgatatacaaaatattaaaaaaaattctagttatggcacttctaatgttgatttgtacatatgtagggtttttcaagtcgtgtaattactatttgatatgaactatgtttttttatatatataccaaggaagttgcatatggatgaaattaagctgtctgaagatgcattttctagactataaatatagagcctagacaattctggaaggattctttgtttacccatatatatatgtgtaatctggtaatgaatctgctttgtatttccaccgttcctatatatatgtatcactttaggtaaatctatatacaattgaactgtttatttcatatatatcaagatactaatgcattgtctcagctcattcttcatctctttggtgatttacttaattatattattgtagctcctttacttttttttttcgttttgctctttactaaagaatgctttagctactgttctatcccaacataattaacaacgaacatgcaacacagcagcagcagcaacaaaagcttgacaggaggtctgccggcttggaggaactgataatgggctgcacgtcttcgagcacaaaaggagtaagtttctcttgcatttttatttgattgcctcctcagcatggatccaagccgataatttaccagtcagaggctctacgcatgcagtaaagcattcctgcacatatccaattggaattaatatatatgcatgtacgtagcaattgcatgtgagacgcatgcatgtgtcccttttaaacggttttaatctgaacattagctcaggccaaatttaatataattgtagttatttatatatactgatttaaacatataatacatgggtgggaaagctgcaagctatgtcttataggcgaggtgaggggtttagaaaagaaagactgctcaggagggtcctgaggaaacttcagtgtggggcctcatagtttctttgtcgtcctagccagcactttgaaacaggcccttcaccttgacagctttttcctctcatttgtttccctatttttaaattcgccattttaggtgtgcttttacagcaagcatgccgacgagagagagagagagagaaatcttcagtactcctagtgagatagtagatagaagaaacatcatgaatatatgcaaacaaggaccaccctttgctttgcttttgagtgccaaagggggagagccaaagaccagcgtaaaaacaagaccatactttccttgctttcatgaccgtataggtgaaaacgagagctttctctccatgtcagtagcccctctcctcgcttttctgactgtatggctataagaatagttgtttactgttatctcttgcgaaaagagcaaaagaaaaggaggaaatattattcgtttcttgctctcttttgtctcttttctatgaaatgaattcacactgacaccatgcatgaggataagagaatcattattgtgaaatttgtttgcattaatcgttgtgaacttgttcttgtattacattactaaaaattaaaatcttgacatttacaaggtagtatatacatgcacgttcaggtaatatagaacaaaagtgtacttatttttgtcaaaactccattggatgattagacatgagtagtacatccgtctcaaaatataataacttttagctacgaatttaaacaagagtatgtctagattcgtagtcaataattgctatattttcgaacagatcaaggtagtaatgatatgtgtattgcatagttattcaatgagatcgttctttgacacgttggcctcattaataatatggtgcaatgcgttatattggagatcaatcattctgaccccgactatatactccgtataagtaagtgacaaaaagagttatgccttactacttttcccctcctttgttttcgcgttgaattatatgggagattaattaataaagtactgtgacaacacaactatagtactactagtctactaccgtggtatctgctatatctctcacaagagatccgaattggctaccttgatattatttaaatgaacatttctggtatcatctggagtgtaaataagagcaagtactataaaacttgctctaaggtagtccgtacttgaacagttgaaaattttgaattatttccctactgacattttaaagtgataccgtatctttcttattcaactgttgcacttcactgagctgttcttttttgacccccccttttccatattctattgcaggaagcttcaattcctcactcccaagagacagaatggccttaccagccatactggactcctgacaaccaggatcatcatggatagtagcaacaaggctggtaaatagtgaagatcaataccaaaagaaaactaaccacattctctttcaccttgtgtggtctctgtcttcttgaatatacaacattgctttcttgaagaatgtatgtactacggttgggagaagaaatagattaaagagatctgtatagatctgcctccatgaaaaaagggagatcaaattaactgtgcaaggacactccaagatagaagagacaaagttgttgaaagaaaagaaaagagaggacaaaaaaagtttgggcaaaggtattgttgtgcttaattacatcagaatgaaggctagacatgctagatgcagtcaatattaatgcaccccaatcgaagcataattataattacattttggtttatcacagcttttgatatgcattagatatttttcaactgtaaaaagtagtattgtttgcatgtactgtgatgtacattacaccccctggccggtcccttctctctctagatgggtgtgtgcgtgtgtgtttttcaccttgcttaccttgtgcttcaaatgcatccagggggactaaattcccaacttaataagttctttttcctttctagaggcgcaaaaattgtttagcgtttgggtactgatgctacttactttgtaacgagagttgaattcatctgccatgcatgttggtttcaaggaataaactggcgttgacatgcatgatttttgtggtctatatatatcacatatatatcagattactcgatgatctaactagttagtttactgctgtacctgtacatatggatttaagaatcagagtggtgttggctatatattaagagttatgcttgcatactgatactgatgtacatatacgtaagcacagaaaattcctttgttcatgtaaaaaaatatcagctctcaatatagacatgtgttgtatttat

SEQ ID NO: 5246 - DNA, 1907 bp, Oryza sativa
  Predicted polypeptide sequence is orthologous to G2826, G2838, G362
ctgccagtgctttctgctctttctattccctccctcccttctcccttcatagttccaccctccttccattcctctctgctggtcagggacgagagaaacgtaaacccagccgtgacattatattgcctagctagttgattaatttgttgcaagaactggctagctagctcgagaaattctgtgtacctggccgggtgcatgggcagcggcggcgaaggaggtggtggagcagcgagcgtacgggatcagccgccgcatgacttcgccaacgtcgcgtccttctccgagttgccgttcctgcggccggctccggcgcccagggagagccccaacaactccgccatccgcctcttcggcatcgacgtcccgcacgcgtcgtcgtcgcctgacggcaaagcctccaaggaatccgtcgtcgtctccaccgccgccgccgcggcgtccacgcatggcgctgccgctgccgccattgccgcggccgccgacagcagccgcaagttcgagtgccactactgctgcaggcacttcccgacgtcgcaggcgctcgggggccaccagaacgcgcacaagcgggagcggcagcacgcgaagcgggtgcagatgcagaccgcgatggccgctgccgccgcggcggccagcggcgcgcaccaccaccaccaccaccaccagctgctcggctacccgcagcatcatcaccgcttcggcttggcaggccccacggtggcggcattgtatcaacacccgtcgtggccgacgatgagcggcggcggcggcggtatctcctcaattggccctcagttctatagcgggatcggatcggtcacccagccgatcaacgggagcccgctgccggcggggctctggaggccgggcccgatggcggcgccgccgctgctggccggagagcggcggccggtcgcggtgtcgacgtcgtccgtgttccgaggagacgagccaagagcttcagcttctcttgtggcgtcccagacagcttcttcctctttgctgctgtctccgcaaggtcagttcgcttgtgagcagccgccggcgaccaccgcagctgagggcgtgagcttagatttgcacctataattgttcttttttcttctgttggttttagcggattactacgtacaataactgatttctcgctaccttttcttccttgcctgggaatgagattgccctttactaaattcagatgaatcgtgcgccttttttttttctcctgacacgtgcaaaagaattccatttgccaaactttgatccttttgttaatgtgcatatatacacatgacaaaataatttgggtacattgttagggtttgaattatcataaattacgtccaatacaaaacgcctatgcatttgaaaatgtttactaagtagttagttgaggaacagtcaggtttcatgctgtttctagacaataaatgtgcatattaattcctacgatgaaagagaacagaaattacaactgcatgcattaaccaatttcaatttcggattgcaaaagcaccagggacaataaaagagtaagattttaactgatcatatttttcacggaatcggtcacatataagtaagctgaaagtgcacaatactttttcaacaattgaaaaaaaaaatcataatgcatatacttttcatgcggcccagtaaactgctgcagcttgcagggccggcctgtacgtatgcacacgctaaaaaacatgaaggatatagacactaaaattctttctgaagcgggtgcagagttttttgttttttttaatcctctgtacgtgcgtacctatgggcaacagttctagcaactgctgctgcttgtatgcaatgaggctgtagctttatgtgtagctttcgcatgtcgctagggtcaggtatatgcacaactgcagatgcatgat

SEQ ID NO: 5247 - DNA, 1234 bp, Oryza sativa
  Predicted polypeptide sequence is orthologous to G2826, G2838, G362
gcttcttgcatggtccccctcttcgtccccctctcctccgccccagcttacaactcccatatccccttaaaaccacaccaactcgtagccaatttcttcagcgcggagacgcaagatatagcagcagctagcaagaattgccccgagttgggtggttaattcttggttttggttcacgtagaagcagatagcttggttggttggttagacggccatggcgaagccgcaggacatgcgcagcgtcgactcgttctcgcagctgccgttcatccggccggcgccgccgccgcagcagcaggcgcgggacacaatccggctgttcggctgcgaattctccaacgacctgcagctgcggcccacggaggccggtgcaggctcccccgacgcggccaacggcagcacggtcacgtcagagggcagcaacggcggcgacggcggcaccaagaacggcggcgccgcgacggcggcggcggagcgcaagttcgagtgccactactgctgccgcaacttcccgacgtcgcaggcgctgggcggccaccagaacgcgcacaagagggagcggcagcacgccaagcgagctcacctccaggcctccctcgccatgcaccgctacatgccggggcacatgtacggcctcttcaactaccaccaccacatcggcggccgcttcgaccaccacccgccgccgccgccgccgccgccaccgccggcgcactacccgatgtggacgagcgccgccccgggcgccttcgccgggccaggttccatggcgcagcccatcaacggtagccccgtgcaggccgggctgtggagcgtgccgccgccgacggagaatttcggcagcacggccggcaggcagggcgctgacaagctggctactacggtggcgggcacgccggcggcgggggaggtggcatgcaaggacgagatggtgccgatgagcttgctgtcctcgtcgccttcgttgtcgtcgtgctcgtcgacgtcgccggagatgctaggtaggtgtgaattggggcagaaggagggtgtcagcttggacctccatttgtaatccatgtctaattaggttttcttcttgtggattagcagtcgcaagaaagggtatgttaattctcatagcttaaataatctactctttttgccttgtccggatccaagtttagctagctacctagcttgtgttgccactttatttttaccaggcaaagaaaaagaaaatccttcgaattgc

SEQ ID NO: 5248 - DNA, 1236 bp, Oryza sativa
  Predicted polypeptide sequence is orthologous to G2826, G2838, G362
gcataaccaaaagaaagaaagaaaaatcttcaatagtggagagagagagagagagagagagagagcgcttctcctcctctcttctcttctcttctcccccttcgcttctctttccccccactcaatcaaaccctaaccctactgcgtacgccgcgccatcgacgacgacgcgctcgcgcgatgagcgttgagcgagatgggcgcgaccagcccaacatcgactcgttctcgcagctgccgttcatccgccaggcggcccgcgagaagccgccgtcgtcgtcgtccggcggctccgtcgtcgtccctcctgcgcccatccggctgttcggcttcgacgtgccgccggacgcgtccaccaccgccgatgtgctaggagagaacaaggagagcgccgccgccgtcgtcgccgctgaggggagtaaacaaacggcgtccggtctggacgcaatcggcggcggcggcgggagccggaagttcgagtgccactactgctgccggaacttcccgacgtcgcaggcgctgggcgggcaccagaacgcgcacaagcgggagcggcagcgcgcgaagcacgcgcagttccagacggccatggccatgcaccacggccacggtcagtactacccgctcccggacccctacgcggcggcgttcgcggcgtaccccggccaccaccaccaccaccgcttcgccgccaccgccgccgccgccatgcctccgccgccgcactacccgtcgtgggctgcaggctccaggtactacagcggtccaggatccatctcgcagccgatcaacgggagcccggtggcgccggccgggatgtggcggctccctgccgccgccagctgcgtcggcttggcgacgacgacgactacggcggcgccgctgcccgcgcggcgccaagagcggccggcggcgacaattccttcgctgctcggaggcggcgaggagcccgtggtgctgggaggagctggctccacctcgttctcgccgtcgacgtcctcctcctcgtcgtcggcgtcgccgcacgagcggcgcgcgcagccagcgcgtaaagagaatgtgagtttggatctgagcttgtagcagcggaggaatgatggccggtgtcagcctcataattgtttcttaattacaaaacaaaatcaagtgccttttcatttcacgtttggatttattttcagctcgttgagctaataccaatggtactagagatcagctactaattaagatagtagt

SEQ ID NO: 5249 - DNA, 804 bp, Oryza sativa
  Predicted polypeptide sequence is orthologous to G2826, G2838, G362
atgagcatgacgagccccaggctaaagctcttcggcttcgacgtctccgaggaggagacggcggagcacgaggagcagtactcggctgagccggagagcgcgccggtctgcgggggcaacggtggcggcggaggcggcggctcggactcgtcctcgtcgtctactacgaccaccacgacggccacggccggcggcgacgggcggaggtacgagtgccagtactgctgccgcgagttcgccaactcgcaggcgctcggcggccaccagaacgcgcacaagaaggagcggcagcagctcaagcgggcgcagctgcaggcggcggccgcggccgccggccgtgtcgcgggcggcgccgccgcgctctacccgcgcgccaacccgatggtctccgccttcgctccgaccccccacctcctcggcggcggcgaggcggggcccaccagctgggtctacttctccccgcgcgccgccgcggtggccggcggggcgcaaggccagcagttccacgtgtcccacggctgcgtcttccccgcccgcggcgccggccctgccgccgtcgccgccgcctcgccggctgtgttctcgtacactccggcgacgtctgccgccgccgtcgccgcggcctcggcaccctacgtgacgacggacgagcaccacgggcggaggatccacgcgagctcggcggccagccttgcgagatatcccggtccggcgatggtggtggcggagccggtggccaccgtgccggaggacacctgcctggggcttgacctccagctcagccttgcgcccgccggcttgtga

SEQ ID NO: 5250 - DNA, 1364 bp, Oryza sativa
  Predicted polypeptide sequence is orthologous to G2826, G2838, G362
gacacatggccatcagatcaccttgaacctacctagctagcgagctaatctcctgtagttcagtagctatctagctagcttgccctagctaccttgccggcgagctaggcggtggccggctggccggcgatgagcgagcacgacgcgaaacacgtcggagacgtgccggcggccgcgggcatcgagtcgttctcgcagctgccgttcgtgcgcccgaggccggcggcgatggccggctccagccccgcgtcgtccatccggctgttcgggttcgagctcccgcccgacggcgtcgtctccgccgccggattaggaggcggcggcggcggcggcgggcgcaagttcgagtgccactactgctgccgaaacttcccgacgtcgcaggcgctgggcgggcaccagaacgcgcacaagcgggagcggcagcacgcgaagcgcgcgcagttccagagcgccatggccatgcacgcgcactacccggcctaccctgcctacgccagctactacggctcgcaccgcttcggcccctagccgccgcacatggcgccgccgccgccgccgccgtacccctcgtggtccaaccaccaccacctcccgcccggcggtcccgcgcccatggtggcggcgaggtactacggcccggcgccgccaggctccgtctcgcacccgatcaacggcagcccggtggtgccggccgccgctgcgctgtggcgtgtccccgccgccgccatcgccgtggcggcggccgccgcgccgctggcgcgccaagaacggcagccgccgctgtcgctggccggtggacgcgaggaggaggacgcaatggtggaggtaaggagagggaacggggtaggcggcgccgccgccgcggtggtgcaactgcaacccggctcgcggctgtcgcggtcgtcgtcctcgtcgtcgtcggcgtcgtcgtcttcgcagcatcaccacgagcgccgccgcctgggagacctggcagagattaaccgggagaatgtgagcttggatctcaccttgtaattctccatgagaattgagagatgcgtgcgcgattaattagcgggttcttgccttcttggtaagtgcgaattaagagaaaaaaataattctttttctttagttcgtgaattcgtttagctagagatgctcacaagagagggattttctttttcttcagtgccttttttgcagtcctttttcgccgctgcactcattcaatattccaacctcgttctgtaacttgtaacttctgttcatcacattagatttctttgttagaaatagagataaattcaaggacaagacgtatggagcatgaaagattgtggtctcataattaattactatctccctaattttctact

SEQ ID NO: 5251 - DNA, 944 bp, Oryza sativa
  Predicted polypeptide sequence is orthologous to G2826, G2838, G362
ggggaattcggcattatggccgggggctcatcatcatttctcatcactgagctgagctcagttcagtcagttcatggaagtatatctccttcttggcttcatttgacaacttccaacacaagcagaacaaggtgatcaaatcatcctcaaggcttgtcttttttttccttctctggttatctccaatggaggctcccccttctctttccatcgtcgacgaagacggcttcgtcatcgacctctcgctgacgctgggcctgacatcgcctccgccctctccaggcggcgcgtctccttccattcctccgggaagaggcggcggcggcggcacgagtggtggtgacaacaacagaggcagcagaggtggtggcaatggtggtggtggtggtggtgtgaggctcttcccttgcctcttctgcaacaagaagtttctcaagtcgcaggcgctagggggacaccagaatgcacacacgaaggagaggagcgtcgggtggaacgcccacctctaactcccggccggcgtcgtcgccgacgacacgacgacgacgaagacggcgaaggccgacctgacatggccggatgcccacacaaaaatgtctccaaggggtgacccctcgcggctcccaatggccaatgcacagcagcagactcgcacgtaggagccagccattaacgaaaccatgcatcgcgactacagcgcggacacaccgcgggggcaaccgcaggcgccgcagccccgcgccgacacgacaacctccaatagccgacgcgggcgcacaccccggcagcgagcgcctcagctacgacacgtagacgccaacgcacgcagaggcgctgcggcgcgacagccgagccgaacagaccaagcagcagacgccactgacgcacgcagccgaccacaccgactcaacaccagtacaaacggaagtaaatgtgcagaagga

SEQ ID NO: 5252 - DNA, 650 bp, Oryza sativa
  Predicted polypeptide sequence is orthologous to G2826, G2838, G362
agttcttgaagtcgcaggcgctgggcgggcaccagaacgcgcacaagaaggagcggagcatcgggtggaatccctacttctacatgccgccgacgccgcaccccgccggcaatgccgccgccgccgccgcggcggcgacgcccggtgggatgtcgtccgtcacgacgccatccgggagctacggcgtcgtcggtggtgccgccgtcggggctactgctggcgttgggggcggaggtggagtgggaggggggcttctcccggcgcacgcgtacgccgggcacgggtacgccgcggtgccgacgtcgttccccatcgcgtcgcacagctcgagcgtggttggctccggtgggctgcagtactacgctggtaccgccgccgccgccgcgcaatccaagaaggcaaggtcaatcaatcgccatgttcttcttctccaagctccacctactcctcttccaattcctcctcgtgtgtgattaatccccctcttcttgctgcctgcgtacgtactccttaattaattagctcttagggacgttaattaatctcagttcttggctctcttctcctctcctctcctctcctctcatctcacttgtatgttaatgttagtactccttgtaatcgatcaatcagtcctctttttttgcatc

SEQ ID NO: 5253 - DNA, 2565 bp, Oryza sativa
  Predicted polypeptide sequence is orthologous to G2887
gggttgcttcctccgaaaatcctcatcctctccattgaccagacggcggcgcaggcgcaggcgctcacctccctcctcctccgcggcatccccaatcgaccagctggctcccctgcctcctccgcgattttgatcctaatcacccatgtctgctgaagtcagcgaggaatatccttatttcctctcctgctacttctggttcatatattgcataaaattccgagatttcacttgatacaagtggatcacctggagttttgtgctaatacttcctatcatgtgaatcagttgtagttagcataattggcaagactcaagttttctctcatctgggttcagaaacatttgtcggttgagtgctcgatctaaactctgcttgagtcttgccgaagattgtttctcaacaatcacgtcttctgttctctctgaggttggaccaatctcccttttggtctgatcaacctcctgatctcccttaagtgaaccgtcctgctgtgttcacgcaatacaatcttctgaagtcctctcttgttccttctgtgctcaaacatcaaaagcagctctctcctaagttctcttgattgtttgtgctcctaaattctgttgtttgagcactcaaacatttcccttactggtcaatcttagatcacttgttgattattggtattggcattatttggtgaagcatttctgcttgtaccttaaacaaaggtctctgttgtcttattggtgctgaaggcaagatatacactgcagtgatggctcaaacttgcttgccacctggctttcgttttcatccaacagatgttgaacttgtttcatactatttgaaaaggaagattatgggaaagaagcctcttattcaagctatatcagatgttgaactgtataaatttgctccctgggatcttcctgctcaatcctgtctccagagcagagatcttgaatggttcttcttttgcccacgagacaagaaatatcctaatgggtctaggacaaatcgttccacaccaaatggttactggaaaacaagtgggaaagatagaacgattgagcttaactctcgcattgttgggtcaaagaaaacactgatttttcatgaaggcaaagcacctaaaggcaacaggactgattgggtgatgtacgaatacaaaatggaagacaatcaattggtctctgctggtttctcaaaggatgattttgtcctctgcaaaattttcaagaaaagtggccttggtccaaggattggggagcaatatggggctccatttaatgaagaagaatgggagcatgcagatgctgaaatgtttcccttgctgccaaatgttgaaacttctgtgtttccattgctgccctcttcagaggtagtaaattctactgatgatacacgtgttcagccttctgttgctgccagagctattgaggaactacctgtgcagcatttacctcatgtatgtgctgggaatggatcaacatatcaaaatattactgttactggtgaaagtgctctcatggaactgccttcccagcactctgttgaatctattggtgatgaggtagtttctgtggacaactgttctaatgtggtcaataatgcagacagtcctgtaattgaggggcttgtattggaggaactttctaggtttttaactgattctcctcatcatggcaaccctgttggggagcactctggtctcccaccaatgtctgaggctgaagctcatgcttttgaggttagcacaaatgatctgtacaatgaaattgcagggcttgctgaattgggtgtgccaaatggtgatggattttctccgtccaatgctggtgttactgaacaacagcccacatactttggagttcctaacagtgaaaattatgtaaatatggatgatatctttgctccagacacaagattatcctatgcatatcctttgccaaacaaccaattttggcattatcccatggatcagttcacatacagtactactctatctgctgcctttccatctggtgactcgcgtccaactatgcgcattgttgatgatttacctgctgctgctaataacggtggctttgcttcaaaacccagcatgcagttcccactgtcataactaagtccagaaccgttctagaggactctgatactgatgacctagtgggattccatatgctggcagtactgcgcaacagatgtgtcttcatggccacctgctgccgctccgagctaagccaaacctcgctgaatctttctcgtggactgttgctggatttaccagtgctcgaactggtggtcactgcaagcattgtgaggccaacaatgtacattgttttgaaggtttggcctagttctcgatggcgatgctctatgatccgaacttgtctagcctggcgcgctactgaggatcagatattcgctttgtgttaccttatttacttgctgctgaataaagtttgtttatcaaactagtgtatattgtgttatgactgcacttaaaccttatgtaagtttgcatggtttggcctactatttacttgctattaatcttctcctaagttcgttgttttggc

SEQ ID NO: 5254 - DNA, 2255 bp, Oryza sativa
  Predicted polypeptide sequence is orthologous to G2887
ggacgggagccgcctgcctctctccgctgcgcgccgcctctttccaattccacctcgccgcttctcctctcctctcaatctctcatccctcccttgtcgtaccgcatccgcatcagcaccaccatctcctctccgcggcggcgccgcatttccttccctcgccgaccgccaccaccagcggctccgcttgctcttcaaatgactcttgacatcaggaaggattatctctgttttccttgctgtggatgctcaataatatgccaaattcttaggccaaggtctatttggatctcgttatgctagtatagacaacgttccattctccttagtatggccaagacatctcttcctcctggattccggtttcatccaacagatgttgagttgactgtctattacctgaagagaaaattattgggcaaacacttacggtgcaatgctgtttcagagcttgatctatacaaatttgccccttgggatcttccagagaaatcttcgttgcagagtaaggatcgagaatggtatttcttttgcccacgtgataggaaatattctagtgggtcaagaacgaaccgatcaactgaagctgggtattggaaagctactggaaaagacagaccagtaatatataattctcagactgttgggatgaagcgaactttggtgtttcatcttggcaagccacctcggggtgatagaactgattgggtaatgtatgaatacaggctggaggacaaggaactgtctgcttctggtgttaaactggatgcttgtgttctctgcaaaatctttcaaaaaagtggtccaggtcccaagattggggaacagtatggtgctccattcaatgaagatgattggaatgaagcgaacggggagctatcctcttttgccttttctgtgcccccttgtgcgctggaatcaagtaatggcaggttaaacacagctggtcagcagctggctgttagtgataatattggatcttctttggaccattgttcagaaactaatgacaagatcgctgttggtggctgtgggacgactagtcctagcgttccttttgataccatacatacccagcagctagatgagattatcagttgtttctcgacagatcttttgaactccgttagtcgagatggttcattgcctgactcaactgctgactatgataatgacaatgaagtatcgtccgatgatggtgaagcaatatttaatgaacttgatgaacttgattcccaatcagatgagagcatttccaaccattgtaactcatgtggtgaagacttgattcctcctacgctggaagtacttaaaactgaacagtacttggagctgaatgacttgtccttttctcttgccgatgatcctgatccatgtaacctgctgctgacaactaatctatctgatcagaaccatccagaattagagaccaggtttgagcaggggtctcttgttgacatctgcaataccactaatgctaccatatccaatgctgcctgttcagcgtcaacagttggtgatcatgtgacctgaatcacaggtatggctcctatacctatagcctgaaccagacgggggttcgttcgctcgctgttacttgaggcatgtcatggttcttctgtttcctgtttattgaagtgcattttacagctcaaacaggaaggcgctcagattatgagattgggagttgcagctagtttgcgaagattcagtttgggccaattcaggagaattcgtggttcatggacatttcgcttaccctagtttgcgaagaagattttgtcaccaataagggatcggtacgaataactcgttggcgacgttggatcacttgtccttaaaaagatgttggaagcctgattctggagcggacagccttacattcctggtgatcccctgagcttgtgtggtgcttactgccgtccaaattagtactcctaggcagctagtaggaatttcctctttttttttcctgttttacctgtacgagcggtctgtctgatcatctgatgtatgctaacgtcaatagcgagttacgcagcagcgtagtacaaagctcaactattaggctagattagagagagacggcgatggtgacttttcgcaacgaacctagattgaacatgttgcaaactaaatgttggcacagctaaatattcttaaaaccaacgactaaatgtaatatgcgcaaatctttgaccatacccatacgttgcagatgcaattaattaatgaaaccttacatctgatttttc

SEQ ID NO: 5255 - DNA, 722 bp, Oryza sativa
  Predicted polypeptide sequence is orthologous to G2898
tactggtggctttcgccgctgcaaacctccgtctcctccggctccggctgctcggggcctaaaccctcgccgcgtgtactaaaaaccccggcggcccaggcggcggagggatgaagacgaggtcgcagacggcgccgaagccgctgaaaacggtgcggctgcctcctgtcaagccgcggcccaagccgccgccgccgcagccgcagccgccgccgtcccggaagaaggggcagcccctcgtcgaccggcgccgccccaagaagccgcccaccgccttcttctacttcatggaggattttcggaaaacttacaaggaagaaaatccaagtgtaaaatcaatgcaagaagtagggaaggcatgtggcgagaaatggaatacaatgacatttgaggaaagagtgaagtattatgatatagcaaccgagaagcgtgcagagtatgagaaggcggtggctgaatttgacaagaaaaaggaaagcggtgaattgtccgaggaatcagattacgactagaggtgaacgtcgggtagttgttccgatggttcacccaagtaattggatggacgaatcaattgtatattacagaactgaggcactgagctttgtaatggaatctatatatagtcagtttcctgctcattctagagtgaactatcgtcttgtgataaagtgatagctttggatcgagtattcgctggtacaccaccagtgcttgaaataact

SEQ ID NO: 5256 - DNA, 501 bp, Oryza sativa
  Predicted polypeptide sequence is orthologous to G2898
atggtcatcgccgctcaccgccaccaaggactgtcatgcaagtcatcgccgctcgccaccatggtcatcaccactctccacagcaaatccagcgagctcgcggcgagatctgataagctcacattcggatccagcggcggagggatgaagacgaggtcgcagacggcgccgaagccgctgaaaacggtgcggctgcctcctgtcaagccgcggcccaagccgccgccgccgcagccgcagccgccgccgtcccggaagaaggggcagcccctcgtcgaccggcgccgccccaagaagccgcccaccgccttcttctacttcatggaggattttcggaaaacttacaaggaagaaaatccaagtgtaaaatcaatgcaagaagaaagagtgaagtattatgatatagcaaccgagaagcgtgcagagtatgagaaggcggtggctgaatttgacaagaaaaaggaaagcggtgaattgtccgaggaatcagattacgactag

SEQ ID NO: 5257 - DNA, 1041 bp, Oryza sativa
  Predicted polypeptide sequence is orthologous to G2982
atggtctccggcgcggcgcattcggcctccaccagtggcggcggcggggggagcgagggctcccccaccggccgcgccgcgccgggcatgcagggcggcggcagcgccgccacgcccgccgcctcggcctccgcgtccacgccggccagcgagaccaccgtcgcccgccgcctcgacggcctcgacatccagggcgacgacgcgccctcgtcgcagcccgccacgagcaagaagaaaaaaagggggcctggaacacgtgcaacgggccctgacaagggtggccgtggattgcgccaatttagtatgaaagtttgtgagaaagttgaaagcaaagggagaacaacctacaacgaggtggcagatgagcttgtagctgagtttgcagaccccaacaataattttgcatcacctgatcctgacaaccctaacacaccacaatttgatgagaaaaatatacgacgaagggtttatgatgcattgaatgtcctgatggctatggatattatatctaaggataaaaaggaaattcagtggaagggcttgcctcggacaagtatgagcgatgttgaagaattgaagacagagatcatcggactgaaaggtaggatcgacaagaaaaatgcatatttgcaggagttagaagatcaatttgtaggtcttcaaaacttggcacagcgaaacgagcagctttatggttcaggaaatgctccttcaggaggagtggcattgccatttatattggtgcagacacgtcctcatgctacagtagaagtggagatatcagaagatatgcagctggtgcattttgatttcaatagcactccatttgaactgcatgacgattcctttgtactgaaagcattggggttctctggcaaagaaccagatgatacgcaagcctgggttggaaatggaggtgagtgctcaaccacacctatctatcatcaatcaccccaagttgcgaggccaaacggagttagactaccaacatcgccccctattcccggtatacttaaagggcgtgtcaagcatgaacattag

SEQ ID NO: 5258 - DNA, 1140 bp, Oryza sativa
  Predicted polypeptide sequence is orthologous to G2982
atggtctccggcgtcgcccaccgcccggacgacgacggcgggcgcgccgcctcgacgttccagcgcccgccgcagccggccggcgcgcggccgtccctggccacgccgccgccctcgggcggagcgcaatccgcttcgacgagcggcgggagcgcgggctccccgtccagccgcagcgagcagcatgtccccgcagccgcaggcatggcggcgggggcggcggcggcctctactccgattagtgagaataccttcctccgcctcaacgaccttgacatccacggcgacgatgcgccttcctcacaggctccaacgagcaagaagaagaagagaggagcacgagcagttggtcctgacaaaggtggcagggggctgcgccagtttagtatgaaggtttgtgagaaagttgaaagtaaagggagaacaacatacaacgaggtggcagatgaacttgttgccgaatttgcagatcccaataacagcattttgccaccagatccggataatcccaatgcacaacaatatgacgagaaaaatatacggagaagggtttatgatgctctgaatgttctgatggctatggagattatatctaaagataaaaaggaaattcagtggaaggggttgcctcgaaccagtataaatgatattgaagatttgcagacggaacttgtaggactgaaaagtaggattgagaagaaaaatacatatttgcaggagctgcaagaccaatttgtaggtatgcaaaagttgatacaaagaaatgaacagctatatggttcaggaaacattccctcgggtggagttgcattaccatttatccttgttcagacacggcctcatgcaactgtggaagttgaaatatcagaagatatgcaacttgtacattttgactttaatagcacaccatttgagttgcatgatgactcatttgtactgaaagcaatgagttcttgtggagaagaacaaatcgacggtattcatgatctaatttcaaatggaggtgagagctcaagcatgccaaatatttataggcagcaagtgcagcaacctgcaagatcaactaatggtacagctagattgccaagctcaccccctattccaggaatactgaaagggcgagtgaagcacgagcattag

SEQ ID NO: 5259 - DNA, 1174 bp, Oryza sativa
  Predicted polypeptide sequence is orthologous to G2982
ggctcgagccgcaatggcgcctccctgcggcgatgccgcggcggctgcctccgccgcgcccggcctggccaacctgctcattcgcgaaggcgccggcctcccttcgcgtcccgaacggtacccgccattccggccctgtacttctgattcctttgctccaatctctagggaaggggacgatattcccccccaaaaaaaatcggtttctttacgcagcggcggcggcggcaatgcggcagagagggaggagggcggtgcgaacaggaacgggaagaaggagaagaccggggcgcagaggatcaccgggtgggggctccgtgagttcagcaagatagtttctaagaaagttgaggccaaaggaagaaccacatataatgaggttgccgatgagatttttgcggagctgaagtccattacgcagaacggtctggagtttgatgagaagaatattaggcggagggtatatgatgctttcaatgtgctcattgcaattcgtgttattgcaaaagataaaaagaagataaagtggatgggccttactaattatagatacgaaaagatacagaagttggaggaagttcacaaagaactcatcaccaggatcaagaataagaagaagcttctccaggaaattgaaaagcagtttgatgaccttcagaatattacattacgcaaccaggctagtcagaggccagcagaaagtgttaatggcatcctccttccgttcttattgatcaagacatcccgaaaagcaagggtggaaattgagatttcggaagattcgaagtttgcacggttcgacttcaacggtgcaccattcaccatgcatgatgatgtatcaatccttgaagccatcaggcgtaacaaaggaagagctggcctctccattcacccttaagaggcacaagaatgtgacaaaaccaattgaagtgtcaaaactcaaaactggcaccaccagtttcttttgcacagttatgtatagctatagcgtacctttcagtatggaaactcgacctagtttataggacagtctctcaggctttttagcagatatgacctgcgaattttgcctcttttttgtgcctagcaggtgagtatggaatagttttttcttgcgtgtgctgctatgtataaactcaattgccgtttcaattcgaagcttgtgtacaagctc

SEQ ID NO: 5260 - DNA, 467 bp, Oryza sativa
  Predicted polypeptide sequence is orthologous to G2982
tggttcaggaaacattccctcgggtggaggtgcattaccatttatccttgttcacacacggcctcatgcaagctttggaagtttgaatatcagaagatatgcaacttgtacattgtgactgtaatatgaaacaacggaatatgggatacacgaacaacttcttgtgaacatctttacacgctggtgtgattatcctcaacttcagtgaccagaaagaaactgcaaatgcatctcggttgaaccatcacaccttcacacttcattagagcgtttggagtgttggttctctaggcctttcgtccgccaatcagccaatgtattttgaagagtccaccaattttccattgccattagagcaagtttaatagtatagccaactactagttccaagttcatttataatcaatctaatagctcattcatacaatacttacatactacactattaatatctggtcccatctgtc

SEQ ID NO: 5261 - DNA, 413 bp, Oryza sativa
  Predicted polypeptide sequence is orthologous to G2982
agtgctggtgctgccgccagcagtgccactggcgacaacgctggtgccatgcccactgctgccgtcgctatgggtgctcttatgggtggtgctgctctctttgccaacatgtagattggcatttacggaagacaacagtaataatgaaataaacggtcaaatcttcacgcgccatcattttaaccaacatggagctcttgtgtatatccaattctgatgaagcaaggatatgacagggttcgggatcttaattaactagcgttgcacatctaccgttagtgtgatgaaaaggggaatctggaattgagggatgccaatgtctggtgcagcctttgtaacggtgactttgtcaatagcattacttacatgaaacgttctcgaccttggatattaaaataaagatgtttcgtatt

SEQ ID NO: 5262 - DNA, 714 bp, Oryza sativa
  Predicted polypeptide sequence is orthologous to G2983
atgaggcttcaccatctgcatgtggcctacctggatcacaaagcgtcgtcgtcctcgtcgtctccggcgccaccatccatctccccgtcgtcgatccccggatcggccgccttccctgctttctccttcaaatgcctccgcccgctcgcgcccaagatctcgctgccggagccgaggaagatgatcgcgccgccggacttcgtcgtccctcgcgccagaaacgcttccaagctgctcaactacactgtgcaggtgccggcggcggggacgacgaggtggaacccgtcggcggagcagataaaggtgctggagatgctgtaccgcggcgggatgcggacgccgaactccgtccagatcgagcggatcacggaggagctcggcaagtacggccggatcgagggcaagaacgtcttctactggttccagaatcacaaggcccgcgagcgccagaagcagaagcgcgccgccctcctcaccctcaggacgctcgacccttccttgctgcgccgaccgctaacgaaaccaaataggcaccgtacaacaaggagaaggacgtggaagatggattggcgagctgcaagcggcggtgcaaggcgtgggttgacggcgccggcgatggagacgcggtggtggcgacggaggcggcggcggctgcaccgacgaagtgtccctggagctcttcccgttgcatcccaaatcgtcggacctgtagga

SEQ ID NO: 5263 - DNA, 964 bp, Oryza sativa
  Predicted polypeptide sequence is orthologous to G2989, G2990
cttgcattcactgcttctgctcggctgtgaacttggtgcggaaccgcttcctcggcatcccggcgccgccggagggaggcgcggtcgccgccggcgacatcacctacagcgggagcctttgcgcctgcccgctcgagcccagcgagagtagcatgtgctgcgccgaagggtaatacggctggtgcaccaccggcgccggcaggtgcggtggcgacggcggggacacagaccgctcgtcgtagtattccgagccatccgagttgttgtcagactcgtcgccatcaaccccagggagccggacctcgggcgtctcctcctcgcggtgcagctggccgtggagcacgttcgccggcatgggcggcgcgggcagcgccagcggcggaggcggcggcggggacccctccagcagccagcagtggaagttgcagtggcagccgcacgcggcgcacatgagcgacgtcgggtcggtgggttcaccgccgacgacggcatgaactcctcgcagccgtccagcgccgtgtccgcccaggctcgctgcgtggttcttggggcactcctggtacaccgtctctcctccgcccaccgccggctgtgctcgtcgcagctgtagctacggaggggtacagcccacaagctccacctcagccatgtctccggcgacgacgcggacgaagctgggcgacagtggcgcggcgaggtcgggcggcggcacgaccttgcggtgcccggcgaggagtggcgtagcaagccgagcattgctcggcgcggcatcccgaggctgacgtacggcggaggtgcggctgctgaccgaggtggcggcggcgctgagcgctgtgacggagatgacggaaaaggagggggatagatggaaaacttgacgagagtggcacggttctaatttctgtaaaattttaatggcacgtttacgaataagcgaattataattgtatttttctgaatggcg

SEQ ID NO: 5264 - DNA, 1080 bp, Oryza sativa
  Predicted polypeptide sequence is orthologous to G2989, G2990
atggaggccgtcgtcggcgtcaagtacaggccggtggtgttccccaacggcggcgcggcggcggctgcggcggggaagagcaaggcgacgccggcgtcggcgacggcggcggtgtacagggagtgcttgaagaatcacgcggcgagcttgggcgggcacgcggtggatgggtgcggggagttcatgccgtcgccggcggcggatgccgctgatccggcgtcgctcaagtgcgccgcgtgtgggtgccaccgcaacttccaccgccggctccccgaggcgccgccctccccgcctctcctcgcgctgcctccgccgccgccgccaccgccaccgccaccgccgccgccgcagcctcagcagcatctgccgcggaccgcggcggtggcggtggcgccgcagctgctgctgcatgggagccaccagcgtcgcgagcagtcgccggagaccgaccgcgtgcgcgggcccgggcaccaccacgacgacgacgccgccgccgacgatgatgattccgaggactccgagatgtccgactacgacgacgaccgctccgcctcgccgctgcaggcgccgccaccggtgctctctccggggtacctcccctccgcgacgcacatgctgctgtcgcttggctccgcgtccgccccggccgtggcggcgtcgaggccccacgccgccgccgccgccatggggcccccgcctccgccgggcgccgcgacgtcggcgtcgaggaagcggttccggaccaagttcagcccggagcagaagcagcggatgcaggcgctgtcggagcggctcgggtggcgcctccagaagcgcgacgaggccgtcgtcgacgagtgctgccgcgagatcggcgtcggcaagggcgtcttcaaggtctggatgcacaacaacaagcacaacttcctcggcggccacagcgcccgccgctccgccgccgccgccgccgccgcgccactcgccccaccaccagtgctcactgacttcagcatcaacggctcatccacgcatgccgccgccgccgaccacgccgcggcaacggcgagtggcggcggcggcggctcgccgcagtcgacttaa

SEQ ID NO: 5265 - DNA, 300 bp, Oryza sativa
  Predicted polypeptide sequence is orthologous to G2989, G2990
gctatcaacaccaacaaacaccgcgcctcgcctcgtctcctccgatagctgacgccgccgccgccgccgccaccgacgccgggagtgacagcgagtgagatcgtcatgatggatcacctgagccttgtgccctacgagggcggcagcgccggcggggtgaggaggtgtaggtggaggtggtggagggaagtacaaggagtgcatgcggaaccacgcggcggcgatgggcgggcaggcgtatcgacgggtgcggggagtacatgccggcgtcgcccgactcgctcaagtgcgccgcgtgcg

SEQ ID NO: 5266 - DNA, 1005 bp, Oryza sativa
  Predicted polypeptide sequence is orthologous to G3
attccgcgaggatggataggtgggaggccaccgtcttcttgcccccgccgccgccaccgcagccgacgcagccgcagcagcagcctgcggcggcggcggtgagggctccggtaggcgggaggggtgggggaggagggaggcagtatcgcggggtgcggatgcggaagtgggggaagtgggtggcggagatccgcgagccgaacaagcggtcgcggatctggctcggctcctactccaccgccgtcgccgccgcgcgggcctacgacaccgccgtgttctacctccgcggccgctccgcgcgcctcaacttccccgaccagctcgacggcgcgggtggtggtggcgcgggcgccggcggcgccgaggaccacagggagctcaccgccgccgtcatccgcaagaaggccgccgaggtcggcgcccgcgtcgacgcgcagcactccgtcgtcggcgccgcggcgcccgtgccgctccagccgccgcagcccccgccgccccagcgccgccggaccaagaaccccgacctcaaccgggagcccaccccggacacctccgacgacgagtagtaatccgtgctaattttgcctcccttcttccatccatctagttcgtagtccttagccaccccaagacacagagagagagagagagtagcagctagtagctatagctagtcagcgaagcagatagcgccaaggaggcggtcgtggacggggcgcatgcaaggtgttcggcgaaatgcgattgaggtcggaggagcccacaagtatatccaataatggagccgcgacgtcgccgtcaagccggggaagtggtggttagcaagtaggaatctagagctcagctcgtcgtctgttccggcgacggcgactgtactaggagcgtgcgtgtcagcgtgagcatgtagctaaaagcaagacggctatgtacctcacccttttcgcttaagcgtttgtttgtaaagagaagatacccagcaagcaagacaaaaaaaacagcttcaag

SEQ ID NO: 5267 - DNA, 882 bp, Oryza sativa; identical to SEQ ID NO: 2099
  Predicted polypeptide sequence is orthologous to G30

SEQ ID NO: 5268 - DNA, 660 bp, Oryza sativa
  Predicted polypeptide sequence is orthologous to G30
ccaatcggcgtcgtcaggcctctcgcgtgtgcgagcggttgcgtccgcatggaggacgacaagagtaaggaggggaaatcgtcgtcgtcgtaccgcggcgtgcggaagcggccgtggggcaagttcgcggcggagatccgcgacccggagcgcgggggagcccgcgtgtggctcggcacgttcgacaccgcggaggaggccgcgcgggcgtacgaccgcgccgcattcgccatgaagggcgccacggccatgctcaacttcccgggagatcatcatcacggcgccgcaagcaggatgaccagcaccggctcttcttcgtcctccttcaccacgcctcctccggcgaactcctccgcggcggcgggccgcggcggctccgatcggacgacggacaaggtggagctggagtgcctcgacgacaaggtcctggaggacctcctcgcggagaccaactatcgtgataagaactactagtgataagaactactagctagctagctactatggctacttagctagtacataccgatccgtcggtattagcaagacggacatggagcagtcgtgatctcgtctgtatgcgctccttgaaacgatcgagaccatgagcttgctagctagctacgcatagtagtagcaataacagaggaaaaaaaaaaa

SEQ ID NO: 5269 - DNA, 375 bp, Oryza sativa; identical to SEQ ID NO: 1771
  Predicted polypeptide sequence is orthologous to G30

SEQ ID NO: 5270 - DNA, 1104 bp, Oryza sativa
  Predicted polypeptide sequence is orthologous to G3055
atggattacaccaacgccatccacatcatcccggacgcggcgggccccgacgcctgggcgaacgcggcggcgcagggcggggacgccgggatatgggccaccgaggacgactacaacagccagtggaacgccgacggcggcggcggcggctcctcgagggccgggagcgagcagccacctccgggcaagaaatcccgcggcggcggcggcggcgaaggcggcgggaacacgagcaagtcgcgggcgatcgggaagatgttcttcaagacgaagctgtgctgcaagttcagggcggggacctgcccctacgtcaccaactgcaacttcgcccacggcatggaggagctccgcaagccgccgcccaactggcaggagatcgtcgcggcgcacgaggaggccacggaggcgagggaggagcaccagatccccatcatgacgtcgtcgggacccaccgccggcggcgacgcgggctgcggcggcggcggcggcggcggctccgggagggcctacaaggggaggcactgcaagaagttctacaccgacgagggatgcccctacggcgacgcgtgcacgttcctccacgacgagcagtccaaggccagggagagcgtcgcgatcagcctctcgccgagcgtcggcggcggcggcggtggcgggagctacaattctgcggccgccgcggccgcctccgcctccgccgcggcggggaatgggccgatgcagaagccgtcgaactggaagacgaggatctgtaacaagtgggagatgactgggtactgcccctttggcagcaaatgccacttcgctcatggagcagctgaactccacaagtatggtgggggacttgttgacatagacagcagggatgctgcagcaactcccgactccaagcaagctgtggtatctgcgaaagctccagcagagaccgctgctgcatccaccacagtgctccctcatgcagacgtgtaccatctaggcgtgcaggcgcagcgttctaccattgccggccaaaggtctgggcaggtacagaggcccattcagaaatggaagggccctgacaagatcagcaggatctatggtgactggatagacgaaaccgagtag

SEQ ID NO: 5271 - DNA, 3135 bp, Oryza sativa
  Predicted polypeptide sequence is orthologous to G3060
gggttcgctcgtcgcctcgcgtctcgtctcctgttcggctcgactccacccgccgcgagagagagagagagagggagggagcaaaccctatctagggttttgcccgcccaccgccctcgccgtcgacgccatggaagccggaggaggcaagcgggccgccccggagggcaccaacggcgccgccaagcgcgcgagaggtgagcctcttcgtggtttccttcttcttcttgttttttttcccttttcttggttgctggctcttccattggaaggatggctggttcctagggtttctccagccggctaccttgttggggggctcggattctcggcggcgctccggcttggttttgagctgggtggtgattggtgaagacgggagacgaagatttggggggtgttgggattggggagcttgtggccgccttaagcctttcatgtttttttttcttgttttgttcgtttggagatgatgacggaaggctcgccactatttttttaaaatttatttttggcaatatttcgcaaagagatctagaaacgcgattggtgacctagtggacctgctaaatatgtgaacggatctagctgctcgtcgaattttcttgagtgagttgaaagagatgtccgatttctcaaggcgttaatttgaaagtgaaactcattaagctctggatactggacattattgtattgtaccatttaccttttttttttctttctgagaaggtaatgctcagtggcttttgaaatgattaatgtgtacatgttgtttatatacatgccatgttttagtaaaaatcaacgctattaaccggcggaaataataaatttggtgtaacagcatcggagtcgtctcaagtgggtgtaggaagcaaattgaagccatgcaccaaatttttcaggttctaatctaacttaaaatgaactatcacctgtttacacatgctattctgcactttgctgtggttttgccttaaataattataatttgttattttgctaagaaattgttgttgaggggtaacaaatgggttaagtaagatttttctacaggtttccattgtgtataatggataacatagcagctatatgtaaaactccatttctgatgaacaatcaaatctatctgttacactgtggtaccatatcacctgcagcaatcaagataatagtattaaacgttccatatgggattgcaattgacttgccattatggaattatactacttactaaatgataacattcagtgtagcagcttattttcagtacacgcacagtgtgtttaccttgaatttgaacttggagagatgtttttctttttatattctactattgattgatcatgtgttttagttatcacatcgatataagctactccttctgctacactcctgagttgcaaaagatgttcttattatatacaattgtgaatgaatcatgcagtaaagtgataatgtgttgtcatgttcatataagtaaagtagctataagacaatagggaaataacttctttgacaaactaaaattctattattttttttaaaaaaaatggtgacacactgataggcaaattattctgtgttgctgtatgcctttattaatatgtatgctatatttactgtttaccacagtatatgtttgcttctgtattaatatgttcagtttcatgtgatgctacgagtgcttcttaataattagatagtattcaccatcaagctttgaccactggtaaatctagattgatcccattgaaaataactttgtagatttacttaacctgtgaaaataattttacagataagatatccacataatgattatagatgtgttttgtacgtcaattattaatgtttaatgtcatttatatgaatcaaaagagagaggtggtttcatctattttgtgttgtttactcgtatctgttagcagtgacctaataaggttccatcttcagctaaatataacattacttgtttcatccatattgggtcactgtaattttcctttcgtacacatttggtcgctgtaattttattccttaaatgatgttttctttgtgcagtacttctggctgtccttttggttcaagttgtcattttctccataacttccctggtggctaccaggctgctgcaaagatgaccagccatggtgggacagctgttgcagctcctcctggaagaatgcctttaggacctggtgctcctaatgggccacctacatccagcgtgaaaactcgcatgtgtaacaagtacaacactgcagaaggatgtaaatggggtagcaagtgtcattttgctcatggagagagggagcttggaaagccgatgctgctggacaactcaatgccacatccaatgggatcaatgccgtttgaggctccaccaatgcctggcccggacatcgttcctccctcaacctttggtgcctcagccacagcaaagatcagtgttgatgcatccctggctggcggtatcattgggaagggtggaaccaacacaaagcatatatcccggatgactggggccaagctagccatccgggataacgagtccaaccccaacctcaagaatatcgagcttgagggtacatttgaccagatcaaacatgctagtgctatggtcacggagctaatcgtccgcatcagtggtaatgcccctccagccaagaacccgggcagggggtcgcatgctggggggcctggaagcaacttcaagaccaagctgtgtgagaacttcaacagaggctcctgcacgtttggagacaggtgtcatttcgcccatggtgaaagtgagctgcgcaagccgccggctgctgcttgagacatgcgtgtcgtggcttggactagacggccagcatacctgagctccaaatatgaaaacgattgcacacaaggtgaaaatgatatgtgcattgttgctgcttctgcagcatgagatattttgtcatgggaggaaactggatgtaatctgggaggaaatagataacagggaatttcggtgtctttgatttgtagaattaccttggagtttttccctcggcgcttcagtcaaattttgtaatgcttcgaatgcactatataacctagcaaaactacaatgattccatttacttgggtgctttctgatgcttc

SEQ ID NO: 5272 - DNA, 1349 bp, Oryza sativa
  Predicted polypeptide sequence is orthologous to G3060
gattccgcggctggtcgcttccccttccgcttccctccgccaaccacgagctagggtttcgatctcgcccccgaccggcttcccctcccttccctcctcctccctccgcgcgaaggctcgccatggagggagccggcgccgcccgcaagagatcccggccggacacggccaacggaggcgccgccggagggaagcgctcgagagaaacggagtcatttcaaactggtctatcaagcaaattgaagccttgcaccaagtttttcagcactatcggatgcccttttggcgagggttgtcatttctcgcactttgtccctggtgggtatcaagcagtagcaaaaacactcaatctaggcaacccagctgtgcctgcaccggcaagagctcctatggatcatgctgctggtggtaattctcatccagcttcttctggcaagacacgcatgtgcaccaagtataacactgcagaaggctgcaaatttggtgacaagtgccatttcgcccatggtgagagggaacttggcaagccagcttacatgtcccatgagagtgccatggctcctcctatgggtggtcgatatggaggccgacctgaaccacctccaccagccgctatgggtcctccagcaggaaactttggtgcatctgctactgccaagatcagcgttgatgcctcgcttgctggtggcataattgggaagggtggagtcaacacgaagcagatatgccgagtaactggggtcaagctctcaatacgtgaccatgaatcggattcaaacctgaagaacattgagctcgaaggcaatttcgaccagataaagcaggcaagcaacatggtgggtgagctcattgcaacaatcagcccgagcacaccagccaagaaacccgctggttcagcagcaggagcagcaccagcaggccgaggcggccccgggggcaggagcaactacaagaccaagctgtgcgagaacttcgtgaagggaacctgcacgttcggcgaccgatgccacttcgctcatggcgagaacgagcagcggaagggcgctgcttgagagccgaaacgcatcttgggcgcggcgcactaattctccattgccttttgtgactatatatatctctgcatctttaggtgattagcctgttgtattgcgattttctatatggattgttacgttttcggttcagcttttgatagatgtctaagaagcaaataacttagtctttctggggtgtatgccagtgtagagctccctctttcagtatcttcaccctcactttattcatctatagtagtttcatcagttgaggacagtggagttcattttgcccaaaactgagacccttgaacg

SEQ ID NO: 5273 - DNA, 921 bp, Oryza sativa
  misc_feature (593)..(593): n is a, c, g, or t
  misc_feature (603)..(603): n is a, c, g, or t
  Predicted polypeptide sequence is orthologous to G3060
aggatcggcggaatcctgggtgaccacgcgtcggccgcgccgcgcgacgagccggaaacctagccgagctccgaggcggcgtgcgcgagcgcgagcgcgggcgcgggtgtgggggagccgagagatggaagtcggcggccgcaagaggggcaagcccgacggtgcgaacggcgccggcgggaagcgcgcgcgagaatcggagtcatttcaaaccggtgtaggaagcaaatcgaagccatgcaccaaatttttcagtacctctggttgcccctttggtgagggttgccacttcctccaccacttccctggtggctaccaagctgttgcaaagatgaccaatcttggtggtccagctattgcgccgcctccaggaagaatgccaatgggaaatgctgttcctgatgggccaccaacacccactgttaagactcgcctgtgcaacaagtataacactgcagagggatgcaaatggggggataagtgccactttgcgcacggtgagagggagctcggcaagcctatgttgatggatagctcaatgcctcccccaatgggaccaatgcccactggtcactttgcacctccaccaatgnctagccctgncatgttcactccagccagctttggcgcttcggacacaggcaagatcagtgttgatgcatctcttgccagtggcataatccggagggggggggttaacaccaaggagatatcagaatcacggggccagctggccaccgggacataattagaaccactttaaacctgtgcttggggccttggacaatgaacgctgtgctgtgagacgatgacatcggcggcccccaggcgaactggggacccggggagcgcaaacatacaagtggacaccaggcgctgacgcgatcgaaaagaagccaagggcagaccgggcagagctaa

SEQ ID NO: 5274 - DNA, 1694 bp, Oryza sativa
  Predicted polypeptide sequence is orthologous to G3067
ggcgtcctcctcctgtgccgccgcgctctctctctctctcgcttcggatgccgctattgctgctgctgcgcctgtggctgccataagtatatcgcactccacggtgaccgaccgaccgacgcagtcgtcacgggcgcggcagatagctggctagtggctagcaccgcgcgtcgagacgggatgggcgagaggaggcgccgtgccagcgctgtcgccggcggccgggctgaggatgagaaggctgcttcggcgcctgcggccgcggccccggcaccgacggtgtggttcgcgctgaagaggtcgctgcactgccggtccgagccgtcggaggtgcacgtgccgaggcccaaggccgtcgccgccgccgctgcgggcggtggcgggcacctctcggcgattgtgaccaagcgcgcggcgccgcggtcgggttgctcccggtcgatagccaacctgcgggacgtcatccacgggagcaagcgccacccggagcggccgccgagctgcagcccgaggtccatcggcagcagcgagttcttgaaccccatcgcccacgaggtggtgctcagcaccaactcccgctgcgagctcaagatcaccggcttcggtggctgcggcggcctcgcggcggcggcggcggcggggggcggcgtactcgcgtcgccgcacgaggcggacggcgacggcgccgtggtgtcgtcgttcgttggcacgctccggccgggcaccccggggcccggctggagccacggcctgcagtacagcggctcgtgccggggcagcatgcggtgcacgcctccgaggtcgccgaatgtgctgctggacagcagggacgccgccgcggccggggtgaccgctcaccgcgcgtcctgcgaggacgccgtcaagagctttggcaagggcggcggcctaagctgccaccgttgcggtgagcagttcagcaagtgggaggcactggaggcgcaccacctttccaagcatgcagtgacggagctggtggaaggggactcgtcgaggaagatcgtggagatcatctgccggacgagcctgctcaagtcggagagcagctgcgtgcggatcgagcgtgtgttcaaggtgcacaacacgcagcggacgctggcgcgcttcgaggagtaccgtgaggcggtgaagctgaaggcgagcaagctgcccaagaagcacccgcgctgcctcgccgacggcaacgagctgctccgattccacggcgccacgctctcctgcgcgctcggcggcgcggcgggctcctccagcctctgcgcctccgacaagtgcgccgtctgccgcatcatccgccacggattctccgccaagaaggaaggcaaggccggcgtcggcgtcttcaccacgtccaccagcggccgcgcctacgagtccatcgaggcctccgccggcgccgtcgtcggtggcgacgacccggcggcgacgcgcaaggcgctgctggtgtgcagggtcatcgccggcagggtgcacaagccgctcgagaacctcaaggagttcgccggacagaccggcttcgactcgctcgccggcaaggtcgggccctactccaacatcgaggagctctacctgctgaacccgagggcgctgctcccgtgcttcgtggtcatctgcaaggcttaactccagagtcatgcattgcaaacgactaattaatcaagtaattaaccattctttcc

SEQ ID NO: 5275 - DNA, 2297 bp, Oryza sativa
  Predicted polypeptide sequence is orthologous to G3067
gcataagaccaaagagcaatttcagaggccagccagtcccaattatttttacctaccagtttactccaagataatgccggcctctagctagctgcatgtgccaatgagacccgttcagtttgaactttgcatccatggaggcagtaatactctctggccagctgaaggtagaagaagaagaaggcaatgatgaggaatgaatgacattagcagttacagacttacagttagcagtgcacagtcattgcagtattcagcaatcggattgtccggcgaggaaggggagtcgccggagaagggggagatgccgacggtgtgggcggcgctcaagaagtcgctcaactgcaaatcgggggattcttgcggcgtgatcgagcgggaggaatctcagggcggcgtcacagccggcaagaagtcgtcgtcgacgtcggcggcggcgctgcgcaggtcggggtgctcgcggtccatcgccaacctgagggacgtgttccacagccagtacggtggcagccggaggcaggaggacgccgtcgccgccgccgccgccggcgaaggcgatgggggatgcggtagcccgaggtcgatagggagcaacgacgtgctgaacccggtgacccacgacgtgctgctcgccgccaggtcggacgcgaagtgcgagctccggatcagcacccccggccgcggcgcgtgggccggcgccggcggcggggtgccgttcccgcacagcccgctcctgctgcggtgcagcaccacccctgtctcgacgaggaagtccccgtccgccatgtcgccgctccgccgcgccgacgacgacgacgacaacgccgaggcgccgtcgcccgctcccgccagggcctcctgcgaggtcggcatccggtgccaccgctgcggcgaccgcttcgccaaccacgacgccctggagtcgcaccaccactctagacacgccgtgaccgagctggtggaaggcgactcgtcgaggaaggtggtggagatcatctgcaaggccgggtgggcgaagacggagaacgcgctgggccgcatcgagcgggtggtgaaggtgcacaacgcggagaggtcggtggcgcggttcgaggagttcagggaggcggtgaaggggaaggcggcgaggctgtccaagaagcacccgcgctgcctcgccgacggcaacgagctcctccggttccacgccacgacgctcgcctgctccctcggcgctggcgactcctccaccctctgcacgtcgggcagctgcagcgtctgccgcatcatccgccacggcttctcggcgaccagagagatcaaggacggcgtcggcgtgttcaccacctccaccagcaagcgcgcgctggaatgcatcgccggagacggagacggcgacgaggcggcgaacgcgggcgtgaggaaggcgctgctggtgtgcagggtggtcgccgggaggatccaccggccgctggagaatctccaggaagtggcggcgcagccggggttcgactccgtcgccggcaaggtgggcgcctacgccagcatcgaggagctctacctgctcaacccgagagctctcctcccttgcttcgtcgtcatctgtaaaccttgatgattccttctgcaaaactgcttttaagaattgaggaatcgaatcattgtttagagtggtgatctgatcccaggaatccatgatcaacgcactgtacgacgctgttcttgatgatttcctcaacatcatactcgaacctgaaccccaaatccctcagccgcttggacgataccaccgacgggtttgaaaggagggtagtgcaaggacagaatctgagcaatctgggccatcggatagctccctccggcgcacagataccgtccatccgcttgctccgtctccatcaagaacacgtgagcgtcgcacacgtcctggatgtgtgccaatggcacacacccgaacctggagtgcacagatgccagcagagaatacagcttcggatcacctgcatatggagatgaacacacaaattgattttcagaacaatgctgttgatcattgcaagattagtacaatctgtacatgattatgtacttgtgtgatggagaatttgtttgcctgtaattggtgagaggaggagctggatgctggtaggcacattcggcgtcaagaacgggccggccactgtcggcagcacgagcgacgccagattgatgccattctccctcgcgaacccgaatgccgcctcctccgtcatcagcttcgacaggatgtaaacctgcaaaatgttcattgatccatggaacactaagtttttcagagg

SEQ ID NO: 5276 - DNA, 619 bp, Oryza sativa
  Predicted polypeptide sequence is orthologous to G3074
aaaaagcctcgttcgtcacgtcggttggcaccctccccgcgccgcgacacgacgcccgactccgactcgccgccggcttctccccttcgccatctctctcgcgatctcgccgcgccctcgccggaggagcgaggaggagatggaggcgaccaagacgcgcggcaccggcaatgcggctgcggcggcggagaagaggagggggcacggatcgacggcgctgttcgtggcggtggactacgccttcctgctcgccttcgccgggttcctctcctacctcgtcgtctcccacctcctcccctccgtcgcctcctcctagatctgctctgttttccctgtttttgttatgtttctttttttttttcgtttgctcgatcggatccgacgcgggtgacgtcacttcagatcgcctcgtcgtcggatgccatgacatctccgatgtgtaattccgtgtaatgggatgagaaaccagagctgcagtttcttggaaatttggcatggatttcagttcttgcttgcttgctcatttgttcttcaattgttcatgtcctggtcccgattggttggcctctggatctgatactgttcttgtcaatgcaaatttctgaatgccattgttgcc

SEQ ID NO: 5277 - DNA, 1049 bp, Oryza sativa
  Predicted polypeptide sequence is orthologous to G3074
gggtggaggagcggaggcggaggcgaacgcgaggaggaagacgaagatgaggaagaagctgggcacccgcttccccgcggcacggatcaaaaagatcatgcaggctgatgaggacgttggcaagattgcactagctgtacctgttttagtatcgagggcccttgaattgtttttgcaagatttaattgaccgaacttacgaaattacactgcaaagtggtgcaaagacattgaattccttccacctaaagcaatgtgtgaggaggtacagttcttttgacttcctaactgaggttgtcaacaaggtaccggacctcggtggcgctgactcatgtggagatgatagagcattacccagaagaagaaaagccttgccaaatggaagtgacccagagaatgaggaatctcgatcaagcaaaatggccgtaagaagtgcaaatatcagtcccagaggacgtgggagaggtcgaggtagagggcgaggacgaccacccaccaagcggaaggaagttggttatgtacaatttgaggatgagagcagcatgtttgctgatcagggcgaagccttaccaggagaggagacggttccagagaccatccatggcaccgagagcgtacctccaagcacacaccctccagcagaagccccatcggcagcagagataccagctccaaatccaaaggtggaagaagcgaaaaacgacgaccatcagccggattggcctatgccagatgcgattgggaacatcggtgtcggaccatccggttttggacatcttacggtgcaagttgacgaggatgaggactacgacaacgaggattagccacggccatcttctgattgttatgcactaacagggcagttctcctggtgttgtaaaatgtaaatatgtagctgcagctagctgtgatgtgctgctgatgtaatgcagtatgtagttgtcccgtgtaactttgtctgttttccaataattgcttgctagttgcctcacattgttgacatgattgactactgaagtgttttgtcagaattaacccggtattgaagcc

SEQ ID NO: 5278 - DNA, 1210 bp, Oryza sativa
  Predicted polypeptide sequence is orthologous to G3074
ggatgtcctcctccgctccggccccctcatcgatcgagctcgcagccgccgtgttccccgccggggaaggtcgtccttgccgttgggtggtgttcccggcgctggattgacgccatgaggaagaagctggacacccgcttccccgcgcctcggattaagaaaatcatgcaagcagatgaagatgttggcaagattgctttagctgtacctgttctagtgtcaaaagcattggaattatttctgcaagacttgtgtaataggacatatgacattacagtgcaaagaggggtcaagactctgagttcttcccatttgaaacagtgcatacatagttataatgtttacgatttcttgagggatgtcgtcagtaaagttccagacatgggtacatctgatgctggtgttgatgataaacttggcaaaaggaggaaaactgctgaagatgacagtgaagaggaatcaaagcggacaagaaatgaggcagcaagccagacaagcactggtagagggcgtgggaggggtcggggaagaggccgacgtggtgggcgtgtgtctgagagggagattatttccgcttacgaaaaatttgaggagaaccatgagtttcctccaggtcaatttagcaagccttctcagctgaaggtagatgtttcagttgatggtacagatgcaattgaaacaaaggaggctaccccattaagcaacgcaagagcttctctaaggaacattgacttaaacatagagcttactgactatgatgatgagggttcagctccactggaggtccagcctccagctccggcagcaggtgtggttacaacctcttcaggaccacttgtttcggaggtgaacgaagaggcgaagaccaaagactttctaggatggcaattgcctgagctgaccaagatggccatggaccctgttcagtttgccttgtcttcaaaccataggttagaggaggatgaggattatgacaacgaagaatgataacttgccccttttaggttaagaagctgatagatagacatgacttttgtcttttgtacatccttgtagcccagcttaactctgtagctgatcttgtataatgtgtgtacctgctgaagctgcagtagtttaggatgttacagaggtttatcgatcgatagctagcaactatgttgacagacagattcatcagttgtacatcctatctgatctccagtttatg

SEQ ID NO: 5279 - DNA, 1475 bp, Oryza sativa
  Predicted polypeptide sequence is orthologous to G3075
gattgagtttcagcatcagcgcccccaaaccaaataattttgaactctccggactccggccgccgccttccagaggaacctcgcggctgccggtgccggtgccggagaagacatggccgggaagaagaaggccctaacaaatcccgcctctccctccgcctccgcctccgcttccacccctaagaaatccaccgccacctccaaggaccgctccacgccgaaaccccgcaaaaaccccaaccccaaggaggaggcaccaccgccgccgcccgccaacaacaagcgcctcaacccccaagggggatccaaccgtaagaagaaggccgatgcggggacgccctccaagaagccgaagcgccagccgccggagcccaaacctcggaagcacaagggggccaagagcgagaagccgcaccgggtttccggcgaaggggagaagcccacgcccacgaagaagaagaagaagaaggagagcagcaaggagcccaagcgcgagaagcagcaagcgtccgcgcctatgtcgactccctcgaagaagaacaaggaagccaaacgcgacacaggaggagcggggaagcccacgcccaccaagaggaagctcggcgacgtggatcccccacaggagcgaccgtccggtgaaggccaggcaagctctcccacgcccgccaagaagcggaaggacaaggcggcggcggcggaggcggttgccgaccacggcgccggcagcttcccgatggctcgggtgcggcagataatgcgggccgaggacgccaccatccgcccctccaatgaggctgtcttcctcatcaacaaggccaccgagatattcttgaagaggtttgcagacgatgcttatcgaaatgctttgaaggatcggaagaagtcaattgtgtatgataacctttcaacagcagtgtgcaaccagaaaagatacaagtttctctcagattttgttccacagaaagttacagctgaagatgctttgaaggctccagttagcagccaagtgaaccaaccacaataagttgctagtgctccgcgagggaggtcatcctttcacgagttatctcctgggagggttctgcaattgtaaacgccagctgtgcagctcatgttgccctcaggactggcatcttgcgacatgttcaatatgattctgatcagaatcggaggcttaaaagaagattataaggggaaacctgagtaatctacatatgaaagaagcatgatgaaactttttgtcatgagaatcacttgaaatatgcttgcttagagcctcaaatcaggatcacctttttggctgtgtaagctgtgggttgtgtgaggtggatgtagcttaggctaaatgttactgtgtatttttttttagataatacgttactagtagtatacatttgtgagttctgacttgttcatgtactagttcattacatatattttcgcaggtgcatgctttaccaattacttgctggtgc

SEQ ID NO: 5280 - DNA, 2500 bp, Oryza sativa; identical to SEQ ID NO: 2147
  Predicted polypeptide sequence is orthologous to G309

SEQ ID NO: 5281 - DNA, 1727 bp, Oryza sativa
  Predicted polypeptide sequence is orthologous to G309
cattccaccaaaccaagccaagcaagcctcacaccctcgcccgcgtcgtcttcctcctagccgccgtcgcgcatggctcagttcggcggcttcggtggctggtccgccatggacgttgccgctgccgccgccgctgctctgggcaacgtcagcggcgcggtgtaccacgccgatcctgctgctgccgtgtacgcgtctctagtccctggcatggctgtggtccccgggcgtgctccgccgtccgccgtgcagatcgaggcggcgaggcggtggaaggagctggagaagatggccctgcggtcggtgaatctcatggtgacgtgcgccggcgccatccaggcgggcgactacgcggcggcggccgggagcctgtccgacgcgcgcgagatcttcgccaagatgcccaccacccgcaccgggatcggccgcgtcctcacccacttcgccgacgcgctcgccgagcgcctgttcccggcgttcccgcagtccgcgccgccgccgcccccgccacgcggggagcagcgcgagctcttccgcgggttctacgaggcggggccgtacctcaagttcgcccacctcgcggcgaaccaggccatcctcgaggcgttcgaggggtgcaacagcgtgcacgtgatcgacttcgccctcaccgatggcatccagtggccgtcgctcatccaggccttggccgtccgccccggcggcccgccgttcctccgcatcaccgggatcggcccccacgccgccggcaaccgcgacgagctccgcgacgtgggcctccgcctcgccgagttcgcgagatcttgcagcgtccccttcgccttccgcgggatcgccgcggaccagctcgacgggctccgcccgtggatgttccaggtcgcgcccggcgaggccgtcgccatcaactccgtgctccagctccaccgcctcctggtcgaccaggacgccgccgccgcggcgtcgttcccggcgcccatcgacggcgtgctcgactgggtcgcgtccatgaaccccagggtcttcacggtggtcgagcaggaggcggatcacaacaagtcgtcgctgctcgagaggttcactaactccctcttctactacgcctccatgttcgactcgctcgaggctatcagccgccatggcggcggcgacggggcgggcaacccgctcgccgaggcgtacctgcagggggagatcgccgacatcgtgagccgcgaggggagcagccgggtggagcgccacgagcagatgccgcggtgggtggagaggctgcggcgcggggggatgacgcagctgccgctcggcgccaccggcctctggcaggcggcgatgcagctccgcgagttctccggcgccggcttcggcgtccaggagaacggcggcttcctcacgctcacctggcatagccagaggctgtactcggcgtcggcgtggcgcgcgaccgcggggaagaagatgacgatgatggctagcggcgccgccgacgccatggaggagagtcagaacagcaacaccaacggcggcggcggcggaagcagtggtggtggccatggtgctctcaaccaaatcatgcagtgaagaagagggatgtttgggtttcgaagtttatgtgggggaaacaatgtgatcgattttgatgaaccagattaaaaagttgtaataatattgcatttagtctgagagagcaacatgttggttttcgaattaataataaaatgtcgtttctagct

SEQ ID NO: 5282 - DNA, 1482 bp, Oryza sativa
  Predicted polypeptide sequence is orthologous to G309
atggataccttcccgttccagtggcccatggatccagccgcgtcatccggcctcgacgctgggtttctgccgcctccagcggctgtggcgcccgacgacggcgtggggtactacgacccgcctgcgggggcggatgtggacgccgctgctctgccggagttcgccgcggccttcccgccgtgcgcgcctgatgctgccgctgctgtgttggccatgcggcgggaggaggaggaggtcgcgggcatccgcttggttcatcttctgatgagctgcgcgggcgccatcgaggctggtgaccacgcgctcgcgtccgcgcagctcgccgactcgcacgccgcgcttgcggccgtctcggccgcctccggcatcggccgcgttgccgtccacttcaccaccgcgctctcccggagattgttcccttcgcccgtcgctccgcctaccaccgacgccgagcacgccttcctctaccatcacttctacgaggcgtgtccctacctcaagttcgcgcacttcacggcgaaccaggccatcctcgaggccttccatgggtgcgaccacgtccatgtcatcgacttcagcctcatgcagggcctgcagtggccggccttgatccaagccctcgccctccgaccaggcggcccgccgttcctccggatcaccggcattggcccgccctcacctaccggccgcgacgagctgcgcgatgtcggcctccgactcgccgacctcgcgcgctccgtccgcgtccgcttctccttccgcggggtcgctgcgaacagcctcgacgaggtccgcccgtggatgctccagatcgcgcccggggaggccgtcgcgttcaactccgtgctgcagctccaccgcctcctcggcgacccggccgatcaggcgcccatcgacgccgttctcgactgtgtcgcctccgtccggcccaagatcttcacggtcatcgagcaagaggccgaccacaacaagacgggcttcctcgacaggttcacggaggcgctgttctactactccgcggtgttcgactcgctggacgcggcgagcgccagcggcggcgcgggcaacgcgatggcggaggcgtacctccagagggagatctgcgacatcgtgtgcggggagggcgccgcccggagggaacggcacgagccgctgtctcggtggcgggacaggctcacgcgcgccggcctgagcgccgtgccgctcggttcgaacgcgctgcggcaggcgaggatgctggtcgggctgttctccggcgaggggcacagcgtcgaggaggccgacgggtgcctcaccctcggctggcacgggcggccgctgttctcggcgtccgcctgggaagccgccggggacggcggcggcgacaataacaacaacagtaacagcaacgttagcggtagcagcggcagtgacagtaacaacagcggcagcagcaatggtaaaagcagtggggctcgggatggtagcagcgtgtgtttgtaa

SEQ ID NO: 5283 - DNA, 894 bp, Oryza sativa
  Predicted polypeptide sequence is orthologous to G309
atggagatggacaaattcagctcgtcgtatcagccgtcgtggccaccagcgcaggccaccgtcgacgtcgtcgggtcggtggagaccttctggtcgcctgcgctgaggcggtggcgccgtgctaagaccgcgtgcaggcggcaacgctgcaggccggcgcgccgggcgttccagcgcgtcgcgtcgttcttcgtgcaggagctcctggaccggcgagcatccgccggcgctgggccctgcgagcacggcgttctgcatcccgcagtcgtcgtgcgcgaggcgtacgcggaggggttagggatgtacctcgagttcagaggaatcaaccgtggcctcgagagcctccacatcgacgacctcggcgtcgacgccgacgaggccgtcgccatcaacagtgtcctggagctccactccgtggtgaaggagagccgcggggcgctcaactcggtgctccagaccatccgcaagctgtcgcccagggcgttcgtgctcgtcgagcaggacgccggccacaacgcgccattcttcctcggccggttcatggaggcgctgcactactacgccgcgctgttcgacgcgctcgacgcggcgctcccgcgctacgacgcgcggcgggcgcgcgtcgagcagttccacttcggcgcggagatccgcaacgtggtcgggtgcgagggcgcggcgcgcgtggagcggcacgagcgcgcggaccagtggcgccgccgcatgagccgcgcggggttccagtcggtgccgatcaagatggcggccaaggcgcgggagtggctggacgagaacgccggtggcgacgggtacacggtggcggacgagaaggtctgcctggttcttggctggaaggggaagccggtcatcgccgcctcgtgctggaaatgctag

SEQ ID NO: 5284 - DNA, 1599 bp, Oryza sativa; identical to SEQ ID NO: 2151
  Predicted polypeptide sequence is orthologous to G309

SEQ ID NO: 5285 - DNA, 1058 bp, Oryza sativa
  Predicted polypeptide sequence is orthologous to G3111
attgaacctaatcgccatggaggcattatcttaatcatgaggattacaaagaaaatgtatataccattagcgaacctggcgcgcccacgaaagctacctgcatccaacctgccttagttgcagcttgcctctgctctctgctctagctgctatccgtttctgtctcggacaggacgagcttaaagctgcgtcgcccatgtcgccgttgctcagtgacaagtgtcgtcgcgcacgcgcagcgatgtcgtcgtcgccggcgccggtggagtccccgtggctgacgatgcgcgccatgcggcgcgttggcggcgcggacggcggcggcgggcagcggagcgcgctgatggtggcgtcgtacccggtgctgctgctgctcgtcgtcctcgccgcgttcgtcaagtacgtgtggatcgcgctggcgctctacagcgcgctcctgctgctgttctcgtgcgcgtcgcgccgcctggcgctggcggagcggctgccgtcgccgctgggaggaggcggaggaggaggaggagtcgccgcggtcaccgcggcggaggagctccagggcgcggcggcgcggggcggggtgtccggggagacgctggcgtccatcccggcgttcgcgtacgacgcgtccgcgcacggcggcggcggcgaggcggcggcgcagtgcgcggtgtgcctggaggcgctgcgcggcggcgagacggcgcgccggctgccgtcgtgcgcgcacacgttccacgtcgcgtgcatcgacatgtggctgggctcgcacgccacctgtcccgtctgccggcgccgcgtcgagcgcaagcacaagggcggcgtgctgccgccgatgccgccggagccggagacggagccgccggtgtagctcgtcgtacttcctgtgtcttcctcctagtgatgcagaagattgcagaatggcagacaaaatttgtcaaatttgtactacatgtttagattagaggtacaataggccagtttttcttgccactctgcttattctgctgtttgtagatgctaacgcgactcatctttgtgaaatctgaagcctgtcgcat

SEQ ID NO: 5286 - DNA, 931 bp, Oryza sativa
  Predicted polypeptide sequence is orthologous to G3111
attgccttctccatttttcaccatttttaggtcagtgtattgcttaactggcccctcgtcggcacagtggttggcagtgctctcagtctcaccttcacctaccatgcgtcacttgctgcagtcgtcggagcacctgaccgccgcgacggcgacggcggcggcgtcgggcggccggggcgtccacacggacacgttcctcatcctcgccgccgtgctctgcttcctgctctgcgtcgtcgggctggcgctggtggcgcggtgctcgcggctgtgcaacccgtcgtcgttcgccgtcgaggcggaggaggcaatgcccccggcgccatgcaaggggctcaagaggaaggcgctgctgtcgctgccgaccgtgtcgttcgccgaggcggcggcggcggaggaggaggaggagcggccggagtgcgccatctgcctcgccgagttcgcgcgcggcgacgaggtccgcgtgctcccgccgtgcggccacggcttccacgccgcctgcgtcgacgtctggctcgtgtccacctccacctgcccctcctgccgccgcgccatcgtcgtcctcgcggcgccgtcgcctgcagtcaccgccgccgccaccgaccccccgccgccgtgctgcgccgccgacgcggcacaggcgtcgtcacagccaccgcaacccaccggcgccagcgaccgcggcggctgccggacatcggtgccgtagagctccagctctctctcgctcgcgtacgtgcatcattcgattgtacatacacacacacctagcaaaaacgtgaatagtagatacgtgttccgagagattttttcttgtactacgcagcaatgcaactgtagtagatacatgtgttctgtaaatacatgcatgtacacatctctgttaattaaccatcattttcccttctttttcgaacgataattaaccgtc

SEQ ID NO: 5287 - DNA, 563 bp, Oryza sativa
  Predicted polypeptide sequence is orthologous to G3111
aagcagagcaaactcattcactccgatagattgattgatttgtcagtccgaggccgaggcggctccatccaagtcgagcagaaaagaatgcgagttctcgtccactccgccgagtccccggcaacaccggcggcggccatctccatcgactcggacatggtggtcatcctggcctccctcctctgcgccctcatctgcgtcgccggcctggccctcgtggcccgctgtgcctgccgccgccgaggcgccgctaccaccaccaccaccactactactacaccggctgctacatcccctgcacccaaaggcctgaagaagaaagccatcgacgcgctccccaccgtgtccttcgcactcaagcagcagcagcagcaggcggagtgcgccatctgcctggctgagttcgccggggggggaggagctacgcttgctgccgcactgcggccacgccttccacgtctcctgcatcgatacgtggctggggacccacgccacctgcccctcctgccgcgccaccgtcgggactagtacattattcctccctctccccggccgctgccgga

SEQ ID NO: 5288 - DNA, 768 bp, Oryza sativa
  Predicted polypeptide sequence is orthologous to G3111
atgctccggccgccgacgccgacgcggcgcctcctccagagcgtcggcggtgggagcaaccccaaccgcatccctggcatcccgcccgccgatcccccctccggcggcgtcagctccgatgtcgtcgtcatcctcgccgccctcctctgcgccctcatctgcgtcgtcggcctcgccgccgtcgcccgctgcgcccgtaaccgccgcaacagcggcggagccggcgccggcgccggctccgcctccccgtcgcacagcccggcccacgcggggcacttcggcggaggagggagcggaggtggcggcgtaacgacgacgacggcggcgacgaccgccgccaaggggctgaagaagaaggcgctgaaggcgctgccgaagctggcgtacgcggacgcggtggcggcggcggcggcggcgaggggcacggtggtgggggaggaggaggaggggaaggtggaggtgctcgccgagtgcgccatctgcctttccgagttcggcgagcgggaggaggtccgcgtgatgccgcagtgcggccatggcttccacgtcgcctgcgtcgacacctggctccgatccaactcctcctgcccctcctgccgccgccccatcgtcctcgacgacccctcgccgcccaagcgctgccgcaagtgcgaggccatagtcctcgaggccgtcgtcgccgcctcctcctcctcctcctcctccgccgccaccgccaccggcagcggcggaggcggcggcggtggcggtggccgattcttgccgtag

SEQ ID NO: 5289 - DNA, 528 bp, Oryza sativa
  Predicted polypeptide sequence is orthologous to G32
atggcggacgcggcggagcagcatcaccggcaggaagagactgcggcggcgacgacgacgccgcagcagatgatgatgcggcggcggcgggcgcgcgcgtcgagcgagtacctgggcgtgcggcggcggccgtgggggcggtacgcggcggagatccgcaacccgtacaccaaggagcgccactggctcggcaccttcgacaccgccgaggaggccgccgtcgcctacgacctctccgccatctccatctccggcgccgccgccgcgcgcaccaacttcctctaccccgacatgcaccaccaccacccttcgccgccgcagcacgcgctgtctccggcagtgccaccgccgccaccgccgccgccgccgtcgccgctgtacgatgatgattacctgtcgccggcggcggcggaggaggaagtggaggccggcgacgacgagtcgctgacgatcgcgaccatcctgcagagcttccagtatcagcagagcgtcccaccggcgtcatcgggttccatgttttattattag

SEQ ID NO: 5290 - DNA, 879 bp, Oryza sativa
  Predicted polypeptide sequence is orthologous to G32
atgatgaacttctcctcgtacttctactcgtcgtcggcggcggcggcgggtggtggtggtggtggtggggagaagaagtcgtcgtcgtcgtcggcgtcgaagaagaagcagcagcaggcggcggcggcggagggagggaataaccagacgaggtaccttggggtgaggaggaggccgtgggggaggtacgcggcggagatcagggacccggcgacgaaggagaggcactggctggggacgttcgacacggcggaggaggccgccgtcgcctacgaccgcgccgcgaggtcgctccgcggcgcccgcgcgcgcaccaacttcgcctacccggacctccccccgggctcctccgtcaccccctacctctcccccgacctctccgccgacgcctccgatcagctgctccagccgttctacgccaatccctccgccgccgccgcgctgcccactccggcggcggtgatggccggaggaggaggagtcgaattcggcggcgagtacatgtacggcggcggcgtcgacatgtcgtcgctgatggacgacattgcggccatgcccgacgacctcccgcccagcgtgacgggcggcggcggcggcttcgccagcagcgacgaatactccagcggcggcggcgggatggtcgacgacgtctccatgtactgcggcggcaatggcggagggtcgtcgtggtgcgacgcctccgacttcgcctcgtactcgtcctcctcgccggcggcggcggcggcggcaggctcgcacgggatgtacttcgaggaggggtacgtgcacagcccgctcttctcgccgatgccggccgtcgacgacgccggcgccgacgggttccagctcggcggctcgtcgtcgtcctactactactga

SEQ ID NO: 5291 - DNA, 437 bp, Oryza sativa
  Predicted polypeptide sequence is orthologous to G326
gcacttatttttgggacggatgaaataatgtgttttttagagaaaagaatcgagcgtcagtatgcttcgctgacaaggggatggcccacgtgtcagtgaatcgaggagtatggtaccacgtgatagatatactgatatacatatatagaggcgtatgagaagagagaagtaaaaaaatacaataaatactggaaacattattgtaaatatacactttgttttattctttttatatttcttgtttggtcatggatttgtttcatttttgtaaaatgtagaacggtgctatgtgatgtgtagtttcccatagtttgtaatgttgaactactggatggttgaagctgttgtattttgtcccactttcacatgaagcctggttaaataataaataaagaaaagggtaacaaacatttttcatgccaaaaaaaaaaaaaaaa

SEQ ID NO: 5292 - DNA, 1892 bp, Oryza sativa
  Predicted polypeptide sequence is orthologous to G326
gcctcctcattcctgcattgcattgcttccgagctcaaaagtcgtcgtagacccccgcctccttcctcctcctcctcgcgcttcgatttggtttggtttgattcggtttgcgagatgaaggatggtggtggaggaggagggagggggcagcagcagcagtggccttgcgactactgcggggaggcggcggcggcgctgcactgcagggcggacgccgcgaggctgtgcgtcgcctgcgaccgccacgtgcacgccgccaacgcgctctcgcggaagcacgtccgcgccccgctctgcgccgcctgcgccgccaggccggccgccgcgcgcgtcgcctccgcctcggcgccggcgttcctgtgcgcggactgcgacaccgggtgcggcggcgacgacggcgcggccttgcgggtgcccgtcgaggggttctccgggtgccccgccgccgccgagctcgccgcgtcgtgggggctcgacctccccggcggctgcggcggcgaggaggaggaggccgacgacgcgttcttctcggcgctcgactactccatgctcgccgtcgaccccgtgctgcgcgacctctacgtgccatgcgacccgcccgaggtggtggtggccggcggcgggcggcgactcaagggggaggcgctcggccaccagctcgccgagatggcgcgccgggaggccgagacggcgcacccgcacacgcagccgcactcggatctgagcccccgcacgcctcgccggacctccgccgcggcgagcggccgcctgcaggaaaagcaagctcccccgccgttgcctcatgctgctgcgacggcggcgccgctgccgtacacttcactgctcatgatggcgccggccaactgcaccgagctcatggaaaacaaccgtgttggagacgaagatgaaaatgttctgtgggagagcaccgcgccatcagtgccaccaacccagatatgggattttaatttgggaaaatcaagggatcacaatgagaactctgcacttgaagttggatttggctcaaacaatggaggctttatgattaagagttataatgacatgctcaaggagatttcttctgggacaacgaaggatctggaagatatttatgactcaagatattttgcagctgccgaagatatcatgtcgactaatgtctgtcagctgtcatcgaaaaatccaagcaccaggagcaacaaacggaaggcgagctcatgcgcttcgacgatcgatggaccgacaacttccacaagccatgtacctgctgcttcaggggcattggggggctcttcgaacgacagaggatcggctctccccaaggagatttccttctgtgatcagaccgtcgtccctaccggagccgatcagaggccatgtaccatcaagatcgacagcgagacgctcgcgcagaacagggacagcgcgatgcagcggtacagggagaagaagaagaaccgcaggtatgagaagcacatcaggtacgagtcgaggaagctgagagcggacacgaggaagagggtgaaaggccggtttatgaagtcgaacggagcacctgatgatgtcagcaatggcgggtgatctcatccctgcaatccctgatagctagctgcaatgtacgtagcctggctttttgacgttgcagagatcgatgtggccatatatatgctgagagctaagtctgaaatatgttgcgtatgttgttacaacctatgcacgctctgcttaagtctgtctgctgctgcatgtattgttcagctaaaatttttgcgtccaagagtcgatcttgataattaagtacccctactacaaatctacactacatactgtaatagaccttagattttttttctcatctcctcgtagaaatatatggcattttatatatacgt

SEQ ID NO: 5293 - DNA, 1817 bp, Oryza sativa
  Predicted polypeptide sequence is orthologous to G326
tgatgcccacacgcacccacccaccgcgccggcggcgaggccatcacctcctcctcctgcacgtgcgccgtgggcgtggtcgccggagccggaggggtggatgacgtggcggagctgcgactactgcggggaggcggcggcggcgctgcactgcagggcggacgcggcgaggctgtgcgtggcgtgcgaccgccacgtgcacggcgcgaacgcgctgtcgcggcgccacgtgcgggcgccgctctgcgcccggtgcgaggcgcgccccgcggcggcgcgtgtcgccgccgtcgctggagctggaggatgcggcggcggcggggaggccaggttcctttgcgccgggtgcgccgacgacgacggtgcggaggcggcgagggtgcccgtggtggggttctccggatgccccggggccgccgagctcgccgcgtcgtgggggctcgacctcggcggcggcggcggaagagatgaattcgaggaggatccgttcttccccgaggccggttacccaatgctggcggcggatcgcgtgctgcgggacatgtacgtgccctgcgacccgccgccggaggtcgccgccggcggacgcggacggcggctcaaaggggactcgctctgccaccagctcgccgagctggcgcggcgtgagatggaatccgcgccggcgcaggcgaactcgggatcgatctccccatcagctcgccggggctctgccgctgcaatccgccatgaggctgcggcagcggcggcggcgcaaagggccacattgccgtacaagtccacgccggtgacggaggcggcgggctgcggcgatgtcggcaacggcgagcagttcaccgacgacaacgaactcgtgtggcagcgcaccgcgccctccgatccgccatgccagatatgggattttaatctaggaaaatcaagggaccatgatgagcactctgcacttgaacttcatttcggcccaaaagatggaggctttatgatcaaaagttataatgacatgattgaggaagtttcctctagctcaaggtaagatcttcaatatatttatgactcgacatactcttttgccacggaagatattgtgtcggccaatatctaccagttgactccaaaacagctgagcactgccacatccggcaacaggcgacacaaggacgagcaacacggattgacaaatgacgggccatcatcttcgaggatcgacagcaaaacgatcgccatgaacagggacaacgcgatgcaacggtatagagaaaagagaaagactcgcaggtatgacaagcacatcaggtacgagtcgaggaagatgagagccgacacgaggacgcgggtgaaagggcgcttcgtcagggccactgacatcttcaacgtcggtggcggcgacggcggctgaaaatgtgcttgcgatgtctgaaatccagcgacatcctcaacaacgtcagttcagtggggattattgctgggggaatggagatgctgcatcaccaacactttttgtgaatagcctgaactgaaacttgtttcctggagtagtagaatacatacgatatcacatccatgatcttgtattgttgtatttttttttttgagggattgtttttttttaatgacaagttttttttgaatgactttttgagggattgttgtatggttattattccactcagaagtttttgcagcccctgaaaatgtggcaagttatgtaggacctgtttgtaattttgttgccactttcaaccccactaaactttagtagggtagcaaactaaacattatcttataaatacaattgtattaatatttggtagttacgg

SEQ ID NO: 5294 - DNA, 1361 bp, Oryza sativa
  Predicted polypeptide sequence is orthologous to G328
attgacgtcttcgcacaggcacccagccatgctgaagttggagccggagttccccggcctgccgcagcggtgcgactcgtgccggtcggcgccgtgcgcgttctattgcctcgccgattcggcggcgctctgtgccacgtgcgacgctgacgtgcactccgtcaacccgctggcacgccgccaccgccgcgtaccaatgggcgtggtggctgcccccggcgccgggggagccttcgtcgtccgccctgcaggcggtgtcaactcctcctggccaatccgagagggcaggaggtgcgactacgacgatgacgacgccgacgccgctggggaggaagacgaagaggcgacgtcgtggcttctgttcgacccgctcaaggactcctcggatcaggggctgccgccgttcggcgacgcgctggtggccgacttcctcaacctcggcgggggcgccggggagaaggaggacgcgtcgtcgagcaaggactgcagcagcagccacgggaagagcagcgagggcagccacgagttcgccgtgcccggcgagcccgtaccggagcgccagggcttcggggcggtgagtatggacattaccgactacgacgcctccaatttcaggcgcgggtacagctttggcgcatcgctcggccacagcgtttcgatgtcatcgctggagaacatgagcacggtcccagactgcggtgtgccagacatcaccacctcctacttgaggtcatccaagagcaccatcgacctcttcacggcagcagctggctcccctgtggcggcgcacagcataatgtcgccaccgcagttcatgggcgccattgacagggaggccagggtgcaccggtacagggagaagaggaagacgaggcggttcgagaagaccatcaggtacgcgtcgcggaaggcgtatgccgagacccggccgaggatcaagggacgcttcgccaagcgcagcgacaccgaccttgaggtcgaccagtacttctccaccaccgccgactccagctgcggcgtcgtgcccacgttctagcgagcagcttggccgcacgcctggaagacaatcaaagaagctcaggaatgaatatattctcccactgtatagtacatcttggttgcttagctatatatatatatatatatatatatatatatgtataattcgccgaatcgcctctaaatttgtgggaggtatgaggcttcagctgtaggtatatatagatgctagaaagatgctccttgtaaaattgtgcaggagtaaatgtaatcatgtagtcatccctccttctccaatcctttacaatacatttctgtttttttattcagcttaaaaactacgttttgttttttctcccgat

SEQ ID NO: 5295 - DNA, 1557 bp, Oryza sativa
  Predicted polypeptide sequence is orthologous to G328
caaaattccacaagagccatgcgaggtagaggaacaggagaagacgcatacacacacgacacatagagagagaggacaaacacaatagcttggatcgatagacttgtccatgtggtgcaagctaaagctactactaccacaagcaaggctacttcgttcatgaattataattttggtggcaacgtgttcgaccaggaggttggagttggaggcgaaggaggaggaggaggagaggggagcggctgcccatgggcgcggccgtgcgacgggtgccgcgcggcgccgagcgtggtgtactgccgcgcggacgcggcgtacctgtgcgcgtcgtgcgacgcgcgggtgcacgcggccaaccgcgtggcgtcccgccacgagcgcgtgcgggtgtgcgaggcctgcgagcgcgccccggccgcgctcgcgtgccgcgccgacgccgccgcgctgtgcgtggcgtgcgacgtgcaggtgcactccgcgaacccgctcccggccatcaccatcccggccacctccgtcctcgctgaggcggtggtggccaccgccaccgtcctcggcgacaaggacgaggaggtggactcttggcttctcctctccaaagattccgacaacaacaacaacaataacaacaacaacgacaacgacaataacgacaacaacaacagcaacagcagcaacaacggcatgtattttggtgaagtcgatgagtactttgatcttgtcgggtacaattcgtactacgacaaccgcatcgaaaacaaccaagatcggcagtatgggatgcatgaacagcaagagcagcagcagcagcagcaggagatgcaaaaggagtttgcagagaaggaagggagcgagtgtgtggtaccttcacagatcacaatgctgagtgagcagcagcatagtggttatggagttgtgggagcagaccaggccgcctccatgaccgccggcgtcagtgcttacacagattccatcagcaacagcatatctttctcatcaatggaggcgggtatagtaccagacagcacggtgatagatatgccaaattccagaatcctgacacctgctggagcaatcaatctcttctcaggtccctcgcttcagatgtcccttcacttcagctccatggacagggaggccagggtgctcaggtacagggagaagaagaaggccaggaagtttgagaagacaatacgttatgaaacaagaaaggcgtatgcagaggcacgaccccggatcaagggccgtttcgccaagagatcagatgtgcagatcgaagtggaccagatgttctccactgcagctctatctgacggtagctatggtactgttccatggttctgatgggactcatgagacgctatcttataggcatatatatggggacttactgagtagcaataacatcgatccagtgggagtagttctagacaatctgtgttatgaataatagtgtgttgtttgcgacttaaaattgatcaagtaccttagctttttaaagttttgctttgtaatttccggatagcagatatatattgttggtacttgctcagt

SEQ ID NO: 5296 - DNA, 776 bp, Oryza sativa
  Predicted polypeptide sequence is orthologous to G328
ctagaaagattatcagtttattcatgggtcttgactaaagcagtaacagaatttacaaagtgaaaaatagggtgttaattctacaccgagatatatggagaaaatatcaagaatctacaggatctcctacaaataaaataaactgtaaagaaagcactagctaaaactcaaaaacaaatggtaaaactgtttagagatttcatacatggtgaatgatgatcctggtgtaaaattgttgatgcttgcagggagaccttgctgtcacagggtggatatgaacaggagttccataattttatcccctgatgcatgatcacatagtcattctgcaaatggtccccactggaacaagtccaaaccactgctggtcccaattcacggcattaatgtgcacatgccaataacctgcatgtcgatgcaccgttaaaagattcagacgtgatctagtatcagtggacccaagatcaaaccagtgctctaaccatacgaaagcctccgtaatgtatgctgttgccagtgtgtcacagacaccatcatgagctcaattcaacatgacatgttttctgcatgtgacaacaattcaaacgatgcatacgggcatgaacctgcgctgagccaacttgtgaccggggtgctaagatcaagaacagctccagatggtccctagcaatcctcaaccatgtcgtttcagtcttgtcatcgatggcaacgatatccctcttttcacggtcataagagagcccatcagtggtaaggaaacaacgatctgctccgga

SEQ ID NO: 5297 - DNA, 447 bp, Oryza sativa
  Predicted polypeptide sequence is orthologous to G328
atggtggctgccgccgtcctgagcccatcccgacgcgcccatggccgtcgctattatcctgagtccatcccgacgtgcccgagaaacccagcacacgccgaggccgctactatcctggcgagccccaggatcgagaggatcatatgctatccctcggcgctcctgcgcctatcgctgtcgcctccaccgtctccacgccatccgcgagctctgcgccgtatttggtggtggtgtaggagctctaggactgcttggtgcgccgacgccgacactgacaccgacgccgaggttgaggttgaggttgagcgcgccgtgctgctatcgctgctaccgaacatcacggcctcggctgccacagcagctgaaccgatgggcgtgacagggacgcgcgtggcgccgggccagcgggttggcgtcgtggatgttggcatcgcaggcagcacatag

SEQ ID NO: 5298 - DNA, 242 bp, Oryza sativa
  Predicted polypeptide sequence is orthologous to G344
gaatgtctgccttccttccacggtagagccacccactgcgctttcgccggcggcggaggaggagggaggtgcgtttatggttgattgtgtcagttgttccctcgccggctaagaatacgacttcttccggacggctcaggtcggtaattcaaaacttggacgtggtatataacagtgatcttacctcgtttggaccaccctctatatgcgctctatgctttacatgaaactgataatggaaa

SEQ ID NO: 5299 - DNA, 811 bp, Oryza sativa
  Predicted polypeptide sequence is orthologous to G351
ttggccatatatatgttcgatcactcccacacaattctccaaaccaagagcacataacgtatccagggcagagcagcatatcgatcttagaattagctttcagttcacgcgcatcatacaaaaatggtgaccaacatgacccacgatgactacgtctccctctgcctcatggcgctcgcccaggcgggcgtcgggggtcagtggccggcgcagaaacagcagatcgacatggcaccgccggcaccggaacgcgagcttcttcggttccggtgctccgtctgcggcaaggccttcccgtcgcaccaagcgctcggcgggcacaaggccagccaccgcaagccgccgacggccgcgttgcccatgcacgtaatcgacgcgccgccgccgccgtcggccgaggacacagcctcgtcgtcgacgacgacaacaacgtcgggcggcggcaggcacaggtgctcggtttgccaccgtaccttcgcgacggggcaggcgctcggagggcacaagaggtgccattactgggacgggctgtcggtggtgtcggtcacggcttcggcgtcaggttccgggtcgtcgagcgtgaggaactttgacctcaacctgaaaccggtgccggagacggtggccgctggcgtcagaaggtggggagaggaggaggaggtgcagagccctttgccgttcaagaagcgccggctgtcaagcccatcattggagcttaatttatagtagcatcttaattcatcctaattccttactgtccagaaattcattcgtttacttttttttcttgttaaagctatcctttgtgatt

SEQ ID NO: 5300 - DNA, 1097 bp, Oryza sativa
  Predicted polypeptide sequence is orthologous to G351
atcatccatccatctccctgcagctacgtactgtacttgttagcaatcaatcccatcaaatcatccaccgctcgctgctgctgctacgtactatacagcttgattaattaggttttacgacgacggcaacggggacagatatgacggccgccctgcaagcgctgctcgacccgacggcgctgtccttgggcctgcccacgccggcgatcaacaaggaggagtacctcgccatctgcctcgccgcgctcgcctgcacgcgggcggggaaggccctggtgggagtgggaggccagcagcaggtgcaggcctgcaataagtggctgtgcccagcgcccgcggcgcctgaggagctccgcttccggtgcaccgtctgcgggaaggccttcgcctcgtaccaggcgctcggcggacacaagtccagccaccggaagccgccttccccgggagaccactacggcgccgccgccgcggcgcagcagctggcatccgctggtgactcgaaggaggactcggcgtcgtcagcggccgggagcactggcccgcaccggtgcaccatctgcaggaggagcttcgcgacggggcaggcgctcggcggccacaagcgctgccactactgggacggcacgtcggtgtccgtctccgtctcggcgtccgcgtcggccgcctcgtcggccgtcaggaacttcgacctcaacctgatgccgctgccggagagcacagccgccgccgggatcaagaggtgggcggaggaggaggaggtgcagagtccactgccggtcaagaagctcaggatgtccaactaattcatcatacgccatcttgtaaaaacaagagatctgcccattgatcgactctattgaacagagtctattctttgattttttttttcttttcaactcactaattgtttggtttctgtcatcgagtatgcaacaagctaagctggtgaccatggatcttccaagattgattgtcgccaagggacatatatggttctaggagtgttgattcatttgattctttgtatatttgttcaatctaaaaattaatgtactcaatctgctcaatatatatagacgctatattattacgactcc

SEQ ID NO: 5301 - DNA, 712 bp, Oryza sativa
  Predicted polypeptide sequence is orthologous to G351
gtcgatttcataccactatggggctaaacgagaagccattggtgcctccgttgtctccaacgccggtggacttccgagcccatcaggtgttcccatccaagcaccacgattttgacactagcaagagtcgtaacatctctggtagtgtcgccatcggcagtgattctgaggaggagtacttggcgacttctctcttgatgctcgcacatggcattcgggacgagaccaaggacatccgagggatgggagacgtaaaaggtgtgggtgttgacactttggagctggtgaaaccaagccaacgggcttatgagtgctcggtgtgtggcaaggtgtactggtgttaccaggcgttgggtgggcacatgacgtgccaccgcaacctatttgcacaagtggtggccggtgatgagttgtcctccgataggaccatggtggttaaggggcacaagtgctctatctgtcgccttgagttcccatctgggcaggcgctaggaggacacatgcgggtgcactatgtgggtggtgttgaaggaggctctgtcaaggagaagaacgttgtgaagaccaaggttacaggagcactgaagctagtgttgaaagactttgacctgaacgtgcctgttgtggcaacgatggtgggagacgaggctgagagctcacattcagaggccaaagcgcggatgatgacactcccctaaccagcgcaatactt

SEQ ID NO: 5302 - DNA, 894 bp, Oryza sativa
  Predicted polypeptide sequence is orthologous to G351
aatcgcatgcaaacgtatcgccttcaattttcacgacacgagctgtgtgtgttggatagcgtgacgtgatggagcaaggcggcggcgccgccgacggcggcgacctcatctccctgtgcctcatggcgctcgccgccgcggcgcgcggggagagcaccgcgctggcgctggcgctggcgccgccgccgccggagctccacttccggtgctcgctctgcggcaaggcgttcgcgtcgtaccaggcgctcggcggacacaaggcgagccaccgcaagccatcggcggcggcggcggcgccgcccgcgcacagagacgtcgtcgttgctgctgctccggcatcatcaggccgcgtcgccgccgacgccgacgccgcctcggaggcggacgggcggcggcggcggcacgtctgctcgctgtgccggcgaggattcgccaccgggcaggcgctgggcgggcacaagaggttccactacttgcatggcccatcggtgtcggcgacggtctccagtgcagcgacggcggcgagcgtgggcgccgctttcgacctaaacgtggcgcccatcaaggaaatcgccggcgagcaacgacggtgcggcgaggaggccgacgacgacgatgaggcggagagcccttcaccggccaagaagccacgacgccggccaggatgagatcctccacgttagtatatatgaagtactaaccatccaattatatacatatagctcgttgagcatgtatgtatacaaccggtagagaaagcagaggctgctcacgtcgtcacgcgtgtgctccgatcgataactttagggtgtgcaattgtaaataaaaaaagggagattcggagggaaagacgtcctccagacagagattaaacacgggctcgatgttaaaatt

SEQ ID NO: 5303 - DNA, 883 bp, Oryza sativa
  Predicted polypeptide sequence is orthologous to G354
gctcgtcattaagagcgaaagaaagttacttggaattctttggtttgttgtaatgacaatcacgagagaagaagcggagagcaaggagatggagagcctacgggtgcacgccagcgcgctgctctcgctgtcgtcgcctgcagcgtcggcgtcgcagccgacgtcgtcgtcgtcgacgacggagggggtgttcgagtgcaagacgtgcagcaagcggttcccgtcgttccaggcgctgggcgggcaccggacgagccacacgcggctgcaggcgaagctgctgagcgaccccgccgcggcggcggcggcggcggccgagagggacagggcacgcgtccacgagtgcgccgtgtgcggggtcgagttctccatggggcaggcgctcggcggccacatgcgccggcacaggggcgagacgggcacgacgaccgtcgtgctcgcggacgccgacgactcgggcggcgccaccgtgccgcagccgccggagcccatgccggacctgaactacccgccgctggaggacgccggcgacggctcggagcctgagttacttaaccttcttgtataagttgcatcgatagatatacatgtgaattgaattggcgtctgtacatagatatggtggatggattctttaccaaatttgatcgaaaaaaagaactaaattttggagcgtgatgatcatagcatgtaagttgtaacaaatgattgttaactgtaagataggaattctattcatttgttctcttctgtacaaaattacaaataggttgattaattagttggtcggttgtggttgattctttgtaaaataccaatttactagtataaatatactgacagcttattgtttcaaaaaaaaaaaaaaaaaaaaaaaaaaaaa

SEQ ID NO: 5304 - DNA, 737 bp, Oryza sativa
  Predicted polypeptide sequence is orthologous to G354
gacaaagctgggtaccgggccccccctcgagtttttttttcctttttattttttttttttttttctgtaacaggtggtatggcctttaattatgtgtatgtacacaaaacaaactacgcttccatcatgtgagtaaaatctctgttatctaaattattctggcatgtacatgtgtggtacatatataaatcaatatttgaaaacagggaacaatggacgtaaaacacagccgattcgatcgaacagtctgacacaaataaaattcgattggaaaattgactaatgaatgaatgaatgaattagtatatccagcgtaaagcaattcctacaatggtaaaatctctatctgaaaaaaaaaaaataatgaatgcaatagccacaatcgtgcaccaatatgtacaggcagcaatcgcacgaatctaaacgaaaagctcgagcaaaacgggcggcgcgtgcaccgccgcggcggcggcggcggcctcctcgcggtggcggcgcatgtggccgccgagcgcctggcccatctcaaagccttggccgcaaatgtggcactcgtgggtcgccgccgccgccggcttctcctgcaccttcttggtggtctccttggccgtggcggcggcaaggccaagcgcgagcccgtggcggccgcgcaggtggctggtccggtggccgcccagcgcctggaacaacgggaacgcgcggctgcacgtcttgcaaacaaagtccccactcccgga

SEQ ID NO: 5305 - DNA, 761 bp, Oryza sativa
  Predicted polypeptide sequence is orthologous to G354
cagatttcgatcggcgacgttagtgatcagctgggttaattaattacgtggctaattaagctagctatagccatgagcaagaggagcaggaccatgtgggacatgcaggagttcgtcggcagcgtggacacggcccgcgtgctgatgctcctcgcgcagcagagccagcacggcctgctgggcggcggcggcttcgccgccggcgcgcagccggtggtggtgcgcggcggcgcgcacgaccgcgtgttcgagtgcaagacgtgcaaccggcagttcccaacgttccaggcgctcgggggccaccgcgccagccacaagcggccgaggcagcagcagcagcacgcgctcggcggcggcgccggcgccgacgacgtggggctatgcctcgggaggcagccgacgccgccgcggccgcagccggcgaagccgagggtgcacgagtgccccgtctgcgggctcgagttccccatcgggcaggcgctcggcgggcacatgcgtcggcaccgcgcggaggccgaggcggcggcgacaacgacgacgacgacgacgaagaacggcgacgtaggcaaggcggcggccgtgaaggcctgcgacggcggcggtgtctgcctggacttgaacctgacgccgtcggagaaccgcgcaaagtgccggaacgtggtgggtctcggcgccggcgggcagggcgtacacaaggcgctcgccatgttggattgtttcctttgagccgttcaaactgcacatattattgcatgatagct

SEQ ID NO: 5306 - DNA, 382 bp, Oryza sativa
  Predicted polypeptide sequence is orthologous to G354
acgtcgatggcactgacgtcgtcgtcgacgccggcgggcagcagggcgctggcggcggagggggtgttcgagtgcaagacgtgcaacaagtcgttcccgtcgctccaggggctgggcgggcaccggacaagccacacgcggctgcaggcgaagctgctgagcgaccccgccgccgcagcggccgagagggacagggcacgcatccacgagtgcgccgcgtgcgcggggtcgagttctccatggggcaggcgctcggcggccacatgcgccggcacaggggcgagacgggcacgacgaccgtcgtgctcacggccgccgacgtcgacgactcgggcggcgccaccgtgccgcagccgccggaggccatgctggacctgaacta

SEQ ID NO: 5307 - DNA, 932 bp, Oryza sativa
  Predicted polypeptide sequence is orthologous to G354
attcaaccacgctttcagccttccaagctctacggctcattatttttccatctccctccttaatttagccaagctctacactgctcgatcaatggcttacgggaagaggcctcggcagcaagccgaggaggcggcgttcagcctgttcgacagcagcgacatggcgcgcatcatgctgctcttctccggcgcccacggcggcggcggtggcgcggcggcggcgtcgccgccggagcggatgttcgagtgcaagacatgcaaccggcagttcccgtccttccaggcgctcggcggccaccgggccagccacaagaagccccgcctggcggacggcgacccggccgccgaggcgccggccaagcccaaggtgcacgggtgctccatctgcgggctcgagttcgccgtcggccaggcgctcggagggcacatgcggcgccaccgcgccgtcatggcggacggcctcgggcttggcctcagcctcggcctcggcatcggcgtcgtcgggcagagcgacgacgacggcggcaagaagaaggccgcggccgccgccgccgccgccgagctggtgttcgacctgaacgcgccggcgatagaggaggagccggatcgcgccaggccggcggggctcgccgtagagttccccgtggtggttgacttcccgtgctgacattgacacagagatttacttctccatacaagttttgaaaattaatttacagtttacatttatacgctacccgagaagtcaaccctggagacattagctagagagattccgtcatacatattttttccctggaaatgtattcggatgattataatgttttcagggcctatatattgtattggttgacttatcgtggtacttatagtcggttgtccttttccctttcggtgctacatattttattctacctgtagtggttgttttc

SEQ ID NO: 5308 - DNA, 884 bp, Oryza sativa
  Predicted polypeptide sequence is orthologous to G354
attggagagtcatacatctcaagcttgcttcagatttcgatcagcttcagtcttcagacaacagagaggttggttcacaaagtttctgtaagtaaagcattcattcagatcatgaagaggtttgcattcgaggacagcgatatggcgcgcgtgctgatgctcatgtcgtcgcacgggcagcaggagcaggcgctggctctgccggtgccggtgcagctgccgctcgccgccgcgcgcggcgaccgcgccccggagcgcgcgttcgtctgcaagacgtgcaaccgcgtgttcccgtcgttccaggcgctcggcggccaccgtgccagccacaagaagccgaggctcgacggcgacggcgacctctccctgtccaagcccaagctccacggctgctccatctgcggcctcgagttcgccattggccaggctctcggcggccacatgaggcgccaccgcgccatgaccggcggcatgccgcgggcgatcgtcgtcgacaagaagcccgacgtcgtcgacgtccacgtccacggccacgacgacgacggcggcatcaagcgcggcggcctgtggctcgacctgaaccatccaccctgcgacgacgccggcgacgacgacgccgagtgcggccacaatgccgccggcgccggcatcacgttccaccagttcttggataccggagccatggccgttgactgcgtcggctactagctctctttgccggatttttgccggatactacaatacttatatgcaccgattaatcttggtgcaatttctcttttaccttttctttttcttttcatttcttcttcttcttgttgagaaatccacattttgtagcggtagaatatattagttcctaatacaacagagcatggcacacg

SEQ ID NO: 5309 - DNA, 845 bp, Oryza sativa
  Predicted polypeptide sequence is orthologous to G354
atttcggtagctggtttgctattaacactttaattttgcatgcagcaattaaggtgttaattaatatatataattaagctttaagctcattagtttaccgacgatggaagtggccaccaatacggcgacacgatcgccggtgaagctaatgctggtgctgacactgtcgccggcgagcaaggtgatcgccaagggcggcggcggcgtgaagcgggtgcacctcgacggcggcgcgttccagtgccggacatgcgggcggcggttctccacgttccaggctctcggcggccaccggaccagccacaagcggccgcgggtgcgcgccgacggccttgacctcctcctcggcgcgcgccccggcaagctcggcgccggcggcgcctcgacgccggtagtgcaccggtgcgacatgtgcggcaaggtgttcgccaccggccaggcgctcggcggccacatgcgccgccaccggccgctggtgagtcgtaatggcacaatgtccacgacgtggacggcggcggcggcggcggcggcgacaatgtccggctcctcgtcggaagagcgtgacgacgacgacgacgacgacgtgcacaattataatttcatccactttttgtgagtggctaatggacaaatcaatatatgaattgaataaaaccagtgattaatgtcaataataattaagtttgttctggagtggtatacaaacacgcaacatgcttatagctagatatatatacacgtatacgccacaagatacaataccaattaagttcgtctttgattttgtaatgttcaattatattttttcaatgattaaatacacgtgattttaattgtattcgttc

SEQ ID NO: 5310 - DNA, 1013 bp, Oryza sativa
  Predicted polypeptide sequence is orthologous to G354
gggagcgcaggtacggtcggaattccgggtcaccacgcgtcggtcggactcgtcggcggcggcggcgggcggcgcggcgaggaggaagagggcgcggcggaggagcgtggtggcgacgtcgggggaaggggagttcgtgtgcaagacttgcagccgcgcgttcccgaccttccaggcgctcgggggccaccggaccagccacctccgcggccggagcaacgggctcgacctcggcgccatcggcgacaaggcgatcaggctgcacagggcggccgacaaggagcacagggacaagcacgagtgccacatctgcggcctcggcttcgagatgggccaggcgctcggcggacacatgcggcgccaccgcgaggagatggccgccgccggcggtggatcctccgccgacgactgggtctggcgctgcgacgcgcggccggaggggatcgccgccgagccaccggtgttgctggagttgttcgcctagttaccgctggtctccattagtttcgtccaagttttgaactgacgcagtgtgtgtcaccattaattagttcatgtcacatgtctagaaaaaaaaaagccaggttcatcgatcttgtaactatgataggggtttaattttttttttcattaggcaaaaaaaaaaaacaaaagggagggcgtcgggaacctctagaggatcaaggtttagtacgcgttgatgcgaggtctagccttctatagtgtccccaattcatcctggggcggcgttaacgcgctggaggacacctgggttccctaatgctgggaatcccttgcggggtattaaggcgcgaggcctcaaagggggacgagagaagcccctggacagcgggggttcacacgaaagacagccagattctcacggcgacaggtgtgtgctcttgtcctcgtattcttctctgtggtgtcgtatagatcgtggaggcgacatcacaagacagttggggaagcagacgagagcacgggatactagccagcccagacgcctcgct

SEQ ID NO: 5311 - DNA, 420 bp, Oryza sativa
  Predicted polypeptide sequence is orthologous to G354
cggcggccaccggaccagtcacctccggcccactaccaacaagcggcggcccggcccgtccaagcctctaatccacgcgtgcgaggtgtgtgggttgggctttcagatgggccaggccctaggtggccacatgaggaggcatcggcctagaaatattgatctgggccataagcagatcgtcatgccagaaattcggcccagttcctccctgcagctgcttgatctcttcgtttagatacactcaatatacagtggtttatgtgctgtgtgctatagtaccgtactgtcttgcagtatactacagcgaaaaaaaacttacagccatttagtacaaaaaatatttaggaatcaataaaacagatacaatgtttagcctatgacaatgtggatgcactacttaataaactttttttttctacc

SEQ ID NO: 5312 - DNA, 1270 bp, Oryza sativa
  Predicted polypeptide sequence is orthologous to G363
gagtttgtcatgatcaccaccacactgacaagaagaatatagcatgttattctactcattctccacttgtgagttctgacttatctgcacattggtgagacagtcaatgagtgcagatgagactgcagagattaaccctgtcttgtccagagaataatctttgatttcagagcatcttgccactcaaatatctcgcatacatacataagattcgctcgcatgatctgagctgttttgtctgaatttctgaatgcagctgaggcagaaatcggtgagagtggtaggtgtttgttgcgatcgttgaagcatgaagagcagcagccaagaagcgggagaggaggtgtccgagatcagcagccaggcggcgtccaacaacaacgagacgtgcaactcctcctccggtaaggtcagcctcgacctgtcgctcaccgtcgccgccgccgccgcggcggctgcctccgccaccgagtcgagcaccacggacagcggcggcacgcggccggcggcgacggcgacggcgacggcgcgcgagccggcgcgggtgttcacgtgcaactactgccagaggaagttcttcagctcgcaggcgctgggcgggcaccagaacgcgcaccggcgggagcgcacgctggcccggcgcgccgtgcggctcgacgcgttcccctacggctacgccgacgtggcctcgctgccgctgtacggcgccggcctgtaccccatcggcatccaggcgcacgcgtcggtgcaccaccaccaccctggcgtggcggcgccggcggggcgcgccgagttgaggtcggcgcgcgcgctgctcggcccgatgccgttcttcgtgcaggcggcaggcgatgaggatgccagcttcgggtggccgggcagcttcaggccaccgcccaccgccgccaccaccatccccgccgccgccgccgccccggtcgccgtcaactccggctcctccaactccaaccacggcggcagcgtcgtcgtgcaggccgccgccgacgagcccgacctcacacttagactctagctgtcccatccatccatccattagtctggtgtaacattcatcaggttgctcctgatcatctcctccgtttgtgagtagaattcttgcttgcttgcttgcttcgctctcgatcctgctgcttgagcttgacatcaaccaacctgctagtaaattactattgcttcaaatgcatgcgtggaagtattgtttttgtaaatacagcttagcctatcctaatatgattgtacttgtgccctaagc

SEQ ID NO: 5313 - DNA, 2537 bp, Oryza sativa
  Predicted polypeptide sequence is orthologous to G385
acggggaaatacaacagaatcgaaatacagaatactgggataacgacacactgggagtcacttgcaacctttagggttgaatctccggagatggaaatgaatcaacagcataatgagggcaacgaatctttcgtggccttgatgaacggttttgctggtgacgggacggcaacactaccgaatgatggggagcagagaatgagtattccagcaagagaattatttgcagcaattgaggccgactcaggcttgttgcctgtgaacagtagcaacactaatgaaaaaaggaagaggcgtctacagaggctcactggcaaacagtcggaggtacttgaggggtttttcagcatctgtgggcatcccgatgatggacaaaagaggcatctgagtgagacaacaggtcttggtttagatcaagtgaagttttggtttcagaataaaagaacacaagtaaagactatgtgctggaaggaagagaactataagttgtcggtggagaatgaaattctgagggatgagaacaggagagttaagatagctcactgcactgctgtatgcctcacttgctgtaattcatcagtacagaaccagcttgccgttgagatggaaaggttaatggggcagagtgagtggctgcaacaagagattgcacggtcgaatggaacacccccggctgcaaaccttgcctttcaacttaattcatcagcagactatgtattttcagggcaacatgaccaacaaatgattgctgaactagccaaaaacgcaatgcacgcattgattattttggccgaatcccatgtcgctctatggtttcccgtccctggctgttcttatgaagtattgaacaagatggcttatgaccaagcatatcctggggataacagtgcaaacgccattggattcaagacagaggctactcgtgcagtttctatggtgatgatggactacaaaagcgttgtggatttcctcatggatccttacaactaccgaactttctttcctgaagttatttccggggcagtaaccaacaggatctacacgtggcctaccagtgatggttataatggggttatacaactgatgactgtcgagatgatgttcccatcgcccctggtaccggctaggaaatgcacattcctgcgctattgtaatgtgctgaacgaaggattagtggtcgtcattgatgtgtcattggacgatggcagtatcttctccaaatgccgtaaaatgccatcagggtttctgatccaatccataaggccaaacagctgcaaggtcactgccatagagcacgtccttgcggatgacaccggtgttcatgagctctaccagcctcgtgtgaatggactcgtcttcggagctcggcgctgggtggcgaccatggcgcggcagtctgcacgcatgagagatgttcatcacaacaagacagctccgcaagtcagcacgaaggggaggaagaatctaatgaagctagcggacgacctgctcgcgagcttcgccggcggcatcgccgccactggcggaggaacgtggaccgtcgtgatcggcgccggcacggagaaggacatcagggtcgcgtacaggaggaccaccgagggcagcagcagctacaacgcgatcctgtccgtcaccgcgtccctgcgtctgccgctgcccatgaggaaaaccttcgatctgctcaggaaccttactcaccgctgcaagtgggacgtcctggtgcacggcagcgtggtgaaggaggaggtcaccatcgccagaggcgtcgggaacgacgacactgtcaccgtcctccactgcaagcgcgccggcagggaggacaggggaaggaccatgatcctgcagaacaacgggtacgacgcgtcgggctcgttcatggtctactcccagatcgacagcgagctgatgaacaccatggtcctgagccccagcgacctgccgcccgggcggggcgggccgtccctctaccccaccggcttctcccttctccctgacgtcgaggctgcccaggacagcagcggcatcgccctcggcgaggttgggggaactctcatgaccatgggcttccagattccggtgaagctcgccagtggggatcgcatgtattcccggtctgcggcatcggcaatcaggctcatgactgacaccattgccctcgtcaagaagacgctgatgaacgagcattctggtatctacggggttagcccgttccacccctagattcagaaaaacaccagagggagaaaagggaggtccgtgtgcagataaaaatcaagaacatgcgaaggggattcatcggctccgatcaccctgcatctcccagaatttgctgaattaattagaactttaaggttgtgttaacaacctgtaataatgtttttaaggccaaacttatatcgtgtctttgctgtaataatgtagtatgcgcctgatggatgtcgactgccgtgtaccgatgcagtttgcttcgcagagacgcggatacatttgctatcgtatggatgctcctttagaagcaaaaaaaaaaaaaaaaaaaa

SEQ ID NO: 5314 - DNA, 390 bp, Oryza sativa
  Predicted polypeptide sequence is orthologous to G385
cgcaagaagcgctaccaccgccacacccagcaccagatccaggagctcgaggccttcttcaaggagtgcccccaccctgatgacaagcagcgcaaggagctcagccgcgagctcggcctcgagcccctccaggtcaagttctggttccagaacaagcgcacccagatgaagacgcagcatgagagacacgagaacaatgcgctgcgcgcagagaacgagaagctgcgggcagagaacatgaggtacaaggaggcgcttgccaacgcgtcctgccccaactgcggcggtccggccgccatcggcgagatgtccttcgacgagcaccacctccgcctcgagaacgcgcgcctccgcgacgagattgacaggatctccgccatcgccgccaag

SEQ ID NO: 5315 - DNA, 3063 bp, Oryza sativa
  misc_feature (3002)..(3002): n is a, c, g, or t
  Predicted polypeptide sequence is orthologous to G385
ggcacgagtgatctcttgccgtgtgatctctagcttgtgtgctagatctgtttctacttgcgtttgcgttgcttggcaagcaagatatatatatatatatctatatctatctatctatcattctatctccctacatatttagagctagcactttgtgtgttctttgggtttgggacacactcatatacgcgtgttcatgagtggaaatggaaggagctgcaagggcaagaattagggtttgagatataggagtataatgatgatcccggcgaggcatatgccgtcgatgatcggccggaacggcgcagcgtacggatcctcatcggcactgtcactcagccagccaaacttgctggataatcaccagttccagcaagcgttccagcatcagcagcagcagcatcatctccttgaccagatcccggcgacgacggcggagagcggcgacaacatgatccgcagccgtgcgtccgaccctctcggcggcgacgagttcgagagcaagtccggcagcgagaacgtcgacggcgtctccgtcgacgaccaggaccccaaccagcggccgcgcaagaagcgctaccaccgccacacccagcatcagatccaggagatggaagcattcttcaaggaatgtccacacccagatgataagcagcgcaaggagctgagccgggagctcggcctggagcctctccaagtgaagttctggttccagaacaagcgcacccaaatgaagaaccagcatgagaggcacgagaactcgcagctgcggtcggataacgagaagctccgggccgagaacatgcggtacaaggaggccctgagcagcgcctcctgccccaactgcggcggccccgccgccctcggcgagatgtccttcgacgagcaccacctccgcatcgagaacgcccgcctccgcgaagagatcgataggatatcggcgatcgcggcgaagtacgtggggaagccaatggtgccgttcccggtgctgtcgaacccgatggcggcggcggcgtcgcgggcgccgctggacctccccgtggcgccgtacggcgtgccgggcgacatgttcggcggcggtggcgccggggagctgctgcgcggggtgcagtcggaggtcgacaagccgatgatcgtggagctcgccgtgccggcgatggaggagctggtccgcatggcgcagctggacgagccgctctggagcgtcgcgccgccgctcgacgccacggcggcggcgatggagacgctcagcgaggaggagtacgcgcgcatgttcccccgagggctcggccccaagcagtacgggctcaggtcggaggcgtcccgcgacagcgccgtcgtcatcatgacgcacgccaacctcgtcgagatcctcatggacgcgaatcagtacgcggcagtgttctcgaacatcgtgtcgagggccatcacgctggaggtgctgtccaccggcgtcgcggggaactacaacggtgcattgcaagtgatgtcagtggagtttcaggtgccatcgccactggtgccaacgagagagagctacttcgtgagatactgcaagcagaacgcagacgggacatgggccgtcgtcgacgtctcgctggacagcctccgccctagccccgtcctcaaatgtcgccgccgtccgtcaggctgcctcatccaagaaatgcccaatggctactccaaggtgacgtgggtggagcatgtggaggtggacgacaggtcggtgcacaacatctacaagctgctggtgaactccgggctggcgttcggcgcgcggcggtgggtcggcacgctggaccgccagtgcgagcgcctcgccagcgtcatggccagcaacatccccaccagcgacatcggcgtgattacgagctcggaggggaggaagagcatgctgaagctggcggagaggatggtggtgagcttctgcggcggcgtgacggcgtccgtggcgcatcagtggacgacgctgtccggcagcggcgccgaggacgtccgcgtcatgacgaggaagagcgtcgacgaccccgggaggccccccggcatcgtcctcaacgccgtcacctccttctggctccccgtcccttccaagcgcgtttttcacttcctccgcgacgaatcctctcgcagtgagtgggacatcctctccaatggcggtatcgttcaagaaatggcccacatcgccaatggccgggatcagggcaactgcgtctcacttcttcgcgtcaacagctcgaactcgaaccagagcaacatgctgatcctgcaggagagctgcacggacgcgtcggggtcgtacgtcatctacgcgccggtggacgtggttgcgatgaacgtcgtgctaaacggcggcgacccggactacgtcgcgctgctgccatcgggcttcgccatcctgcccgatgggccggcgcacgacggtggcgacggcgacggcggcgtcggcgtcggctccggcgggtcgctgctgacggtggcgttccagatactggtggactccgtcccgacggcgaagctctcgctggggtcggtggcgacggtgaacagcctcatcgcctgcacggtggagcgcatcaaggcggccgtctccggcgagagcaatccgcagtagcttcgtccttgaatcaaacaaaagcttcttgtgctttcaatttcaggagcagcaaaattttggagctttcatcagtgggaagtcaagaacgcacctcagactgtccttgccatgtggtgcccatatatagtttggattatttttcgctagtttttccgcaaattcgggaaatttcaaaaaaaatgtgtcaccactacgcaagggcggttggttcgggtattgacttcctcttcatgttcgcctctcggatgctgctaccttatgaatttagggttcttctggagtacaaaaaaaaccccttaatttgatctgtaatttctgttgttcagacttcccagtacctagctagctagtaggagttgcagaatagagatctgtgtccctgtcttanacttttagttctcttcagtgtttgatcagtgctgtttcaatccaaaaaaaaaaaaaaaaaa

SEQ ID NO: 5316 - DNA, 759 bp, Oryza sativa
  Predicted polypeptide sequence is orthologous to G385
atgtcatcctctctttatcccttcttcctcctctctctcatcccttctctatctctccctctttctcttcgtgcgtggggagcggcgtccggatcggcggcggcgacggagggcgggggccagagcggcaggcaggatggcgggtgggcggtcgctggagttgtggacctggaggcagcggcggtggcttgtcacgtgttgcgcagccatgcacaggaggtgaacttcgtccgctactgccgacagatcgagcaggggctatgggccatcactgacatcttcgtcaacctgcagcgcgacgcctacttcggcgtgccaccgctgcgttcccgccgactcccgtcgggatgcctcatcgctaacatggccaatagctactccgaggtgaccagggtcgaacacatggaggtggaggagaagaacccgatcaacgtgctctaccgtgacctcgtgctgagcggcgatgtattcggggcgcactgctggctcgccgcgctccagcgcgcgtgcgaccgctacgcctccctcgtcgcgctcggcgtcccgcaccacatcaccggaggtatgcacacgctatgccacgcacctagcccagatccagagcttcgaatcggccacgacgggcggctagaggacgggccgcaaggaggagctgctcctgcgcctgtcgcccgaggtccgccgcctggcacccgctcgccgccgcctccactcgagcccccgcgccgccggctcatgtcaagggggagagagagataa

SEQ ID NO: 5317 - DNA, 3280 bp, Oryza sativa
  Predicted polypeptide sequence is orthologous to G385
gccccccctctcgcaataactcctcctccccatctccacattcctcccccaaatcccctcttcttcttcttcttcttcttcctcctcctcccatggcgatcggcgtctgcttctagctagagagatctcgcttcgtttcgagctgtccaccggtggttttctcgcatgcgatatcacacgcttcttggaagcacatcagagttcttggtgctgaccttgccctagatctgcttctgactgttgctgttacgtggcgtgcaagctagctatagccatttctgtgtgtgtagctgtactggtggtgaagaagaagatgcaagcgaatgggtggaggagctagaggcttggctggaggaagaagaagaaggggttggtggtggctagctagctagggtgcgtgcttaattacctggcttcgttcatgacgccggcgaggcgcatgccgccggtgatcggccggaacggcgtggcgtacgaatcgccgtcggcgcagctgcccctcacccaggctgatatgctggacagccatcatctgcagcaagcactccagcagcaatacttcgatcagatcccggtgacgacgacggcggcggcggacagcggcgacaacatgctgcacggccgcgccgacgccggcgggctggttgacgagttcgagagcaagtcgtgcagcgagaacgtcgacggcgccggcgacggcctctccggcgacgaccaggaccccaaccagcggccgcgcaagaagcgttaccaccgccatacccagcaccagatccaagagatggaagctttcttcaaggagtgcccgcacccagacgacaagcagcgcaaggagctgagcagggaactgggtcttgaacctctgcaggttaaattctggtttcagaacaagcgcacacagatgaagaaccagcacgagaggcacgagaacgcgcagctgcgggcggagaacgacaagctgcgcgcggagaacatgcgatacaaggaggccctgagcagcgcgtcgtgccccaactgcggcggccccgccgcccttcgacgagcaccacctccgcgtcgagaacgcccgcctccgcgacgagatcgaccgcatctccggcatcgccgccaagcacgtcggcaagccccccatcgtctccttccccgtcctctcctccccgctcgccgtcgccgccgcccgctcccctctcgacctcgccggcgcctacggcgtcgtcacccccggcctcgacatgttcggcggcgccggcgacctcctccgcggcgtgcacccgctcgacgccgacaagcccatgatcgtggagctcgccgtcgccgccatggacgagctcgtccagatggcccagctcgacgagccgctctggtcgtcgtcgtcggagccggcggcggcgttgctcgatgaggaggagtacgcgcgcatgttcccgcgcggcctcggccccaagcagtacggcctcaagtcggaggcgtcccgccatggcgccgtcgtcatcatgacgcacagcaacctcgtcgagatcctcatggatgtgaatcaattcgcgacggtgttctcgagcatcgtgtcgagagcgtccacgcacgaggtgttgtccacaggcgtggcaggcaactacaatggtgcactgcaagtgatgtcaatggagtttcaagtgccgtcgccgctggtgccgacgagggagagctatttcgtcaggtactgcaagaacaactccgacgggacatgggccgtcgtcgatgtctctctcgacagcctccgccccagccctgtccagaaatgccggcgcaggccgtctggctgcctcatccaagaaatgcccaatggctactccaaggtgacatgggtggagcatgtggaggtggacgacagctcggtgcacaacatctacaagccattggtgaactccggcctcgcattcggcgcgaaacggtgggtcggcacgctggaccggcaatgcgagcgcctcgccagcgccatggccagcaacatccccaatggcgaccttggagtgattacaagcgtggaggggaggaagagcatgttgaagctggcggagaggatggtggcgagcttctgcggcggcgtgacggcgtcggtggcgcaccagtggacgacgctgtcgggcagcggggcggaggacgtgcgcgtcatgacgaggaagagcgtcgacgaccccggcaggccaccgggcatcgtgctcaacgccgccacctccttctggctccccgtccctcccgccgccgtcttcgacttcctccgcgacgagacctctcgcagcgagtgggacattctgtccaacggcggcgccgtccaagaaatggctcacattgccaacggccgtgaccatggcaactctgtctcgcttcttcgtgtcaatagtgcaaattcaaaccagagcaacatgctgatcctgcaagagagctgcacggacgcgtcgggctcctacgtggtgtacgcgccggtggacatcgtggcgatgaacgtggtgctcaacggcggcgacccggactacgtggcgctgctgccgtcggggttcgccatccttcccgacgggccgtcggggaacgcgcaggccgccgtcggggagaacggctccggctccggcggggggtccctcctgacggtggcgttccagatcctcgtcgactccgtgccgacggcgaagctctcgctgggctccgtcgcgacggtgaacagcctcatcgcctgcacggtggagcgcatcaaggccgccgtctgcagggacagcaaccctcagtagtagcaccggcttcaaccaaatatgatcacgaacaatgttccaaggagcagcaaaattttggagtttgattcagcagtagggagtcaagaacgcacctcaaactctccttgccatgtggtgcccttgctagtgaagaatttgcgaggaaaccgacgcgtttgcgagaaaattttcgcgaagatacatagtgtcaccactatgcaaggggggatggttcgggcattgacttccaccttttgattttcatcaaatgcatcgaagagtggatgctgctaccttgttgtttttctgaatctctatgttagggcttcttttaccatgtttaaaaagggctatgaagcctcatttttatctgtactgttgtgatgtgttgtctgtttgttcagacttcaggttcctgtcccttagctaggagttgagaatagagagattcatgtccccccttttggattttatcacatttccgatgatttgtagacttgtggttgttgcttgttggtcattaccattcttgtctc

SEQ ID NO: 5318 - DNA, 3089 bp, Oryza sativa
  Predicted polypeptide sequence is orthologous to G385
agcacgcactgctgctgctgctcgctctcgctttgcttcccctaatcttctcccgggccaggggggaagaggggcggaattcgggcacgagctttggagttggagatcacttcggcgacggcgtggtccccgccggcatgcagttcccgttctccggcgctggcccgggcgtcttcacgtcatcgccggcgctctccctcgcgctggcggacgcggtggcaggccggaacagcggcggcggtgggaagatggttaccgcggcccatggcggcgtcggcggaggaggaggaggaggacgcgcgaaggcgagggacgcgttggaggtggagaacgagatgagccggtccgggagcgaccacctcgacgtcgtctcttgcggcgacgcgggcggcggcggcggcgacgacgacgatgacgaggacgccgagcacggcaacccgcccaagcgcaagaagcggtaccaccgccacacgccgcagcagatccaagagctggaagcgatgttcaaggaatgcccccacccagacgagaagcagcgcgccgagctgagcaagcggctcggcctcgaaccccggcaggtcaagttctggttccagaatcggcgaacgcagatgaagatgcaactggagcgacacgagaactcgctgctgaagcaggagaacgataagctgcggtccgagaacctgtcaatccgggaggccacgagcaacgcggtgtgcgttggctgcggcggcccggcgatgctcggggaggtgtccctggaggagcaccaccttcgcgtcgagaacgcgaggcccaaggacgagctcagccgagtgtgcgcgctcgccgccaagttccttggcaagtccatctctgtcatggcgccaccgcagatgcatcagcctcatcctgtgccaggctcgtcgctggagcttgcggttgggggtatcggttcgatgccatcagccacgatgcccatctcgacgatcactgattttgctggcgccatgtccagttcaatgggcacggtgatcacgcccatgaagtctgaggctgaaccatcggcaatggctggcattgacaagtccttgttcttggagctagcaatgagtgcaatggatgagctagtcaagatggctcagatgggggatccgctttggattccaggtgcctccgtaccttcctcgccggcaaaggagagtctaaacttcgaggagtacctaaacaccttcccaccttgcatcggggtgaagcctgaagggtatgtatcagaggcatctagagaatctggcattgtcatcattgacgatggcgccgcgcttgtggagaccctcatggatgagcgacggtggtccgatatgttctcatgcatgattgccaaggcatcaaccactgaggagatttctactggtgttgctgggagtagaaatggtgcattgcttcttatgcaggcagagctacaggtgctttctcctcttgtgcctattagagaggtgaagtttctcaggttctccagacagctggctgatggtgtatgggctgtagtggacgtttcggctgatgaattgatgagggatcagggcattacttctgcatcctcgactgcaaacatgaactgccgaaggctgccttctggttgtgtgctgcaggacactccaaatgggtttgttaaggtcacatgggttgaacatacagaatatgatgaggcatctgtgcacccgctctaccggcctcttctccggtctggtcttgcccttggtgcagggcgatggatcgcgacattacagcggcagtgcgaatgcttggcccttctcatgtcttctattgcattgccagagaacgactcatcagctatccatcctgaaggtaaacggagcatgttgaagttggcaaggaggatgacggacaacttctgtgcaggggtgagcacatcatctacccgtgagtggagcaaactggttggattgacaggcaacattggggaggatgtgcatgtaatggcgcggaagagtgtggatgaacctggaacgccgccaggtgtggtgcttagtgctgctacatctgtgtggatgcctgtgatgcctgaacggctcttcaacttcttgcacaacaaggggctgcgtgctgaatgggatatcctcagcaatggtggccctatgcaggaggtgacaagcattgccaaggggcaacagaatggcaataccgtatgtctactgaaggctagtcccaccaaagacaagcagaacagcatgctgatcctacaggagacgtgtgcagacgcatccggttcaatggttgtgtatgctcctgtagacatcccagcaatgcaccttgtcatgagtggtggggattcgtcatgcgtcgcccttcttccatcaggttttgccatcctgcctgctgggcctagcatcggcgcagatcacaagatgggcggttcattgctcaccgttgcattccagatacttgccaacagccagcccagtgctaagctcacggtggagtcagtcgagaccgtgagcaaccttatctcctgcaccatcaagaagatcaagacggcgctgcattgcgacgtgtgaacccaacaaggggggacttttggcctagtgggagcggctgtggcgatgagcctgagtcaagaacgaaccgcgacataggaagggacctttgctaggtggcaaggaccggacggggcaggtccttagcacagagcaatggtggtggttcgggtattgactcagcctctcccgcctccgttctctcctgtgactggtgcatgttgaagtgaacctgcattttggacgccatgtagcaggccatctttctttctttttcctttttctttttctttttctttttttagggagaagggagtcatctgtgttttttgttggctggctcagggtgttggtgtttctggtttctagcttttgttacagggagatgtgatacattttgtagaagctccgaattgtcgtgctggtatgtgaggttctgatcataggtctgtgtttgatagtctcgagctatcaacgcctggcaaatgcaaaccttgttatgctaaaatatgttttagatcaatctgattctgaaagctgtttacatgtccc

SEQ ID NO: 5319 - DNA, 3437 bp, Oryza sativa
  Predicted polypeptide sequence is orthologous to G385
gtctggttctatttttctctcgcgtccacacgacgggggggcctcctctcctctccctcctcccctcgtctccacactagacttgccattttgaccctccgcttgctccctcctcccgttcctatctccccgccgccgtacataagtgctttctttaatcggatgcgtcccctcccctcgccaccagttcgttcgctcgctcgctcgctcgctcgccttgttaatctatccctccctctctcccgcccctccgtccgccgtggagggttagggttttgagggttcgctcgcctcggcgaggctttatctctctaccagtagtctcttactcttcttcgttgggccgtgggttaggaatcgggttgtgaggcgtgtgggaggggcggggtagatccaaggaagaggactttctcgagtttacgccgtggtgttttgcttcggcgaggaggcggcggcatgagctttgggggcctctttgacggcggcggcgggggaggcatgcagttccctttcgccagtggcttcgcgtcctcgccggcgctctccctcgcgctggacaacgccggcggtggcatcggcgggcggatgctcggcggcggcgctggcgctggttctagcgcgggcggcgcgatgacgagggacactgaggcggagaacgacagccggtcgggaagcgaccatctcgacgccatctcggccgccggcgaggacgacgtcgaggacgccgagcccagcaactcccgcaagaggaagaagcgataccaccgccacacgccgcagcagatccaagagctcgaagcgctgttcaaggagtgcccccatccggacgagaagcagcgcgccgagctcagcaggaggctctccctcgatgcgcggcaggtcaagttctggttccagaatcgccgcacgcagatgaagacgcaactggagcggcacgagaacgcgcttctcaagcaggagaacgacaagctgcgcgccgagaacatgacgatccgggaggcgatgcgcagcccaatgtgcggcagctgcgggagccccgccatgctcggggaggtgtccctagaggagcagcacctgcgcatcgagaatgcgcgcctcaaggacgagctcaaccgcgtgtgcgccctcgccaccaagttcctaggcaagcccatctccctcctgtcgccgccgcccttgctgcagccgcacctctcgctgcctatgcctaactcgtcgctggagctagcgatcggaggcatcggtggcttagggtctctcggtacactacccggctgtatgaatgagttcgccggaggcgtgtcgagcccgatgggcacggtgatcacgcctgcgcgcgcaaccggggctgctataccatcgctggtgggtaacatcgacaggtccgtgttcttagagcttgcaatcagcgcgatggacgaacttgtcaagatggcacagatggacgatccattgtgggttccggcactgcctggttctcccagcaaggaggtgctcaactttgaggagtatcttcactccttcctaccgtgcattggcatgaagcctgccggctacgtctctgaggcctcgagggaatccggtctagtcatcatcgacaacagccttgcccttgtagagaccctcatggatgagagacggtggtctgacatgttctcgtgcatgattgctaaggcaacagtgcttgaggaggtgtctaccggcattgcaggaagcagaaatggcgcgttgctgctgatgaaggctgagctacaggtgctctcacatctagtaccaattagggaggttacatttctccggttttgtaagcagctggctgagggtgcatgggcagtagttgatgtgtccattgatggtttagtgagagatcataattctggaacggcacccacaggtggaaatgtgaagtgtaggagggtaccttccggctgtgtgatgcaagacactcccaatgggtattgcaaggtcacatgggttgagcatacggaatacgatgaggcatcagtgcaccagctctaccgtccactccttcggtctggtctcgcctttggcgccaggcgttggcttgcgacgctgcagcgccaatgcgaatgccttgccatcctcatgtcctctgctacagtgacagcaaatgactcgactgctatatcgcaagagggcaagcgaagcatgctgaagctggcacgccggatgacggagaacttctgtgctggggtgagcgcatcgtctgcacgtgaatggagcaagctggatggtgcgaccggtagcatcggggaggacgtgcgcgtgatggcacggaagagcgtgagcgagcctggagagccaccgggcgtggtgctgagcgcggccacctcggtgtgggtgcccgtggctccggagaagctcttcaacttcctgcgcgatgagcagctgcgtgcggagtgggacatcctcagcaatggaggccccatgcaggagatgacccagatcgccaaggggcagcgggatgggaactcggtttcactcctcagggccagtgctgtgagtgccaaccagagcagcatgctgatacttcaggagacgtgcaccgacgcttctggctccattgttgtgtacgctccggtagacatcccggcaatgcagcttgtcatgaatggtggcgactccacctatgttgctctgcttccatccggattcgccatcctgcccgatgggcctcgcatcggcgccaccgggtacgagacgggcggctctctgctcaccgtggcgttccagattcttgtcaacaaccagcccaccgccaagctcaccgtggaatcggtcgagaccgtgaacaatctcatctcctgcaccatcaagaagatcaagacggcgctgcagtgcgacgcctgagtgtttacagtggatttatgtccgcggggatacgccggcggcgacgagcctgagtcaagaacgaaccgcgcgttgaaaaaagaaaataacctttgctaggtgataaggatcttgcttggccggtccttagcacagagcaatggtggtggttcgggtattgactctggcctctaccgtacgccgatctctccccggcagccggtgatcattggatgatacagtaccatgcattttggacatttcttcgaggggttaaacttatgctttagtttcgtcgtcttagggagtcaaacctgtatacttttggcagttggctcatcgttgctctagtgttgtttgttttttgttgtgctatggctgtatgaggtagcctgtactagtagtttctcggaaatgctgggttcatactgtactagtgtcgtccatacttcatataggttatggtacaagtgtaggatcaaattgaaggtctcagaaagtgtatcagccaataatgtctgtttgacagtggcattgctatggatcagctgaaaattgttttttgcaatacacatgggatcaaagct

SEQ ID NO: 5320 - DNA, 2487 bp, Oryza sativa
  Predicted polypeptide sequence is orthologous to G385
atggaggtttgtgaaggcggcagcgacgatggcgggcgcggatctgggacctcggtggtggtggatctagtgctcgaaacctcagcgacaacggatctagtgcttgggacatcagtggcggcggagctggtgctgccggcttcgggagctgcaggacctctggcaatgatggcgaacgatgctcaggagctctgtgacaacgatgacggaggcaacaatgggctgcgggagagggagaggatgatgatccctggccggaacatgtcgccggcgatgatcggccggcccaacggcggcggcggcggcggcggcgtcgcctacgcttcttcttcctcggcgctctccctcggccaggcgacgacgacgagcgagagcgacggccgtgcccctcgcgacgagctggagatgagcaagtccggtggcagcgacaacctggagagcggcggtggcggtggcggaggtggctccggtggtgatcaggaccccaaccagcgcccccgcaagaagcgctaccaccgccacacccagcaccagatccaggagctcgaggccttcttcaaggagtgcccccaccctgatgacaagcagcgcaaggagctcagccgcgagctcggcctcgagcccctccaggtcaagttctggttccagaacaagcgcacccagatgaagacgcagcatgagagacacgagaacaatgcgctgcgcgcagagaacgagaagctgcgggcagagaacatgaggtacaaggaggcgcttgccaacgcgtcctgccccaactgcggcggtccggccgccatcggcgagatgtccttcgacgagcaccacctccgcctcgagaacgcgcgcctccgcgacgagattgacaggatctccgccatcgccgccaagtacgtcggcaagcccgccgcggccgtctcggccgcgtacccgccgctgccgccgtcgaacaggtcgccgctcgatcatatgggcattcccggcgctggcgccgacgtgttcggcgccgacttcgacaagccgctcgtcatcgagctcgccgtggccgccatggaggagctcgtcaggatggcgcagctcggcgagccgctctgggcgccggcgctcggcggcgaggcgctcggcgaggaggagtacgcgcgcacgttcccgcgcgggctagggcccaagtcgccggagctccggtcggaggcgtcgagggagacggcggtggtgatcatgaaccacgtcagcctcgtggagatgctcatggacgtcgggcagtggacggcgctcttctcgagcatcgtgtcgcgcgcggcgacgctggaggtgctctcgacgggcgtcgccggcaaccacaacggcgcgctgcagctcatgtccgccgagttccagatgccgtcgccgctggtgccgacgagggagacccagttcctgcgctactgcaagcagcaccccgacggcacgtgggccgtcgtcgacgtctccctcgacgggctccgcgccggcgccgggggcggatgccagccggcggcggcgcgcggccaccggcgccgcccctccggctgcctcatccaggagatgccgaacggctactccaaggtgacgtgggtggagcacgtggaggccgacgaccagatggtgcacaacctgtacaagccggtggtgaactccggcatggcgttcggcgctcgccggtgggtggcgacgctggagcggcagtgcgagcgcctggctagcgccatggcgagcaacgtggcgtcctcgggcgacgccggcgtgatcacgacgtcggaggggaggcggagcatgctgaagctggcggagcggatggtggcgagcttctgcggcggcgtgacggcgtcgacgacgcaccagtggacgacgctctccggcagcggcgccgaggacgtccgcgtcatgacgcgcaagagcgtcgacgaccccggccgccctcccggcatcatcctcaacgccgccacctccttctggctccccgtcccgccttcccgcgtcttcgacttcctccgcgacgactccacccgcagcgagtgggacatcctctccaatggcggcgtcgtccaagaaatggctcacatcgccaatggccgcgaccacggcaacgccgtctccctcctccgcgtcaacaacgcgaactcgaaccagagcaacatgctgatactgcaggagtgctgcacggacgcgacggggtcgtacgtgatatacgcgccggtggacgtggtggcgatgaacgtggtgctcaacggcggcgacccggactacgtggcgctgctgccgtcggggttcgccatcctccccgacgggccggacggcggcggcgggtcgctgctgacggtggcgttccagatactggtcgactccgtgcccaccgccaagctgtcgctcggctccgtcgccaccgtcaacagcctcatcgcctgcaccgtcgagcgcatcaaggccgccatcaccggcgacaacggcgtcgcgccgccatgcccacggtga

SEQ ID NO: 5321 - DNA, 427 bp, Oryza sativa
  Predicted polypeptide sequence is orthologous to G4
ccgacttcgaggagttcgaggtggactccggggactcggatttggagctcggggaggaggacgacgatgacgtcgtcgagatcaagccggccgccttcaagagggccctctccagagataacttgatctccattaccactgccggatttgatggtcctgctgcaaagtctgccaaaagaaagagaaagaaccatttcaggggcatccgccaccgcccttggggtaagtgggctgctgaaatcaaaatcctcgcaagggtgttcgtgtctggcttggcactttcaacagtgctgaagaagctgcaagagcttatgatgctgaaccacctcggattccgtggcaaagaaggcccaaggtgaatttttccagaaggctcccaacaacttgcctcaaaaagcgttctgttgctgggctcccccccacttgc

SEQ ID NO: 5322 - DNA, 1260 bp, Oryza sativa
  Predicted polypeptide sequence is orthologous to G4
gtctcaaacccaatcaaactccaaccaaactcacctacctacccccaacccatccagagctagagctatgtgcggcggcgcgatcctcgccgacctcataccgtcgccgcgctccggcggccacaccaaaaagaacaagcggcggcggatcagcgacgacgaggacttcgaggccgccttcgaggagttcgacgccggcgacgacgactccgactccgactccgagtccgaggaggtagacgagtacgacgtcgtcgtcgacgacgacgacagcgaggacggcgtggtggttcttccgccgccgccgccgccgccgccggtgattccacatgagcgccatggcgcgaggcggttccgcggcgtgaggaagcggccgtgggggaagtgggcggcggagatccgcgaccccgtgcgcggcgtgcgcgtctggctcggtaccttccccaccgccgagtccgccgcgcgcgcctacgacgccgccgcccgccgcctccgcggcgccaaggccaagcccaacttcccctccgcgccgccgccctcggctgctgctcaccgccgcaagaagcgccgcgcccacgccgccacgcgctcgccgtcgtctccgcccgccaccagcgaggtcacggcggcgtccgcgtccgcgtccagcgatgtccccgcgccggcgttcgcttccttcgtcggcgagcccgggcacggcggcgccaagtcgatgccgacgacgagccacacctcgcagccagccccgccggcgacggtggcgtccgagaacgtcgacgacccggaggtgttcgacccgtacgacgtccacggcggcctcgcctcctacttcgccggcggcgcgtacgagtccctggagagcctgttcgcgcacggcggcgacagcgccgccgtcgaccaagcggcgagcgaccactggccggcggcgctatggagcttcgcagacgacggctcgttctgcttctgatgctgtcaaatcacatcgccattggcggccattgcaagccatggcatggcacctgatgatgctgatccagcgaactggtcactcgttcttgatgcgttttcagtttcttgtacagtgtttttccccagcaacagtgaagtagtattcagttattcactgttcagtcatgagttcatcgcaaaatatgatgtaagtatgtgtcttgagattgttttagcagtggcttttgtttgtataatgtatttctctgtaattaattaatagctgttttcagtgatgaactaaattttctg

SEQ ID NO: 5323 - DNA, 1433 bp, Oryza sativa
  Predicted polypeptide sequence is orthologous to G4
agactacaagccattaaacagagacgaccaacgacttaaccacacttcttctttgtgctgtccaacctccattgttgggtgtgaaagctttggctcatctgccatgtgtggaggatccattctcggcgaccttcacttgccggtgcggcggacagtgaacgccggtgacctgtggggagacgccggcaagggtagagatggtggcgacggcttgaagaagaggaaggggagttcttgggatttcgatgttgattgcgatgatgatgatgatgatgactttgaggctgattttgaggagtttgaggatgactatggcgatgatgatgatgtgggtttcggggacgacgaccaagaatccgacatgaacggtctcaagctcgccggattcagcaccacgaagctcggcctcggcggcagcaggaagaggaagacgcgataccgagggatccggcagcggccatgggggaaatgggcggcggagatcagggacccccgcaagggcgtccgcgtctggctcggcacgttcggcaccgccgaggaggccgccatggcgtacgacgtcgaggcacgccgcatccgcggcaagaaagccaaggtcaacttccccgacgccgccgccgccgccccgaagcggccacggcgttcttcggcgaagcattcgccgcagcagcagaaggccaggtcgtcgtcgtcgtcgccggcgagcctgaacgccagcgacgccgtgtccaagtccaacaacaaccgcgtcagctcggctgggagcagcaccgacgccaccgccgccgccatcgccatcgacgacggcgtcaagctcgagctgctctcggagacggatccttctccgcccatggccgccgccgccgccgcgtggctcgacgcgttcgagctgaacgatcttgacggatcaagatgcaaggacaacgcattcgatcaccagattcacaaggtagaagcggctgtcgctgatgaattcgcgttctacgacgatccgagctacatgcagctgggttaccagctcgatcagggcaactcgtacgagaacatcgacgcgctcttcggcggcgaggccgtcaacattggtggactctggagcttcgacgacatgccaatggagttcagagcttattgagcatttgattctatttaggagggagtgaattatttgggaggaagaatcgatgttgtaacttgtaaaatctctgatgatgatctctgcatcatatgatcaatttgagtgcagttttgtttttgtaaatacgaattctttattatgatgttaggttcttaatttgcccttcttcatcagggatttgttcaggcttttgttgtgatgactgattggacgagggaaagattgcgttttttgttgtcatgttgggtactctactcttctgttcctaaagttgataagtgccaaaatttgtgagagg

SEQ ID NO: 5324 - DNA, 1107 bp, Oryza sativa
  Predicted polypeptide sequence is orthologous to G4
agatattcagacacacaccttcaataacttgcaaggataactcaaactacttgaatcagatcagacaaaaacatcataagaatatcacgatgtgtggaggagcactgatcccgaacgactatggcgacaagccgccgccgccgccgtcggagtcgtcggagtgggacgccacaacgaagatgaagaagaagaagaagcgtggtggcggcggcgacgacgactgggaggccgccttccgggagttcatcgctggcgacgacgacgacgacgacggcggcgtttccatgttcccttctggtgcagggacgatggagacgaccacagaggtggcgccggcggcggcggtggtggagaggccgcggcggcggcgaagggtgaggcggagctacccgtaccgcggcgtccggcagcggccgtgggggcggtgggcgtcggagatccgcgaccccgtcaagggcgcccgcgtctggctcggcaccttcgacaccgccgtcgaggccgcgcgcgcctacgacgccgaggcgcgccgcatccacggccacaaggcaaggaccaacttcccgcccgacgagcctccgctgccggcgccatcgcaggcgccgttctgcttcctgctcgacgacgacgacgacgacgacggcgtggcccgtggaaacagcccggcgtcgtcgtcggcgccggacagagcctccgcttgcacgacgtcgtcgacggtggcgtccggcgagcgaggcgatgagctcatactgctggagtgctgctccgacgacgtgatggacagcctcctcgccggcttcgacgtgtccagcgaaccacgcagtgttttgggaatggttaattagcagcgcgcacgcctgattagatcggtacatgtgaagtacaagagaagtagttactactagctaggagcaaattaacttggagtgcaagaataaaatatgcatgtctctgcactactactgtagtgttagcaagtttgctcattgttctgttgtatcctttcatgtccatttcagacttcccaatgctacataaggatgtacatatgtatgatgttgtgtgccttgttaatcaatgaatgtaaatatctttatattgcttttgtac

SEQ ID NO: 5325 - DNA, 1689 bp, Oryza sativa
  Predicted polypeptide sequence is orthologous to G4
gtctctccaatattttgtcgaaccgattgagggaaaaaaaaaagagaaaaagaaaagaaaaaaaagaagaagaagagagaactcgaactctcgcctaccatttcgcccccctccgcaagcaatccaccactgcatcggcggcgagggctcaccggcggcgagccatgtgcggcggcgccatcatccaccacctgaaggggcacccggaggggtcgcgccgggcgacggaggggctcctgtggcccgagaagaagaagcccaggtggggcggcggcgggaggcgccacttcggggggttcgtggaggaggacgacgaggacttcgaggccgacttcgaggagttcgaggtggactccggggactcggatttggagctcggggaggaggacgacgatgacgtcgtcgagatcaagccggccgccttcaagagggccctctccagagataacttgagcaccattaccactgccggatttgatggtcctgctgcaaagtctgccaaaagaaagagaaagaaccaattcaggggcatccgccagcgcccttggggtaagtgggctgctgaaatcagagatcctcgcaagggtgttcgtgtctggcttggcactttcaacagtgctgaagaagctgcaagagcttatgatgctgaagcacgcaggattcgtggcaagaaggccaaggtgaattttccagaggctccaacaactgctcagaagcgtcgtgctggctccaccactgctaaagcacccaagtcaagtgtggaacagaagcctactgtcaaaccagcattcaacaatcttgccaatgcaaatgcgtttgtctacccatctgctaacttcacttcaaacaagccgtttgttcagcctgataacatgccatttgttcctgcaatgaactctgctgctcctattgaggaccctatcatcaactctgaccagggaagcaactcatttggctgctctgactttggctgggagaatgataccaagacaccagatattacatcaattgctcccatttcaaccatagctgaagtcgatgaatctgcattcattaagagcagtaccaacccaatggtccctcctgttatggagaacagtgctgttgatctgcctgatttagaaccctacatgaggttccttctggatgatggtgctggtgactcaattgatagccttctcaacctggatggatcacaggatgttgtcagcaacatggacctctggagctttgatgacatgcccgttagcgatttctattgaggaattcgaagtcttctagtcggagcatgtacacagggaaaaaaaaggaataaatactattggagattgggaggcacctgcatggcaccttgggggtagcatatcgttatgtttagcttagatgcaaaaggctgcatcctgaaactctttggtgattggacctgttccctatccgctgtctatgtatggcagccatctatgagactcaagaactgcttttttttttccgttctagttttctgtcgttgctacctgtatatggctatgaacatcgtgaatccatggccattatgttttaatctatgttgttgactgctctttctttcggtctttgctgtgctgcgctatgttggtgataactagctaccatattgattttctgtacataattcatttgttgaatccgaaattaaatagtgcattgacc

SEQ ID NO: 5326 - DNA, 1575 bp, Oryza sativa
  Predicted polypeptide sequence is orthologous to G4
gaaaggcattcgcaacacacacttgaagaaaaaaaacacgacgaacacgttaaaaaaaggtcgaagagaagtgggagacccaaaccgcgaacaatgtgtggaggcgccatcctcgccgagttcatcccggcgccgtcgcgcgccgcggcggcgaccaagcgggtgaccgccagccacctgtggccggccggctccaagaacgccgcccgcggcaagagcaagagcaagaggcagcagaggagcttcgccgacgtcgacgacttcgaggccgccttcgagcagttcgacgatgactccgacttcgacgacgcggaggaagaagacgaaggacacttcgtgttcgcgtccaaatctcgtgtcgtcgccgggcacgacgggcgcgcggcggcgagggcggcgagcaagaagaagcgggggcggcacttccgaggcatccggcagcggccatgggggaagtgggcggcggagatccgcgacccgcacaagggcacgcgcgtctggctcggcacgttcaacaccccggaggaggccgcacgcgcctacgacgtcgaggcgcgccgcctccgcggcagcaaggccaaggtcaacttccccgccacgcccgccgccgcgcgccctcgccgtggcaacacgagagccaccgccgtgccaccgccggcgacagcacccgccgccgccccgccgcgcggactgaagcgagaattctcgccgcctgctgagaccgcgctacctttcttcaccaacggcttcgtcgacctgacgaccgccgcggcgccgccaccggccatgatgatgacgagctccttcaccgacagcgtcgccacgtcggagtccggcgggagccccgccaagaaggcgaggtccgacgacgtcgactcgtccgagggcagcgtcggcggcggcagcgacacgctgggtttcaccgacgagctggagttcgacccgttcatgctgttccagctcccctactccgacggctacgagtccatcgacagcctcttcgccgccggcgacgccaacagcgcgaacaccgacatgaacgccggcgtcaacctgtggagcttcgacgacttcccaatcgacggcgcccttttctgatgtactcctccattgatgcagtttgtgcactcaattgttaatcacgtcgtcgttgatgaatgtttaaccggaggatgatggggtgcagctgatatcatggcttgcttgattaccgaattatattgcggtgtttgtgtttgtcaattagattctgaatctgtactactgccgatcttatgatcaaaactatatattaagtttatgtactcttaatttgtgggctacttttacggggtcttcgtactgctggtcaaatagtcctatgaaatcgatcatgtcggcaatatcgtcgtcaattatcgtggtcgtggttgttaatgatgtcaaataagtctatgaaaacctggtcctcttggtgtttatgtaccactgatcgatccatcatttgatctctgtcatgttgagatggatcgtgtaagaatatcataatttgctggattcagtccagtcgtaatgtattttggtttgtacaactgc

SEQ ID NO: 5327 - DNA, 1516 bp, Oryza sativa
  Predicted polypeptide sequence is orthologous to G4
gacccacaacccccaagcatcagcatcacaacccaccaatcgaatcgatcgaacaagacacgacaccatgcgccgccgcgtctcctcctcctcctcctcctcctcgtcctcgtcgccggcgaggcatcacaaggcgcggcgcagcaggaggaagctcgccgtcgacgaggactgggaggccgccttccgcgagttcctctcccgcgaccacgacgacgacgacgacgaccacgacggtcagcatgtcgttgttgcgccgttgatccgtggtagtgacaagtgcgtccacggccacgaggtggtggcgtcgacggtcggcggtggcgcaagcggcggacgacgacgagccgacgacgacgacggcgagcggcggcggcggcggcggagggagaagcggagctacccgtaccgcggcatccggcagcggccgtgggggaggtgggcgtcggagatccgcgaccccgtcaagggcatccgcgtctggctcggcaccttcgacaccgccgagggcgccgcgcgcgcctacgacgacgaggttcgccgcatctacggcggcaacgccaagaccaacttccccccatcgccgcccacgccgccgccgccggagaagccagcggcggagaggagcccctcgacgacgccgacgacgaccacggaggactccggcgactcgcgcatactcatcgagtgctgctccgacgacctgatggacagcctcctcgccgccttcgacatgaccaccggcgacatgcgcttctggagctaacgaacaacagagcagattcaggtaattaaatccacacccaagcaggtctaaaagtttttaacaatttcatgaaacaaaattaacaacaaatccagtaagataaataggatttaacaaggattgcaatggtaattattgcacaattttaccatttcggtgctttcaactgttcaatcaccgaaagaaattcagcaacttttgaagggcactgctacgcgtacttaatttctttttttcttctacaaaacactttctaaacaagttctcgaatgttccatttaattagatgggagtaaaaaagaaatccagaattagttatagcatgtggcattagccatgaaagttttagtaaaaaaaatttgcacttttgaatgatctagatcatagaggatcagtcgaattctgtgtgttcatgccatttctagcatttacgtgcagtattaaataaagttactactatttttttcttgttttctctatgttactcatcatgattttacatttttctttcccttttgacaggacaacataaacggcacgtctttgcaaccttgacatgcgactcgcctaataatcttgtcaaacaagggccgccagcttaattagctttttccaaaggtggggaacaattttgggggatgcaattaggacgcacagagatgaccccaacttgtcaatgggaattgaactctgatgacctttgtaatgataatcaaggcaccacattgtggggttaagcaaagttttggc

SEQ ID NO: 5328 - DNA, 1430 bp, Oryza sativa
  Predicted polypeptide sequence is orthologous to G4
cccgcgtcgcgccatagcgacgtctctcccggagaaagaagagcgcgccgcgccatgtgcggcggtgcaatcctcgccgatttcaccccggcgagggtgccccggcggctgaccgccgccgagctcctgccggtgaccccgactccccccgccgccgagaggagaaccacccggaagcgcaagtccgacgtcgacttcgaggcggagttcgagcttttcgaggacgacgacgacgacgatgagttcgagctttccgacgatggcgacgagagtttggccgtgtcatgtgtgtcgtcccccaagtcgaaggcagtaccttcgttttctttttcgtcggatgtctcctcgagctccaggccgcggcggcgcgtggcggcggcggcggccggtcgtcggaaggcgagcaagaagagcaagtacaggggcgtccggcgccggccgtcggggaggttcgcggcggagatcagggaccccaagaaggggcggcgcgtgtggctcggcacgtacggcagcgccgaggaggccgccatggcctacgaccgcgaggcccgccgcatccgcggcaagggcgcgaggctcaacttcccccgcgacggcgatggctcccctcgccggagtaacgaccggccctgctggaccatcgacctcaacctccccgcggcggccgtctccggtgacgacgacgacgccatggccgtcgacgccgcagacgcagacgcaggcagtgctggccgtgcagcagcctatgcagatcaagaagcactgagcgcggcaaagtgcaagatcaagcagtgtcctcgcgacgaacagatggcgagcgccacacctgagctcatggaggaggacgcgagcagcagcagaaacatggtgcccctgtccatggcgctgcagctgcagtatgcggcgatgatcgccgaatgcgaccgcgagatggaggagatcgccgccgtggagagggacctcgagaggcgcaggaggcaggtgttcgagcgcagaggccacctggtcaggcaggcctctcttctgctcgactgacgatcttgctgaactgaactctgaatgtttgagcttgtctgaagtctgaactctgcactatgccatatggtgtttcaccttcactgtgaggctgacatgtgggccagacgtccgtttgccttgcttgcttttgagctgcaactgggcgttgtgctgcaagcctgcaaagtgcctgtgtaaagtttgtgggattgtgtgtgtggatcttgtatccttgtgactttgcaagctttaattttgtgaggaacaatagtattttagattggtgtgtaaaatatagaaataaataatagtagcaactaaattttggttttcagctcttcatcagatggtttgtcatgggaacaaaatttcaaacatgagcaaattaaggtcatgttattatcaattgtgat

SEQ ID NO: 5329 - DNA, 927 bp, Oryza sativa
  Predicted polypeptide sequence is orthologous to G4
atgtgcggcggcgcgatcctcgccgacctcataccgtcgccgcgctccggcggccacaccaaaaagaacaagcggcggcggatcagcgacgacgaggacttcgaggccgccttcgaggagttcgacgccggcgacgacgactccgactccgactccgagtccgaggaggtagacgagtacgacgtcgtcgtcgacgacgacgacagcgaggacggcgtggtggttcttccgccgccgccgccgccgccgccggtgattccacatggtgaggcgatcgatcgatcaagaattgagcgccatggcgcgaggcggttccgcggcgtgaggaagcggccgtgggggaagtgggcggcggagatccgcgaccccgtgcgcggcgtgcgcgtctggctcggtaccttccccaccgccgagtccgccgcgcgcgcctacgacgccgccgcccgccgcctccgcggcgccaaggccaagcccaacttcccctccgcgccgccgccctcggctgctgctcaccgccgcaagaagcgccgcgcccacgccgccacgcgctcgccgtcgtctccgcccgccaccagcgaggtcacggcggcgtccgcgtccgcgtccagcgatgtccccgcgccggcgttcgcttccttcgtcggcgagcccgggcacggcggcgccaagtcgatgccgacgacgagccacacctcgcagccagccccgccggcgacggtggcgtccgagaacgtcgacgacccggaggtgttcgacccgtacgacgtccacggcggcctcgcctcctacttcgccggcggcgcgtacgagtccctggagagcctgttcgcgcacggcggcgacagcgccgccgtcgaccaagcggcgagcgaccactggccggcggcgctatggagcttcgcagacgacggctcgttctgcttctga

SEQ ID NO: 5330 - DNA, 1687 bp, Oryza sativa
  Predicted polypeptide sequence is orthologous to G4
ttctctccaatattttgtcgaaccgattgagggaaaaaaaaagagaaaaagaaaagaaaaaaaagaagaagaagagagaactcgaactctcgcctaccatttcgcccccctccgcaagcaatccaccactgcatcggcggcgagggctcaccggcggcgagccatgtgcggcggcgccatcatccaccacctgaaggggcacccggaggggtcgcgccgggcgacggaggggctcctgtggcccgagaagaagaagcccaggtggggcggcggcgggaggcgccacttcggggggttcgtggaggaggacgacgaggacttcgaggccgacttcgaggagttcgaggtggactccggggactcggatttggagctcggggaggaggacgacgatgacgtcgtcgagatcaagccggccgccttcaagagggccctctccagagataacttgagcaccattaccactgccggatttgatggtcctgctgcaaagtctgccaaaagaaagagaaagaaccaattcaggggcatccgccagcgcccttggggtaagtgggctgctgaaatcagagatcctcgcaagggtgttcgtgtctggcttggcactttcaacagtgctgaagaagctgcaagagcttatgatgctgaagcacgcaggattcgtggcaagaaggccaaggtgaattttccagaggctccaacaactgctcagaagcgtcgtgctggctccaccactgctaaagcacccaagtcaagtgtggaacagaagcctactgtcaaaccagcattcaacaatcttgccaatgcaaatgcgtttgtctacccatctgctaacttcacttcaaacaagccgtttgttcagcctgataacatgccatttgttcctgcaatgaactctgctgctcctattgaggaccctatcatcaactctgaccagggaagcaactcatttggctgctctgactttggctgggagaatgataccaagacaccagatattacatcaattgctcccatttcaaccatagctgaagtcgatgaatctgcattcattaagagcagtaccaacccaatggtccctcctgttatggagaacagtgctgttgatctgcctgatttagaaccctacatgaggttccttctggatgatggtgctggtgactcaattgatagccttctcaacctggatggatcacaggatgttgtcagcaacatggacctctggagctttgatgacatgcccgttagcgatttctattgaggaattcgaagtcttctagtcggagcatgtacacagggaaaaaaaaggaataaatactattggagattgggaggcacctgcatggcaccttgggggtagcatatcgttatgtttagcttagatgcaaaaggctgcatcctgaaactctttggtgattggacctgttccctatccgctgtctatgtatggcagccatctatgagactcaagaactgcttttttttttccgttctagttttctgtcgttgctacctgtatatggctatgaacatcgtgaatccatggccattatgttttaatctatgttgttgactgctctttctttcggtctttgctgtgctgcgctatgttggtgataactagctaccatattgattttctgtacataattcatttgttgaatccgaaattaaatagtgcattgac

SEQ ID NO: 5331 - DNA, 1447 bp, Oryza sativa
  Predicted polypeptide sequence is orthologous to G4
gcctccttcagactacaagccattaaacagagacgaccaacgacttaaccacacttcttctttgtgctgtccaacctccattgttgggtgtgaaagctttggctcatctgccatgtgtggaggatccattctcggcgaccttcacttgccggtgcggcggacagtgaacgccggtgacctgtggggagacgccggcaagggtagagatggtggcgacggcttgaagaagaggaaggggagttcttgggatttcgatgttgattgcgatgatgatgatgatgatgactttgaggctgattttgaggagtttgaggatgactatggcgatgatgatgatgtgggtttcggggacgacgaccaagaatccgacatgaacggtctcaagctcgccggattcagcaccacgaagctcggcctcggcggcagcaggaagaggaagacgcgataccgagggatccggcagcggccatgggggaaatgggcggcggagatcagggacccccgcaagggcgtccgcgtctggctcggcacgttcggcaccgccgaggaggccgccatggcgtacgacgtcgaggcacgccgcatccgcggcaagaaagccaaggtcaacttccccgacgccgccgccgccgccccgaagcggccacggcgttcttcggcgaagcattcgccgcagcagcagaaggccaggtcgtcgtcgtcgtcgccggcgagcctgaacgccagcgacgccgtgtccaagtccaacaacaaccgcgtcagctcggctgggagcagcaccgacgccaccgccgccgccatcgccatcgacgacggcgtcaagctcgagctgctctcggagacggatccttctccgcccatggccgccgccgccgccgcgtggctcgacgcgttcgagctgaacgatcttgacggatcaagatgcaaggacaacgcattcgatcaccagattcacaaggtagaagcggctgtcgctgatgaattcgcgttctacgacgatccgagctacatgcagctgggttaccagctcgatcagggcaactcgtacgagaacatcgacgcgctcttcggcggcgaggccgtcaacattggtggactctggagcttcgacgacatgccaatggagttcagagcttattgagcatttgattctatttaggagggagtgaattatttgggaggaagaatcgatgttgtaacttgtaaaatctctgatgatgatctctgcatcatatgatcaatttgagtgcagttttgtttttgtaaatacgaattctttattatgatgttaggttcttaatttgcccttcttcatcagggatttgttcaggcttttgttgtgatgactgattggacgagggaaagattgcgttttttgttgtcatgttgggtactctactcttctgttcctaaagttgataagtgccaaaatttgtgagaggaaaaa

SEQ ID NO: 5332 - DNA, 1214 bp, Oryza sativa
  Predicted polypeptide sequence is orthologous to G4
atcacaagctcacaagttcacaacccaacacccaaaagcaaaagaaaagcagcaaccaaagatgtgcggcggagcgatccttgcggagctcataccgagcgcgccggcggcgaggcgcgtcacggcgggccacgtctggccgggcgacgccaacaaggccaagaagaagggcgcgcgcgccgacgacttcgaggccgcgttccgcgacttcgacaacgactccgatgacgaggagatgatggtggaggaggcggaggaggaggaggcgacctccgagcacaagccgttcgtcttccgcgccaagaaggcggcggcggcggcgtcgagcaggcgcaggaagccggcgcagtacaggggcgtgcggcgccggccgtgggggaagtgggcggcggagatccgcgaccccgtcaagggcatccgcgtctggctcggcaccttcaccaacgccgaggccgccgcgctcgcctacgacgacgccgcgcgcgccatccgcggggacagggccaagctcaacttcccttccgctaccacccctgacacccgcaagcgcggccgcgccaccgccgccgccgccccggccgtcaaggcgaccccggtcatcaacctcgtcgaggaggaggacgaggaggaggtcgccgccgccatggcgtccatcaagtacgagcccgagaccagcgagagctccgagtcgaacgccctcccggacttctcctggcagggcatgtcggcctccgacgagttcgccgtcgccgcggcggcgctgtcgctcgacagcgacgacgacctcgccaagaagcgtccgaggaccgagccggaggacaccaccgactccggctccggcgacgacaccgacgcgctgttcgacgcgctgctgttcgccgaccagtacaaccacttcaacggcggcgcctacgagtccctggacagcctgttcagcgccgacgccgtgcagaccaccgccgccgccgccgccgccgaccagggcatggggctctggagcttcgacgacggctgctgcctcgtcgacgtcgaggccagcttgtccttctaggctctagccgtcgtctccggcgaccctgtgactcgatcttgtaccatgtcatgtacatagaagagtggttttgccaagcaagcatgtgttcgtcctggttcctttcggtaatgaaaaattatgtgaggcttctcgttctcgtaaaaaaaaaaaaaaaaaaaaa

SEQ ID NO: 5333 - DNA, 1613 bp, Oryza sativa
  Predicted polypeptide sequence is orthologous to G4
ctgtagcttattagcggccatgtgcggcggagcaatcatctccgggttcatcccgccgtcggccgctgcggcggcggcggcggcggcggcggcggccaagaagcagcagggcaggagggtcacggccgacgtgctgtggccggggatgctgcggaaggggaaggcgggggcggcggaggaggactttgaggccgacttccgcgagttcgagcgtggcatgagcgacgacgaggcggaggggggcggcggcgaggaggaggaggaggaggaggacgacgtggtcgtggaggtccccccgccggcgacggcgaggttcgtcgtccgtgccgcggccaaggcggcgcccccaactgcagatgggatgttgactacaaagcttgtccaacatgatggacctactgctagatcggcaaagcgcaagaggaagaatcagtacagggggatccgccagcgtccctggggcaaatgggcagctgaaatccgagaccccagcaagggtgtccgtgtttggcttggaacatataacactgctgaggaggcagctagggcatatgacgctgaagcccgcaagatccgtggcaagaaagccaaggtcaactttcctgatgaaccagctgttgctcagaagctctccctgaagcaaaacgctgccaagcaagagaaactagctccacctctgaagtcctgtggcgatgatgctttctttcagctaaacagttcagacaatgatttgtttgcaatgcttgcaaaggtgcctgcaaagccggcagagcctgttgatctcatgcctccagtcaaacctcttgcttccactgagacattcgagatgaacatgctctctgatacgagcagcaactcatttggctcttcagactttggttgggaggatgacaccctgaccccagactacacttcagtctttgttcctaatgctgccatgccagcatatggtgaacctgcttacctgacaggtggagcgccaaagagaatgaggaacaactatggtatcgccgtgccccagggaaatggcatgcctaatctcgcacaaaacatgcccaccttcgatcccgagatgaagtatttgccattaccttatgttgagagcagctcagatgaatcaatggacaaccttctgcaaaatgatgctacacaagacggggcaagcaacgagggcatctggagccttgatgagctgctcatggcagctggtgcctactgaggagacgaaatgttctggtcagtgtggtctgtcactagcaaaccatgtaaggcactccacactacctactattttgatttcttgtagatacattttcatgtttgaatgtgtatggccaagatgaagagctggtgatgtctgctatgttttgtagagggatgctaccaaagtaatgctagaatattacaagctgctatcagctgtactctctatgacaatgtttatactatgtttgctgtatggtgtggtctatgatttgaagtatgtcggagactaattcaaataatgcccttgggccatggtgctgtgccttggtaaatggtgctttatttaagggttatattaggttggtgcctcagtaattgccgttttctaccaaaaaaaaaaaaaaaaa

SEQ ID NO: 5334 - DNA, 1201 bp, Oryza sativa
  Predicted polypeptide sequence is orthologous to G409
ggcacgaggctcctcgaagaggagtactaccgagcagctcccggagaagaagcggcgcctcacgccggagcaggtagatactccagctagctagctaagctgtaaagatcggcggcgcgcggtgctctgttcccgagttgtgacgtgacgactggatcgatcggcgtcggcgtgtgtgtatgtatgtgcatctgctggagaggagcttcgaggaggagaaacaagctggagccggagcggaagacggagctggcgcggaagctatggctgcagccgcggcaggtcgccgtgtggttccagaaccgccgcgcgcgctggaagaccaagcagctcgagcgcgacttcgaccgcctcaaggcgtcgttcgacgccctccgcgccgaacacgaagccctcctccaggaaaaccaccgcctccactctcaggtgagctagctacgcccgccgcccgcgccaccgcccaaccgcgcgttatcctcgatccgatttggccgggctccttgattctgactgaattcgtggtgatcttgtgccgtcaggtcatgttctttgaacgaaaaactgccagaaaaagaaacaacaaccgaaggcacccccggcgccggccgtaaacgtccccgggctgccctgcgggcgccgaattgaagttccccgtcccggaacgccggaggacaccgggcgttggaggaggcggcggcggctttcgaggagcagcaggagcagcaggtgaaggccgaggacaggctgagcacggggcagcggcgggagcgcggtggtggacacggacgcgcaactggtggtcgggtgcggccggcagcatctcgccgccgtggacagcagcggggagtcgtacttcccgggcggggacgagtaccacgactgcgtgatgggccccatggaccacgccgcggggggcatccagtcggaggaggacgacggcgccggcagcgacgagggctgcagataatacgccgaagacgccggcgtctttttcgcggaccacggccaccaccaccaccaccaacacgcggacgacgacgaggaggacgggccagcagatcagctgctggtggatgtggaactagatttctcgcgcgcgcgcgtcgtcgtgcattcaattctcgtgttaaaaaaaatcgttctctttttcatttttcaaaaaaaaggggggcccggcacccaatccctcccctcccccccc

SEQ ID NO: 5335 - DNA, 1269 bp, Oryza sativa
  Predicted polypeptide sequence is orthologous to G409
tcttggagaagggaggagaagagggggaggagagcatggatcccggccgcgtcgtgttcgactccggcgtggcgcggcgggcgtgccccggcggcgcgcagatgcttctcttcggcggcggcggcagcgccaacagcggcggcttcttccgaggtaaacagagatccaatagagatcgtcgtcgtctccgtctcaggcgagtgacgcgtgttataacgcaggcgtgccggcggcggtgctggggatggatgaatcgcggtcgtcgtcgtcggcggcgggggcgggggcgaagcggccgttcttcacgacgcacgaggaactcctggaggaggagtactacgacgagcaggcgccggagaagaagcggcggctgacggcggagcaggtgcagatgctggagcggagcttcgaggaggagaacaagctggagccggagcggaagacggagctcgcccgccgcctcggcatggccccccggcaggtcgccgtctggttccagaaccgccgcgcccgctggaagaccaagcagctcgagcacgacttcgaccgcctcaaggccgcctacgacgccctcgccgccgaccaccatgccctcctctccgacaacgaccgcctccgcgcgcaggtctcccactgatttttttcacccttctcaattaattaattaccgcagttaatttcttgtgatcgaaggaccgctcttttaaaattcgaacaagttcgggggcttcggtgcaaaatggtagtaccgtagtttaattttgtaaaaatagccccccccccccccccttttgtaaaaatacaaccgcacttgtaaaataagattccactttttggcgccttttcattggatagcgaccagcggcgacccacaactcgatgcgtttttttaagtttttttttaaatcaaactttttaaacagtggttaggaatctaacgaacatatttatgctcgtttcccaaagtctaagcaccgctaatctaagcagcacatgcatatttctcttaattttttttagaatatcctgacgactagatgtactctttgttttgttttttctcagctcgtgtaatcacgtgaattcatatggttgctccgtttcacagttggctactgcttcagccgcggtcaaattttgaaatttagagcttatttttagaattaatttagagattgtttcgtctttgtcagccttcagccttggcttttaaacgctaaaactattttttttcagcgtaggtcaagtgccttttaacttgtaacccac

SEQ ID NO: 5336 - DNA, 1854 bp, Oryza sativa
  Predicted polypeptide sequence is orthologous to G409
gagcaacaaaattcagaagtcaaaaaaatcccaaaaacaaaaaataataaaaaaaaagaaagagagagacatttcgcatctgctgccctgcctcctctcccatcacctgcccattttttcacattgaggcccctctgaagatattatatttacaactaggtccctggccgggccggccggccaccggaaggagcacctcgccggagaaggctttgtctcttctttttcttctcctcctcctcctccatcggcggcggcatggggttctcgctgtaccccatgaagacgtcgacgcgcatgctgtggagcaccagcttcttccgccataaggtcgcctcctccttctaagcccacgccctctcgggcggcggcggcgagccggcggcggagcgcgcggttggtaggtgcgcgtgcgtgcgtgaacgggagagcagcttcgagatcgggttttcttgggttcttggagaagggaggagaagagggggaggagagcatggatcccggccgcgtcgtgttcgactccggcgtggcgcggcgggcgtgccccggcggcgcgcagatgcttctcttcggcggcggcggcagcgccaacagcggcggcttcttccgaggcgtgccggcggcggtgctggggatggatgaatcgggtcgtcgtcgtcggcggcgggggcgggggcgaagcggccgttcttcacgacgcacgaggagctcctggaggaggagtactacgacgagcaggcgccggagaagaagcggcggctgacggcggagcaggtgcagatgctggagcggagcttcgaggaggagaacaagctggagccggagcggaagacggagctcgcccgccgcctcggcatggccccccggcaggtcgccgtctggttccagaaccgccgcgcccgctggaagaccaagcagctcgagcacgacttcgaccgcctcaaggccgcctacgacgccctcgccgccgaccaccatgccctcctctccgacaacgaccgcctccgcgcgcaggtaatctcattaaccgagaagctgcaagacaaggagacgtcgccgtcgtcggcgaccatcaccaccgcggcgcaggaggtcgaccagccggacgaacacacggaggccgcgtcaaccaccggcttcgccaccgtcgacggcgcattggcggcgccaccgcccggccaccagcagccgccgcataaagatgatcttgtgagcagcggcggcaccaacgacgacggcgatggcggcgcggccgtggtggtcttcgacgtcaccgagggcgccaacgaccgcctcagctgcgagtcggcgtacttcgccgacgccgcggaggcgtacgagcgcgactgcgccgggcactacgccctctcgtcggaggaggaggacggcggcgcggtcagcgacgagggctgcagcttcgacctccccgacgccgccgccgccgccgccgccatgttcggcgccgccggagttgtgcaccacgacgccgcggacgacgaggaggcgcagctcggcagctggaccgcctggttctggagctgatcgatggaagcatggagcattggagccatgctatcaatgaatgaatgaatcaaatgaccttgagaccctcctctccgtcctttcttttgccctatttttaatcgctgttatatgttaattatgtgcaattaaagtgtacgtgttttgtcgtaagttgtgtttgttcaaattgtatgttttgaaggtgtcatgtattcatacacgatatgatatatagacgggatcatgaatgatactcggaaagattggaataattccatgtagtgttgagcaataataaacattttcctccgataagatgtttttatgatt

SEQ ID NO: 5337 - DNA, 1710 bp, Oryza sativa
  Predicted polypeptide sequence is orthologous to G409
tttagcttcagagccctccaaaagaaaaaaatattataggaaataaaaaataatttcctggttagaataaacacatttttaaaaaaaccaagaaaagattttcctcttctgttacattccttcttccttctccggccaccggagccgtagccgaattgtgcctcttctccggcgaggggagagggagagagggggtgtgagttttgctccttccggcgagtggtctcctccccgcgcggctgaggagatctctcgggacatcggggttggggcggcgtgcatgatggggttctcgctcacgccgatgaagatctccacgaggcttctgtggagcaccagcttcttccgccacaagatcgccgccaccatcgcgtcctcctcctccttcttataagatcatcttctccgccacagcaatctgtaaatatatacacatcgaacgcgacaagcgcgtttgattgattggatttttctcccctctcctcacgacaagtaattaaggcgcgcgatctcgatctctagcgttgagaacttgatccgcgatggagtccggccggctcatcttcagcacggcgggctccggcgccgggcagatgctcttcttggactgcggcgctggcggcggcggcgtcggcggcggggccatgttccatcgaggggcgagaccggtgctcggcatggaggaaggagggcgcggcgtcaagcggcccttcttcaccacccccgacgagctcctcgaagaggagtactacgacgagcagctcccggagaagaagcggcgcctcacgccggagcaggtgcatctgctggagaggagcttcgaggaggagaacaagctggagccggagcggaagacggagctggcgcggaagctagggctgcagccgcggcaggtcgccgtgtggttccagaaccgccgcgcgcgctggaagaccaagcagctcgagcgcgacttcgaccgcctcaaggcgtcgttcgacgccctccgcgccgaccacgacgccctcctccaggacaaccaccgcctccactctcaggtcatgtcgttgaccgagaagctgcaagagaaggagacgacgaccgagggcagcgccggcgcggccgttgacgtcccgggcttgcctgcggcggccgacgtgaaggtcgccgtcccggacgccgaggaaccggcgctggaggaggcggcggcggcgttcgaggagcagcaggagcagcaggtgaaggccgaggacaggctgagcacgggcagcggcgggagcgcggtggtggacacggacgcgcaactggtggtcgggtgcggccggcagcatctcgccgccgtggacagcagcgtggagtcgtacttcccgggcggcgacgagtaccacgactgcgtgatgggccccatggaccacgccgcggggggcatccagtcggaggaggacgacggcgccggcagcgacgagggctgcagctactacgccgacgacgccggcgtcctcttcgccgaccacggccaccaccaccaccaccaacacgcggacgacgacgaggaggacggccagcagatcagctgctggtggatgtggaactagatttctcgcgcgcgcgcgtcgtcgtgcattcaattctcgtgttaaaaaaatcgttctctttttcatttttccgcttctttgtctgtaatgttgagtttcgatcggctatgagaaggaaggaggtgtatgcatgtgc

SEQ ID NO: 5338 - DNA, 1710 bp, Oryza sativa; identical to SEQ ID NO: 5337
  Predicted polypeptide sequence is orthologous to G409

SEQ ID NO: 5339 - DNA, 1273 bp, Oryza sativa
  Predicted polypeptide sequence is orthologous to G428
gaattcccccatgagcctctgcctccctgcctgcccccgtatgtagcaagaacaagaacaccagcgagtaacacaggctcgctacagtggtactagattaccgcttgtgcgggcatagtgatcgtctatagttgtgaattgcgatgcagcagcataggtggtgagctgctgcggctgctgctgctggtacgtagatggaggatctgtacagcatccacccggggatctcgcgggtcggcggcgcggcgagcgaggcgtccggcgtgggcgtcgtcgtcggcggcggcggcgggtcgtcgtcgtcggatctgacggagctcatgaaggctcagatcgccggtcacccgcgctacccgaccctcctctccgcctacatcgagtgtcgcaaggtgggagcgcctccggaggtggcgtcgctgctgaaggagatcggccgggagaggcgcgccggcggcggcggcggcggcgccgggcagatcggcgtcgaccccgagctcgacgagttcatggaggcgtactgccgggtgctggtgcgctacaaggaggagctgtcccggccgttcgacgaggcggcgtctttcctcagcagcatccagacgcagctcagcaacctctgcagcggcgccacctcgccgccggccaccaccgccacgcactccgatgaaatggtggggtcctccgacgaagaccagtgctcgggggagactgatatgctagatatagggcaagagcaaagctcccgcttagctgaccacgaactcaaggaaatgcttctgaagaagtacagtggctgcctcagccggctccggtccgagttcctgaagaagcggaagaaagggaagctaccaaaggacgcacggtcggcactgcttgaatggtggaacacacactaccgctggccatatcccacggaagaagataagctgaggcttgcagcgaggacaggtcttgacccaaagcagatcaacaattggttcatcaaccagaggaagaggcactggaagccatcggacgggatgcggttcgcgttcatggagggcgtggcgggtggatcgtccgggacgacgctctacttcgacactggcacaattggaccatgaattcatttttgagcaatgccgcctcttgagaaaattggccatttaggcagtaatagtaggacatggtatttggtggtgattgtgtctagctatgatcaatctttcagcaggtcagtgttattcagttcagggtaaagtaattgcctcattgttttggcaaaaaaaaaaaaaaa

SEQ ID NO: 5340 - DNA, 1785 bp, Oryza sativa
  Predicted polypeptide sequence is orthologous to G428
gaatctttgtttccatgtctgtctgaattctgatctcttcttctctctgcctgcagacacaagcaggtgactcctccatcctcccaaagcaaagcacccatgtatcccgctgctgccgctgctacctacaagtgcaccctgcagaagctgcttctccttctccttctgatctgaggagctgcagctgctgctccagcagcagaggctgcagtgcaatccgctgccaaattcctcttcttctccttcctactagcttttctcttcttcttcttcttcttcttggaaagctggaacttggagctgcttaagcttacacctgctgattcatctccagctgctgctgctgctgattcagtattattatgtgtggagatgtacagtagatgaggaggaaggaagtagctactggatagctagctgagctgagctaagctgagctaagcttcttggctaggtaggtagctagaggtgaggtgaggtgggggaagaggggattggacatggaggatctgtacagcatccacccgggaatctcccgcggcggcggtgggggaggaggaggtgcggccagcgaggcgtccggggtcgccggaggggggagctcgccgccgcatcccccaccgccggcgacgacggcggcggcggcggatctgacggagctgatgaaggcgcagatcgccggccacccgagctacccttccctcctctccgcctacatcgaatgccgcaaggttggtgcgccgccggaggtgaccacgctgctggaggagatcggccgggaggggcgcggcggcggcggcggcgcgacagccggcggggaaattggcctcgatccggagctcgacgagttcatggagacgtactgccgggtgctggagcggtacaaggaagaactcacacggccgttcgacgaggcggcctccttcctcaccggcatccacacccagctcgcctccctctgtggcggcgcgccgccgcccaccgacaactccgatgaaatggtggggtcttcagaggatgagccgtgctcaggagacgccgatgcagcagattttgggcaagaacacagctcccgcttggctgaccatgagctcaaagagatgttgctcaagaagtacagtggctgcctcagccgcctccggtccgagttcttgaagaagaggaagaaagggaaactaccgaaagacgcgcgatcggcacttatggactggtggaacacacattaccgttggccttaccccacggaagaggataaggtgaggctggccgcgatgactggcctcgacccgaagcagatcaacaactggttcatcaaccagaggaagaggcactggaagccatcggaggacatgcggttcgcgctcatggagggggtcaccggaggatcctcctccgggacgacactgtacttcgacaccggcacaattggtccatgatcagattgcactccaaattaaatgtagcaccttgcaacagacattggcaggtattacctgctgctacaccctctgtgaggagcaagggatgatcatatattaaaaggaaaaaaagatgaaatcaatcaataacctcatcattttgtcgaaattattgtgtatatggtgttgtaagagggagttgggatgacctgtaaaaacttgcctgcattcagctaccataacattaattaattgtttgtatccctgacaactgcatccccagttaaaaccattttagacaggaaagagtgaactatgagtaatagtaacatgtagcaataataaagatacttattttttcccttgc

SEQ ID NO: 5341 - DNA, 580 bp, Oryza sativa
  misc_feature (45)..(45): n is a, c, g, or t
  misc_feature (81)..(81): n is a, c, g, or t
  misc_feature (90)..(90): n is a, c, g, or t
  misc_feature (196)..(196): n is a, c, g, or t
  misc_feature (274)..(275): n is a, c, g, or t
  misc_feature (281)..(281): n is a, c, g, or t
  Predicted polypeptide sequence is orthologous to G450
tggcgcctgtgagaagtgttgttctacgttgggctttcacccaancctggccaaaggatgggctttattctggagagccgnccaaagganggctgcaataatggtgcgtgacttgatgaagaccataggatggaggactggagtgcttgtgttggccgatgtttccactggggagaatcgttgtcccacaactctntgtcgcagactcaggatcatgaaaggttcagatgcaattggacttgctcacaagggcagttgataagtccctaatatnnccgcantactagaatggtttctggccccacaagtcaaaagccaagatggagtatcaaatgactgtagggaattttgctgaaaaccaagaagtgctgaacacgttttaagatggagtgctgcgccttatgggctgtactacactggtttgctattggtgaaagttaaaaaaaaaaggtgtcttgttatgttagcttcgccaaatctccctagggacataaactctatttggattgtgcccaagtcgtttgtacgtgtgttaatgctattcgtgtaaatggtttggtaaaaaaaaaaaaaaaaaaaa

SEQ ID NO: 5342 - DNA, 1118 bp, Oryza sativa
  Predicted polypeptide sequence is orthologous to G450
attttgctttgctttctttgctttcctctcctctctcgccgcccacctcgccgtcgccgccgccgcgagggccaacgccggcgaagtccgcgagccgaagcatcacacagctgcgccagcgatgtcggtggagacggagcggagctccacggagtcgtccgccgcgtcggggctcgacttcgaggacaccgccctcaccctccgcctcccgggctccctcgccgccgccgccgcacctgaccccgaccgcaagcgctcctccccctcctcctccgacgccgccgacgccgcagacaactcctcccccctcgccgccgccgccgatgctccccctgctcccaaggcgagggtggtggggtggccgccggtgaggtcgttcaggaagaacgcgctggcggccaagttcgtgaaggtggccgtggacggcgcgccgtacctgcgcaaggtggacctcgaggcctactccggctacgaccagctcctccgcgcgctccaggacaagttcttctcccacttcaccatccggaagttcgccgacgacgagaggaagctggtggacgcggtgaacgggacggagtacgtgccgacgtacgaggacaaggacggcgactggatgctcgtcggcgacgtcccctggaagatgtttgtggaaacttgccagcgccttcgtctcatgaaaagttcagaggctgtcaacttagcaccaagagccgctcaatgaggcattcccggtgcccatgaccgtgtggttggattgaaagaaagtggaagctttgccccgccgatgttcgcccacgtgtgatatgaacatgtacagttgtctcctactacttttggttccttgatgatgctgagttgagaaaaaggttgtagtttcgttactcgtctgtagtctctccatatatagataatgaagcactgaagcttgaaatatacacctacagtttgtctctttatgaataagaccatatacgcaaaaaaaccgatgttctttgctgcggctcgcgtgtcgtcaggctatatgcagttttttgtcgcaccataggcgatggacatctctggccttatactttcgtaaaaatcttatcatgttaagcgatggtcttgctttggagttc

SEQ ID NO: 5343 - DNA, 1204 bp, Oryza sativa
  Predicted polypeptide sequence is orthologous to G450
gatataatctcctccgccgccgcacctcgcagagagagagacgccgccgccgtcgccgccgccggcgaccggagagaaagagagagaagagcaacgcccacggcttcgccgccgctgccggcgaccatgtcggtggagacggagcggagctcgacggagtcatcggcggcgtccgggctcgacttcgaggacaccgccctcaccctccgcctcccgggctcctcctcctcctcctcctcctcctcgtcatcctcctcctcctcgtcgccgtcggagcccgaccgcaagcgcgcctccgccaccgacgacgaccccgacaaccgcctcggctccaccgccaccgagtcccccccttcccccaaggcgcgggtggtcgggtggccgccggtgcgcgcgttccggaagaacgcgctcgcggcgttggcggcggcgtcctccagcaaggccaagttcgtgaaggtggccgtcgacggcgcgccgtacctgcgcaaggtggacctcgaggcgtaccggggctacgaccagctgctcgccgccctccaggacaagttcttctcccacttcaccatccgcaagctcgggaacgaggagatgaagctcgtcgacgcggtgagcggcaacgagtacgtgccgacgtacgaggacaaggacggcgactggatgctcgtcggagacgtcccctggaaaatgtttgtggagacctgccaacgtcttcgtctcatgaaaagctctgaagcagtcaatttagcaccaagatctgcttgatgagtcgcaaatctctgctcctgtctttgagaagcatgagaggaagccatctttgcttgctgaggtttttccatgtctgtgagagaaatgtgtacagtcatcgacttcgacttttggttccatcgtgctattgagtttcagaaaagaaatggtttttagcttgtagctttgttaccagtcagtagtctctccatatagatgagcgaagcggtgatgctttaaaatacacccatagattgttttctcgataaataaaattggtctcactcactgagcccctgttcttcgacatgctttctaccactagtttgttcgataatgtgatgtgcatgtgaggcctgtgatggtgcaagaatcatataacttgtcatgttaataactattttgttgtaagattatgtttactgcatggtgttataagctatttaaagtttactcc

SEQ ID NO: 5344 - DNA, 1097 bp, Oryza sativa
  Predicted polypeptide sequence is orthologous to G450
gatctcatcacagccaacgcatcgtcttccttcttcgtcgtcgatagatcggctctcgagctcacaaccacatcgatcgtctccggcaagccgacgtacgtacgactagctagctagagaggaagcgagaaatggaagccgccgtggggtacgccgccgacagcctcatcaaggccaccgagctcaggctgggcctgcctgggacagccgacgacctgccctccacgcccaggggcaagaagcgcgccgccgcggcggaggacaacaacgccaacgccgccgccgccgacgacgacgagcacgacgccgtcgaggccgcgccgccggtagccaaggctcaagtggtcgggtggccgccggtgaggtcgtacaggaagagctgcttccagcaacagtcagcggcggcgagcaagagcaaggccgccgtgagcagctgcaacaacaaagacgagcccatcaccaagaacgcggcgccggcgccggcagcctcctcggcggcggcggccaacggcgggtcgctggtgaaggtgagcatggacggggcgccgtacctgaggaagatcgacctgaggatgtacaagggctacagggagctccgcgaggccctggaggccatgttcgtctgcttctccggcgccgccgacggtgccaacccgtcggagttcgccatcacctaccaggacaaggacggcgacctcatgctcgtcggcgacgtccctttcgacatgttcaccagcacatgcaagaagttgaggatcatgaagagatctgaagccacagggctaggatcaccaaggcaaatgaagatctaatctaagagcgacaagagatcgatcgatgcattccatcaacttttcatttctttttattttttttcctcccaagccaaaaaggagatgagcttgggggcatcaaagcaaacacatggatgtgcttctgctttgtttccatctttaaaaactagtaggttttaattttatgattttagcagcacaaaggagatgtggagatttgggttcaactctccatgtgtatgtacaaacgaaacagttattatatattgattgttggttactactactatactacttcaaacc

SEQ ID NO: 5345 - DNA, 1230 bp, Oryza sativa
  Predicted polypeptide sequence is orthologous to G450
gaccaccacacccctcgtctccgcaaactcgacgcgccactcgacagcgaccccgcagccgatccatcccgccgccgaagcagcagcaaccgccacggtgcgccgccgccgccggtaccgatgtcgacgagctccggcgccgactcgtccccgcccgtctcgggcctcgactacgacgacaccgccctcaccctcgccctccccggctcctcctcctcctcctcctccaccgccgaccccgaacgcaagcgcgccgcccacgccgaccacgccgacgccaagccgccttccccaaaggcgcgggcggtggggtggccgacggtgagggcgtacaggcggaacgcgctgcgggaggactccgcgagggcgaagctggtcaaggtggccgtggacggcgcgccgtacctgcgcaaggtggacctcgcggcgcacgccggctacgcgcccctcctccgcgcgctccacggcatgttcgcctcctgcctcgccgtccgcggcggcggcggcggcgacggcgagggtacaaagctcgtcgacttggtcaccggcgccgagtacgtgcccacctacgaggacaaggacggcgactggatgctcgtcggcgacgtcccctggaagatgttcgtcgagtcctgcaagcggatccgtctcatgaagagctccgaggccgtcaacttatcgccaagacgatcatccagataatcgatcctaccacacgcaacgatgcaatgccgcaattgatctgtctgtctgtctgtctgtctgaattagttcgtctgaaagtgtgtgcaatggaagaggcttggctgtacaggtcctccatgcatatgtacctataccgtagtaggatcagtgatcgatgagccaaattggtgtgtgtactgtacaggccacaagaacgaaaatatcctctctctttaattcaggtgtgctccctgctgccggatcacggccggcccggtttggtttttggacgacggcggcgaggatcgatccaagggaggcgccgccacgccgccgcggcggtgtactttaattttcaagttgtcagctactttctgtaatttgtttcatgatggttcggtttcctgtgacagccagcacttttgttgtatgtcaaatgcaatgtatacatgatataccggttgttatcgttgttgttgctgttgttgactttgttctgtccattgatgcattgcaaggtcaaatataggagcacaataatctgcc

SEQ ID NO: 5346 - DNA, 1545 bp, Oryza sativa
  Predicted polypeptide sequence is orthologous to G450
ggctcctttacatcacatttctagccaccctctcatcatcaccatcaagctcaaaccaacaagaagagagctagcttttggtactattagccactagtagatagccaagaagaaaccaagaaattctttgagctatctaattagctaggtccattgattcatcatcatctccattgatccacttagctttgaagaagaagaagaagaagacatttagttagctagctatattgaggtgaggtggcggcggcaatggcggcggacctggccttcgaggcgaccgagctccggctcggcctgcccggcggcggcggtgatggagacgccgcggcggcggcggcgaggagctcctccgggaagaggggcttcgccgagaccatcgacctcaagctgaagctggagccggcggccgcggcggtggacgacgacgacgacaaggaggaggcggcggctgacgaccgggagaagaaggtcgacatcgtcggagctgacaacgacgacgcctcgccgccggccgccgccgccgccggcgggatgaagcggtcgccgagccagagcagcgtcgtcaccgccgccgccgaccccgagaagccaagggctcccaaggcacaggtggttgggtggccgccggtccggtcataccggaagaacatcctggccgtgcaggccgacaagggcaaggacgccgccgacggcggcggcgacaagtccggcgccggcgccgccgccgccgccttcgtgaaggtgagcatggacggcgcgccatacctgcgcaaggtggacctcaagatgtacaagagctaccttgagctctccaaggcactcgagaagatgttcagctccttcaccattggaaactgtgggtctcatggggtgaacggcatgaacgagagcaagattgctgatctgctcaacggctctgaatatgtgccaacctacgaggacaaggacggcgactggatgctcgtcggcgacgtcccatgggagatgtttgttgaatcatgcaagcgccttaggataatgaaaggatcagaagctattggccttgcaccgagggcaatggagaaatgcaagaacagaagctgagaaagaagaacatgtcgccatcaaaaacggatggatcatcatcagatgcaacaatctatctatagcttttcttaattgcagctttgcctcatccctgtatcatactcgcttgctgtcctcatctccaagtctgtacctttcctgatcagtgaaagtcattttggtgttgtggtcagtttctgttctgttgcagtcattaagttcctaagtgtgtcatcttgtcttatacataagaaagaagccaagaacatgtaccagtagtacctgtcccataattatgtcttttttgctctccctgttcttccctttctatctgtttttttttaccttaatggcacaaaatgtaaaggcaccctgctcaaagggacctcaatgtattttgtccatgaaaaggttgtttaattatcttcatggtgtatccatcaaacaaataattattactgcaaggtgttatgtgtt

SEQ ID NO: 5347 - DNA, 1241 bp, Oryza sativa
  Predicted polypeptide sequence is orthologous to G450
accaccacacccctcgtctccgcaaactcgacgcgccactcgacagcgaccccgcagccgatccatcccgccgccgaagcagcagcaaccgccacggtgcgccgccgccgccggtaccgatgtcgacgagctccggcgccgactcgtccccgcccgtctcgggcctcgactacgacgacaccgccctcaccctcgccctccccggctcctcctcctcctcctcctccaccgccgaccccgaacgcaagcgcgccgcccacgccgaccacgccgacgccaagccgccttccccaaaggcgcgggcggtggggtggccgccggtgagggcgtacaggcggaacgcgctgcgggaggactccgcgagggcgaagctggtcaaggtggccgtggacggcgcgccgtacctgcgcaaggtggacctcgcggcgcacgccggctacgcgcccctcctccgcgcgctccacggcatgttcgcctcctgcctcgccgtccgcggcggcggcggcggcgacggcgagggtacaaagctcgtcgacttggtcaccggcgccgagtacgtgcccacctacgaggacaaggacggcgactggatgctcgtcggcgacgtcccctggaagtaagcaacgcgtgtacacatctcaatcagttcttgccgattaattcaccgaaatcaaatgcaaaatctgatccgatcaatcaacacaggatgttcgtcgagtcctgcaagcggatccgtctcatgaagagctccgaggccgtcaacttatcgccaagacgatcatccagataatcgatcctaccacacgcaacgatgcaatgccgcaattgatctgtctgtctgtctgtctgtctgaattagttcgtctgaaagtgtgtgcaatggaagaggcttggctgtacaggtcctccatgcatatgtacctataccgtagtaggatcagtgatcgatgagccaaattggtgtgtgtactgtacaggccacaagaacgaaaatatcctctctctttaattcaggtgtgctccctgctgccggatcacggccggcccggtttggtttttggacgacggcggcgaggatcgatccaagggaggcgccgccacgccgccgcggcggtgtactttaattttcaagttgtcagctactttctgtaatttgtttcatgatggttcggtttcctgtgacagccagcacttttgttgtatgtcaaatgcaatgtatacatgatataccggttgttatc

SEQ ID NO: 5348 - DNA, 1180 bp, Oryza sativa
  Predicted polypeptide sequence is orthologous to G450
tcctctctcttcttccaacacctcctaatcaccacaaaggcttaaaaatctccagtctccatagagagaaagagagagaagagaaggcagcttgatttggggcgaggagacgcgatagccgcgataggctaagcagctggcagcggcggctgctgcgatggccggcgccgacgtggacgtcgggacggagctccggctggggctgcccggaggtggcggcggcgccgccgaggcggcggccaaggccgcgaagaggggcttcgaggagaccattgacctgaagctgaagctgcccaccgccggcatggaggaggccgccgccggcaaggcggaggcgccggccgccgagaaggccaagaggccggcggaggccgccgccgccgacgccgagaagccacctgctcccaaggcgcaggcagtgggttggccaccagttcggtcgttccgcaggaacatcatgaccgtccagtcagtgaagagcaagaaggaagaggaagctgacaagcagcagcagcagcccgctgccaatgccagcggcagcaacagctctgccttcgtgaaggtcagcatggacggggcaccctacctgcgcaaggtggacctgaagatgtacaacagctacaaggacctctcccttgctctgcagaagatgttcggcaccttcaccgcaactgggaacaatatgaatgaggtgaatggctctgatgctgttacaacttatgaagacaaggatggtgactggatgcttgttggagatgtcccgtggcagatgtttgtcgagtcatgcaaacgcttgaggatcatgaagggttccgaagccattggtcttgcaccaagagcaaaggacaagtacaagaacaagagctgaaaatgttgcagtattaagatgctgagcatggtgccataagaatggtgttcttgcagtgtgttatggtttccttagaaatataaggttttacttgtttagctggattaaaagaaggaagagttgtcatgtttaatttgtttatggaccagaagcaataatctatttgtgtgtagctggattggtgttatgtgatgtcccctaccgtgtgtcccaagatctacttgatgattttattccaatgttgttaatttaagtttgtgtgattgtgaagtaaagggtatcaatgagactattattattatggtatctggt

SEQ ID NO: 5349 - DNA, 982 bp, Oryza sativa
  misc_feature (62)..(62): n is a, c, g, or t
  misc_feature (200)..(200): n is a, c, g, or t
  Predicted polypeptide sequence is orthologous to G450
cccccctcgtccggcccctcccctcctccccctcggcgcgctcgcgtcgaacgggatccggncttatggccggggacgcggcggcggcgggcgccgacgagaagatgtcgatgaagaggtcggcgagccagagcagcgtggtcaccgcggagcccgatcccgacaagccgcgcgcgcccaaggcgcaggtggtggggtgngcgccggtccggtcgttcaggaagaacgtgctcgccgagaaatgcaaggcggcggcgctggtgaaggtgagcatggacggcgcgccgtacctgaggaagatcgacgtcgccatgtacaagagctacccggagttgtccatggcgctccagaacatgttcacctccttcaccatcggcaagtgtgggtcccatcagcagctgaaggagagcaataagctgagagatgacctggagtacgtgccgacgtacgaggacaaggacggcgactggatgctcgtcggcgacgtcccgtgggagatgttcgtcgagtcgtgcaaacgcctccggatcatgaaagggtctgaagccattggccttgcaccaagggcagtggagaaatgcaagagctgaagctgatcaaggagaattaattagcgccgcatccagatttattaactttcacggatattatattatattatattatattatattatatcgcatgcatgcattggatctccctgtatatacaagttcaggtaatagatactggaatagcgtagaaaacagggtactagatcgtacggaatgagataccgaggagccctgtatgcagggctattgacaacgctatatcacacacgttgcggcgccatatacatagcgcatactctgtactatctgagctgtgatgtattgatagtacgtaatcatacgcgtgcgcacaacgatacaaatccgaccacagagtctaaccagtcacgagcacatagacagatagcgagactagccagatacgccaa

SEQ ID NO: 5350 - DNA, 1379 bp, Oryza sativa
  Predicted polypeptide sequence is orthologous to G450
ctctctcttcttccaacacctcctaatcaccacaaaggcttaaaaatctccagtctccatagagagaaagagagagaagagaaggcagcttgatttggggcgaggagacgcgatagccgcgataggctaagcagctggcagcggcggctgctgcgatggccggcgccgacgtggacgtcgggacggagctccggctggggctgcccggaggtggcggcggcgccgccgaggcggcggccaaggccgcgaagaggggcttcgaggagaccattgacctgaagctgaagctgcccaccgccggcatggaggaggccgccgccggcaaggcggaggcgccggccgccgagaaggccaagaggccggcggaggccgccgccgccgacgccgagaagccacctgctcccaaggcgcaggcagtgggttggccaccagttcggtcgttccgcaggaacatcatgaccgtccagtcagtgaagagcaagaaggaagaggaagctgacaagcagcagcagcagcccgctgccaatgccagcggcagcaacagctctgccttcgtgaaggtcagcatggacggggcaccctacctgcgcaaggtggacctgaagatgtacaacagctacaaggacctctcccttgctctgcagaagatgttcggcaccttcaccgcaactgggaacaatatgaatgaggtgaatggctctgatgctgttacaacttatgaagacaaggatggtgactggatgcttgttggagatgtcccgtggcagtatgttactacttcattcttgtgcccccttaactgttttccttattttccacctcatgattagaatgcggtttagcgataccacgttcaagtttctcgcattagctgattggttactctgcaggatgtttgtcgagtcatgcaaacgcttgaggatcatgaagggttccgaagccattggtcttggtcagtatcttcagctaaaatttgctttcgtgtcaagatttatatcttaattcacaccccttgtgtgtgtggtttttcttccagcaccaagagcaaaggacaagtacaagaacaagagctgaaaatgttgcagtattaagatgctgagcatggtgccataagaatggtgttcttgcagtgtgttatggtttccttagaaatataaggttttacttgtttagctggattaaaagaaggaagagttgtcatgtttaatttgtttatggaccagaagcaataatctatttgtgtgtagctggattggtgttatgtgatgtcccctaccgtgtgtcccaagatctacttgatgattttattccaatgttgttaatttaagtttgtgtgattgtgaagtaaagggtatcaatgagactattattattatggt

SEQ ID NO: 5351 - DNA, 471 bp, Oryza sativa
  Predicted polypeptide sequence is orthologous to G450
tttttttttttttttgacgtaaggatgacattgttgttacgtatatatatactccatgagcataacaagatggagctaacccacatgtaaatacatcaaaatcccttagaaaaactgagatgacacaagcttaactgacactgaattacagtaaactaattacttgatactagtataatacaggcaggagcaaagcatgcatgcaatataatataatataatataatataatataatataatatccgagaaaattaataaatctggatgcggcgctaattataagatctccttggatcagcgtatcagcgtcttgcattactccactgcccttggtgcgaggccactggcttcagaccctttcatgattcggagcgtcagtgtgtacgactctactaaaatgtcccacgggacttcgccgagtagcatccagtcgccgtccttgtcctcggacgtcggaacgtacgtccga

SEQ ID NO: 5352 - DNA, 1120 bp, Oryza sativa
  Predicted polypeptide sequence is orthologous to G450
cgcgaggtcggtcggaattccgggtgaccacgcgtcgcatcgatcgatcgatcacaactactagaaatccagccaagaagatcgagaccggatacagctagcaatccatccaagaagatcgagagagcggatacagctagcctagctacgcgaaggatcagatcatcggcatggagctggagcttgggctggcgccaccgaattccggtcatctcgtcgtcgacgagctcagcagcagcagcagcagcggcggcggcagcggcagcgcgccggtgtctgcctcgtcggccgggaagaggggattcagggaggcgttccaggagacgctgctgctcttcgacgacggcagctgctgcaacaccagcgacgacgattgcaggaggaggaagaagacggtggtggggtggccaccggtgagctcggcgcggcgggcgtgcggcggcgccaactacgtgaaggtgaagaaggaaggcgacgccatcgggaggaaggttgatttggccctccattcctcctacgacgagctcgctgccacgctcgcccgcatgttccccaccaacgaccaccaaggcgagaagaaaatggccaatgatgatcatggcgatgccgctggacctgtggtcacctacgaggatggtgatggggattggatgctggttgggggacgtgccatgggatgattttgcacgatctgtgaaacgcctgaagatactggtaactgaatgaaggaaatgctgcttgattgaggagccagtcgggttgttgcagacattgtttggttacgaagtttatgtgtccaacacagagtgcgagagaaactcggaacaaatagcaacataagcgggacactgccggcgtgatgaacaggtacatataggagtactaaaaaaggcgatagttatataggagacaagcgaaagaagaaaaagaatcattagtaacattatacaataacgatgattaagacagaagaggagtctagagatccaagcatagagaagactaaagaagcaagtaagaagaataataatagactgatagtacgagaatacatgacaatagacaacagattaacgtagcacgagaagaaaacaaagaacaaaaacgatcaacgtcagaa

SEQ ID NO: 5353 - DNA, 480 bp, Oryza sativa
  Predicted polypeptide sequence is orthologous to G450
tcggcgacgtcccctggaagatgtttgtggaaacttgccagcgccttcgtctcatgaaaagctcagagggctgtcaacttagcaccaagacccgctcaatgaggcattcccggtgcccatgaccgtgtggttggattgaaagaaagtggaagctttccccccccaattttcccccacgtgtaaaatgaacatgtaaccagttttctccaacaacttttgttcccttgataatgctgagttgagaaaaaggttttagtttcgtaactcttctttattctccccaaaaataaataatgaaccactgaagcttgaaaaaaacacctccactttgtctcttaatgaataagaccaaaaacccaaaaaaaccgatgttctttgctccggctcgcgtgtcgccaggcaaaatccagttttttgtcccaccataggcgatggacatctctgccctaaaactttcgtaaaaatctaatcatgttaacc

SEQ ID NO: 5354 - DNA, 605 bp, Oryza sativa
  misc_feature (201)..(201): n is a, c, g, or t
  misc_feature (280)..(280): n is a, c, g, or t
  misc_feature (503)..(503): n is a, c, g, or t
  misc_feature (520)..(520): n is a, c, g, or t
  Predicted polypeptide sequence is orthologous to G451
agacccccaaggatggtgaatatgtctgacttatgaagacaaggatgggagactggatgcttgttgccgatgtccatgggagatgtttcccaactcttgtcgcaagactcaggatcatgaaaggttcaagatgccacaattggacttgctcccaaggcagttgataagtccctaaaaccgcaaactagaatggttttctgnccccacagtccaaaaagcatagtatgggagatcaaaatggactgtagggaattttctgaaaacccaagaagtctaacangttttaaagatggagtcgcccttagggtctggtactacatgggtttgctattgtgaaagttaaaaaaaaaggtgtcttgttatgtttagcttccccaaatctcctagggacaataaactgctatttgattggtgcccaagtcttgtgtacgtgtggttaatgctattcagtgtaaaatggttttggaacaccatggtggctactgctatgattgagcaccccnacctacttgtgcaaaangttgtcaatgaactgtttgttcgctacataaatgttcaatgaagctggcaaatgtattgtccaccaaaaaaaaaaaaaaaaaaaa

SEQ ID NO: 5355 - DNA, 1164 bp, Oryza sativa
  Predicted polypeptide sequence is orthologous to G451
ggtcctcatctcatcttctcctccaaattcctcttccacatttcctcctcctcctcttctttctctcaagaaaatcagtagctagccatggcgtcttcttcttctctcaggagcaccagctgcctcgcctccgccgcggagaccgacgccgacaacctctgcctccgcctcggcccgccgggaagcagcatcaccaccaccaccaccaccggcggcgccgacccggcggcgaagaggtccctcggggcgaagcggtcgctggagagcacggacagcatggcctccggcaccggaacttccgccgccggcgacgagcacgacgacgacaccgccgcaccggccaaggcacaggtggtaggatggccaccagtgagggcataccggaggaacaccttccatcaggccgccgccgccgccgccgcaaccaagaagggtggtgatgagaaacagaagcagcagcagcagggaggagggctgtatgtgaaggtgagcatggatggggcaccatacctgaggaaggttgatctcaagatgtgcaagggctacagggagctgagggaggcactggatctcctcttcaccaagtgcttctctgcaaccgcctctgacggatgcagcgatggccagttcgccattgcctacgaggacaaggacggtgacctcatgcttgttggagatgtgccctgggaaatgttcatctcttcctgcaagaagttgaggatcatgaagggctctgaagccaggtgatggtctgatggatgatcaaaggagacaaatcacaggctaggacacaccacatgagaagatggatgatgaatcagagatcatgaatcacatggcatgagatgaatgggatcaagaagggagcagaggactagaagagccctgatggcttgtgctcttcgttgctgtacagagagagtttaggcactgccttgtttcagtgtttctgaatccaagagggacaagatgtatgaactgtgtatatagtcttttaattaggctcatttcttttttcagtttgagttttgtactgtatgagcgaaggctggaaaatatgaaaaaagggagaaatttgacctaagcttggtcatttctccacaccaaagattccttgtttctctgtgttcatatcataaatacagtaccaagccagtatttgtc

SEQ ID NO: 5356 - DNA, 1165 bp, Oryza sativa
  Predicted polypeptide sequence is orthologous to G451
gacgaagacaaagtcagaggtcacacagctcatcgtctcgagctacctagctggaagaagaagaggaagaagaggaggaggagctcgtcggagtttagttggtgagttcgccggagagatcgatcatggagaatctgaaggcgacggagctgaggctcgggctgccggggacggaggaggaggcggcgccgccgccgtcgacgcccagggccggaagcaagcgcgccctcgccggcgagcctgatcaggccaagatcaagcccgccgccgccgccaaggcgcaggtggtgggatggccgccggtgaggtcgtacaggaagagctgcctccagccgacgacgacgacgacgaagagcaagccgccgccggctgccgcggcggcggagacgcagcagaaggaggatgtcgccggcgccggtgggctgttcgtgaaggtgagcatggacggagctccatacctgaggaagatagacctcaaggtgtacaagggctaccgggagcttcgcgaggcactggaggccatgttcctctgcttctccggcggcgccgccgccgacgccgccgtcaacccgtccgacttcgccgtcacctacgaggacaaggacggcgacctcatgctcgtcggcgacgtcccattcgagatgttcattagtacgtgcaagaggttgaggatcatgaaggggtctgaagcaagaggcctaggagcaacaaggggttaaaaactgaacaacaacaagaagaaatcatcatcatgtgtgcatgagcaattcttttgttctttttgggttctccaagacatgcaatcatctcatctcctcattgcaaccttcaagaaagagagagagagaaagaaaaggaaagcaaaaaaaaaaaagatgcagtgaaaaaaatatgtgaagcttaattggagtcatcagattgcaaagcatgcatgcatgtgtggatgtgtggctttaatttgtttttttcctcttaattaggtgttagaaaacacagaaggaatggaggttcgagttgagcctccatgtgtgtttgtacaaagcaaacatcttttttcttttacatgaatggttgattacttttgtaactggagggaagaagaatgcatgtatgcatgggctgtgtgtacttctccctctggcttcaatgctttgatttccatccg

SEQ ID NO: 5357 - DNA, 1128 bp, Oryza sativa
  Predicted polypeptide sequence is orthologous to G451
gacgacgaggtcagtgtcgcagcgacgaacgccgacgagctagctctctctctcgatcggtggccatggcggcggagagcatcgacgcggagctgcgcctcgggctgcccggcagcggcggcggtgacggcgtggcggcgaagaagcggcggtcggcgtcgtcgacggtgaagagcgaggcctccggcacggcctgctgcggcggcgccggcgcccgggacgtcgaagacggcgcctcgccggcgtccaaagtgcaggtggtggggtggccgccggtggggtcgtacaggaggagcacgttccagtcttcgtcgtcgtcgacggcggcggcggcgaaggggaagggcggcggcgagacggatcaagggaggaagaataagggaggagggctgtacgtgaaggtgagcatggacggggcgccatacctccgcaaggtcgacctccggatgtacggcggctacagggagctcagggacgctctcgacgcgctcttcggctgcttctccgccgacgcctccgcctccgccgcccacttcgccgtcgcctatgaggacaaggacggcgacctcatgctcgccggcgacgtgccctgggacatgttcatctcttcttgcaagaagctgcggataatgcgaggatctgaggcgagatgatatatatcgaaatcgaaaggcgtcgagctgaagaaaaaattttcgccgatgcatgcatggagtagacatctcacagaaaaaaggcttcatgcatgagagagatgagatctatccgtggacatcgtcatgcatggcgatcggacggctggccaagaaggacacttacacgtagatgcatcttgtttttgttctacgtagatgtgtagatgagatatccaaggatctgaattctaaaaaagttcaggattcagttggatcggagttggtgaggaggaggatatgatcgatcgagcagagctgcagtactcctatgtacagaataatctagctgagattttggttgttggaaatggcaactgctagttctgcagatttgtgtacacatgccttttttttaaagctttttttttctagcttctgttgtgtcactgaagaaatctgagagctgaagaaagagaaacttggaagtttggtc

SEQ ID NO: 5358 - DNA, 1164 bp, Oryza sativa
  Predicted polypeptide sequence is orthologous to G451
cgtcctcatctcatcttctcctccaaattcctcttccacatttcctcctcctcctcttctttctctcaagaaaatcagtagctagccatggcgtcttcttcttctctcaggagcaccagctgcctcgcctccgccgcggagaccgacgccgacaacctctgcctccgcctcggcccgccgggaagcagcatcaccaccaccaccaccaccggcggcgccgacccggcggcgaagaggtccctcggggcgaagcggtcgctggagagcacggacagcatggcctccggcaccggaacttccgccgccggcgacgagcacgacgacgacaccgccgcaccggccaaggcacaggtggtaggatggccaccagtgagggcataccggaggaacaccttccatcaggccgccgccgccgccgccgcaaccaagaagggtggtgatgagaaacagaagcagcagcagcagggaggagggctgtatgtgaaggtgagcatggatggggcaccatacctgaggaaggttgatctcaagatgtgcaagggctacagggagctgagggaggcactggatctcctcttcaccaagtgcttctctgcaaccgcctctgacggatgcagcgatggccagttcgccattgcctacgaggacaaggacggtgacctcatgcttgttggagatgtgccctgggaaatgttcatctcttcctgcaagaagttgaggatcatgaagggctctgaagccaggtgatggtctgatggatgatcaaaggagacaaatcacaggctaggacacaccacatgagaagatggatgatgaatcagagatcatgaatcacatggcatgagatgaatgggatcaagaagggagcagaggactagaagagccctgatggcttgtgctcttcgttgctgtacagagagagtttaggcactgccttgtttcagtgtttctgaatccaagagggacaagatgtatgaactgtgtatatagtcttttaattaggctcatttcttttttcagtttgagttttgtactgtatgagcgaaggctggaaaatatgaaaaaagggagaaatttgacttaagcttggtcatttctccacaccaaagattccttgtttctctgtgttcatatcataaatacagtaccaagccagtatttgtc

SEQ ID NO: 5359 - DNA, 860 bp, Oryza sativa
  Predicted polypeptide sequence is orthologous to G468
ggcttgtttttttctcaactcgatccatctctctctctctctcgatctctccattaatttctacgtaagcattcgtagctatggaggagtgcaagggcggtggcatgtcgccgtcctcctccatggatagcagcacccacccggcgctgtccacgacgtcgtcggcggcgacggcgaggcgggacctcagcaccgatctccggctagggcttagcctctcgacgtcgtcgtcgtcctccctccggcggcgctcgccgacggcgaacgctgttcgtgaaggtgtacatggagggcgtcccgatcggccggaagctcgacctgctcttgctggatgggtatgacagcctcctcatcaagctctgccacatgttcaagacgcccatcacctatgctgatgttatggagtgccatcaacaagttcctggccagaaggctgcccatgtcctcacctatgaagaccaggacggggactggatgatggttggggacgtcccatgggaactcttcctgagcagcgtaaagaagctcaggattgcaaggatggataaatgctaaaacagttgcatttgaatttctctttgtttcttcttttttttttcccattggagggagggcccttattatatgtaggttagttgaaaaagatttttgctgaagctgagattatacttactagcagtgtacattatagtaaagaagtgtagcattatcagctacctaccgtatagcagaactgattattatttttcctctacttctttaactggtttgtaaatatcatgtattcgttaaagagagtagagaagttgataacacaaaggttccattttacctcagtggaatcaaattttgtggccttt

SEQ ID NO: 5360 - DNA, 1006 bp, Oryza sativa
  Predicted polypeptide sequence is orthologous to G468
gcgtttctctagtgatcttctttttcttttcttttgttttctgtctctagcgaactactagttcttggatccgatcgaccgaccctaccacccttgatttcatggagtgcatggcgagtactgaagagtctctcccagcttcttcctccatggatagttgcagcggcgaactgccgacgacgacgacgacggcgccggcgcaatccacggcgtcttccggctgccgaccgccggcgacggcggcgaagcggcggagtctgatcagcacagatcttcgcctcgggctcaccctctcctccgtcgtccacatcgacggcaacaacccttctaccccaaggagttccctcacgacggcgacagtgacagctgatcgaggcggcggcggcggcggccatggacggcgacggtcactgttcgtgaaggtgtacatggagggcgtccccatcggcaggaagctggacctgctgccgctagacggctacaaaggtctcgtcgcacggctcgcctccatgttcagagcatccatcacctatcatcattgccatcgacagttcgccgtcgtcgggatgaagacgaacaaggttcatcatgttctgacatacgaagaccaggagggagactggatgatggctggagacgtgccatgggagctgttcctgacaagcgtgaagagattgaggattgcaagagcggatgacaagtactgctatagctgttgaataattggttaaccaggatggtcaattaattcttccagagttcttggatttcattcattcttactttgctcattttggtggagcaatttagatttgagatgattgttttcgggagcggaaatttactagtaaaagcatagtgatattgagcagaggatattgtacaaaatatattgtacacactagtaaaagaaaagaaacatatatatagaaataccattttacttctcagtctagaataatttattccgaactggcaattttactgtatgaaaaataattttctc

SEQ ID NO: 5361 - DNA, 841 bp, Oryza sativa
  Predicted polypeptide sequence is orthologous to G519
atgcacgagtaccgcctcgccgacgtcgaccgctccgcccgcaagaagaacaccctccggctagatgattgggtcctgtgccgaatctacaacaagaaaggcggcgtggagaagccgagcggcggcggcggcggcgaacgttcgaatatgatgagccacggggagaccgcgtcggcgggctcgccgccggagcagaagccggccgtgctgccgccgccgccaccgccgtacgcggcggcggcgccgttctcggagctggcggcgttctacgacgtgcggccgtcggactcggtgccgcgggcgcacggcgcggactcgagctgctcggagcacgtgctgacgacgtcggcgtcgtccggcggcgtcgtcgagcggccggaggtgcagagccagcccaagatcgccgagtgggagcgcacgttcgccggcgccgccgccccggctggcgccgtcagcacggccggaccgattctgggccagctcgaccccgccgccgccgtcgccggcggcggcgacccgctcctccaggacatcctcatgtactggggcaagccgttctgacggctcggctcggctcggcggcttgagccgggagggatgaatgatctgatattctatcggggtggctcgggcgagccgctggaatcgatcggtggccgttggatggcggccgagttattggtagccgtcagatgggagatggaatggcattagttagttactagtatccgtatggacggcggcgatgaaacaggggagccccgagatgcgtgtaggaaggagatgcatggtactgtactcgagaattataagccgtgtgtatatgcgaaattggttggct

SEQ ID NO: 5362 - DNA, 1361 bp, Oryza sativa
  Predicted polypeptide sequence is orthologous to G519
gtcactgcagtgcctttgagctttcgttctctagagtgtctagggtgaatcttgagcgagtgagcgagcgatctctgtgttgtgtagtttgtgagctagggtgatggctaacaccggacttagcatccccatggtgaatggtgccacaatccacctcctccctggtttccggttccgtccaactgacgatgagctagtcatcaaatacctctacccccgtgcttttcatgtgccactgccctgtgcgatcatcaccgatgttgacatccatcatcacaacccctgggacatcgtcccagtggcggagagggagaaagggaagcacttcttcacaagaaaggaggtcaagtaccctggtagccgccgtagcaaccgtgttgctggtaatggcttctggagagcagcaggctcggaggtgcccatctattacaaaccagaaggtgctgctaacgacatgctagttgggatgaggcggactctagtgttccactacggaaagtcacgatctgcagagcgcactgaatgggccatgcatgagtttcagcttgctggtgctggtctccttcctcaccctatgatgaggcatgcaaccagcaatggttcagagccaccctgtggctgccttgaagcgacaatcgctaagaaaagtgatggtctctctgcaactcttcgtgccaagcgtgattctgcccctcttatgagaatcatggtagaacccgatagctcatgggtgatctgctgcatctacaagaagaggcagcgtgccccgcctgttgttatccctcctgtcattggcgatgtaggggaagctatcatccctcatgctattggcgatgcaagggaaggccaacttcacttcattgacttcctggggcagccagctcgcaatgatccatcctcgccccatagctgcaccattgacccctcctctttggaggaagggagtgatgagtctgccggtgatggtgaagataaggatggtgatggcatgaatgaagcaaattgatcgagtgtgaaggaagtgaactgagtctcaagaataaaaactgcaagtatggcgctccattccatggaagacctgcatgcatcctatatatgtgcttttatgttcaagttggagaactatgtgtgttgtctttaagttggagtactctaagctattcgatctggagattatgctgtttttaataaaagtttgaagtgtatctgtcctgtttaattagtttcaagaaagccaagcgtgtttgggttctaggatgaacaaagtcgtccaagatgcaagaagttctagagaggtagctacatttctggaaattgttgcatcttcctttcttcaatatatatatattgtcctatttcat

SEQ ID NO: 5363 - DNA, 1319 bp, Oryza sativa
  Predicted polypeptide sequence is orthologous to G519
tattcttaccccgacgcggcgtctcctcccctctcctctccccttccctccatcgcatctcctcccgctccttcgatcccaaatcggccgccgccgccgctccgccatgtccccctcccgccccgacgaggcggaccccgccgccgacttcggctcccaccccaccgaccaagagctcgtcaccaaatacctacgccgccacgtcgactccggcgggaacccgtggcggtacgtccacgaggccgacgtgtacgccgccgatcccgacgacctcaccggcaagtactccccggccgtcgccagcgacgggtccagggcgtggtacttcttcaccaccgtgcggtccaagagcaccggcgggcagaggagggcgcgggccgtgggcgacggcgggtgctggcactccgaggccggcgccaaggacgtcgtcggaggcatccgcagcccccgcccgatagggcggcgccagttcttctcgttcgtcaacaaggagggcccccggcgggtgcggtcggggtggatcatggtcgagatcggcctcaaatacgcccagcagaacgcctcctccgacgagcttgttctgtgtaaggtgtaccggagcccgcgggcgccaccggctgccgccgccgccaacaaatccatggccgccccacctcccaccgccacgaaatccaagacggaggaggctacaccacctcccgatgacgtgaaaccggtggtggcggctgcgcagactcccgacaccaaaatactcagggcggcgaaggaggcggccgcgactggatgcaagaggaaggctgacgtgaagagctctggtgcaagaaggggcaagcggctctgctcccgctgccgggcggagacatcggaatcggacagcgagacggcggtacttgacaggtcgccgtccatcgaagacgaaacggcggactcttcagaaatccatggaagcagtgatggcaaattcatcaggttcttgtgatttagttcgatctggagccccgagggtgctagcctagattggaatcagcgtgtaccaacaaaatggatagagctgctgtagttctcattttgagttcttaagccctagtataatgcctaccccaaatcatgcgttacccgcaaatttcagcatgatacagacaaggtaagcatttattttcagtatcagttgcaccgtatggtgcacttgtagatagaagttactacagcatggagaaatttggagattaacatatagacattagacattttctttcatgtaatatagtagtagaacacacaagaggttcaagcttgaatgattagaaaagcttcttgcc

SEQ ID NO: 5364 - DNA, 1255 bp, Oryza sativa
  Predicted polypeptide sequence is orthologous to G519
gacccaacaacccaccaccctcattccctcaagtcccaagatcgaacacctcgtgtccatggcggcggcgaagcggcgagtgcgcgacgcggaggcggacctgaacctcccgccgggcttccgcttccaccccaccgacgaggagctggtggcgcactacctctgcccgcgcgccgcgggccgcgccgccccggtccccatcatcgccgagctcgacctctaccgccacgacccatgggacctcccccaccgcgccctcttcggccgccgcgagtggtacttcttcaccccgcgcgaccgcaagtaccccaacggctcccgccccaaccgcgccgccgcctcgggctactggaaggccaccggcgccgacaagcccgtgctgcacaacggcaggacggccgggatcaagaaggcgctcgtgttctaccacggcaagcccccccgcggcgtcaagacggagtggatcatgcacgagtaccgcctcgccaagaagggcggcgccgccgccgccgcgggcgcgggcgcgctcaggctggatgactgggtgctgtgccggctgtacaacaagaagaacgagtgggagaagatgcagagcaggaaggaggaggaggaggccatggcggcggcgcagtcgtggggggagacgcggacgccggagtcggaggtcgtcgacagcgacgcgttcccggagatggactactcgctgccggcggcgtcgttcgacgacgccctgctgcccaaggaggaggcgcgcgacgacgactggctcatggggatgagcctcgacgacctccagggcctcggctcgctgctgcaggccgacgacctctccatgctcgcgccgccgccggcggcgaagacggagccgctcggcgcgccattcttctgagctctctctctctctctctctctctctctctctgtgactgcaccactgtatataaattcagagttttcagacatgttcagtattcagagttctcaggcaagttcagaattcagagatggttaaggattagtggcttatgagcagtatgatatgcaggttagtttctagtttagcagtgttactccagattggagatttgattaatgatttgattctaattaatgtagtatactgagtgttactcatcatcacagattcatcagagctgtgtcaagtgacaattctttttttttttatttcctggatcaagttcaccatgttgtgctcaagatttgtggataaatgcacatccatccttgaattggc

SEQ ID NO: 5365 - DNA, 1529 bp, Oryza sativa
  Predicted polypeptide sequence is orthologous to G519
gccaagccctcctctcctcttcccaacactagtaggataaagccacagagagagcagtagtagtagcgagctcgccggagaacggacgatcaccggagaagggggagagagatgagcggcggtcaggacctgcagctgccgccggggttccggttccacccgacggacgaggagctggtgatgcactacctctgccgccgctgcgccggcctccccatcgccgtccccatcatcgccgagatcgacctctacaagttcgatccatggcagcttccccggatggcgctgtacggagagaaggagtggtacttcttctccccgcgagaccgcaagtacccgaacgggtcgcggccgaaccgcgccgccgggtcggggtactggaaggcgaccggcgccgacaagccggtgggctcgccgaagccggtggcgatcaagaaggccctcgtcttctacgccggcaaggcgcccaagggcgagaagaccaactggatcatgcacgagtaccgcctcgccgacgtcgaccgctccgcccgcaagaagaacagcctcaggttggatgattgggtgctgtgccggatttacaacaagaagggcgggctggagaagccgccggccgcggcggtggcggcggcggggatggtgagcagcggcggcggcgtccagaggaagccgatggtgggggtgaacgcggcggtgagctccccgccggagcagaagccggtggtggcggggccggcgttcccggacctggcggcgtactacgaccggccgtcggactcgatgccgcggctgcacgccgactcgagctgctcggagcaggtgctgtcgccggagttcgcgtgcgaggtgcagagccagcccaagatcagcgagtgggagcgcaccttcgccaccgtcgggcccatcaaccccgccgcctccatcctcgaccccgccggctccggcggcctcggcggcctcggcggcggcggcagcgaccccctcctccaggacatcctcatgtactggggcaagccattctagacgaccaaaaaaaaaaaaaaacaaccgcattggcagcaatggtgtcactgaacaccgtgcaggctagctagcttcatggccggtgaactttgactcaggcgagccgccggagttgactcaaagataattaaaagaagtgttttaagtggattggattggattagacagaggagatgaggactcgagaaaggcggcgatgagaccgtggttggggggaccctggcctggactgaacgacgacgaggcagcagcagaaagatggtgcaattgcatcgggtggcatgtcagtgtgtgtgtatagtggcatgtacatagtacatggtgattgattcggtatacagggggctagctttcctgtttctgtttcttcattggttaattattactcccattataaggtcttcttcagggttgctagcttaattaattaattaattagcccagtggttgaagtgtaagtcaaaattcatcaagtcagagactggaataatacaatacagtactgc

SEQ ID NO: 5366 - DNA, 1868 bp, Oryza sativa
  Predicted polypeptide sequence is orthologous to G519
attccaaaactttcgaaagcttccattagcgactaatccagccttcgttaagggtgattagaatttgattaatttcaaggcctcagatcggagattgaatggagtgcggtggtgcgctgcagctgccgccggggttcaggttccacccgacggacgacgagctggtgatgtactacctgtgccgcaagtgcggcggcctccccctcgccgccccggtgatcgccgaggtggacctctacaagttcaacccatgggatctccccgagagggcgatgggaggggagaaggagtggtacttcttctcgccgcgggaccggaagtacccgaacgggcagcggccgaacagggcggcggggacggggtactggaaggcgacgggggcggacaagccggtggggtcgccgcgggcggtggcgatcaagaaggcgctcgtcttctacgccgggaagccgcccaagggcgtcaagaccaactggatcatgcacgagtaccgcctcgccgacgtcgaccgctccgccgccgcccgcaagctctccaagtcctcccacaacgccctcaggttggatgattgggtgttgtgccgaatctacaacaagaagggagtgatcgagaggtacgacacggtggacgccggcgaggacgtgaagccggcggcggcggcggcggcgaagggtggtcgcatcggcggcggcggcggcgcggcggcgatgaaggtggagctctccgactatgggttctacgaccaggagccggagtcggagatgctgtgcttcgaccggtcggggtcggcggaccgcgactcgatgccgcggctgcacaccgactccagcgggtcggagcacgtgctgtcgccgtcgccgtcgccggacgacttccccggcggcggcgaccacgactacgccgagagccagcccagcggcggatgcggcgggtggcccggcgtcgactgggccgccgtcggcgacgatggcttcgtcatcgacagctccctcttcgagctgccctcgccggcggcgttctcccgcgccgccggcgacggcgccgccttcggcgacatgttcacgtacctgcagaagccgttctaattaacggaacgtgacgcctctgcaaacgctaattagctcactaaccactgtcaggtcgatcgtgtaattcttttaccagtctagggtacagccaaaaaaccaaaaattaaccgtgctcgatcgatcgatcgatccatggatcgatgatcgcctccaccggcagatcaaaatcgaagcaaaaaatcagggagaattcttggtacttccagtacctctcgtcgacaccacgtgtcgggttttctgcaccgcggatcctcgctggccgcatcgtaacggcgagcgaggttaaaaatagtggagaattcaagaacacatccctgatttttgtttctgccggatggggagtaccgtgagcatggtagaaatgactggtaaaattttcgttgatgataggtagccagagtcgatgtaaccagtcgatttttttttttttttggttttagttgacatgccttcctgatagattcagaacaaacaatagagaagagaggagaaaaaaacacagaggagaaattcagagaccaaagttcaaagttttggaattttcaggggcgccagcagctgatggtattgtcagtcgtgtctaggttcgtagaggaaattaaaatgtagaagaacgggtacttcagttcacttcaggttcgttcgtgccaaacaggtctctgacactttagttaggttttgatttttttttctctttttttctggttttttgtcgtttggtaatgtaatgtaagggtgattgcgacatggtatttatgtgattagagtcgctttcagttg

SEQ ID NO: 5367 - DNA, 969 bp, Oryza sativa
  Predicted polypeptide sequence is orthologous to G519
atgagcggcggcggcgaaggggcggcggcggcggagaggcaggagctgcagctgccgccggggttcaggttccacccgacggacgaggagctggtgatgcactacctctgccggcggtgcgccggcctccccatcgccgtccccatcatcgccgaggtcgacctctacaagttcgatccatggcatctcccaagaatggcgctgtacggcgagaaggagtggtacttcttctcccctcgggaccgcaagtacccgaacgggtcgcggccgaaccgcgccgccgggtccgggtactggaaggccaccggcgccgacaagccggtgggcacgccgaggccggtggccatcaagaaggcgctcgtcttctacgccggcaaggcgcccaagggcgacaagaccaactggatcatgcacgagtaccgcctcgccgacgtcgaccgctccgcccgcaagaagaacaccctccggctagatgattgggtcctgtgccgaatctacaacaagaaaggcggcgtggagaagccgagcggcggcggcggcggcgaacgttcgaatatgatgagccacggggagaccgcgtcggcgggctcgccgccggagcagaagccggccgtgctgccgccgccgccaccgccgtacgcggcggcggcgccgttctcggagctggcggcgttctacgacgtgcggccgtcggactcggtgccgcgggcgcacggcgcggactcgagctgctcggagcacgtgctgacgacgtcggcgtcgtccggcggcgtcgtcgagcggccggaggtgcagagccagcccaagatcgccgagtgggagcgcacgttcgccggcgccgccgccccggctggcgccgtcagcacggccggaccgattctgggccagctcgaccccgccgccgccgtcgccggcggcggcgacccgctcctccaggacatcctcatgtactggggcaagccgttctga

SEQ ID NO: 5368 - DNA, 1332 bp, Oryza sativa
  Predicted polypeptide sequence is orthologous to G519
gccacggaagcgcagcatcaacaaaggcagcagcagcagcagcagcagcagcagcgttggtggtggtggtgtgtcatcaccaacattttcacgagaggagaaggatggaaatggcggcggcggttgggggcagcgggaggagggacgcggaggcggagctgaacctgccgccgggcttccgtttccacccgaccgacgaggagctcgtggtgcactacctctgccgcaaggttgcccggcagccgctccccgtcccaatcatcgccgaggtcgacctctacaagctcgacccctgggatctccctgagaaggcgttgttcgggaggaaagagtggtacttcttcacgccgagggaccggaagtacccgaacgggtcgaggccgaaccgcgcagcggggagagggtactggaaggcgacgggagccgacaagccggtggcgcccaaggggagcgcgaggacggtggggatcaagaaggcgctcgtgttctactccgggaaggcgccgaggggggtcaagacggactggatcatgcacgagtaccgcctcgccgacgccgaccgcgccccgggcggcaagaagggctcacagaagctggacgagtgggtgctgtgccggctgtacaacaagaagaacaactgggagaaggtgaagctggagcagcaggacgtggcctccgtggcggcggcggcgccgcgcaaccaccaccatcagaacggcgaggtcatggacgcggcggcggctgacaccatgtccgacagcttccagacgcacgactccgacatcgacaacgcctccgccggcctgcggcacggtggctgcggcggcggcggcttcggcgacgtggcgccgccgaggaatgggttcgtgacggtgaaggaggacaacgactggttcaccggcctcaacttcgacgagctgcagccgccgtacatgatgaacctgcagcacatgcagatgcagatggtgaatccggcggcgccagggcacgacggcggctacttgcagtccatcagctcgccgcagatgaagatgtggcagacaatcctgccaccattttgagatggatggagcaagaaaaaggttgctgtagataaagggcggaaataggagtgatggctagaaaattattagatttactagaacgaaaatgattagaaatctggcaagcatgattctgcaaatgtggtggtagatgcttgcagtatgtaattcatttgttcagtatatgcatttggtaatctgcaaaacatctccttttgttctcatatcctaagcgaaacatatatgattttatccttcaaaaaaaaaaaaaaaaaaaaaaaaaaaaaaa

SEQ ID NO: 5369 - DNA, 1312 bp, Oryza sativa
  misc_feature (1168)..(1168): n is a, c, g, or t
  Predicted polypeptide sequence is orthologous to G519
acattttcaaacaacgcaaagcagtagcagcagcgagaagcaagcaagaagcgatggggatgaggagggagagggacgcggaggcggagctgaacctgccgccggggttcaggttccaccccacggacgacgagctggtggagcactacctgtgcaggaaggcggcggggcagcgcctgccggtgccgatcatcgccgaggtggatctctacaagttcgacccgtgggatctgcccgagcgcgcgctgttcggcgccagggagtggtacttcttcaccccgcgggatcgcaagtatcccaatgggtcacgccccaaccgcgccgccggcaacgggtactggaaggccaccggcgccgacaagcccgtcgcgccgcgtgggcgcacgcttgggatcaagaaggcgctcgtgttctacgccggcaaggcgccgcgaggggtcaagactgattggatcatgcatgagtaccggctcgccgatgctggccgcgccgccgcgggcgccaagaagggatctctcaggttggatgattgggtgctgtgtcggctgtacaacaagaagaacgagtgggagaagatgcagcaggggaaggaggtgaaggaggaggcgtccgacatggttacgtcgcagtcgcactcgcacacccactcgtggggcgagacgcgcacgccggagtcggagatcgtggacaacgaccccttcccggagctggactcgttcccggcgttccagcctgcgccgccgccggcgacggcgatgatggtgcccaagaaagaatcgatggacgacgccaccgcggccggcgccgccgccgacaccatccccaggaacaacagcagcctgttcgtggacctgagctacgacgatatccaggccatgtacaggcgcgctcgacaatgctgccggcgggcgacgactctactcggtcgtctcgcgtcgcgcgggtgaaggtgagaagcacgcgccgcgccggatgggatggcccgtctgagggacgggaacgacgaccgggtggacaagctgaagggttaatatacgcggggggcagaagcctggtatccccgcggtctacatgtccggacataatcactatccccgggcaaaccggtcgtctctttcacccggggctgttcaacgggcgcactgctgactcttcactctcacgagancgaacatctcagcatgtacactgtcacagatcactcacggctagcgtcgtctcatcgcacatatctacactatacgagtcattcacagactgatgctgcagtagtctctgatactagagctgtgctctcatgtcacgtctagac

SEQ ID NO: 5370 - DNA, 1753 bp, Oryza sativa
  Predicted polypeptide sequence is orthologous to G522
atccagatgcgcttgcacttgcacttgcatgcagttcattgctctagctataggctatagctactatacactcatgagaatctgagattgggctgaaaattgatgagcatcgatctgaagaagacatatatatagctgatgatgatatagctttttctgcatatgcttgttttgatctgcagccaatcgatcgaggcatagagagtcaccaggcaatcaaattccaaccatccatcagctagatatatatacagcaaagatcacgatactcctagctagctagctagaagaattgatcggtcgatcggaggaaatagcaatggatcggcatgaggaggaggcaggagagtctccatgtgtgccgccggggttcaggtttcacccgacggaggaggagctggtgggctactacctcgccaggaaggtggcctcccagaagatcgatctcgacatcatccaggagctcgatctctacaggatcgagccatgggatctgcaagagcgttgcaagtacggtgggcatggcggcgatgagcagacggagtggtacttcttcagctacaaggaccgcaagtaccccagcgggacgaggaccaaccgcgccacggcggcgggcttctggaaggccaccggccgcgacaagccggtgctctcgtcgccgtcgacgagggtgatcgggatgaggaagacgctggtgttctacaagggtcgcgcccccaacggccggaagaccgactggatcatccacgagtaccgcctccaatcaaacgaacacgcccctactcaggaggaaggttgggtggtttgccgcgcgtttcagaagccgatgcccaaccagcagcagcacaggctgtcctacggctgcatccccggcagctacggcgccggagcctacgccgccgtccccgacaactacagcttgctgctgcaccacgacaaccctagcttcgccgggcggccattgatgagcgccgctgcctcagctctcttcgccaacaacaacaataacagcgtcgtcgaccacagcaacattctgagttcagagtccaagcttcacttctccgacatgatgccgcctctggagagccccaccatcgtcgacggcgagggctacgtctcgcaggctagcagctgcgtcgacgtcgatcagcaagccggcatcgtcgactggaacctgctcaccagcttgctgccgccgccggcgcatcagctcttccaccacctgccttccgcttctagctccaagaacagcaacaacatttcttcgtcaggcttcatcgatgaccgagactgatcgatcgatccagatcgattattatcaattgacaattcattcatcatatatatgcatgaattcttacaaatacgcacaattaaacgatcgagtgtactattaattagttgattactccgtctccatgatgtatacattaatttgaccactggccatcatcaggccatctgcatgcttactatctagcttatgtcagtacacggttgttagttcattcttaattaattagctactagtgtcagtgtgtgtatctatcggttgttcgtcttttgacctcattgctgagagaggtttgtaactgatgatgattaagttagctagcatttaattaggtgctatatatacacatatatatgcactatcactatatacatcatatatatgtatacatatatcgttgtctgcttaatgtgtacaccacctctctgcagtatatatagtattgatcaattaatttgt

SEQ ID NO: 5371 - DNA, 1418 bp, Oryza sativa
  Predicted polypeptide sequence is orthologous to G522
ctcatgcgatcgatatagctgctccatccgtttgaaggctggctgctgctggccgagggaggcgctgcatgctgctgcaagctacgaagcagtagcaattgcaggcgcgcgcgcacaagttcatattaacttgctaccagttcgggagctatactttgatccgcggaagaagatggacgcattctcccatgtcccgccaggttttcgtttccaccctactgacgaggaactcgtggattactaccttaggaagaaggtagcactgaagaagatagacttggacgtcataaaagatattgatctgtacaaaattgagccttgggacctacaagaacaatgcaagattggaaacgaggagcagaacgagtggtacttcttcagccacaaggacaagaagtacccgacgggcacacgcaccaacagggcgaccactgccggcttttggaaggccaccgggagggacaagccgatctatgtcaagaactgccttgttgggatgaggaagacgttggttttctacaggggccgggctcccaacggacagaagtcggactggatcatgcacgagtatcgcttggagaccaacgaatacggagctccccaagtaagtttgtgtactagtgcatgcatgctaccgaggattcagacttcagacacctaacatgctccatgttcaggaggaaggatgggtggtctgcagggtgttcaagaagcgagtcgcggcggtgcaaagggcggccggcgacggcggcgactcacctttctggttcaacgagcacgtcgcgttcatggcgccggcgccaggcctcgactcgccgtaccatggccaccgccagagccacccttgcaagctggaggtagagtatcaccaccacctccttcctcaggaggcggcgccgttcatgcacctcccaaggctggagagccccaagctaccggccgccgacatcattgtcgccaccgcagcgtcgtccgctctccagccgtgcggccacacgacggcgcagcagctgcagctgcagatcgagccggtctacgtgacggccgatgcgtcggcagcagattggagggatcttgacaagctggtggcgtctcagttcggccacggcgactcgactgcgaaggagcccagttactgcaatccggtgcaggtgtttcaggtcgaggggaagcaggaggatagcttggattacgtgtccacgtctgcctcctgcggaggggaggaggatttgtggaaatagccgcgtgaatgatgcaaaacacatactaacatatacgccattgtatacagcctaataacattgcggtgtgatttgatacagtgtataaatagctagcattgtcatggtaattaccaactgcccatctatatatactaataaagtataaccgaagtggttatacatgcatgcatgatt

SEQ ID NO: 5372 - DNA, 1346 bp, Oryza sativa
  Predicted polypeptide sequence is orthologous to G522
aatttgcttctcatctttcttctctactcctctcaaatacaagagctcacactgctccctagcttccttcttcatcccttgaactagttgtcagctactgaccagcctgaagatagatgctagtttgtgtagagaattcgatcttctgaggcgtatggtgatcatggagtcatgtgtgcctcctgggtttaggttccaccccaccgacgaggagctcgtcggctactacctccggaagaaggtggcctcgcagaagatcgacctcgacgtcatccgcgacgtcgacctctaccgcatcgagccatgggatctccaagagcattgcaggatagggtacgaggagcagagcgagtggtacttcttcagctacaaggacaggaagtacccgacggggacgaggacgaacagggcgacgatgacggggttctggaaggcgacggggagggacaaggcggtgcgtgagaggagcaggctcatcgggatgaggaagacgctcgtcttctacaagggcagggcacccaacggccacaagaccgactggattgtccacgagtaccgcctcgagtccgacgagaacgccccgcctcaggaagaaggctgggtggtgtgccgcgcgttcaagaagcgaaccatgcagccgccgcggagctccatcggagcatgggaggcgagctactcctaccacgaccccgccgtcttcgtcggcggcggggaacacttcaagcaagaggccgcggccgagctggacggcgtcgccgccgccgccggagctaacgccttcctgcggtactccacccgcctggccgagctcccgcagctggagagcccgccgctgccaagccaggggagccaggcggcctcggccgtcgtcgacggcgaggaagataacgccgattctagcaggcgccctggcggcggcggcggcgccgccgccgcggtgaccacggactggagggcgttcgacaagttcgtcgcgtcccagctcagccccgaggagcagcacacctgccgggccaccgacgacgacgacatggcagcgctgctgctcctcgacggcggcgggcaggaggacgacgccgggaggtggctgggctccgccgggttgctgagcgccgtggcggccgacgcgacgacggactgcggcctcggcaccagctgcgtgcctggcgacatcaactgattcagggccaagccgatcgagctctcacttctccttagcataaagtgtgagatatctacgaattgtatggatggctatatatacgtacgcctatacatatgtagctggtcaaagcatcgtttcagtttcagtttcagttcttggaagtcaatggatgttgaccatt

SEQ ID NO: 5373 - DNA, 2350 bp, Oryza sativa
  Predicted polypeptide sequence is orthologous to G522
gctagcttcgccatccacattcttcttgcttcttgctcctctctctctctctctctctctctctctctctagcttcctgctgcatcttcctcagccatctctttcatcctcccagtcgtcccaggctgcttaattacatatatctagatatatatattattcttgttaatttcgatccatcagtgtgcaatatatatatatagttttacctctaatatttagcttcttaatttctcctcatttttctgcctgtgctactgcatacatgcgttaattcatggtcgccatggatcgcatggagatccgtttctttactactccacttgttttctctagctactagttttctcttcttcttttcatcaaacaatcaatcaatcatatcccgttctatcttcacacatcaaccccgttccctgttctccgttctctctcagctgcagctagctacctctcctcctctcttccgatctctcatcaggatcggatcgaggagggaggagggagaccaacgatcgatcgagccatccaggatttactagtcaatcaacaactttatatatcatgcagctgatgcatccacacatctagataacgagctagatagctagctagggatcgagaaggagagagaatatatacatactgcatatatatatgcacattgatcgagcaactaatccagacagggatcgacaagagaacaaaagttcattcatgtctcctagctagctactcttatctgctacctatcgagattcatctttggatttctacaaggattttgatcacatcatacactgattttaacccaaccaaccacgactgatcaaaccaaggcaagcagaggcaggctctcaaatatatagatagatagcgatcgatcgatcgaaatggatggatctagtatgagcagcagcagcacgcagcagcaggcgcaggttcctcctggatttcgtttccacccgacggacgaagagctggtggattactacttcggaagaaggtggccgcaagaaggattgatctcaatgtcatcaaggacgtcgatctctacaagattgagccatgggatctgcaagagcgttgccggatcaatggcgggtcggcggcggaggagcagaacgaatggtacttcttcagccacaaggacaagaagtacccgacggggacgaggaccaaccgtgcgacggcggccgggttctggaaggcgacggggcgagacaagcccatctacgccaccaagcagcacagcctcctcgtgggcatgaggaagacgctcgtctactaccgcggccgcgcccccaacggccacaagtccgactggatcatgcacgagtaccgcctcgagaccaccgagacggccccgccgcaggaagaagggtgggtggtatgccgggtgttcaagaagagattacccacaacaagaagagattcagaccatgacgcaccttgcggcagctggtacgttgatgaagatgcaccgggcgccttcatgtctccgatgatgatcaccagatcatcaatattgcgcccacaccaacaccacgccggcatcacgctgcaagagcaacacctccacaccacttacaagcacagagacctcactactaagattcagcagctccaagtccctgcggcaggccatcatctcctcaacaccatgccccatgacctggagagttctacttcctccttccattctcttttggtctcacctgatcaccaccaaatcaacatgcaccatgctcaggctgatcccttctttgacgacatgcatgcagtcgatcaagccactaccactgactggagagttcttgacaagtttgttgcctctcagcttagcaatgatgctacaaacaagcctgcggatcattatactgatgaaggagacattcttcaggtcagtgacaagcagtaagaggtggcagccgccgattatgcgtccacatcaacgtcaagcagccaaattgatccatggaagtgatcgatccatgcatgatcgatgccctgcacgcatttaatcaagatatattatatcttatagataaaattatctcaataatgattatgatcgtatcgtatcaattggacagatcgatacaagtggtttgagctacatattaatgccgtgtaaataagactactctagctagtacaacgtgtggtgtttgtgtgctgcttatatatatattgaccttcgtacgtgtgtttctatatgaaataaggtcatggaggacaaattaaaagcttcatgaatataatcgtggtttgtaatagataaacctcttctgctatgtgattgtaaacttctggtgtttcaacatatgtaacaagtacgccaatatgc

SEQ ID NO: 5374 - DNA, 1101 bp, Oryza sativa
  Predicted polypeptide sequence is orthologous to G522
atggaatcatgcgtccctcctgggttcaggttccaccccaccgacgaggagctcgtcggctactacctccgcaagaaggtcgcctcccagaagatcgacctcgacgtcatccgcgacatcgatctctaccgcatcgaaccctgggatctccaagaacattgtgggatcgggtacgatgagcaaagcgagtggtacttcttcagctacaaggacaggaagtacccgacggggacgaggacgaacagggcgacaatggcggggttctggaaggcgacggggagggacaaggcggtgcacgacaagagcaggctcatcggcatgaggaagacactcgtcttctataagggcagggcgcctaatggccagaagaccgactggatcatgcacgagtaccgcctcgagaccgacgagaacgcgccgccacaggaagaaggatgggtggtgtgccgagcattcaagaagaggacggcgtatccggcgaggagcatggtggagacgtgggactactccttgcacgagcgcaacatcatgagcgccgcggcggcggcggcgttcgccgatccgagcgcggcgtacgcgcagatgaggcggcagcacaggagcgggcggttcaagcaggaggcggagctggacggcgccgccacagccctcctccactactccagccacctcgccgagctgccgcagctcgagagcccctccgcggctgcggcgccgctccagcccaacccgagccagctggccaccgccggcgaggacgacgactgcaagggcgataatggcggtaggagggccaagaaagcccgcgccgccggcgacaaggtggcgacgaccacggactggagagcgctcgacaagttcgtcgcgtcgcagcttagccccggggagtgtggcagcatggaggcaacggcggaagccgcggcggcggcagtcgccggtgtgagctcgccgctggaccacggcgatgacgacatggcagcattgctgtttctcaacagcgacgagagagacgaggtcgacaggtggacggggttgctcggctccggcgccggcgcgagcggcgtcgacggcgacctcggaatctgtgtgtttgacaaatga

SEQ ID NO: 5375 - DNA, 495 bp, Oryza sativa
  Predicted polypeptide sequence is orthologous to G522
atggagtcatgtgtgcctcctgggtttaggttccaccccaccgacgaggagctcgtcggctactacctccggaagaaggtggcctcgcagaagatcgacctcgacgtcatccgcgacgtcgacctctaccgcatcgagccatgggatctccaagagcattgcaggatagggtacgaggagcagagcgagtggtacttcttcagctacaaggacaggaagtacccgacggggacgaggacgaacagggcgacgatgacggggttctggaaggcgacggggagggacaaggcggtgcgtgagaggagcaggctcatcgggatgaggaagacgctcgtcttctacaagggcagggcacccaacggccacaagaccgactggatcgtccacgagtaccgcctcgagtccgacgagaacgccccgcctcaggcaagatctccatttatctctctctcaatcaacaagatcgatctacagtttctagaaaagattaattag

SEQ ID NO: 5376 - DNA, 1308 bp, Oryza sativa
  Predicted polypeptide sequence is orthologous to G525
ccttaaccacttcatcacttctctcgtcgatctagtctaaaaggtttagtagatgcgattagccaggcagcagcagcaggtggtggtggctgcgacgatggagcatgacgtgcaccaccaccggcagatgatgcagcagcagcagcagcaggagatggacctgccgccgggcttccggttccaccccaccgacgaggagctcatcacgcactacctcctccgcaaggccgccgaccccgccgggttcgccgcgcgcgccgtcggagaggccgacctcaacaagtgcgagccatgggacctgccatcgagggcgacgatgggggagaaggagtggtacttcttctgcgtgaaggaccggaagtacccgacggggctgaggacgaacagggcgacggagtccgggtactggaaggcgacggggaaggaccgggagatcttcagggggaaggccctcgtcggcatgaagaagacgctcgtcttctacaccgggagggccccccgcggcggcaagaccggatgggtcatgcacgggtaccgcatccacggcaagcacgccgccgccaattccaaggatcaggagtgggtgctgtgcagggtgttcaagaagagcctcgagctggcgccggcggcggcggcggcggtcggcaggagaggcgcgggcgcggggacggacgttgggccgtcgtcgatgcccatggcggacgacgtcgtcggcctcgccccgtgcgcgctcccgccagcgcacgtgacctgcttctccaacgcgctggagggccagttcctggacacaccgtacctcctccccgccgccgatcccgcggatcacctcgccatgtcctccgcctcgccgttcttggaggccctgcagatgcagtacgtccaggacgccgccgccgccggaggagcgggcatggtgcacgagctgctcatgggcggcggctggtattgcaacaagggcgagagggagaggctgagcggcgcctcgcaggacaccggcctcacgtcgtcggaggtgaaccccggcgagatctcgtcgtcgtcgcggcagcaacgcatggatcatcacgacgcgtccctctgggcctattgaaatattcattcatcatcattgaaaattgcattagccattattattagtactgttggccaccgattattgattgtgttgtaatattggtattgttgattataattaattagtacgccaaagagacaaatcacaagagaacgaagtgtgtatgctgtagattaattccgtatgtttgtgaaaatattcttgaacccaagtgaatgttactagtgcttttc

SEQ ID NO: 5377 - DNA, 1548 bp, Oryza sativa
  Predicted polypeptide sequence is orthologous to G525
gatatacaacgatttcctcttgtcaccctgaatctacttctgctgcaaaagcaataagcaaggagcagttagccaggtaaagctctagctagctagcttaggcagcaatggagcagcatcagggccaggcaggcatggacttgccccctggcttccgcttccacccgaccgacgaggagctgatcacgcactacctcgccaagaaggtcgccgacgcccgcttcgccgccctcgccgtcgccgaggccgacctcaacaagtgcgagccctgggacctgccatctctggcgaagatgggggagaaggagtggtacttcttctgcctcaaggacaggaagtacccgacggggctgaggacgaacagggcgacggagtccgggtactggaaggccacggggaaggacaaggacatcttcagacggaaggccctcgtcggcatgaagaagacgctcgttttctacacggggcgcgctcccaagggggagaagtctggctgggtcatgcacgagtaccgcctccacggcaagctccacgccgccgccctcggcttcctccacggcaagcccgcgtcgtccaaggtacacgaacgcacgtacgccgcgtgcgtgtgtttggttgtgaccagtttgatcgatcgatcgatcgatcgattgagcaggccggactgacacgccgtgggtttttcttgttggtgcgtagaacgagtgggtgttgtgcagggtgttcaagaagagcctcgtggaggtgggcgcggcgggagggaagaaggcggccgtggtgacgatggagatggcgaggggagggtcgacgtcgtcgtccgtggcggacgagatcgccatgtcgtccgtcgtcctccctccgctgatggacatgtccggagccggcgccggcgccgtcgacccggcgacgacggcgcacgtgacctgcttctccaacgcgctggagggccagttctttaacccgacggcagtacacgggcacggcggcggcgactcctcgccgttcatggcgagcttcacgcagtacgggcagctgcaccacggcgtgagcctggtgcaactcctggagagctgcaacggctacggcggcctcgtcgacatggcagcgtccggcagccagctgcagccggcggcgtgcggcggcgagcgggagaggcttagcgcgtcgcaggacaccggcctcacctccgacgtgaacccggagatctcgtcatcctccggccaaaaattcgaccacgaggccgcgctatggggctactaaggtttgatatgatcagcgccgtgtacgttaatcgcgggcgattagcgaagtagcgattactgtaaataaaaccatgagatcgcgatcgaggcatctaccaaggttcgcttaatttgcttgtacctataggtgtagattatttggtgatttgggagatgtaattagcattgtttgtttgtaattcgtatcagaatgatcgatgcagtattgtttggagggttagttaagcaattggccactcctcagttgccagttaattagttagagttgcttaatttagctctttct

SEQ ID NO: 5378 - DNA, 1229 bp, Oryza sativa
  Predicted polypeptide sequence is orthologous to G525
ctggtagagtggtaattgctcgcgcgcattctgcatgcatgagcgcgcgcggcggtgtcacgatggcaggaggcggaggcggcgaccgcgcgccgtcgtcgtcgtcgacggcgatgatctcgcgactcctgccgccgggcttccggttccggccgaccgacggggagctcgtcgcccactacctcgcccggaaggcggccgacgccggcttcacctccgccgccatccgcgacgccgacctgtaccgcgccgagccctgggacctcctgccgccgccgcgttgtgatgcggcggaggaggaggaggaggaggaggaggagcggtgcggctacttcttctgcacggcggcggcggcggcggcggccgccccgtgggggtgaagaagacgctcgtgttctacagggggagggcgccgaggggcgagaagacgacagttgtcgcccgcagtgagtgggtgatttgcagggtgttcgtcaggaagacaccagatggtaacaacgataggggaactacagaacatcatcttccctcctacgacgctcatctccgttcgtcgccggcgccggcgaactctgtggacggcgcaggccatgcgagctgcagcttcttctccggtgctaatgagtccatggcgccaagcgaccatttcaacataggagacgacatgatcctccatggccacgacgaggaggagttgctgatgatgaactgttcttcggcttttgatctgccagagcttctcgactacgagagcttctcgctggacctttgatccaacgagcaatggcatgttctaaaatctaaagtatgatctggttacttctcttaatacaaaagatacataagtcttttgcgtattctccaaaaaaatctgaaggatgatgcagctagctagctagctagctagatcgatcaatcgagatatatatgaaggccataatttgatcattagatgcatatgcatcatccatgtctacttcttcagatcactagctacttaatatgtcccctctctgtaattaaacttgcacgtatctgtatatatatttgtactgtagtcattcatgtaatatacgttttgtgtttgcgtattttatacacgcctctatttcaggcgctcttagcatttcttttactttcttagattataaaaactagtgtgtggttgtgtgtttttgctgtgtacatcttacttatatagagagttaaataaaaactctactatcttt

SEQ ID NO: 5379 - DNA, 3528 bp, Oryza sativa
  Predicted polypeptide sequence is orthologous to G559
aagcgaaaaaccgagtttgtatactcgataaattaagaaaaagttgagcgcgccgtaccgcccgccgcagcgccgacgcgcacagactagggccggtgccactggtggtggctgtggggtggtcgtgggcggcggtctgcgcgtcggcactgtccggcacgtcttggccggtgcaggcgcggccgtcgaattggccgcagacaccgcctcagcaactgtcacaaccaacgagtcgaaacgcgccggcgccgctgtcgacgacggcgatggaacgctggagcgggtggtgcgcatcgcatgcgcgtgtctgtccaaattcacgcccgaaaagagccgcactgtggcggtgcagctcgtggagcgtgcgtttgggcacacacgcgcgaccgtgacgcgcgctaaattgcgtgcgattgccgcgctggtgctggacaaagccgtgactgaaccggcgtttgtggtgtgttatgcggactggactcacgcgctgtgtgagcagctgcgggcattgacgcccgccgataccgacgcggccgcagctgcagccgctgcggccggtggtgtgtcggtggctgacggtgacgcggatgcgcacgcgcgcgtgtgtaccacacccgacgccgcgtactgccaggcgctagccgacgccgtgcgtcagcggtttgacgacacgtttggtggcgctgctgtcgtgcagcatcctgctgcacccgcgctggcgtcagcggacggcgctgccgtaccgccacagtggcccgatctggtggtggtgcacgaattggagtcactgctcacccgcgagcgcgacgccgacgacgcgtttgtgcggccgcgcgaacgcgacgacgaacggcggcggtctgtggccgaccgggagtgccgtcgcgccgccgcactgtgtcacttcattgccgcgctcttggacgttcgcggcatcggcagcggcgacggctcctgtggtggtggtgagcagcatgaggctgctgcgggcggcgtcatcgcatggccgtggatgacgcatgtcattggcgtactgtgcggtccgcaggcaccaccgcgggcgcacacgtcagcgtgtggcgcagcgtatggtcggcctgggcggcgaccgaacaacggcgcacgctaccggccgctctggagcgtttgggcgctgccgtcgatgcggcggtcggtcacctgcgcgtgtggtgtggcgaaccatccgccgatgcggttgccaaaggcagtgcgcgacgggccgctatgcgccaacgcctgacaccggacgtttgtgaggctgtcgacgcgctatgcgcgttggctgcacagcgctgggcggtaccatcagctgcctcagcgggcacgggcccgcaccggcaatcggccgcagtgcgcagactcgtcgcggcgcacgcacaggctcgcgcacacgcggtgcgctgtctcgcgtctgcggttgcggctgcggggcacagcgcgccggtacgagcagttgttgcggcggcagcggcagcagccggtccggctgcatgtgctctcagcgcagtggctgctgcggccgcacccgcaaccgacgccgtgatcgctgccacgtcgccggcgtcaccaccgctgcgcccacagcgcgtcatgtcagccgcggcgccgcctgcgcgtcggcagccgcaacacagcgacagcggcggtaacgaaggcgttggtcactttaaggcgacgcgtcggctcaatgcaagcgcccgcgtgtttgtgccgcgcactgccgtcactttaggcgctgcgactgcttcaccgccgccgctcctccctgccggcgccgtggccgcggcaggagccgtggcagccgctgctgtcggcccgccgccgtccgcagtggcgctgcctgcgcgggagcagcggcagcaaccgcaacaccaacacccgcaatatcgcggcgacaccgatgcggacgcggaggagacgaaggaaacggcggcgcgtgcacagtggcgacggcacgtgtccgcacttatcggcaaactcacggcggagacatgcgagcgcttggccctgcggtttgttgcggactcaccgggcagtttcggggcggacgtaccggaacgcgtgcagcgcgtgcgcatggccgatgccgtggcccttatcgtgtactatgcgcagagcgagtacatgtacacgccgatgtacgcagcatttatggcgcacgtgcgcgatgcgtttgcccaagccgatgtagcactggcggcggcggactccgctgctgctactgctgttcccacagcccctcccggtggtgccgctccggacggcaacagacaccacaagcccgcacggctgcccgcagtactgccgtgggatcgtgcacgggcgtggtttgcgaccgtgagcgagtgtgtgacgggcgaagtgaacgacttttttggtgccgacgcctttctgtgcactccaacgctggccgacctgcagccgcacaccaccaacagcagcagcagcagcagcagcagcagcaacaacaacaacaacaacaacaacaacaacaacaacaacaacaacaacaacaacaacaacaacaacaacaacaacaacagcagaagtgcgtatggcattccgctcgacagcgatcacgctgcggcggctgtcgtcgccgacgcagccggtgccagtgccggtgacggtatcggtttgccgatcgcctgcggtcattacgtgataccactcggcgggtggtgtgcagcggcgaacacagcggcgcgcgaacacgcctccggtgacgcctgtggtgcgtgggagctggtgccggagatggaggccgtcaaagtgctcgaagacctgctttcgtccgacggtgagcatcccgcgcctctgcacgctgcgtcgatggtcgctgctgagcgcgaacggcgccaacagctcatgacacgcgtacggcggcgcatacacgggtgtgtggcgttggtgtgcgaactgcacgcacggcacatggcgcggcgccgtgtgctgctgaccgtactgtggggtttgcgtggtgtggcgttggggaccggtaccggcgtagcggcaccgccgttttggtatggccatgcgccggtgctgccgcccacgtgggcgctggagatgctgtgccgtgcgctgagcggccgtctcggagccgcactgatgccgccatcacagccgccaccacagtcgccaccggcatcaccggcatcggcagcgccgtcgccagcactggcaccggcggtcagccgcgccggagagcgcgcgttagcgcttgcgctcagcgaactccacgcactgagcgtgcgcaaggatttgctgccgagtgcgcgcgcacgcttcctggtactcgacacactcgacgatgccgcacatcactgggagccaaattggcgcgcgcgggaacggcgcacgcgctaccaacagcagccgcagcagcacccgcagcagcaggcgtcaggggttggtgccgcagcgccgttgacatcgtagcagttcagtgttgtctgtgttttcagtctcatttgccgtcggcagtctgagatgtgccattggtct

SEQ ID NO: 5380 - DNA, 1805 bp, Oryza sativa
  Predicted polypeptide sequence is orthologous to G559
gactccgattcctcttctttcgcccaaattttggctcaacatttcgcagcgcaatctcgagctgaatcttggggggtaaagctttgcttcttggaatcttggtgcggtttttgggggagatttgcgagcgtttggagccgagaagatgaacagggagaaatccccgatcccgggagacggcggcgacgggttgccgccgcaggccacccgccgggcgggccctccggcggcggcggcggcggcggagtacgacatcagccgcatgccggatttcccgacgaggaaccccggccacaggcgcgcccactccgagatcctgagcctccccgaggacctcgacctgtgcgcggccggcggcggcgacgggccgtcgctgtcggacgagaacgacgaggagctcttctccatgttcctcgacgtggagaagctgaacagcacgtgcggggcgtcgtcggaggcggaggcggagtcgtcgtccgccggcgccgcggcggcggtggcggcggcggccgccgccgccgcccatggagcgaggccgaagcaccagcacagcctgtccatggatgagtcgatgtcgatcaaggctgaggagctcgtcggggcgtcgcccgggacggaggggatgtcgtcggcggaggccaagaaggccgtgtccgcggccaagctcgccgagcttgctctcgtcgatcccaagagggcgaaaaggatttgggctaacagacatctgcggcaagatcaaaggaaaggaaaatgcgatatattgctgaacttgagcgcaaggtgcaaaccctgcaaacagaagcaacaacactgtcagcccagttggcactgctacagagagataccagtgggctaactactgagaatagtgaactgaagctacgtctgcagaccatggagcagcaagtccacttgcaagatgctttgaatgacaccctgaagtctgaggttcagcggcttaaggttgcaaccggtcaaatggcgaatggtggagggatgatgatgaacttcggtggcatgccacaccaattcggaggcaaccagcagatgttccagaacaaccaggccatgcaatctatgctggcagcacaccagctgcaacagctccagcttcatcctcaggctcagcagcagcaggtgctgcaccctcagcatcagcagcagcagccattgcaccctctacaagcgcagcagctccagcaggcggcacgagacctcaagatgaaatcgccgatgggcggccagagccagtggggagatggcaagtcaggaagcagcggcaactgatgcgtcatttacaaatttacaaaaaaattccccaaagtttcggtgtaaggttgtggtttaacaaccatggagatggtctgtttcattgagatgatgatgatgtgcaagagtagttatcatcatcatcatcggtaggttcaggttggcttcagcttcagtcatacagttgggtggatgttcagttgaagagtttatctgtagctggttcagtaaggaaatggtcgaataatcaagaattccaggttaaaatctttcgtttctttggtaaggtagcacatcaccaagatgtactgttgtagtgttgtctacagttccataaattcaagtagccagtatacgctgttgtttagtttttctccggttttttagaggtagaggcgtttctagtgttaatcgagaggtatactgtataccttctgattaacatgtaaatcactcaacacctctacctccataaggaccggagaaaaactcaattgtttaattaagatgccattcatgactagatgttctctgtc

SEQ ID NO: 5381 - DNA, 1879 bp, Oryza sativa
  Predicted polypeptide sequence is orthologous to G559
cagactctccagacagaagcaactacactatcagcacagttgtccatgttacaggtactttattttggctttaccttatctcatactttgtgcatccatgatttagacactctacaccaatgtttagcagttggttctactctactagacaaatgcctcagccccatgaaaatgtttatttaggtacatgcctatgcttttaacttggcattttttacctggcaggcttcctattatctgtgttagtataaggttactaaacttgtaggttattctaaatttcatgctggttgtatatcaagtgaagctatttgacaaagtgctgcactgctgcttgttctggaaattccgacaacccatacctaggggtggtaatgggcccatcattttgacctacaaaatgtgagggttgggtccaaaaaggtttgggctgaaatttagaatttttttgtgctaaaaatatttaagggttgagatgggttgtgaaaggacccacaggccaccccgaccctgtttcctctatctgagcagtaaccatttatggtagttaggatgttaacatctgatttattttttccagctgcaaatacaccttttgtatcctacaggttgatactgttaacatattgcagattatgtagtttttgaaggaacttacttttcagttttccacgagtctatccttgattatctctacctgaataatacagagagataccactggtttaacaagtgaaaatagtgatttgaaaatacgggtgcaaacaatggagcaacaagtcaggctgcaggatggtaaggttttcatatcatcgcagtaattctaatcgaattgccatatattttgagaaaaaaaaatgaagtgtcttcatgacacactaatttatagtatatataactggaaattacttgagcctattaagtattgttttcttttctctttattctcttgcgtcttcgttggaataatatagtgtgatattatcttcaattttctcctgatattttctttttcatcacctagtgatcgaagtgatattattgttttctctaccccttttgctgagttattaaccttttgtctatggtagagacgtaacaaaaaatcatataacaagatataagttgtatgaagaaagtaagcattagttaatgcaaattatgacttaggatatcatctttgataggcttcagatcatttattactattttgtaggtgtcacaaaaactctcctacagtgtttttccaatcatctttaggattgtaactgttccttgtttgcatgtagcactaaatgacaggctaagagatgagattcagcagctaaaggttgcaacaggtcaggttaatgccaactgcggcaaagtgggaaactttggcctctcctcatttggaggcgccaatccacaaggttaccagcgcagtcacatacaatctcttctggcagcccagcagctgcagcagctacagatccactcccagcaccagcagcaacagatgcatctgcagcagcatcatcatcttagcacggtccaacagcagcttctgcaggaggggttgcccttgccaggggatctgaagatgaaaggaattgtggcggcatcccatgcacagaacgccggcgcatctgaaagccacgctctgaggagtgagccgtgagttggcataggctcatggcggttgtcagtaataataacatgttgtatctgagtgactcatgcataggctagcgcagtatctaggtaaaatttcagactatctatgaagcacttagatgcctgcagcctgtagaatgtagatcccattcagttgtaagttgtagaactgatgaggcaaaactgagtaattcaccggtgccatggagtatgttcacgtcat

SEQ ID NO: 5382 - DNA, 516 bp, Oryza sativa
  Predicted polypeptide sequence is orthologous to G559
atgccggactcgccgccgcggcgggcggcgaggcaccgacgtgcgcagtcggagatcgtcctcgggacggacgacattgcctccgacgccgacctcggcgtgttcttatttggatatgaaagtaaaaatgatgagaggtttatatgtatgattttcatgttatcgttatataagtgtgagactaatgtttactcgagtcatatcttatttagtctaatttacattaagaacagggagatcatgaagagccgccagagccacaaccggtcagaccgagcctgtcagggttatggataccacatacctaatagtagttgcctaaatctcggcagaacccactacataccatgtcctatacggaagcaaccttcggacataggaggagttccggataaggaaagacaaccaaagttctacatggaaacgacaagtactactcggattgtatccatattggtttccctagttctacttggacaaggggacacctatgggtataaatacaagctcccctag

SEQ ID NO: 5383 - DNA, 406 bp, Oryza sativa
  Predicted polypeptide sequence is orthologous to G559
cacgcaatttttaataacaattcaacagattatttgtcaccaagtggtgaaactggtgccaatttgaatggaggtaacgtcgaagaatgtccatcattgaacattgatgattctacaggtgcagcatcaccagcaggagaaccagaaccagcagcgttagaatcaacagcagtagaactagcagaaccaggaccaacagcagttcaaacagtactcgataaaaaagatgaaggcggcaatgttcaagctgattcaaagtttgtcaatcgtgcaacgggcacaaatggtcatgaagcaacttctcgtagtgataatcactatgaccaatgaacttcttcgtttttgtttgttttaatttattctcgcataatatccagaataaaaacaaaaaaagcttcgtagtttg

SEQ ID NO: 5384 - DNA, 1548 bp, Oryza sativa
  Predicted polypeptide sequence is orthologous to G562
agcgcgcctcagcctcagtacccaccacctccacgctcgcgccgtcggcttcgtgctcctgcgccgccgcaccgatctgcaccgtacgcgggcgtcgatccatccaaggaactcataaaaagtcatgggaaatgacgaagctgtagttactcagaagatggggaaagcaccatcgccccctaaggatcatccagcccttagtccataccttgattggtcaaatatgcaggcatattacggcccagggatcttgccaccaacattttttagccctggaatagccgctggtcatacccctcctccatttatcttgggtcctcagcctctggtgccatccgcttttgggaagccatatgccgcaatttatcctcctggtggagctttttcacatccgttcatgcccctaatggtgagcccattgagcatggagccagcaaagtctgtcaacagcaaggatagctgttcaaataagaaaatgaaggaaattgatggtgcgactgtgtcaactggcagtggcaacagtgaaaaaacaagtggagattgcagcttagaaggatccagtgatggaaacaaccagaaggcaagtggaactcccaagaaaaggagcatagatgataggcctaaatcaggcgtggaaactggtggagctttaacacctaatgatagacctagcgaacaagcagctttgccaaatctatgcattccggttacagcaatcaaaccagacgtgagcactgctagtgacttcagagttattgccaccccagtaactgaagtgccaactaaggatgataaggaatcgaagcgcgagagaaggaagcaatcaaacagggagtctgctcggaggtcaaggttgaggaagcaggccgagactgaggaactggctagaaaagttgagctattgactgcggagaacacatcccttagacgtgaaataagcaggctaacggaaagctccaagaaacttagattagagaattctgctctaatggagaaactaacggaaaccgggcctgatgaagcacaagaagtgcctccagtcaaaacaaaagcacagcaagctcgaggcgtcgaaaatttcctgtcaatgatagacaagactggcacgccgagaagcagcgggcacatggatcatgccattgccacgcccaagcttcgtcaactcctgggctctggtctggcgactgatgctgtagccgcaaggtaatcttaacgacttgaccctcccgccgttcgtgctcaaacgcagcatgtggcctggtgaattttataagctcaacctgcccgcacgattaacatcgaagtattaggtacgattttgtcactgtattcgcccttgtaaattactagtagctgccttttagacgagcattccaaccgctccaccgggatatgaatgcccccctggccgtcagttcttccctgagtttttactctactctcgtagatctgtaacatcagtgctggctcgcgttgttcatatcaaactgatctctgtaaatactgtaacactgacagaaagccttctaactttgatcttttaccttt

SEQ ID NO: 5385 - DNA, 897 bp, Oryza sativa
  misc_feature (608)..(608): n is a, c, g, or t
  misc_feature (658)..(658): n is a, c, g, or t
  misc_feature (663)..(663): n is a, c, g, or t
  misc_feature (688)..(688): n is a, c, g, or t
  misc_feature (712)..(712): n is a, c, g, or t
  misc_feature (738)..(738): n is a, c, g, or t
  misc_feature (743)..(743): n is a, c, g, or t
  misc_feature (772)..(772): n is a, c, g, or t
  misc_feature (781)..(781): n is a, c, g, or t
  misc_feature (795)..(795): n is a, c, g, or t
  misc_feature (810)..(810): n is a, c, g, or t
  misc_feature (818)..(818): n is a, c, g, or t
  misc_feature (825)..(826): n is a, c, g, or t
  misc_feature (833)..(833): n is a, c, g, or t
  misc_feature (838)..(838): n is a, c, g, or t
  misc_feature (862)..(862): n is a, c, g, or t
  misc_feature (866)..(866): n is a, c, g, or t
  misc_feature (880)..(880): n is a, c, g, or t
  misc_feature (884)..(884): n is a, c, g, or t
  Predicted polypeptide sequence is orthologous to G562
gggatccccaaccgcgatgtgctagggtttggaggcccggtgttcaatcccatcttccctccgtgcagccgctaggatcagttttatcttctttctttctttctttccgtgtcattgttattagattagattctaagttccctgttgagattccttgctgctcatgggggcctgccgaaaactacctcacctgattacgttttgtttttggttttagccccttattttttttatatgcagatagcgctcgccggaaattccaagcagtatatagaattatagatcgccgacatgtgtaggcgtttcttgtttcaggaattctcgtccgtgctgtccagatcgatgcctaatcgtcctacctccgctgaaggaggaggcgtttctgctatcaacaatgtttttaatggagctctccgtcgttttagcacggtgattcccaataaccatggccttcctttttctcaagcaaagtgcctgaattctattcaaagccctaacgcagctaccaaagcaaaccacccaacaattggtgtgggttccttttgccagcccggactttcttctcttatacaaaaccctaccacctgccttctctgggtgaaaccaantacctggattatgcagcagcagactttaaagcgtaagtctgagtactagncctgnatcaggttactttcctggtacttgnaatgatggttaattggtggcttanccccgaatcttggtctgctatagatnaaccnaaattcagcttattaatttgggccttttntttattggngggatgcatttganagcatatattggcantggaggtncccgttnnatctggntacangggaccggctggttaaggagttancggnccaaaagaagaatngganttttttgggttgg

SEQ ID NO: 5386 - DNA, 1853 bp, Oryza sativa
  Predicted polypeptide sequence is orthologous to G562
gggagatcaatctgctttcacgtctcctctctctctccgcgtgcttcctccgagggtctcctcctccaccgccgtctcgcttcccggcacgcgcgcgcgggcggcggcgagctccctctccttcgccactcctccaacccctgtgcggctactccggtgcggagccggcgagcgagcatgttctaagtggctctcttccttaaatctctctacaagaggcaattgaattgaagacagcaggctttcataaaaggcatggctcatgatgaagctgttgctacacaaaagattgggaaaacaacctcccctcctaaggatcaaccaactccatgtccatttcctgattggtccgctgttcaggcatattatggccctggtgtcttaccaccgacatattttgccccagcaatagcttcaggccatgctcctccaccatatatgtggggtcctcagcctataatgccacccccttttgggaccccgtatgctgcaatgtacccacacggtggagcttatccacaccctcttatgcccatgatggcaaatccattgagcatggaaccagccaagtctgcaagcagtaaggaaaaaggctacaacaagaaacttaaggaagttgatggggctgcagtatccactgggagtggtgacagtaaaaaaacaatgacgtctagtggggattacagtgcagaaggctctagtgatgtaaatgatctaaaggtgggcaagactggcaggaaacggagattggatgatggagctggtgctgaaacatcagcagctgcaaagatggaaaatgctttacctcccagccatatattgggaagtactgcgattttgccaaatcacagctttccagctcaagtaattaggcccagtgctactaatgttgctaattcgagggcattgggcacaccaatatctccaccgcctggtgtgattgttccaagtcatacaggagtatcaacagaattactgatcaaggatgaaagggaattaaagcgtgaaaagaggaaacaatcaaatagggaatccgccagacgatcaaggctgagaaagcaggctgaaacggaggatctggctacacaagtagaatcacttacagcagagaacacgtcacttagatctgaaatcagtaggctatcagaaagctccgagaagctcaggctggagaattcggctctaatggggaagcttaaggatcctgcagcatcgacccaggcagaaacatctctgcagaaaaccaccacagcctcctctcctcgcgtcgtggagaactttttgtcaatgatcgacaacacgaacaagacgagtgtcagacacacagagcatgctgaacccaagcttcgacaactcctcggctccggcccggccactgatgttgttgctgcaagctaatctgccattttccctgtcacagaggagagactacgcgcatgcggcctggggattttgcaagctcacgctactactcacataacattcggcagtacagtgttaggtgtcaatttggtcagtatattcaggtgaccatctactactcaaaataccgtttccaattgctgttccctgctcaggcatggaagcttgctaggtgagaccaatgtaccacgttttagcagtgttgtaacataggggtgttgtgctgcatgccaacctcaaaccttgtgagatcgctaaacactttttagaattgaaatttgtggagaccaaactaaatgaaatgtaacctaccctttttacttgggtatatgggcccatattctttacatggcttggaactgtaactttgtaagatgtttttagtcaaacttctttaaaatttatatttataacactaaattagtttcatt

SEQ ID NO: 5387 - DNA, 1102 bp, Oryza sativa
  Predicted polypeptide sequence is orthologous to G591, G793
atgagggccctgcaggacttggtccccaacacaaacaagacagacagggcagctatgctagacgaaatccttgattatgtgaagtttcttcggcttcaagtaaaggttctgagtatgagcaggctgggtggtgctggtgcagttgcgcagctggttgctgatattccaatctcagttaagggggaggcaagtgacagtgggagcaaacaacagatttgggaaaagtggtcaaccgatggcacagaaaagcaggtagcgaagctgatggaagaagacatcggagcagcaatgcaattcctccaatccaaagcactatgcatgatgccaatctctcttgcgatggcgatctatgacacacagcattcgcaggacggacactcagtgaagcctgaacccaacactccttcatagtatagtaacaataacactagcatgcacacctactactactaggcgtcgacctatccaaagtgtaggatatactggacattttgatttgctaactggaaaaggcctaaggatcctctcctcaaagtagtacccatggtatatgatgtcgtctcctcttttcttcttttcttcaaaggtgctttgattgcaaagatatggtaagcgatgttctcatgctcctacatctttcaatgcccctatcgagtgtgagtgatgggtagagctaccaaagagtctggcatgcgctcatatcatttccttttgggtctgtagtgcactagccatacactttgtggtggggtcggtcagtcttttggtagtggacgtttggactaatgaaaagaagctgatgtatgtgtgttaagtctgcacaaatggttgacacaatttaaaagaatgttcagatggaagatgatgttgacggtgaatggtggtgctatttcttgtctatttttccaaagcggcaacggatgttttagtcaatggaggcgaagcgtgtattaatctggttgctagtgggagcgtgctccttatgtgctttacttttctgtctgcaagtcatagtcttgataagaacctgccctcttaaagtttttagcctcttgtattattggttcactcatgaaactatatatatcatctgtgctgactt

SEQ ID NO: 5388 - DNA, 1636 bp, Oryza sativa
  Predicted polypeptide sequence is orthologous to G591, G793
atggccgggcagcagccgcagcagcagggcccaccggaggacgactttttcgaccagttcttctccctgaccagctccttccctggcgccgcgccgggcggccgcgccgccggtgaccagcccttctccctcgcgctcagcctcgacgccgccgcggcggccgaggcgtccgggagcgggaagaggctcggggtcggcgatgacgccgagggtggcggcagcaaggcggatcgggagaccgtgcagctcaccggactcttcccgccggtgttcggcggcggcggcgtgcagccgccgaacctccgccccaccccgcctacccaggtgttccacccgcagcagtcgaagcagggcggagcagccgtcgggccgcagccgccggcgccgaggccgaaggtgcgagcgcggcgtgggcaggcgaccgacccccacagcatcgcggagaggctaagaagagagagaatagcagaaaggatgagggccctacaggaattggtccccaatacaaacaagacagatagggcagctatgctagatgagatccttgattatgtgaaattcctgaggctgcaagtaaaggttttaagcatgagcaggctgggtggcgcgggtgctgttgcacagctggttgctgatattccactttcagttaagggggaagcaagcgatagtgggggcaaccaacagatttgggaaaagtggtcaacggatggcacagaaagacaggtagcgaagctgatggaagaagacatcggggcagcgatgcaatttctccaatccaaagcactctgcatgatgccaatctcgctcgccatggcaatctatgacacacaacaaacacaggatggacaaccagtgaagcacgaacccaacactccttcctagtatagtaatagcaactgtaagtctgtaacatgaatcgttacaacccctagtagacatcaacctatcaaagtgtaagataaaacagctcgttttgattcactaacaaggaggcaggaaaagacctaagagatcctctccacttgaagttgtaccaatggtatatgatgtcacctttcgttatcatcttttgttcaaaggtgctttgattgcaaggatatggtaagcaatagcctgctcatcctcctacacctttcaatgcccctatgagcgcgggtgattgagagagctactaaagagtctggcatgctctcacattgtctcttttcgagtctgtagtgcaccaaccatacactttgtggtggggactgcttttttggtagtgggtgtttggactaatcaaaagggattgatgtatgcctgtgtctgcagcctgcacaatggttgacggaatttgaacacaagatgaaatggaagatgattttgatggtgatgttcatttatctccatttttccaaagtggaggcggaggctttggtcaatggaggctgagcgtgcgctaagctgatcgctagtgggtctgctatctacatctacatgcactactgttgtatctattgtgacatactcttgataagaaactgcggtataaagtttaatctttctattggcgattaatccatagaattactttgtattttctgccatgagttctcaactacccacattatttgtgaagaacagctgttcttgt

SEQ ID NO: 5389 - DNA, 1234 bp, Oryza sativa
  Predicted polypeptide sequence is orthologous to G598
gcaccacctcagctcgccagcagcaaccacggcggcgcttcggatgcacggcggcggagcctccacgacgaccaccgccatcgccgccgcgcgggtagcacatgttgcatgagcagcacgcgccgccgccgcagccggagccggaggtttcgctacagctgtcggcgcccgccaccgccgccgacgatgtcgctgcaggcgacgacgaggaggtcaccgtcgtcaccacgtaccgcgacatccaccctctgacgccgccgtcgccgacgacgacgacgacgccacccacgcggctcgggtccgccgcgtactcgtgggacacggccagcagccaccggtccgtgtcgtccgaggagcagttcatgacgatgagccgggagttcacggccatggtcgccgccgggacgaccatgcagactggccccaacgacggcaacaacggcggtgaccagctcaccagcatcggcgaggacgagctggaggagaccaacccgctggcaattgtgccggacagccacccgatcgccacgccggccaggagcagggcgtcccagctggaggttgtccccgcggcagggccatcgccggcgccgccggtggaggcgaggcaggtgaagaaggaggaggtggagacgaaggtgtcggcgtggcagacggcggaggtggccaagatcaacaaccggttcaagagggaggaggttgtcatcaacgggtgggagaccgagcaggtcgagaaagcatccgcatggctcaagaagatcgagagaaagctggacgagcagcgcgccaaggcgctggagaggacgcagaacgacatcgcgaaggcgcggcgcaaggcggaggagaagagggcgtcggcggaggcgaagagaggcctcaagctcgccaaggtgctcgagctcgccaacttcatgaaggctgttgggagggtgcctaccaagcgatccttcttctagcttcctgcagccagcctctgcaaaccttcgatcttgatcgatctgctgctgctctgtttctttcagtgccttttgtgtgctggattaatctagctgccgttcttcgtgtgatgtttgcttagctgtgcgcatccgagaacctaattgtaaaaaagattttaaaacaagttgtatatttgctgttgctgctgttgccctctgctgcttgtgatcacagagtggcccttgtttttcccctggcttgtattatccatacggcataaatggtttgtttgctc

SEQ ID NO: 5390 - DNA, 982 bp, Oryza sativa
  Predicted polypeptide sequence is orthologous to G598
ggcttccactcttctcctccacctccaagtactccgcatccatccatggccaccaccgccctctgatccgatcgatactgatcagccagtagctatgctgggttcggaccagctcgagcaccgcccggcgccgtcggctccccgcgccgagccggacgatgtcgccgacgacgtggaggtggaggcgttccgggacatccacccggagccgtcgcctccgcatctaccgccgccgccgctcaggcagccgtcgtgggacgccgcgagccaccgctcgctgtcgtcctccggcgcgggcggcggcggcgacgtcgagctgttcgccaccatgagccgcgagttcaccgccatggtggcggccgggtcgtcgtccgcgcccagccccgacgttcccggcgacgcccccgccgccgccgacctgaacctgctgcagctggcgcgcatcggcgagaacgagccggcggccgaggcgaacgcgctcgccatcgtgccggcggcggcgggcagcggcccgccggcgccggtggagcaggtgaagaaggaggaggtggaggcgaaggtggcggcgtggcaggcggaggaggtggccaagatcaacaacaagttcaagcgcgaggaggtcgtcatcaatggctgggagagccagcaagtcgacaaggccaccgcctggctcgccaagatcgagaggaagctggaggaggagcgggcgaaggcgacggagaaggctcgcaacgaggcggcggcggcgcggcggaaggcggaggagcggcgggcgtcggcggaggcgcggcgcgggaggaagacggcagaggtgctcgaccgtgccaacttctgcaaggccgccggcagggtgccatccaagcgctccttcttctccttctaaagttctaaccaaagctagctagccttgctcaattatatcatctctagctagctaattatgattattacttgttttctacttaattgatcaatcaatttc

SEQ ID NO: 5391 - DNA, 1528 bp, Oryza sativa
  Predicted polypeptide sequence is orthologous to G598
gaccactcaccaccacagctcagctcggagaagcgaagaggaggaagaagagcaagacgccgatggttacgcgtgtgtgctagtggctgagcactagctgcggcggcggcggcgacggcgacgacgacctcacccacggcggcgacacatgttgagtgaacaaacggcggctagtggtagcagcagcagcagccgcggcgccgacgaccgggagattgtcatcagcaccggccgggagatcgtcgtcagaagcagcgggggtgaggagagggaggaggaggtggtggtggaggaggagctcgaggagccggagttcagggacatccacgcgctgagcccgccgccgacgccgacgccgagccagccgtcgtcgtcgtaccaccggcggaggagggagtcgtgggagtccgcggcggggagcaggcacacgtcgatccgctccgtggggagcgacaccgccccaagtgagctcttccctactatgagcagggagttctcggccatggtcgccgcagcagccaacgccaacgccgccgccgccgcagccgcgaacggcggcgactccagccgcgccggggtggacgacgcgctggggaggatcggggaggatgagctcgaggagacgaacccgctcgccatcgtcccggacagcaaccccatcccgtcccctcgccgcgcccacctcgcgctccccgcccccggcgacgtgtcgtcggcgggcggcggccacggcgacgaggtgtcggtggggcaggtggagaagtaggaggtggagtccaagatcgccgcgtggcagatcgccgaggtcgccaaggtcaacaaccgcttcaagcgcgaggaggtcgtcatcaatggctgggagggcgaccaggtcgagaaggccaacgcctggctcaagaagtacgagaggaagctggaggagaagagggccaaggcgatggagaaggcgcagaacgaggtggcgaaggcgcggcggaaggcggaggagaagcgggcgtcggcggaggcgaagaggggcaccaaggtggcgcgcgtgctggagctcgccaacttcatgagggccgtggggagggcgccatccaagcgctccttcttctgagcgaccgcgccaccctcttcccctcctcctcctcctctctgctttgctcgccgccgtcgccgtcgtcgtcgtcgccggcgccggcggctgatcgttcaccgcttcgcttcacacgcagggatcagtgctgtgatgtggttgctgtgtggaactctcgttttagtgttgtatccacatgtatgatgtactgtcatcatatcctctcttttttttctttttttcttgttctctttactttcttgtgcttgataagggtattgcaaagttgggagggacagacagaacaagtaaatagcataagttggatggtgctctgccccttatagcttatggtgagggggacaagagctgcctgtaatttgttttttgtcatcatcaaggattgtgtatgtcaatatgaacaagatatggagctacctgttttgtgtt

SEQ ID NO: 5392 - DNA, 982 bp, Oryza sativa
  Predicted polypeptide sequence is orthologous to G598
tgcttccactcttctcctccacctccaagaaccccgcatccatccatggccaccaccgccctctgatccgatcgatactgatcagccagtagctatgctgggttcggaccagctcgagcaccgcccggcgccgtcggctccccgcgccgagccggacgatgtcgccgacgacgtggaggtggaggcgttccgggacatccacccggagccgtcgcctccgcatctaccgccgccgccgctcaggcagccgtcgtgggacgccgcgagccaccgctcgctgtcgtcctccggcgcgggcggcggcggcgacgtcgagctgttcgccaccatgagccgcgagttcaccgccatggtggcggccgggtcgtcgtccgcgcccagccccgacgttcccggcgacgcccccgccgccgccgacctgaacctgctgcagctggcgcgcatcggcgagaacgagccggcggccgaggcgaacgcgctcgccatcgtgccggcggcggcgggcagcggcccgccggcgccggtggagcaggtgaagaaggaggaggtggaggcgaaggtggcggcgtggcaggcggaggaggtggccaagatcaacaacaagttcaagcgcgaggaggtcgtcatcaatggctgggagagccagcaagtcgacaaggccaccgcctggctcgccaagatcgagaggaagctggaggaggagcgggcgaaggcgacggagaaggctcgcaacgaggcggcggcggcgcggcggaaggcggaggagcggcgggcgtcggcggaggcgcggcgcgggaggaagacggcagaggtgctcgaccgtgccaacttctgcaaggccgccggcagggtgccatccaagcgctccttcttctccttctaaagttctaaccaaagctagctagccttgctcaattatatcatctctagctagctaattatgattattacttgttttctacttaattgatcaatcaatttc

SEQ ID NO: 5393 - DNA, 1287 bp, Oryza sativa
  Predicted polypeptide sequence is orthologous to G598
cgcaccacctcagctcgccagcagcaaccacggcggcgcttcggatgcacggcggcggagcctccacgacgaccaccgccatcgccgccgcgcgggtagcacatgttgcatgagcagcacgcgccgccgccgcagccggagccggaggtttcgctacagctgtcggcgcccgccaccgccgccgacgatgtcgctgcaggcgacgacgaggaggtcaccgtcgtcaccacgtaccgcgacatccaccctctgacgccgccgtcgccgacgacgacgacgacgccacccacgcggctcgggtccgccgcgtactcgtgggacacggccagcagccaccggtccgtgtcgtccgaggagcagttcatgacgatgagccgggagttcacggccatggtcgccgccgggacgaccatgcagactggccccaacgacggcaacaacggcggtgaccagctcaccagcatcggcgaggacgagctggaggagaccaacccgctggcaattgtgccggacagccacccgatcgccacgccggccaggagcagggcgtcccagctggaggttgtccccgcggcagggccatcgccggcgccgccggtggaggcgaggcaggtgaagaaggaggaggtggagacgaaggtgtcggcgtggcagacggcggaggtggccaagatcaacaaccggttcaagagggaggaggttgtcatcaacgggtgggagaccgagcaggtcgagaaagcatccgcatggctcaagaagatcgagagaaagctggacgagcagcgcgccaaggcgctggagaggacgcagaacgacatcgcgaaggcgcggcgcaaggcggaggagaagagggcgtcggcggaggcgaagagaggcctcaagctcgccaaggtgctcgagctcgccaacttcatgaaggctgttgggagggtgcctaccaagcgatccttcttctagcttcctgcagccagcctctgcaaaccttcgatcttgatcgatctgctgctgctctgtttctttcagtgccttttgtgtgctggattaatctagctgccgttcttcgtgtgatgtttgcttagctgtgcgcatccgagaacctaattgtaaaaaagattttaaaacaagttgtatatttgctgttgctgctgttgccctctgctgcttgtgatcacagagtggcccttgtttttcccctggcttgtattatccatacggcataaatggtttgtttgctcaaatcttgcaaacattcagttcgacactagtactagcacttcatttttcttc

SEQ ID NO: 5394 - DNA, 2023 bp, Oryza sativa
  Predicted polypeptide sequence is orthologous to G634
aatctcccttctgcatatacagcaccctcctccttgcctcctcttcgccattgtcctaattcccatctccttgtccctttctccccgggagaaaaaccactcatacgcagtcggccaagcacttgatgcttactatgcctctgcgttagatgcttctcctgcccgtagaagctcgcggagttgggctacaagagaagcgccaagaagtgcaaggagaagtttgagaacgtccacaagtactacaagcgcaccaaggaagggcgcgccgggaggcaggacggcaagagctaccgcttcttcactgagctggaggcgttgcatgccgctgcgccgcagacgccccagccgcagcagcagcagcagcagcagttgccgccggttacaagcagcgcacccgcgatgcacgccttcgcgccgccggttcccgcgccaccgccgatgagcgcaatgccaccgccgccggggccgatccagccggccccgatatcttctgcggctcccgcggtgcccctggagctgccgccgcagccgcccatcaacctgcaaggcttaagcttctcgtccatgtcggggtccgagtcggacgatgagtctgaagacgacgagatgacggcggagaccggcggcagccaggaccgcctcggcaagcgcaagcgaggcgccggcggcaaaaggccggcgactttcttcgaggggctcatcaagcaagtcgtcgacaggcaggaggagatgcagcggcggtttctggagactatggagaagcgagaggcggagcgcacggcgcgggaggaggcgtggcgcaggcaggaggtggcccgcctcaaccgcgagcaggagcagctcgcccaggagcgcgccgcggcggcctcccgcgacgccgccatcatctccttcctccaacgcatcggcggtcagtccgtacaggtcccacccgccgccaccgtcatccagatgcccacaccggtgcagctccagacccctccgccggtcaagcaacctgccaggcagcaccagccacagccaacgccgccgccgccgcaggcggcgccaatcccagccgcgcccctccagcagcaaccgccgcagccgcagcacaaggagacgattcaccacgaggcagtgacgccgcgcagggcgccaccgacgtccggctcatcactcgagctggtgcccgcggcggagcagcacgtcgagagcgggctaggaggaggggagggcgggtcggcgtcgtcgtcgcggtggcccaagacggaggtgcaggcactcatacagctgcgcatggagctcgatatgcgctaccaggagaccgggccgaagggcccgctctgggaggagatctcgtcggggatgcggcggctggggtacaaccggagctcgaagcggtgcaaggagaagtgggagaacatcaacaagtacttcaagaaggtgaaggagagcaacaagaagcggcccgaggactccaagacatgcccgtacttccaccagctcgacgtcatctaccgcaggaagcacctcaccggcggtggcggcggcggcgcttccgcggccaatgtcgccgccacggcaatcgagcaccagaacccgaaccggcacgagatagaggggaagaacataaacgacaacgacaagaggaagaacggcggaggcggcggcgcgcaggtgcccaccagcaatggcgacacggcaccgaccacggccacgttcgacgtcgatagcggcatgaagaagccagaagacattgtgagggagctgagcgagcagccgccccgggagttcacaacggacgagaccgacagtgacgacatgggcgatgactacaccgacgacggcgaggaaggcgaggacgacggcaaaatgcagtacaggatacagttccagaggccgaacccgggcggcgccaacaccgcacctccgccggcaacaaccccggcgtccgcggtgccaacctcgactccgacgagcaccttcctcgccatggttcaataggcgcgcgaacgatgcatcaccaagtacgtacttgttc

SEQ ID NO: 5395 - DNA, 3478 bp, Oryza sativa
  Predicted polypeptide sequence is orthologous to G634
atggccatttattacctggaaagggagggattaacccacaacatgccaatgcatggccatttttatactcctctgcccctgaaccattggcacgcggataccaccaacgcggctgacatgacacgtgggcccatgcgcatgtgggccccacatgtcagtggcatgaattttatatttttcatctcaaaagaaaaggtattgatgagagtagaaatggtgagctctcctgatgtactgatcattccatcacctccattccccagtggtaacactcgtgggggaggaggaggaggaggaggtagtagcatgcagcagcagcagccagggggaggagggggaggggtgcagcagttcggcgcggtggcgccggagatgtcgccattctcgccggcgggaggaggcggcggggggcggatctccatggcggaggccgcgtcgcccatcagcagccggccgccgccggcgcagcagcagttcgacgagctcggcgtaggcggcggaggcggaggcggaggtgggtttgacgccgaggcgctggcggcggcggcggtcggcgaggagggagccagcggcggcgcgggggggaaccggtggccgcggcaggagacgctggcgctgctcaagatccggtcggacatggacgccgcgttccgggacgccaccctcaagggcccgctctgggaggaggtctccaggaagctggcggaggagggttaccggaggagcgcgaagaagtgcaaggagaagttcgagaacgtgcacaagtattacaagcgcaccaaggagagccgcgcggggcgcaacgacggcaagacgtaccgcttcttcacgcagctcgaggcgctgcacggcaccgccgccggcgtcgtggcagcgccatcgccggtgacgtcgctggccccgccgccggcgacggctgtgggggtgtccggcggggtgcgcgcccccgccgagccgccgcccgcggtggtgatggggaacgtgatgagcttctcgacgtcgaacacggaggagtattccgacgaggaggactccgacgacgaggggaccgaggacatgggcggcggcggcggtgatgagagggggaagaggaagaggttgtcggagggtggcgccgccgcgggcgtcggtggcggcggcggaggaggaggagggagcgggaagatgatgaggttcttcgaggggttgatgaagcagaagatcaccgggcagaccatcccaatgccgcccatcatcgccgcccccgccatcaccgtcatgcccccaccggcgccatcccagcagcctcagccgccgccaccgccgtctcaccccacccccatcacctccgtcgcgccagctccgccgccgccgccaccagcagcagcagcagcagcagcatcccagccatcgccgcaggccaccaagtcgccattgccggcgacgccgcagacgcaaagcagcatggacattgtcatgacggccgccgaggcgcacgacgcggggtacgacgggtccggcggcggcggggggcagccgtcgtcgtcgcggtggcccaaggcggaggtgcacgcgctgatccagctgcggagcaacctggacaaccggtaccaggaggccgggccgaagggcccgctgtgggaggagatctccgccggcatgcggcggctgggctacagccggagctccaagaggtgcaaggagaagtgggagaacatcaacaagtacttcaagaaggtcaaggagagcaacaagaagcgccccgaggactccaagacctgcccctacttccaccagctcgacgccctctaccgcaacaaggcggctctcaactcctcctcctcctccgccgccgccgccgcaccggccctcccgccgccggagcacgcggagccggcggtgacagtcgccgcgccgatctcgcagacaccgccgccgccgccgccacagcccgtgacgacgaccaagaacggcaacggcaccagcagtacaaacggcgcgaacggcgaaggaggaggaggcggctccgggggcatgcaaatgcaggcgagcaacggcagcgtcgtcgccggcaacaagttcttcaccggcgcggcggcgaagaagccagaggacattatgaaggagatgatggagcagaggccgcagcagccggcggcggcgaacaacgccttcaaccgaacggacggcggcggtggcggcggcggcgtggacagcgacaacatggacgaggacgacgaggatgactacgacgacgatgacgacgacgacgacgacgacgtcgacggcaacaagatgcagtacgagatccagttccagcatcagcaccaccaccagcagccgccgcagcaccgccaccagcagagcgtcgtcagaccgaacgccgccgcctccgcggccgccggcggcaacccgcccggcaccgccgcccccgccacggcggcggccgcaacgacgaccaccggatctttcttggcaatggtccagtgatccatccatccatccggtgactctctctccttcctacacatgcatacctccatgcgcgtcaatggcttcttcttcttcttcctcctccatctcttgtaccatttgtatctacctacctgtcgcctcctccatggctcgtccatatctcaacaccatcaaaaagctcaaaaacctaaaacctcaagaattctcttcctcctccggcatatttctccattgattcctcatgcaagctagcagctatacatctccatgccaagaaagaaaaattcgcccatttcaagctgcatgcatgcccatcgatcgttcgtcgctggatgttcctagcaagaaaaagctagtagcatcgatccatttcttgattcgttcttgtgttaattacagtggtctctcccatctcgcgtctcctcttagctagtgttaaaagcaaaaaaaaaggaattggtggcgtggtaatttattgatttgttgtggtaaatttaataaggaccctccattcgtgagggttcacggagagggtttaaaacttggtgcggtgaaaaacggcacagaggagcggtaataacacctcgctctcgcggttaaaaaaaaaggaagacaagggtatatatgcaaaatgttgcggtggttgtggttgttacaaattattacacctcggtaaaaatttgtttggctatgtgtactactgctcgatctactgtggcatgttgcaagggcgcggtgaaaaaaaaatcgaaggtgaaaaattaaagatgtgctcatcaagtgaagtggcagtgaaaaagcaagagagctggtgctggtgtatgccggaatttttcccatttctcttttttttctcttttctctccttcttttatatgttttgttttgttttttctaattacctaaactgtccattatgtattacctgagtttttttttcttcctttcccaaactgttgttaccgaagttttacagtgtatactcgcgacatattatatgttacattcttgctattcttatacc

SEQ ID NO: 5396 - DNA, 1623 bp, Oryza sativa
  Predicted polypeptide sequence is orthologous to G634
gaagcgcaccaaggaagggcgcaccgggcggcaagacgggaagagctaccgcttcttctcgcagctcgaggcgctccacgccgcggcgccgccgccgccgccgcagcatcggcagggcatgccggtggaggacccgcagccgctggcgatggcgtggatgatgttgcccggggcggcggacctcgggttcttgtcgatgtcgtcggagtctgagtcggacgatgagtccgacgaggaggaggaggaggaggaggcggtggcgccgggcggcggcggtcgggaggggcttggcgatgatggtgacggtgatggcgaagggggcagcagcaccaggaagctgatggccatgttcgaagggatgatgaggcaggtgacggagaagcaggacgcgatgcagcgggtgttcctggagacgctggagaagtgggaggcggagcgcaccgagcgggaggaggcgtggcggcggaaggaggtcgcccggatcaaccgcgagcgggagcagctctccaaggagcgcgccgcggcggcgtcccgcgacgccgcgctgatcgcgttcctccagcgcgtcggtggcgccggcggggagcccgtgaggctctccccttcgtccgccggcgccacccgccacgacgcggccgcggcggggctgcagctggtgcccgtgccggcgccgagagcgaaggcggaggacgcctgggcggcagcaggaggagacggcagcgggacgacggcgccgtcgcggtggcccaaggaggaggtgcaggcgctcatcgacctgcgcatggagaaggaggagcagtacaacgacatgggacccaagggcccgctgtgggaggagatcgccgccggcatgcagaggatcggctacaaccggagcgccaagcggtgtaaggagaagtgggagaacatcaacaagtacttcaagaaggtgaaggagagcaacaagcggcgccccgaggactccaagacctgcccttacttccaccagctcgacgccatctaccgcaagaagcacttcgctggcagaggcggcggcggcggcggcgtcacgatcgccgcctcccactccagcctcgccatcgtcaccgtctccgagcaggacaacccgagccagcgtgagctcgaggggaagagcagcaacgacgtcggcaacgtgcagctggcggtgcccctccttgtccacaacgccccagacaagaaggtggaaggctccgaaggcgaaccaaatgtcacagcagcagcggaggagacggacagcgacgagatgtgtggagaatacaccgacgatggcgacgacgacgacaaaatgcagtacaaaatagagttccagaagccaactgcgggcggcggcggcgacggcaacgacgcacccgtgccggcgacaactgcggcagcgacgagttcagccccaaccagcaacaccagcttccttgcggttcagtaggtggcagtgcgcgcagagtgagggggctaaagaaagccaggcaggcatcaccgtcttctttttcagttcaagagggtcacaattgccctattatactttttcagttgttttgctgtgatgttggcaacatcccgtataccatttgttgatttctttctgtggtaactagcaaactatcc

SEQ ID NO: 5397 - DNA, 1335 bp, Oryza sativa
  Predicted polypeptide sequence is orthologous to G635
taaggattgcatctgatggcgttatttttgtcagcatggaaatcttccgacctcagaaggaacttgcttcatcacagtcaggattgaaagggaagttcaaaataacaacaagatgcctatggcttgataatggaagactattagatgcactttacaaagctgcatatgctgcattatcaagttgtccagtgaattgtccacttagtcacatggagaggatggtatctgaaatcttgaggaaaatggtaaggaagtatagtgggaagaggcctgatgtcattgcggttgctacagagaacacaacagtgagttttgtagaagactcagaaactaaatcatctggaaagtttggatctttctcagctcctaggcattcgagcaggagttcaggtaggggtcttgaagaaagtgataaatcatgcccagagaatacagagggagaggctaaagaaaatcttcctgatgtcctgggaacaacacgtgatgatgcaaccacaagctccaatggcgaagcatttttctcctcagatttgcataagcctaaaacactagagcatttttgggactcattcaaatcccctacagctgtaaaaattgcaagaattgtcaatggttcagctcaagggagtaaatcaaagattggcaagatcagcatagtgggtaaggactctagcgatccttcttctgctccagttaaatcttcaaaaaagaacaagtggaagcctgaggaaattaagagcttaattcagatgcgtggcgaaatgaatgagcaatttcagactgtgaaagggagaatggttctgtgggaagagatatcttctagcatgttgagccaggggataagtcgtacaccagcacagtgcaagtctctatggacatcattggttcagaaatatgaggagagcaagaaagatgaggaaagcgtaaagacgtggccgtatttcttggacatggacagggttttatcaagccaaggggaaatggcaacccaatgatcccaaggccgtagtttagtggttgtaattttggagggtgatggcataatcaatcaagtggcaggatgagatggctgcagcgtgttcttctccagagaatatacatgccataattcattccacgaaaagggaggcaggcacttggaatgactaagctgctacgtattcaccatgagtgtgctacagggctagggatagctgatattatttgatcaactatactagattaagtaattgaatagctaagttttgttgtgctattatttttggtgtaagaagacaccaaatgctaatccgaaggctttcaattgagctacccacatgcctatgcgtgtaaatt

SEQ ID NO: 5398 - DNA, 673 bp, Oryza sativa
  misc_feature (510)..(510): n is a, c, g, or t
  misc_feature (539)..(539): n is a, c, g, or t
  misc_feature (583)..(583): n is a, c, g, or t
  misc_feature (606)..(606): n is a, c, g, or t
  misc_feature (622)..(622): n is a, c, g, or t
  misc_feature (627)..(627): n is a, c, g, or t
  misc_feature (633)..(633): n is a, c, g, or t
  misc_feature (639)..(639): n is a, c, g, or t
  misc_feature (644)..(645): n is a, c, g, or t
  misc_feature (660)..(660): n is a, c, g, or t
  Predicted polypeptide sequence is orthologous to G653
cttttccgtttcataaatttctgattaaatttgaatcatgccattcaaaccaccagaggcttccaaatgcccaaaatgcaaccaaagtgtctttgctgccgaagaagttccagcagctggcaaaaaatggcacaaaatgtgctttaaatgtggtctttgcaaaaaaatgttagaagctatgaccatggctgaacatgaaggtaacatcttctgcaaacaatgttacggtcgtaaattcggaccaaaaggtgtcggtttcggacaaggtgccggtgccttaggtatggatactggtgaacatttgggaaacaaaagtggatccgagatgagcaacaaacccaactatgctccaccacctggcgttggtcaacaagaagaataaactggacaaattcgatcttaacatcttagtccattgattctcatgtaaaaacagtctctgttcagatgaaacagaagtttatttctctttttcttttttcatatatcttcactcgttttttttatacnattccctttagaaacatcctctctttaanaacctgtttctttctattcttattaccctcataatttcattatnattattaattcataccagatatnatatttgttatattanagacnagaccnacactnatatnnatcaaagaacaaaanaaaaaaaaaaaaa

SEQ ID NO: 5399 - DNA, 962 bp, Oryza sativa
  Predicted polypeptide sequence is orthologous to G653
aaaatcccattgctcacccgcgttatataaccgcggccggccattgggagggacgccgcgaggggtgctcgtttcagcgcgggaggagatcagatcgggctcagatcttccagctcgccgcgccgcctccgccgccgcagcaggaagagagagggtgaggagaggaggaggctacgatgtttagcgggacgcagcagaagtgcaaggtgtgcaccaagacggtgtacccgatggaccagctctccaccgacggcgtcgtcttccaccgctcctgcttcaagtgccaacactgcaagtccaccctctcccttggcaactactcctcgattgaaggagtgccatactgcaagccccatttcgagcaactgttcaaggagaccgggagctacaacaagagcttccaatcacccgcgaaacccgcatcggagaagttgactcctgagctgacaagatcacctagcaaagccgcacgcatgttttcagggacacaggagaagtgtgccacttgcagtaaaacagcgtatcctctagagaaggtgacagttgaaggacaggcctaccacaagtcctgcttcaaatgttctcacggtggctgtgccatttcgccatccaattatgcagctttggaaggtatcctatactgcaagcaccatttctcccaacttttcaaggagaaagggagctacaaccatctgatcaaatgcgcatcagtcaagcgcgccgaagcacagccggcaccaccaccggccgctgcagattcctcctgaatgtaccatatctccagtgaggcttgagggcgaaaattcggaagccctctgttttacaacctgcttgtatgccatgttccagttctgaggataccgggacctatcaatttcgtgtcctctgctgtgctagactcgatcacattggtgaaccatgaatatcatgtccctttcaaagaaatcgttgtgcaagtactg

SEQ ID NO: 5400 - DNA, 1464 bp, Oryza sativa
  Predicted polypeptide sequence is orthologous to G666
agtttcagtttcagagagaggagtcagtggctgtatgctgccatggctctcaaggtggctagatagacagacatgttgcccatcaacttaagaagcaactagctgctgctgctgctaagggagagctataggcttagctgtggtaggctatagatattactattaggtagctactagcctataggcagacatggggagacctccatgctgcgacaatggcgtcggcgtcaagaaagggccatggacgccagaggaggacatcatcctcgtctcctacatccagcagcatggccccgggaactggcgctccgtgcccgagaacaccggattgatgaggtgcagcaagagctgcaggctgcggtggacgaactacttgagaccggggatcaagcgtggcaacttcacccctcatgaggaggggatcatcatccacctccaggcattgcttggcaacaagtgggcagcaatagcctcctacctcccccaaagaacagacaacgacatcaagaactactggaacacacacctcaagaagaaggtgaagaggctgcaacaacaacaacaatcacaccctgatcatcatcaccaccattccttccaaaccaccccttcttcctccaatgcagcagcagtagcaacaaccagcccaaactactacaaccctaacaacagcaacagcaacagcagcaattacctccataacaacaaccacaatcttgaatccatgcaatccatggccactgcacctagcaatgaggccaccaccatccccaagctcttccagttccagacatggatgaagccatcaccagcaacaacatcatcagcagcaacagctgctgcaggtagctgctacaagcaggccatggccatgcaggagctccaagaggagcaagagggctctgctgctgctgctgcaatggcttcttccattgatggcgtctccaaggaccaggattatcacatgtgtgctgtgatcagtggtgatgacaagtcgtcgtcgtcggagatgatgacggctgcggcaatggccggccatggcgaggcggccacgacgaccttctcgctgctcgagaactggctgctcgacgacatgccggggcaggcggccatgagcgccgccatggatgggttcttggagatctctgctggatactgctgtgcagaccctatcatgttctgaactttctgaacttctgatgatcatctcagccttaatttcccatatgagtctctctttgctataggtttcttaatttcactgagttaatttgcacttgtactagctgtttgatgctctctctctctcgatgatcttgtgtttccggtaataaaccgttggtttaatttcctcaagaaaaagcaatccacctggaaataatctggttggtttggagaaatattgtcagttctcaaggatgtaataaaaggattaaagctgccataattcgttgcctgatatgc

SEQ ID NO: 5401 - DNA, 2407 bp, Oryza sativa
  Predicted polypeptide sequence is orthologous to G666
gagatatctctgaaatctccacttctgacagacggtccaccgccggaccgcgacgatgcaccaccgcaccgcccgaccagcgccgaggcactaccgcactgctgcccacggccaggcgcgggtccagccgcctccgaccgccaccacagcgcctccactgcctgcagggacgccaccgctacccgcccggctacctccgttgccgccgccaacacgcgagtctcctcctccctgatcgagatcgagtcgacacacatacaccaccaaccaccggccggccgccgcgcgccggtgagcaggatggggaggccgccgtgctgcgacaaggttggggtgaagagaggggccatggacgccggaggaggacctgatgctggtctcctacatccaggagcacggcgccggcaactggcgcgccgtgccgaccaacaccgggctgatgcgttgcagcaagagctgccggctccggtggacgaactacctccggccggggatcaagcgggggaacttcaccgagcaggaggagaagctcatcgtccacctccaggctctcctcggcaaccgttctctaccataatcgtggtccacaacatagccatgctttctgaatactttcaatggataatcaacgaagctctacactacaaatttctgcaatgacaggtactattattttttgtctgaattttgctttgcttgctacctttattttacctgcagacaatttatatttggcctgtgataatactctattgtagtgtatgtactaaaaggtgtttttattctatttaattaggagggatcatatggaggttagtttatcaacattctaaagtatcaatattgatgctcatgattttgttaactattgtttatcactgattctctttcatgcccaataggtgatttcaccaatgaaagatggaacatttattgattgggatattgttgacaatatatggaatcatgctttcaagcagcggctattgatcaatcctgaggagcatcctatgttgatagttgaaccatctacaaacacagggcagcaaagagagaagtatgtccatatatattctgtatttaaattaattgtgttgcttacttgtatagaaaaacatcgcgtataagaactagctgatttatagcacaattttcttctatggctcttatcagttatgactgaactgtattggtaccaggatttactgcatgatcagacatcctaggtagtatattgtagataaaattcaattacatgggaaattttcaggctgtagttgctctgtttgttgctaacgaataattcagtcctatattcgtcttctagggttttacattcttcctctcgggtcctatattcattttctgggctcctgtatttgttctccgagtctttctctcgattcctatattcgtcctctagggtcctatatctaaatttaacaattctcaaatcctttttatcatttttgtatcgtgggttgtcaaaataagcaactatagtatttctacgtaaaacacccataaagggtatttcaatcgaaatcccaaaaacaggatattggttctttcgcttgctcttgatgatactgtttcttcgcattttggctaacaaatctgaattattttgaagaatagaaggatagacaaaattcaaatgaccattggacatgattcgatccggcgttgaataatcaagaatttccctatcttttttaacaaaagtatccattcagtcgttctttttatcatgccatttttgttatttatcagtttttttggaacaaaaacatggtattttcttagttgatgctttatgcaggtatctactgactttaaagatcatgaaggcataatgcatatatcagggctttgacatggtcttcgtgcaagaataaaatgccattttgtgtttgtcaacaagtgttatttattttttaatcaacaattgtttgtcttacttcaggttcactgatctaatgttttagtcttgcacctatcacttgctaataatgttgtaaccttgccttgcacctatcacttgctaataatgttgtaaccttgctcctgtcacttgatagtatttcaaataatttccaatattatttgtgcagattatataaggtcgctttaagattaccttgttcagattcttcggccggccctattctttacattatgcattggactattgagcctggttgtttttggaggaccagggagcatggctggagtatcatctggaggataacctgatgtggattattcacttggctttgtcttgacaaataatatatgagttattgcttgtaagagaggtcaagagaggtcttattttctgatcttatcctagattgtattaaggacaattcatgtggattaaggagaattcagaaacaaaatttgg

SEQ ID NO: 5402 - DNA, 2327 bp, Oryza sativa
  Predicted polypeptide sequence is orthologous to G666
ggctcgctccgcgcctctctctccccgctcgcgtcctcgctctgcgcctcctctcctcgcgacggtccaccgccggaccagcgacctcgcctcctcgctccgcctcaatgccggaccagcgccgaggcactaccgcactgctgcccacggccaggcacggtccagccgcctctgaccggcaccacagcgcctccgctgctcgcagggacgccgccgctacccgcccggctacctccgttgccgccgccaacacgctagtctcctcctccctgatcgagatcgagtcgacacatacaccaccaaccaccggccggccgccgcgcaccggcgagcaggatggggaggccgccgtgctgcgacaaggttgggtgaagaaggggccatggacgccggaggaggacctgatgctggcctcctacatccaggagcacggctccggcaactggcgcgccgtgccgaccaacaccggggtgatgcgttgcagcaagagctgccggctccggtggacgaactacctccggccggggatcaagcgggggaacttcactgagcaggaggagaagctcatcgtccacctccaggctctcctcggcaaccgttctctaccataatcgtggtccacaacatagccgtgctttctgaatactttcaatggatagtcaacgaagctctacactacaaatttctgcaataacatgtgatttcaccaatgaaagatggaacatttattgattgggatattgttgacaatatatggaatcatgctttcaggtgagttgctttatctatttgatgcagatctgagtaattttgtgccaaaagtgcacgcccaaaaagctggccacacttgtggcaaaacttgtctgaaaaataaatctatgacatgagaggcactggagtaaccaggtttggcacgctgcttatgtggttcgccaaacacttgcccgttgccgcaaaaggccgaacgtgcctaacttgtttctggggaagtttgggatgaaccaaactctatctttaacatagtttctttagaatcagcaacaaagttaatcttctatgcctctatggaatcttttggatgtcagcatggttactgctttatgcccaccatcttttcaccttacatatttatttatgctcttcaaatatactaatagtgaaatcccttcttatgtgtacaaccggataaagttgattaaatactaggatttcctttgtatggcatggagatgcaactactgaagttttttgctttgttagcttttatcctgaggagcatcctatgttgatagttgaaccatctacaaacacagggcagcaaagagagaagtatgtccatatgttctgtatttaaattaattgtgttgcttatgtggtcctatatctaaatttaacaattctcaaaacctttttatcttttttgtatcgtgggttgtcaaaataagcaactatagtatttctacgtaaaacacccataaagggtatttcaatcgaaatcccaaaacaggatattggttctttcgcttgctcttgatgatactgtaatggaatggcaaacctatttcttcgcattttggctaacaaatctgaattattttgaagaatagaaggatagacaaaattccaatgaccattggacatgattcgatctggcgttgaataatcaagaatttccctatcttttttaacaaaagtatccattaaggtgtttcttttatcatgccatttttgttatttatcagtttttttggaacaaaaacaatgtattttcttagttgatgctttatgcaggtatctattgactttaaagatcatgaaggcataatgcatatatcaaggctttgacatggtcttcgtgcaagaataaaatgccattttgtgttcgtcaacaagtgttatttatttttaatcaacaattgtttgtcttacttcaggttcactgatctaatgttttagtcttgcacctgtcacttgctaataatgttgtaaccttgctcctgtcacttgatagtatttcaaataatttccaatattatttgtgcagattatataaggtcgctttaagattaccatgttcagattcttctgccggccctgttatttacattatgcattggactattgagcctggttgtttttggaggaccagggagcatggctggagtatcatctagaggataacctgatgtggattatgcacttggctttgtcttgacaaataatatatgcggtattgcttgtaagagaggtcttgttttctgatcttatcctggattgtattaaggacaattcatgtggattaaggagaattcagaaacaaaatttgg

SEQ ID NO: 5403 - DNA, 1223 bp, Oryza sativa
  Predicted polypeptide sequence is orthologous to G666
ccacgcgtccgctcctctcttgcaacatcaaactcatccatccatccatcgatctgagaaatccagctttccagttcttggatctccatcgaccatggtgaggccgccgtgctgcgacaaggacggcgtcaagaagggcccgtggacgccggaggaggacctcgtcctcgtctcctacgtccaggagcacggccccggcaactggcgcgccgtcccgaccagaacagggctgatgcggtgcagcaagagctgtaggctccggtggaccaactacctgaggcccgggatcaagcggggaaacttcaccgaccaggaggagaagctcatcgtccacctccaggcgctcctcggcaaccgctgggcggccatcgcgtcgtacctccccgagcgcacggacaacgacatcaagaactactggaacacccacctcaagcgcaagctgcagggcggcggcgccggcggtgacggagacggtggcgccgccggcgacgcggtctccccgaagcccgccgcgcagaggcccgcgtcgtcgtccaaggggcagtgggagcggcgcctgcagaccgacatcgacatggcgcgccgcgcgctccgcgaggcgctcacgtcgctcgacgacgtcaagccaccgcatcagcccgacgccgccaacgccgccgcggggggaggcggcgccaccaccggagcagcagcgtccgccggcgccgatagccccgccgcgtcgagcacgtcgggggcgtcgcagtgctccccgtcatccgccggctacgtcctcaccaccgagaacatctcccggatgctcgacgggtgggcccggaagaagggcggcggcggcggcaggcgcgccgccggcagcgggccggccacccccggcgccaccgagagcgcgtccggctcgtcggaagcctccgaggtgtcctacggcggcacggccttgtccgcagcggcggcgcccgcgtccgccttcgagtacgagacaaagccgaccgtcaccgccgccgccgccgccgacgccggcgacgagacgcagctctccgccatcgagtcgtggctgttcgccgacgccgacggcatcgagagtggcagcttgctcgacgcggccatggattacaccttctaatccacaccaccaccaaaccatgcaagaatcgtaggcagcgagagtgagcagcgcgagttcatcactagcccaacctgaaaaaagaaaaatcgaaaaaaaaaaa

SEQ ID NO: 5404 - DNA, 933 bp, Oryza sativa
  Predicted polypeptide sequence is orthologous to G666
atggggaggccgccgtgctgcgtgaaggcggaggtgaagaaggggccgtggacgccggaggaggacctcatgctcgtcgcctacgtccaggagcacggcccgggcaactggcgcgccgtgcccaccaacaccgggctgatgcggtgcagcaagagctgccggctccggtggaccaactacctccggccggggatcaagcgggggaacttcaccgaccaggaggagaagctcatcgtccacctccaggccctcctcggcaacaggtgggcggcgatcgcgtcctacttgccggagaggacggacaacgacatcaagaactactggaacacgcacctcaagaagaagctcaagaagatgagcgccaccggcggcggcggcgacgacggcgagggaggtggcgccggcgaggtgaagaccagggcggctgcgccgaaggggcagtgggagcggcgcctgcagacggacatccacaccgcgcgccaggcgctccgcgacgcgctctcgctggacccctcgccgccggccaagccgctggactcgtcgtcgggcgccacggcgccgccgtcgtcgcaggcggcgacgtcgtacgcatccagcgccgagaacatcgcgcggctcctggagggctggatgcgccccggcggcggcggcggcaagacgacgacgacgccgtcctccgggtcgaggtcgtcggcggcgtcggtgctgtccggggaggccagccacagcggcggcgccacggcgccgacgcccgacggctcgacggtcaccagcaagacgaaggacgaggagaccgccggcgcgccgccgccgccgccgccgccggcgttctccatgctggagagctggctgctcgacgacggcatgggccacggcgaggtggggctcatggacgtggtggtgccattgggggacccgagtgagttcttttag

SEQ ID NO: 5405 - DNA, 6305 bp, Oryza sativa
  Predicted polypeptide sequence is orthologous to G675
gatatcgttgccgtctcgctatcctctccagcggatccaggtacccagaggagagggacgcaagccgctgccgcgacacttctcccccttcatctccatgccaccaccgcctccctcttcctcgccctccactcctcttggtgaggtgccagatcttgttcgagggtcgttggaatcgatggtatcggtctccccaacggtggatccggtcacccggagcgacggacccaagcggttgccaccgccctcttctcctctcccgctctgccctcttcctcttgccctctgcacctctaagtgccaggactagctcaagggctgccggcgttgggagtgtagggtgggcaaggctgagaaaaagaaggatggatagcggtggttgctggcttcatggatgtgcccggttggttccaatctcctcttcccccctaggtttcttcgtgttgtcgcctatatcttgcttcttcctagagttcaatcgatctggtgtggtggttgctctattgtatatttgtattgtctaactcaacagatttggagggcctcttttgagctcaaaataatgttcatgcggtctaatcaatttgtcaaggggtatatatgtttactctagaagatcatgagaggttgcaaagaccggacaagattatcaagccgacgatggggtatgccatctgcaatgctatggataatttctccgtgctcttatcctgagaagatcctctcatcctgtgtgggacaagaacaacatgttcttcaaatttatgaacatggcattttttaggagacaagttcagatcacataatacacataatggagctatgtttcaggtcagaacttccaatctacatcctttattgttatgttcagcctcaaatttgcatgatgttcaaatgtgcttagaaatcaagaaccataaatggaatacattattaagctagaaacaaattacagccttacagagttatagacttaaagtagttgaccatgtctcaagacccaacacttttatcttagaaatgttaattcaaaactttctcaatgacactattttccatatatcaattactccaactcatctgctactagctactgtatatgcatagtgaacagttagtattgcttaaataatgtctgggactgccacgtgtacgccacgtagactaaaaccaccgcggattgggtcgagaggggtaattcgtccggtattcatagttggggatgaaaaatgtcggttttgtggttcggggggtaattcggacgactgcgatagttcgagggtgtaattcgtactttttcctttcttaaaacaaaggggaaaaaataaatatgcaccagcggggtattgaacctaagacgttaagcattccctcctaaaatgctcaccgtgacctcacctaaccatccgaacatatgctacttaatgatcatggtttgcaaaactacattattattattatcgttgttatctaatgacaacaaaaaccgtatttttagcactatcgttgaaccatcagcccactgggctcaacctgcaagtcccaaagccgtcgataattttggactgaacgaataggccttgtgcttagtgtgaacagttcccattaaattaaaaattaaaaatggaataagttcactggccgtccctcaactttacatctagtctatatgacatccctaatccataatatcaagaaatctttacccctaaactatgcaaaaccgtataatttgggtcctatagcgctgaatctctggttacgctgatgtgacatcctagtcagaaaaaaatagaaaaattatgggacccacatataagtgagtaggaaaaaaattatagtgtccgcatatcttctttcttctcttttcttttttctcttctcttctcttctttagcgagcgcggcaattggcagcaaaaggggtagacgccgggtggggtggcgggcgaagcaggcaggcgatataagctatagcacttcagggaggtcaagctttgtagcgacgacggtgtggcattggcgtttctccgataagatgagcttcgacggctcaacagagccgaggttctgtgcaatgatgatgggggcggcgacgagcccgttcgtgttgtggaggcaatgtatgtcatgctatatggcaacgaggacggagcagcgatgactttcagcaagctaattcctgcaacaatagcatggtgggttggtggcgatggacccattcacgttgcgggagcgtaggttgtccagacgacatgcgaactgtgctgggtgataacaaagatgaatatgcagaaatgattggttaagattgttaattatgaaatgtggaacttcgaataaatctaaaattattttagttttgtattacttaaaaataaattttactactgcatttataaaattgtaaaactagttttaaggcaaattttgctacaggacactgcgactttgcggttttagctataggacaccgcacgaagtgacttttggggaaaaacactctcaaaagttggatatttgctggtggacaccgcacccattaaaataataatttctgtatgagaaggagagagaaatcacgtgaaatgtcaaaagtgcccttaggcccacatgtcagctcggctattcccctctctccagccacaggaacgggcggcggcgggacgaccccgtcgcgctacaccagtccaacgagttcgtcgtcgttgtcacgtcgaagagatcggcgagcagcggcagggagccaccgtggcatgcgaacgcgtcggcgccgacgccgcagccgaggagcctcaagttggcctcgacgtcgtcgcttgtaatcaccggcgcctcggaaaacgcgcacagcgcctgggtctggccaccggaatggtctatggccgtcgccgtgattgggacagagctgcctgcagacgacgatgagcaagtcgccacggcgagagccgcgtcgtcgtcgtacgcggacatggcgccgccgccgcccgacccggccgaggcgatggtggaggcggcggactagaggaggcactgtaggtactgcatcttggcgccctggatggcaatgtcggcgccaccaccaccggcgccctgcatgatctgcgccgccgccgccgcatgccatcccggcgaggtggtcccggagggtggcgagcgcgatgagctgcggcagcgcggcgaagaagtcggtacgtggccggtgcgtcatggggtcgaatcccatctgtatgagacgcttcttgaggtgcgtgttctcgttgtccgtcctttccgaaaggtgcgtcgcgatcgccgccgctgttccctggtgctgctgcctagcagagctgacatgtgggcccaagggcacttttgacatttcacacgatttctctctcctcctcacccgtaaattattattttaatgggtgcggtgtccaccagcaaatatccaacttttgagagtgtctttccccaaaagtcacttcgcgtggtattttacagctaaaaccgcaaagtcacgaggtactatagcaaaatttgcctagttttaactgtttctcacgaaaataaaataattccaacaaaaataaaatgtgtagaaccagacaaatcgacattaaataactgtccctcaattcttcccctcttgttttttaatctcacaatttttctcaataatctttcgctagagaaaatcaagcttaaatatagttgatctaaatttaacatttcgtttttctccaaaaattattttgctctccctccattatttccctctttttttcactcttagcaattcttttcacgtcttttgtgatcgcgccatttattccctccattttaccccctctaagaaaacaaacgatagctaaccgcccatgaaaatctctcccctctctctcatgagcaaatagatcctggatttcctcttttcccattatcatctcttcctctctctcctgccattctgcacttcttctcctcccctcagccggcgtcaatctggaggtaaggttctaggcactctgctgatttgctggccaactgcaccgagcaggcgagctcgatccccacggctgctgaggcccatgcggtgaagccccatgccagtggccgtgtgctgcactgctggtgaggttttgcctccgcggcgccggccgtctactccgtgccgcgcagcccgtgccctgaggccttgctgccatgcccctgcatctccatctcccttcctagttcctgcatattttactgcctcgcagagttgtcaaatcgcactcaagccttattccccttcagcattaaaatatattacggatttgatatattcagtattcaggttctggaagagatgcacccttacttgctggaccctggtctacaaacgattaggcttgaacagcacagtaagcaatccaatacgtaatcttgttttattcctctctcctagatgctgcaatctagccttaaccacttttgctttaaatcgttcactgtccatctatgtttgtttatctccgttgcagccaattaaataatgttctttccatcaattacttattcaaattgttggtctattaaaatggacaaaggaattagtgattggcaaataaatccaaattgaactcaataaatttattgttaagtttttaatgttttcacacctctatttgaaaattattcactagctaacagaagaatttagtaagctccgtagtggtacttttaggatagcatcacagcagtagagtaaaatgcctaaaattgtagtcaattctgaaattattcttctgtaggatcactctgttgttcctctttccatatccaactatacagaagaaggtaagtattcactttactctttggtagtcaaagccaacgtcaagcatcaaagttatttgataccaatgtttgaaaatagctttctgaacatatagaattagcaatgttttgttttttattagcaaaatgacactaacaaatagttaccaaaagaacccacctaataagtacattagctgtagaattctctgtttggtctatctgttctatttcatagttaaattgcagaatcaggatccaaaaactatgtttgcatagaaacaggcagtgcagcgcaatggactttatcactgacaaagtgacaattcgatggaggtaaaacatgttaaagttcttactgtgatgttcttttcgattcttaaattacttgaatgctgatcgatatgtatttatgcactagattggaaatagaatattcttaaaaagctggaaaaccttaaacacaaatgtggctcttcctacagttgtaagctgtgatccaacttgcaaagttggatgttttgagctaggaagtgaattcttgatggtccatgtggatgttccataggtgagatttaaagaattgattaggccatacaaaaactacaaaatcgttggttatgtcataggacttgaattgcgtggccttcaattatggtaagctgttatttctttagttcttactttagagatgtgatcttttttttcctcctgacggtgcatcagtggttctgttttttttttcttttatagtttgatagataagtggggtaagatgatgacttcaaggtagagaatggtggcaactgtagatgttgtatgtatatagtttagatcctattttctttgcgtatgatgttctgaacaacgtttttagtacatgaattatgaggatgattatctatgtaataaaaaaattctttgtacaattggttattatgattgattggtcttttctaatttgtgcatgctttgattttgtgggtccctaacaaaacataatattgggcaaaagccagctggagcatgtcaagaccatcccggccctcggctgccttcatctcagactgactgaaagcacgaattgtttccataagtgaaaggaaagaatttgatctagacacaagctcttgttgctgaatgacaaattgggacctactgacaatccttttgtcaagtacttatgttactcatgtatctggacatggttggttcttcagtttctggaaacttgatcctcacctttccacctctagccctttctttctatctccatcattttcatttgttagatcaactggattaaggtagacagttgaaatagtgaagcagtggtggttcacgaaaactgaaaagttgtgggtgatggaggaagcacagcatgccacacagggatctctatctctctctagagtttaattgattcatctttattctagacttcaattttcttaaagattaaagagtggtgctaccatttatctataaactaggtgttttctg

SEQ ID NO: 5406 - DNA, 1134 bp, Oryza sativa
  Predicted polypeptide sequence is orthologous to G675
atggggaggtctccttgctgcgacgagaacggcctcaagaagggcccctggaccacggaggaagatgagaagctcatggagtacatccagaagaacggccatggcagctggagagcgctgcctaagcttgcagggctgaacaggtgtggcaagagctgcaggctaagatggacgaactacctgaggccagacatcaagagaggaaagttcacctctgccgagaaggataccatcctccagcttcacgccgttcttggcaacaagtggtcagccattgccaagcacctcccaggtaggactgacaacgagatcaagaactactggaacacacacctgaagaaggatctgatccagaagggcatcgacccgacgacgcaccggccgaggaccgacttcttcgccgcgctgccgcagctgatcgcgctcgccaacctccgccagctcgtgggccagctgccgtgggacgaccccgccgccgcggccgccgggctgcagcaagccgaggcggcccaggcagcgaagttcggacagtacctgcacctgcaggcgctgctccagcctccgccgccgtccgccgcgactagccccagatcaggctgcatcggcggcgccgccgccgccatgccgggcggcgacatggagcagatgggcgcgggactgcttagcccgccggcgatgtcgtccgcggccttgtcgccgatgtcgacgtcgtccttgtcgccgctgccttcgccgatgtcgtccacggccttgtccccgttgcctccttcgagcttctttggcaatggtggccaaggctcattcctcgctggacaattgcctaacatccaaatgcatggcagctcgttgttcgaccagtcggccgccatcatcaacgacgccaaccacaaccaagattacgctgcaagcactggcgagagggagatcatcaatggcgccacgaagacgacgacgacgacgctgctgccggaaggctctcttccgccgctcgccgactaccccaccatctccaacctcggtgatgtctacagcaccccaagctgcgatggcaacatcactgaattccctctcttgcctgacgccttattcgacgagttgatgagagactatgtatctccttcttcctctttttag

SEQ ID NO: 5407 - DNA, 2892 bp, Oryza sativa
  Predicted polypeptide sequence is orthologous to G707
gatggcgcacatgcttggatgggccggcccgtcgctccacgcctcggatcaccactgtcttcgcccgcggcggcgcacgccgccgccggagcccctgccccctctcgggcggcgcggcggggaccggggctcaccgcggccatgcgctgttcttgctatccctctcgtcagtttgtgccctcaccctgatgatttccgtttcactagccttgcacttcttgtcttcttccactcaacaggttggcgctaggttttgccgattggggatgaactcgtgacgaaattgcaatgtggggctctctctcggtaatggattggagaagtgatgaacggcgagcttaaacttatggcttcctatgtgagcaagcttaagttcatcttgcaaaaagatcagcagcaggagccccatactgcgaaccttctagtcctacttgggagtagcaatcaggacaaaagaaatggcctctcacagggagaaaacagaatggacacttgtaccagaaagaagccaagaagataccaactcctcaccatgcaacaaaaagaaacgcttaatcgtgcatttcaatcatgtccgaaccctgatagaaatgacttgaagaagttggccaaggaactaaacatgactgagaccaaaatcaaatattggttccagaactgcaggacaaagatgaagaaattcaagaacaatgaggagcgcaaactactgcagaaggagaatgaggagctaaagaaggagaatgcagagttgagaaataggatgaagaactcaacatgccgcgcttgtgacctccctttgttccatatagattgccgtcattgggagaatccaatgctcaacaagggtaatcatggcgttacaagtaatctcattcctcaggcagtgtcatccttgctccccagctcaagtggttttgtagcttcaggctccaatcttagtagcaatgctgtgctcatgcccgtatctgccatgccatcatcagttttgcagcctgctccagccgtctctggtgccaattttcccatcttgcacaatctatctgccaatgcaaatgatggctatacggaaaaaaacgtacttcttgatctggcgaaccgtgcaatggaagagttctttagtctaatgaaggagaatgagtctcttcttgtcaaaaaaaaggagaatgggcctctctggctcccacacatggatattctgggagtcgaatcacttaactaccaggaataccttgcaaaatccaggacgattggacaaaaacctgttgacttcaaagtggtcgtcaccagggacactgccattgtcaatggtagctgtgttgacctcgtcaaaagccttttggatgctaaccgctggagagagttgtttccaggcatcgtggcaagtgcaaacaccaccaagatcatctctactgggccctctaacttgcacgacgggttgcttcaattgatgcgtgcagagctccaggtaatgtcacctgaagtcccagtttgcgatgtgacattcttgaggcagagtgtgcagtttggaagtggactgtggtgtgtggttgatgtgtctattgataccatccttcctggagagagtaaaacagctcagtccagtgtgcagaccagcagtacagctgccagacgcatggaagtcaggctgttgccatcaggctgtgttattgaagaaatggagaatggctattccaaggtgacctggatggtgcatgcagcttatgatgagagagcagtgccagtgctttatcattcacttctccgctctgcaaaagcccttggtgcgtgccgctgggtagcatcactccagagacacagccagttcctttccggcctgcacaaatacatcttttgtcctgacagcacaatgacagaagtggtgatgcgaagaaaagtcctgtacctggtgaagcagatgacgagcagcttcacaggcctatttgcgtcgatgtctaaggccacgctgcaagatggtgatgatactcacttcgcgcatcagatagttggtggtgcaacaggtgaacctgccggactgctgctgagcgccaccacaaccatatggctccccggcgtgaacccgaggcacgtgtatgaccacctgcgtgatgagcagtgccatggtgaatggcgctgcctcctcggtgagcagctgcatcagggcaatgccttgccgtatggtgcccccctgaatggtgagaccgtgccagagttctatcgcatggtgaacgggctgcatgaagggcatgctatctccctgatcagccccagagaaatgggtggtaacataagcaacactctgctcctgcaagaggcaagaactgatctttctggctccctcatagtttacgccaggacagatgtgaacaccgtgcattccatcatgaacagtggcctcaaccctgccaccgtcttcctcgtatcctctggatgtgccattcttcctgattgcctggaatcattccctctacacccagctgcaactgcagatcaggccggcacctccagtgccgctatcgctagcaggagcgaaaccggtgggtcattcgtcaccgtcacttaccagatgtttttcagcagccaaggtggcgcagcacctgccagctcatcaattcatcaaggccgtgatgcgctcaagaaagccaccgacattttcaaggtggtcctcgacactctcaccgtggcatagcgcaataccccaggggtagcatttgcatgcgaaagtgaaatccagatcgagttaaatttcagtgtttaagactatgttgtttctgttgttcaggggatggctttatctctgatagacccgtggatcatgctgtttaccttgtttaccattttcagactatcgatttgaaatgttgatcagacatttataataattggaactttgag

SEQ ID NO: 5408 - DNA, 2218 bp, Oryza sativa
  Predicted polypeptide sequence is orthologous to G707
gattatagccattctctccagccaccctctcgcctcctcctcctctcatcatctcccatccttcctcctcctcaactcctctcctctcttcgcttcttctctcatgctagctactactactagcttctccttctcctgtcgcacggtgcggcggaagtggtagtagtagtagctttcttggtttaagcaaggatcggcgaggacggacgccggcggcgaccgagcttggggtgtgtgtgtgtaaagttgtcttctccggcggatgagctgttgtttcttggctcgcgcctccggcgtgtccggcttgttgccttccatgtccgcgacgctgcaataattcgcttccatatttgctgccgccatgccatgtatagccgcgctgctgatgcggccctccagccgttttaatgcgtgccaaatcctctccccgaggctcataaaaattattgaattgttgggatctgaggggatccgccggagttggtaggatcacggtggagtgattttggccggaggaagaagaagaaggagaaaaactggtgtttgttttgtcgtttgtagtgagctcgcgtgatgagcttcggtggcatgttcgatggcgccggctccggcgtcttctcctacgacgccggcggcggcggcggcggcggcggagtacacaactcccgcctcctccctacgccgcccgtccccaagcccggcggcgggttcgccgctcccggcctctctctcggcctgcaaactatggacggtagccagctcggcgacgtgaaccggtcgcttgccatgatgggcaacggcgggagcggcagcggcggcgacggcgactcgctccagcgacagtgccagtatctcgcatgctgaagctggcgcagcggatgacggacaacttctgcgcgggggtgtgcgcgtcggcggcgcagaagtggcggcgcctggacgagtggcgcggcgagggtgggggcggcggcggtggcggcggcggggacggggaggacaaggtgcggatgatggcgcggcacagcgtgggcgcgccgggggagccgccgggcgtcgtgctgagcgccaccacgtcggtgcggctccccggcacgctgccgcagcgcgtgttcgactacctccgcgacgagcagcggcgcggcgactgggacatccttgccaacggcgaggccatgcaggagatggaccacatcgccaagggccagcaccacggcaatgccgtctccctcctccgtccaaatgccacaagcgggaaccagaacaacatgctgatcctccaggagacgtgcaccgactcatcgggctccctcgtcgtctacgctccggtggacgtgcagtcgatgcacgtcgtcatgaacggcggcgactccgcctacgtctccctcctcccctccggcttcgccatcctccccgacggccacaacaatggcgcctcgccgtctccggcagaggtcggcagcggcgcctcgccgaactccgccgccggtggcggtggcggtagcaacaacaccgggtcgctggtgacggtggcgttccagatactcgtcaacaacctgccgacggcgaagctcaccgtggagtccgtcgacaccgtcagcaacctcctctcctgcaccatccagaagatcaagtcggcactgcaggccagcatcatctcaccatagataagtggacatttgacgtggattccgactcgaccatttttgagtcgagtcggatgccatctcaaatgtctaacttttgaaggttagaagactgagaggacttccgcggcgggcgatggccgaccgaaactggctgatggatgcaactcaatcgttgatcaggtagagttttcgagaggcgatatgcgagcgaggataaaaataaaattaagttatatatagtgtgtggagtatatttgcatagatgagcaaattaaatggggtgagttgcagagggatcaagtcaagaacgaaccttgcgctaggcttggctcaagctgatgtggtggttcgggtattgacttagtctctggtgaaaataaacccctagggctttgatctcctatatatatctagcagtttgcttaatttaaccattttgtgaagttttttttaattctccaaaatgggggaaatatagagaaacaatactgatcagatccccaagatcgttggtgtttgtttagtttgcataatgttggaatgagttgatatataaacatgtttattttggc

SEQ ID NO: 5409 - DNA, 663 bp, Oryza sativa
  Predicted polypeptide sequence is orthologous to G707
gggtcgacccacgcgtcgagccgctccggctagcgacaactggacggcgcctccggcgacgaactcgacccggacaacagcaacccgcgcaagaagaagaagcgttatcaccgccacaccccggagcagatccaagaactcgaagccgtgttcaaggagtgtccacatcctgacgagaagcaacggatggagctcagccggcggctcaacctcgagagccgccaggtcaagttctggttccagaatcgccgcacccagatgaagacgcagatcgagcggcatgagaacgcgctgctgcggcaggagaacgacaagctgagggcggagaacatgacgatccgggaggcgatgaggaacccgatgtgcgcgagctgcggcggcgcggcggtgctcggcgaggtgtcgctggaggagcagcacctgcgcatcgagaacgcgcggctcaaggacgagctcgaccgcgtctgcgcgctcgccggcaagttcctcggccggccaatctcgagcatctcctccccgggcccgccgtcgctgcaggcgtgctccggcctcgagctcggcgtcggcagcaacggcgggttcgggctcggcgcgctcggggcctcggcggcgatgcagtccatccccgatctgatgggcggctcctcgggctgacgggggggc

SEQ ID NO: 5410 - DNA, 633 bp, Oryza sativa
  Predicted polypeptide sequence is orthologous to G730
ttttttttttttttttttgtgccttcacacttcacagtcttattggcttcttatctagccaagctagtcatttcgggcaaatgacactatatactactaactgggtcaagctagctatagcacaccgaaatcaatcaacttagttatgcatgcttggacttcgcggttctgatgtatcattgtgaagccttcccaatcccaagtgtgaactcaaggttcggccgacctggtaacctcaacatagatgtctctaagtccacgctcagttttgtattcttgagatatcttctgtaaatttcattagctggttctctgatgggtaagcctaccttgcctgacgagttattgctccataaaccactgtaaatattggtgtcgttctgttcagatgctagcatacttttgttttgcctcagaggaccgtcagtaaaactgtcgtcggagatatctccagccgatgcattgtcaaacccatcgttattttgtcctgcatttgagaccggtctgtcggtatttttaattgtgcgatacatctgcaggtgagacttgacatgagccagcgttagatccttgacatccatcagctccagcactgacttgggcgttgctcccccttgtctcgtcgctcaccta

SEQ ID NO: 5411 - DNA, 1526 bp, Oryza sativa
  Predicted polypeptide sequence is orthologous to G730
tcacaccagaaccaccactgctataactctcctcttcctcttccaccaccaccaacaccacaatatatggtcctctactatcataattctagaagtgtatgatcagtttgatccaagaagtggtagagagtagttggtgttgtattctcttccattgatcattgagctaagctatagctgtagcagcagcagcagcgacaacctcccatagctttgatcttgcaatgctgcaaaggaacctgccgaatctctccctccggataagccctccggccgtctcgtcggcggcggcgccggtatcctccggaacaccgacgacggcggcgaggacgactctgccgaccggagtgattacagacgcagaaggaggaggcgaagtagcagcgttctttggaaaccctagctccggcagcgagccccccggtctgagcctggggctcgggccgacgacgccggcgcacgcggacgccggcggcggccgccatggcgaccaccacctgcagccgcaggggtgcgcgccgttcaagcgcgcggcggccagggcgtcccagctgccggcgggctcgaagcggagcgtccgcgcgccgcggatgcgatggaccaccgcgctccacgcccgcttcgtgcacgccgtcgagctcctcggcggccacgagagagcgacgccgaagtcggtgctggagctgatgaacgtgaaggatctgacactggcgcatgtcaagagtcacctccagatgtataggacagtgaagagcacagacagatcatcccacattgcctcaggagaggcgcagctgcagcagcaggcaggaatggaggtggccatggaggcggcagctggaggaggaggaaatggtggtggtggtggtggtggggtggtgctaccgatgatgccggcatgtgacgacatggttgggatctgtagctcccctgcgccgcctgccgcagcgactagttccgctgctgcctacttcctctgcgcgacgacgacgtcaacagcaactgctccactggcagtagtgccatcgcctcctgctccaaccattcccacaaggaggactgaccaaacgccagcgctggaaaagggtgtcgcgattgttgactcgttgcaccggtgtcagaagcataactactcaccagtgcttcaagatgctcttcatcagggagctgaagaagatcatcttattaccgggaacctaccaatgggaggagcatcagcacaagcgagcattgaggccatggcgactaccaactcttcaagccctgcaagctcatctccatcacttgcaagcctggagcagctgctacctgaagactcgtttgcgcccaacctggagatctccctcgggagacataactggaacatggaccatcctgaagaactcagcctgaaatacctgtgaaaaaagccaaaaaaaaaaagaggtttttctctcctctgggtttcactccactaaccattgatgattgctcgatcagatcgttgtgatgatgactgaaaaatatattcagtaaccgcatccatc

SEQ ID NO: 5412 - DNA, 969 bp, Oryza sativa
  Predicted polypeptide sequence is orthologous to G730
atggagctcttcccttcgcagccggatctttccctccagatcggcctccccaccggcgcagccgcggcggcgcatggccacggcctcaacgcgaggttctttgccgccgccgcgggagcgggtggccacaacccggcaatggcgtcgtcgccgccgtcgtcgctgcagcttccgcttcccatgccgctgcccatggctccagccggcgccggcggcctgcagttctaccccgacgccgccgccgccgccgccgccgccatgctgaggcccatacgcggcgtgccgctgtaccaccaccaccagcagcagcacgccgcggcggcgccgttcgtgggcgcggcgccgctgccgcaccacccgagctcaggcggcgcgtgctactgcgagccgtgccacgtcgccggcgcgtggcgcaggggtggctgcggcggcggcggcgcccgcggcgtgctcccggcgaagcgcgccccgcgcgcgccgcgcatgcgctggacgtccaccctccacgcccgcttcgtccacgccgtcgagctcctcggcggccatgacagggcaacgccaaagtcggttcttgagctgatggatgtgaaggacctcaccctggctcatgtcaagtctcacttgcagatgtacaggacagtgaagaataccgaaaggccggcagcttcgtcagatcaagctgatgggtttgagaatgggtcggccggcgagatctgcgacgagaactcgctcgacctgcacggcggatgcaggccggaggcgatgtcggcggcggcgcgacatggaagggaggactggtctggcttccatgagtccaacactggaaccatgcaaactctgaaggatatgcaatccaagagcctagagatcatatcagacatgaactcctgcgtttcggagacgacatcgagcaccagcgagctgaacctcgagttcacgctagggcgaccacaaaaccgaccaaactaa

SEQ ID NO: 5413 - DNA, 1278 bp, Oryza sativa
  Predicted polypeptide sequence is orthologous to G730
atggcgtcggcgacgtcgacgacgcccgacctgtcgctgcacatcagcctgccgagcggtggcgcggcggtggggacgacggcgccgccggggctggggaacggcggtgcggttggtggtgccggcggcggcaaggcggcgggtggtggtgacccgtggcggaggctggatggctccacagcgtcgacggagctgtcgctgtcgacgccgcagcagcagcaggagggcagtacatcggcggccgatgtgctgccgtggcggctgcggcagccgacggcggcggcggcgtccgtgccggtgacactgccgacgataccgatggatggttcggcggcggcggcgcgcgcgccgatccgtggggtgcctgtgtatagcggcggcggcggcggtggccacccgttcctcggaggcggcggcggcgaccaccggcacaaccggctctacaacccctaccactccacggcatggccctcgtcgtcgctgtgctcgacgtcgccggcgccggctcctcctcccccaccagcagctctcgacccgacgacgtcgtcgctgctgtcgccgtccgcgtaccaccggatgctctccagcacggggcgcctccacggcgtgctcgccgacaccctccgcggctacgccggcgccgctgcggtggcgggctccatcggctacggctccgcggccgccgccgccgccgccatgggcggctacggcggcgccggcgccggcggcgggttcgcctcctcccgcttcatgccgcgcctcctcccggcgtcccgccgcagcatgcgcgccccgcggatgcggtggacgagctccctccacgcccgcttcgtccacgccgtcgagcttctcggcggccacgagcgagcgacgcccaaatcggtgctagagctgatggacgtcaaggatctgaccctagctcatgtgaagagccatctgcagatgtataggaccgtgaagagcactgacaagccagcagcagcctcagggccgatggacggcagcggctccggctccggctccggcgacgacgagctcctggccggcgatggaaggcaggcgacgtcatcgggcgccgatgcggaccggcggatgtcgttcaccgagcaccggtcctcctccgagggcgcggcgagccatgccggcggtggcggcgacggcgactgctcctcctctgccgtcaactccgacaccatcagagcgcgcagcaattcgccgagtacatcaatagaaacttgggattgtgtttggtgctgttcgttaaaagaaaagtcttag

SEQ ID NO: 5414 - DNA, 1095 bp, Oryza sativa
  Predicted polypeptide sequence is orthologous to G730
atggagctgttcccggcacaccctgacctgcagctccagatcagccctcctcctgccaccaagtcaatggacttagggttttggaaacgagctcttgaaacctccacgaccaccaccacggcggcggcggcggcaagtacaggtccttccgtcgctacttcctcctcgccgccggtagcgagtggcggggttggcggcggtgccggcggcttctaccagcaggcggccgtcgcgcctgcagctaacggccacggccatggccatggccatcaccaccaccaccaccaacatcaccagctcggcggcgcactccagttcttgcaccgcacccagcccatcccgccgcaggacgcggccgccggcggcggcctgcaggacctggcgttcgcgcggcccatccggggaatccccgtgtacaacacctcgcggccgctgcccttcctccagagccaccacctccagcaccaccagcattgctacgccgacacgatcggcgtcgcgccgggggccgggccgaggtcccccagcaagcaggcggcggcgctgcggctcgccgcggcgcccgccaagcgtggcgcccgcgcgccgcggatgcggtggacgacgtcgctgcacgcgcggttcgtccatgccgtcgagcttctcggaggccacgagagagctacacccaagtcagttcttgagctaatggacgtgaaggacctgaccttagctcatgtcaagtctcacttgcagatgtaccggaccatcaagaccactgaccacaaacaacctgctccaccatatgggcaaactaagactatcatagagatcccagacgacaatctgtttgacatcaacaacactagtgggtcagagtcttctgttcagcaacaatccaattttgacggcaatgaacaaggatccagcatgtgtgctctacggagcaacaactcctcaagtagaggggcctggttccatgacaaatcaagagatgctacccatggagacatcaaatccttcgaggacgtgcagtcacagagccctgaagacgacgacgcctccgacctgaatcgccgccgttccaaataccggagacgactgtcagcgccatga

SEQ ID NO: 5415 - DNA, 762 bp, Oryza sativa
  Predicted polypeptide sequence is orthologous to G730
cattttcttagctttggaagaagctgaaaaatcctttcagttttctcccaagaaacagcaatggcgactactgctgccaccgcgccggatctgtcactccacataagcccgccttcgccgccggacatggccgccggcggcgagacgatggagcagttggctgagccaaagctgtgcctagggtttggcacggcggcggcggcggcggcggagcagtacaacaatggcggctgcaacctccagcagcagcagcggctgcaccaacctagccagatccagagattcaagaagagcgccagcggcggcagccctgtgtgctccggcggcgccaccggcaccggcggcgttgcggcggcgagatccgggaatggcggtggaggtgggaagaggagctctagggcgccgaggatgcgatggacgacggctctccatgcgcactttgtgcaagccgtcgagcttcttggaggccatgaaagagcgacaccaaagtcagtattggagttgatgaacgtgaaagatctcacgctggctcatgtgaagagtcacctgcaggcaacttatttgcttgacctggtgcagatgtatagaacagtgaagggaaccacagacagaacatgtgctgaaggccatgggcagatgagagatatgggctttctgaggagaggaggtggtggagtggatggctttgacgtgcttggtaacacctcttcaattgcaatcgccaatattagggccttcaatctcaaggatgcaaatatataa

SEQ ID NO: 5416 - DNA, 847 bp, Oryza sativa
  Predicted polypeptide sequence is orthologous to G732
ggtgttaagaaattgttagtgaagtaattaatcaagtaattaagtctgcttaattaatcaactactacacaaagaaaaagatcgatggcgtctcccggcgttgtgtgtactactgtaacgccgacgtcgtcggccgggtcggaccaggtcgtggccggcggcggcgaggcggcgcggcggccggtggcgccggcggtgatggaggagcggaagcggaagcggaaggagtcgaacaggctgtccgcgcagcggtcgcgggcgcggaagcagcagcagctggacgagctggccgggcaggtggcggcgctgcgcgcccggaacggcgccctgggcctcgccgcgcgcgaggcggcgcgccggtgcgccgccgtgcgcgccgagaacgagctgctccgcgcgcgctccgtcgagctcgccgcgcgcctcgactccctcaccgacctggcgcagtgcctgcacgacgccgccgcggcctcctccttcgccgccgcgcccccgatgatgatggcgggcgccgccaccgccttccccaccggcgccgtcggcgccgccgccggcttcatgatgccccagctgccgccgccgctcctcgacgccaccaccatgggcatgcattgcaactactactactagtctactatagctatagctagcgtgtcaagtcttcattaagttagctctagtaagctctctctctctagtctctctacatgtgtccaaagtgtttgtgcctcttcttttgtgttgttattaggtgacctaatcaaagggcaagaaggacatttcatgtgtgtatgagactttattataaatgtgaaatggacatcaaggacaattttatgtggtt

SEQ ID NO: 5417 - DNA, 1407 bp, Oryza sativa
  Predicted polypeptide sequence is orthologous to G732
cacacaatcttgtgtatccgcaaaaccacaatcaacttcgcaaacctaagcaccactactactcttctgcttccccattcctccctccctttcgatctgttcgtcctcctagctctagctagcctctttggtcaggttatagattacatagcaccatgaattattctcctcccggttggctcgatcgattcagctagctgagcttctcgatcgatcaaccgatcttggttgcttcttcttcgatcctttcactccgtgtagttcttgatttgaaggatcgacgacgaactccctgtggcttcttgttcgccgggttcagccgcatccatgtcgatcacggaggctagcctccacttctgctacctccactcgctctccgtcgtgttcctctacttcttctacgtgatttcctgattcgcctcatccgcttcctctccaaacctgatcaaacaaagcttcgtgcacgatccatcttcgttgaaactaaggaccaaaaactgaagctttgtttgatccaaaaaaaatatatattctactaaatgtgttctagcttgttcctttcctagtatcgccttgttcctgcacgcgattgcccaacttggagcacgaaatatttctgcctagtacgtgttcgatcggtgttccacggtgagtgttagtttctctttgtgctctgtgatacattcaagatgtcagttgcgccggcgacggaagggtccgcacgccgctcggcggcggcggcggcggcggaggaggaggagcggcagcgcaaccggaagaggtcgaaccggctgtcggcgcagaggtcccgcataaagaagcagcagtacgtggacgggctggccgtggaggcggagcagctccggcgggagaacgacgccatgcgcgccggcgccggcgccgtgctgcagcggtgccgcctggtcgagcaggagaaccgggtgctcgccgcgcacgcgcgcgagctgtgcagcgcgctccagctccgcgcctcgcagctccgcctgctcggggaggtggcaggcgtgcccctcgacgtgcccgacgtcgccgaccacctcgtgcagctctacggcggcgacctggggatgacgccgctctcgccaccgccgctgctgccgccgctgccgccacagatcgagatgctgtacttccagccagactcggtcatggatccggtcagtatgctgcagggctacgaaaacatatgaaactctacattgtgtacttgacttatgattgttgccacatgcgtgtcttcggtttgtatggtgtgatctagctactgtacgttaatactgttgttgattttacgatccatattcctgttttgattgtgtagtaaaaagtatagcttgttgcgaggtacaagagtggagaaataaataaagtgtgtgaacattgtat

SEQ ID NO: 5418 - DNA, 2210 bp, Oryza sativa
  Predicted polypeptide sequence is orthologous to G732
ccctttttccccttctcccctccttcctcgctaaggttcccttgcttcagcagaacccctgctgggcatcctcctctttcaaaacatcctttgctctccaaccacttcatcttgatgttcttaatctcctatagtctttccctgtgcgaattttttctttgagaaccaaagtttcttagggaaattctgttgaatttttcctttgagaaccaaggtttctcggggagactctgctaaaatttttatcaactagcaagttgaaaatacatcattgtacatatattttgtctgcacatttatatacagtagcaaaacctgtttgtagagggaattattatagtgtttctggctggttgatccatgatagattaaacaaggggaggttgtgacttggtagatgtcaccaatcctctccgaggtcatcctctccggatttatgatcagctcgacgctccggcgaggctctcatcttgtcctctctttctccgtcgtcttcctttactggttctatgtcttctcagtaacatcctagctactgttctcttttatttgatctatccaataccagagaatagaccaccatattctacaaaatacttctcattggaaattatagcttatagacaaaactgagggtgacaatactgtaaggtattttcctgagtgttgcactaaggagggtactcaggacttttattaggatgaccctgtcaggtgggaccctgtcaagcgggataacctctggctcaagccatgggacccggagctcagggtcagagggtgatatccagctgcaggtccaaatggacctgaagcggaaaagaaggaaggaatcaaaccgagagtcggcaaagaggtctaggttacggaaacaacagcacctcgatgaccttacctcacaggtatgtttgaattccttttttttccctatctatatacatatatatataatatggttgcatttgttatgtagattttaatatgtttgtagttcctagctttaattagtttgctttatggattgaagcttgcactcatgtgcaggtgaatttgatacacaaaagcaaaatcagatgaaaaaggacacttgagctgaaggacttgctcaaggaaactccaataatgcacacggtgcccttttttcaaggggccccaactaattgcttcgtacataatacttgaaaaacattaaactcgctatcacttccaaagaaaaaggtgataggcaactagttaccaacaattgctcccaactgtcaaatctggaaataagagcaagctcatcgaaatttcttgatgccgatcaagaccggatcaagcttatgttttgctccggaaatgtgaaggcaaatttctatgaactgtcagatatcgcaagaaaccttcatccagaatttcattcatttttccagattaatcgtaccaacaatagtaggaaaagatttcagaatgttgcttgaacaaattagcaaaataatacataccagtgtaacataaataaatagcacaattcaccagatgcacatggtagatagtaattacttgcacaatctaaaatctgttctgttcatcacagcttccttcagcaaatccaaaaaaaaaatgtttatgttaaaaaggaatgttatcttgattatataaaataggtgaaccagttgaagatggagaaccagcagctcaccacaacattgaacatggtcacccaaagctgtgccttcgcagagtctcagaactcagtgctgcgcactcagatgatggagctggatagcaggctatcagcgctccgtgagataatcttctacatgaacaatggaaaccaatcaccttctaatcctacaatagcagcgactacatacccatccaccactacaatgactgcagcaactactggccattacgattattatgatgttttcactgcaaatgcatggggctcagggatgcaaatgatgcagcagcccatagatcagtttctgtaccagtgctagctagcttctagccaggaagtcgatagagatagtggaccaaattaagaaacagggcattgagatattgggcgtggtgaatgttgtagctaggtccatattaattatattgtgtcaccagtggttgtttatcttttgctttgatttgtgatcggttgtgggggcaggaaaaaaatggtgttgtacctttctgctgttggtggtaagaggccaaatggctattgg

SEQ ID NO: 5419 - DNA, 1647 bp, Oryza sativa
  Predicted polypeptide sequence is orthologous to G732
gcccttttcccctcttccccagctcctttgttaggttttcttccagtgagctctttttgctcatattcagatcttcacttatttcctagttgttactactgcctttgagtattgacagcttcatcctgccaactcagctcaatcttcctctgaagtttcagtctttgtttctgaatctcttcagtgttcagaggggaagttctgccaaaaaatttctctggccatccattttccaaggggagattctgccaaaattttcatctctgtccatcaatattcctggggaggttctgccaaaattttctctgaaatcggttaatttataaggggaggttctgccgaaattttcgctggtcatcaatcttccctttgttgacataccctgcataagtatatacaacaaacatataactttttgcaaggtaagaaggagtttttatctgttcttgatgatagactcctagagaagttgtcctagttgtgtagatgttgttgctcatcatccctgagcacctcctctctagatttatgactggcccagccataacccagcttgttcagtccttctctgttgtcttcctctactggttctatgtcttctcagtaagctccctgtttgtagccttttgaaattacaagacttatttatacaacataattatcaaggcatccacatataaactacaaggtatatatatatatatatatatatatttacaaaaagaaaaggaataagagggagtaaaattgttgccggtgcgaaaaaaaattgttgagaggtgaccatgtcgagtgggacctcgtccgggtcgagccagggaacccggagctccaggtcggaagatgacctgaacctccaggcccagatggagaagaagaggaagaggaggaaggagtcgaaccgagagtcggctcggaggtctaggatgaggaagcaacagcacctcgacgaactcacctcgcaggtgaaccagctgaagaatcagaaccagcagctgagcatggcactgagcctgaccacacagaaccttgtggcagtgcaggcacagaactcagtgctgcaaacccaggagttggagctgcagagcaggctgtgtgccctaactgacatcctgatgtgcatgaacaacaccagtgctactcctactcctacaattccagccaccactacaagtgcttgtgatatttttggtgccagctcatggaaccagccacccatagacttgtaccagtaccagtgcttctgatctaggaataagaagagggttgttgtggtagtgtgggtaggaccagaagccatcaagtaatgtttcaatcatgtagggccattgttgtcactgttaatgtatgcaattcaatcttaattgcctgctgtaggggacagggatatttgctctttcttgtagctgttggtggtagagggattaccagatggcaaaatggtgctttggcaatgtgttaggtggggctggttttggttgttaagggtagggaggagaaaattggtaggtttttcttgagcatgcaagaggggaggcaaaggattttgtgtaatgatgctcttcaaggaaagtattcataattatgattataatgtaatatgtggatttggtggatcttcataggccaagtgcttctttgtgctcc

SEQ ID NO: 5420 - DNA, 549 bp, Oryza sativa
  Predicted polypeptide sequence is orthologous to G732
atggcgtctcccggcgttgtgtgtactactgtaacgccgacgtcgtcggccgggtcggaccaggtcgtggccggcggcggcgaggcggcgcggcggccggtggcgccggcggtgatggaggagcggaagcggaagcggaaggagtcgaacaggctgtccgcgcagcggtcgcgggcgcggaagcagcagcagctggacgagctggccgggcaggtggcggcgctgcgcgcccggaacggcgccctgggcctcgccgcgcgcgaggcggcgcgccggtgcgccgccgtgcgcgccgagaacgagctgctccgcgcgcgctccgtcgagctcgccgcgcgcctcgactccctcaccgacctggcgcagtgcctgcacgacgccgccgcggcctcctccttcgccgccgcgcccccgatgatgatggcgggcgccgccaccgccttccccaccggcgccgtcggcgccgccgccggcttcatgatgccccagctgccgccgccgctcctcgacgccaccaccatgggcatgcattgcaactactactactag

SEQ ID NO: 5421 - DNA, 1174 bp, Oryza sativa
  Predicted polypeptide sequence is orthologous to G748
tttttttttttttttttttttttttataaatgtctcctttatttattattgatattaccatccagtatgcatgtatacactccccaatttatccatgcaagttctataacaaaacacacactgacacacatgtaaggtgtatagatagtctacagcttgcaagaacatgagttatatgtgttccgatgtatctatgtcctttttcttccatcggtcggccggcttgctaggcgagttcggcaaggtcatcatgcagtgcggcgtttccgaggggacacaggacaaggcgcagggcttcgtcgtggcccgggagaaggttgaaccggaggaggaggaggaggaggagcagcgtgtcccggctgctgctacgtcggggcagcgcgcgtcgatcaagcgggaggccgcggaccgcgacgaggagcaacggcaagggggcggggacgcggcggggcagccgacgcagcggcggttgcaggactcggccgaggcgcgtgcggccgccgcggcgccgctgccgtgcccgcggtgccggagccgtgacaccaagttctgctacttcaacaactacaacgtcaaccagccgcgccacttctgcaaggcctgccaccgctactggacggccggcggcgcgtccgcaacgtccccgtcggcgccggccgccgcaagaaccgtcccctgggccccctcgcggtcgcccaccataaccaccaccaccgcgcggccgccggcttcgtcctcggcttccccaacccgtcctccccaacctccccgtcgccggtctacaccgaccggtggccggtcaccccggaccgcccgttttgatcccgccatgcatccagtcgaaccaaccggcttggatatagcttccctttgacttgctgcagctgggttgcggaggctagcttggcttgcttgtacgtgaggcttacacaaacacatggtagatggagatatcgaatgggcttttctttcttttttttcttttctcctcttgctagtaccaccatcatagcatgcagcttctctctccttactactactatcctgctagtagtttgtttcttcctctttctccttttgttgttttctaaggttgcgggtgtaatgtaagaatggaagtgatgaggttgcggaggcaagttgcgaactccgtgcaaaaaaaaaaaaaaaaaaa

SEQ ID NO: 5422 - DNA, 1170 bp, Oryza sativa
  Predicted polypeptide sequence is orthologous to G748
atggagaacggcgactccagatttgttagggatttggtgtcgccgatgcctggaccgccgctactgccgacgcaacaagcgctgagggcactgtcatctttgcagattatccaggggcttagagtggcatcgccagagcggttgccacaaccatcaagcggccagcgtcgtatcttgccgatggccccacaggcacgacggtggcgtgctgatggcagcacaactatgtctgtggcatcgttgccgctaaaccaggtccgtgctattgggttgtttctcaataccttcttggtggccacaatgaggcgccaggaggggcccctttaccacaatgctattgtaatccctacgatagcaccggcaccggcgccggcaccgccgaccacccagatgctcgccatggagaacactatgccagctaccgtggaaccggttaccaaccacaggatcatcaaccatgatatcatgcatttcatgagggaaactccagatatccagaggctccacggcgttgtttcacctgtggcggtccatggtaacgggaatcccctttcatgcatctattgtgggctggtgtttgccctcaggtcatcggaaatcccggggttcctccctcctcctggatttagctacccagaacccatgggaccaccaccattactgtcattgtttccaccagcaagagatgcttctcggatagcagcggtgtgctcagacccacatcattttgctgtcaccatgcaatatatgcccaagcaggaaatggctgatctcatttggtcatccgagataccaagcatccacattccgtcagctgcaggtggccagcatgttggaacggtgccgtctctgaccggtatcactagtgccaccacatcaatggtgaacctcatgcagatgccggctatccacatggagcagcacatgctacatccaaccatgttaaactcatctgcttctccggaatgtatcactagcactgccgtaccatcaacgctgaacatgatgccaatgcgggatatcctcatagatcagctttcactgcctcctgccatatctagctcatctgcttctggtgttctctgtgagtacgtgatgcctgagcacgaggacatggtccgcctcaccttgggtcagtcatccaccatggacctagatcttagcttctag

SEQ ID NO: 5423 - DNA, 1216 bp, Oryza sativa
  Predicted polypeptide sequence is orthologous to G783
ggtggcgtccacgcgcccaccccacgcgcgtcaccgtcgctcgcccaaactgcgggcgcgtcgcacgccgccctcccatcgttttctcccattctttccccctcctcctcgtgcaaccacccaaccactgcagccagccacgagccgaggaagccgaggccgaggaggaagacgacgaagacaagtagcgcaaggaaccctcgaaccgggaggccgccgcggctccgatctgggagggggaggtcgagatggtgcccagggacagggtgaatgccgctgccgctggtggcggcggcgaggggaggctggtccagagcggtatagtgaacaagaagtgtgataagaaggctccaaagagaatccataaatcagagagggagaaacttaagcgggacaagcagaatgacctctttaatgagctgggaaacttgctagaacctgacaggcagaacaatgggaaggcatgtgtactgggtgaaactacacgaatactaaaagatttactttcacaagtggaatctctccggaaggagaatagttcactgaagaatgaatctcattatgttgcattggagagaaatgaactgcacgacgataacagcatgcttcgtactgaaatcttggagcttcaaaacgagcttaggacgcggatggaaggcaatcctgtttggagtcatgtaaacaccagaccagctctcagggtaccttatccgacaaccggagtgttcccagtacagcacctgccacatttaccagtcaccacgacggcagcatttcctcagcagctaccggttatcatcgagcagcactatgccgccacgccaagagaacttcagctcttccctgagtctgcgaccagcgaagacagcgaaccgtcacaagaacacgggatttctgaccatgtaacacggcctcagccaaggtacccaacaccaacggccactttgccagtaaacctgtttccagtgtttccaggaagacaagatcaacaatgtagcagtggtacttctggcactaacgaggaagaccgtataggtagatcttaggtacactacataacgagaggtccacacaatgatttgagaattcctttagtttcaacgtttaactttgcaagtttagcaaatgtgaaacagagatctgcgactgtgctcatgggtagcacctaatctgtatatctgaatctcagttttaagtggtcaaataggtgacattc

SEQ ID NO: 5424 - DNA, 1135 bp, Oryza sativa
  Predicted polypeptide sequence is orthologous to G783
gaatcttcgccctcctcctcctcctcgtacgcgcccacgcggttctctttctgccccctcgatcgatttgagcagggaacggaagggggaggtttttggaggaggccatggtgccgtcggagaggggggacgtcgccaccgccatcagacccgccgctgccgacaagctcgtccatgggcctatctctgacaagaagtgccggaagaaggtcccgaggaaggttcacaaatctgagagggagaagcttaaacgcgggcatctcaatgatctgttcggcgagctgggtaatatgctagaagcggataggcagagtaatgggaaggcatgcatactaactgacaccacccggatcttaagagatctgctttctcaagtaaaatctctccggcaagaaaacagcaccctccagaatgaatctaattatgttacgatggaaaggaatgagttgcaggatgaaaatggtgcgctacgcagcgaaatctctgacctccaaaacgagctgaggatgcgtgcgacagggagtccaggttggggccatggcgcgactggatcacctctccccgttcctccctctccaggcacggttttcccatcgcagcagccaatgcagccatctcccatgacaacaagcacagtgttccccttgcagcagccactgccacaaccaacagtcattgagccctctgcaagacagccactggaactgaagctcttcctagaagcaccccccgccgaagaccctgaaccatcagaagaccaggaggctccgaacaatgtggcacgaccgcagccgaggtacccaacagaggcatcttcttggcctattagcctgggacttccaagaatggaagatgagcaaatgtagtggtagcacgatagatgatagcacaggtagagattgagagggtctgtttttaatgcatgcaggaattccacacgaaaacacttctgtccttgcatgaaaactggaaaatttcctgcattccaagtaagacctgagtagatcagctccaaccaatcagaaactcactttgagcctagaggatatactactgaatgatgtgcatgtaaatatttcaatctcccttttgtttctgtaaactctagtgagaatagaacccgttttatcccctt

SEQ ID NO: 5425 - DNA, 1485 bp, Oryza sativa
  Predicted polypeptide sequence is orthologous to G783
ggcctccctcccctctcctccctcctccttccaaatctgcagctcaagctggtgttggtggtgttggtggtggtaggcggcggcgtcgccttctcctcctcttcttgctgaccccgcctgactggcttccttccccttccacacctgccggatcgggtggctgggttggttgagggtccaagaaagaaagattttgggggttcgggggtgaacccccctccccatgccccaagtgaggaaccagaatctgggcatggtggctgacacggagagctcggggtcactgggtggcagctcaaatgctgcttctgacaaggctgttgatgggtctcttgacaaaagatctcaggaaaaggctccaaagaaaactcataaagctgaacgagagaaacttaagcgtgaccagttgaatgacctttttgttgagctcagcagtatgcttgatcctgaacgacaaaatagtggaaaggctactgtgttaggtgatgctgcacgagttctgcgggatcttgtttctcaagtagaatctctcagaaaggaacagtccgctcttctaactgagcgtcaatacgttggttcagagaataatgagctgcaagaagagaatatcatgctcagagcccaaatattagaactgcataatgagatttgtgcaaggatgggaaacaaccgcctcaatcaaagcaatcttgcgatgtcacaaccagtagccaacaatggcagtaactcagcaactcaacccgttccacatcacatatggggcaatggtccgaatttagctatggtgcacccaacaaacacattatctccgttgcacaatcagcaccatcagtctgctggtgccagccaggtttatgcgtcacggcctcaggagctgcagctctttccagggacctcagtatcaacagagcgagaacgatcccgagctggaagtggaagcaccccggctacttcttcaggcctgacggattctttgccagggcagcttcgcctcagcctcccgcaatcttctcaagaagaaaacagcagcggcagcaagaaaggtcgaaaaaagggctagccggccagttgacacttgacagttgctaaaaaagaatcgataaatcgatacttggtgaatggtgatagttacacactcctgtaaatactgcgaagcgcttactgatacctactgtgatagttgccctctgttgtaatttgtatttgtagtgcttgctctgaaacttagatcacgtttgactatagttttccacttccagtccttttacggatatatgttgccatattacagagttgtttaccaggaagagagaaaaatgatgcaattcgatagcagtgttaactgatgataattatatgatccctgtcaccaagtcatgaaaatctgatcttgtatgttcatgggcagcttgtttcagcattacaagttgaagaaatatttgtaatctgttgcaaactgcatgtttatggctatgagaaatgatc

SEQ ID NO: 5426 - DNA, 1216 bp, Oryza sativa; identical to SEQ ID NO: 5423
  Predicted polypeptide sequence is orthologous to G783

SEQ ID NO: 5427 - DNA, 406 bp, Oryza sativa
  Predicted polypeptide sequence is orthologous to G789
ccaacgccaaggccaaggttaccaccgaggtctaaatctgtggtacatgagactgagctttggagagatggggacggaccagttcttccaccagcaatttttacggcatctgtcactattcgataaacgaagccagcaagaggcacgattgggatcagacagcccaggatgcggtggatgtgaactcggttggaaggaaaagaaaaatatttcctggcggaagttgtggtgtttcccggccggttattactcattgggaagggcagcatggactttgctgtttctggttgcagatcgcaaagggcgaaaagggacctgcggctggctttgcatggatttgcggatcagacgttctctggcaatgtatgtttggttgctagaggaagaatatgacgcacctgaaatg

SEQ ID NO: 5428 - DNA, 1539 bp, Oryza sativa
  Predicted polypeptide sequence is orthologous to G8
atggagttggatctgaacaacgtggcggaaggggtggtggagaagcatgagacggcggcgaggagcgactccggcacgtcggagtcgtcggtgctcaacggggaggcgtctggcgcggccatcgcgccggcggaagaggggtcgagctcgacgccgccgtcgccgccgccgcctcccgcggcggtgctcgagttcagcatcctgaggagctcggcgtcggcgtcgggcgagaacgacgccgacgacgacgaggaggaggaggccaccccctcgccgccgccgcaccaccaacaccagcagctgctcgtcacccgggagctattcccttccgccgctccctcgccgcagcattgggcggagctcggcttcctccgccccgacccaccgcgcccacacccagacatcagaatcctcgcccacgcgcctcccccggcgccaccgccgccgccgccgcagccgcagcctcaggcggccaagaaaagccgccgcgggccgcgctctcgcagctcgcaataccgcggcgtcaccttctaccgccgcaccggccgctgggaatcccacatctgggattgcggcaagcaagtctacctaggtggattcgacactgctcacgcagctgcaagggcgtacgacagggcggcgatcaagttcaggggagtagaggctgacatcaacttcaacctgagcgactacgaggaggacatgaggcagatgaagagcttgtccaaggaggagttcgtgcacgttctccggcgacagagcaccggcttctcccgcggcagctcaaagtacaggggtgtcaccctccacaagtgcggccgctgggaggctcgcatgggccaattccttggcaagaagtacatatatcttgggctattcgacagcgaagtagaggctgcaagggcttatgataaggctgcgatcaaatgcaatggcagagaagccgtcaccaacttcgagcccagcacatatgatggtgagctgcctactgatgctgctgctcaaggagccgatgtggatctgaacctgagaatatctcagcctgcagcctcacagcagagccccaagagggatagcggctcccttggcctgcaaatccaccatggatcatttgaaggttctgaattcaagagagcaaagaatgatgcagctccctctgaacttgctagccgccctcatcggttccctcttctgaccgagcatccgccaatctggactgcccaacctcatcccctattcccaaataatgaggatgcatccagatcatcggatcagaagaggaagccatcagagggggtagctgttccaagctgggcatggaagcaggtgagccatcatcaccctgctcctcctcacacgctgccattgcccttcttctcctcctcctcgtcgtcgccgtcgtcgtcctccgctgcagcatcatcaggattctccaaagccgccacgacagcagctgctgcccaacacactgccaccctccggttcgacccgacggcgccgtcgtcttcgtcgtcaagccgccatcaccaccaccattga

SEQ ID NO: 5429 - DNA, 1392 bp, Oryza sativa
  Predicted polypeptide sequence is orthologous to G811
atcccgcatttcctccattgcataccaacaccaaccactgaactagcactactagtatagcaagaagggtgatgacgacgacgacggcggagggcggtggcggggtggcgccgttcgtggcgaagacgtaccggatggtggacgacccggccaccgacggcgtcatcgcctggggcagggacagcaacagcttcgtcgtcgccgaccccttcgccttctcccagaccctcctccccgcccacttcaagcactccaacttctccagcttcgtccgccagctcaacacctacgggtttcgcaaggttgatccggacaggtgggagttcgcgcacgtgtcgttcctgcgcggccagacgcacctgctgcgccggatcgtgcgacggagcagcggcggagggggagcgaagaggaaggaggaggccggcggttgcggcggcggaggggaggcggccgccggggacgtcgacgaggagagcgccgtggtggccttggaggtggcgcggctgaggcgggagcagcgggagatcgagggccgcgtcgccgcgatgtggcgccgcgtgcaggagacggagcgccgccccaagcagatgctcgccttcctcgtcaaggtcgtcggcgacccgcaggtgctgcgccgcctcgtcgacagggacaacaccaacgccgccgcctccaacgccgacgactccgccgtgcatcatcaggtcaagaggccgcgcctcctcctcgactcatcctccaccaccaccacccacggcgaccgccacctcgtcaccgccgccgcagacgggttctacgccggcggctgcggcccggaggccgcagctgccgccgcgttcgtgccggacgacgcggtcgacttcaccggcctctacaccggcggcgacgggttcggcaacgccgtcgtcgacgccggcgtcgactacccgccggcgtacgcgttcccggtggtggacagcggctactaaagctgtaaccgctttgagattcgtgctcttgttgccgatccaacgatttgtgtacgcagtagtattttccgtttcagtttgccctccccaaagtgtttggacgaagtggctgtgaacggcgaaagaaggaagctaggtagctctcctagtagccatgttgggttttttcccccttgttgggggtttttggtctcggtgtgtgcctgacttgtgggccagccgggtgtatatgcgcaagcaaaaaaaaataatagtactggtagtatctaagttcaacaaaatttgctccgtttgaacaaaagatttcaaaaactacagaaacaggaaaagcacagtattaggaatcgaatgttggaatcgaatgttgagtgtgccttgtttggatggttatgaaaggaaaaatattttttaaatgtttggtacc

SEQ ID NO: 5430 - DNA, 1573 bp, Oryza sativa
  Predicted polypeptide sequence is orthologous to G811
gtccgtgcgtggctttgccttttgagggatttgacgtgtaggcaaaagctatagctcggagcagtggagtggcttggcttggcttggcttgctgctcggtcgatcgatcgagagatggacgggctgcacacggagctcgcgctggggctgatcgggtgctgcggcggtgacgggcagcagcagacggcgccgttcgtggcgaagacgtaccagatggtgtgcgacccgcggacggacgcgctcgtccggtgggggagggacaacaacagcttcgtcgtcgtcgaccccgccgccttctcgcagctcctcctcccctgcttcttcaagcacggcaacttctccagcttcgttcgccaactcaacacctacggattccggaaggttcaccctgaccggtgggagttcgcgcacgagtcgttcctgcgcggccagacgcacctgctgccgcgcatcgtgcgccgcaagaagcgtggcgagggcggcggtggcggtggcggcgcgtcctgctctttcggtggcggcgccggcgagcaccaggtggctgctgctgcggccagcgtgggaatgtcgggagaggaggaggatgcggcggaggacgtgctggccaaggaggccgcgctgttcgaggaggtgcagaggctgcggcacgagcagacggccatcggggaggagctggcgcggatgagccagcggctgcaggcgacggagcggcggcccgaccagctcatgtccttcctcgccaagctcgccgacgaccccaacgccgtcacgggcctcctcctcgagcaggccgccgagaggaagcgccggcgccagcacctcccttcccacgagcccaccgtctgtcccctcccgccggcgccgccgccacaacctccgcagccgctcctggctctcgccggcgccgcggccatggacggcacctactggtggacgacggagcatcatcatcatcatcatcatcagatgaagcccatgacggtgttgccatccttggagccgcccaccgctagctgcggcgtgcaccaagtgccggagctcgggggtggcggcgtgatgggcttaacgacggacggtgaggccaaggtggagccgccattcccattctgtctacttggtcaagctttcttttaattaacctgccgaatcatgcccatgcacgtagtaattcttccattccacttactgattcagtcactcgatcctacgtacacactgccaagaaaaaaaaaaacagatgttagttctggtgcaatgcatgcagtaacaccagcatcgatcagtacgtgttgatctgattattcttacagggtacagattagattacagacgatggtgtaaaaccttaattactactgtgtacttatgtacaacgcatcaaacaatagtggtacggtgttgattactagtacttttttgattgctagctgatagttaattagtactactattattagtaagtagtgttttcattaggtggatgcatggacatttcttcttgccctccaagtttgtagggttcatgatttcatcaaagtgcttatattaatctctgctgcataacttttgctgg

SEQ ID NO: 5431 - DNA, 1102 bp, Oryza sativa
  Predicted polypeptide sequence is orthologous to G811
ggcgcgctcactccctcccttgcccccaccgacgaacggaacaaatcttagcgaggaaaaagcgagcgcttttttcttatcctgttccgcgggcgcgctgccacgaccgaaccgggaggatacttgcgaattacacgatcggttgtggcactatgatgggcggcgagtgcaaggtccaccagctccaggccgccggcgacgggggcccaggcgccgtcgcgccgttcgtggcgaagacgttccacatggtgagcgacccgtcgacgaacgccgtcgtgcgctggggaggcgccggcaacacgttcctcgtgctcgaccccgccgccttctccgacttcctcctcccctcctacttcaagcaccgcaacttcgccagcttcgtccggcagctcaacacctacggattccgcaaggtggatccggacaggtgggagttcgcgcacgagtcgttcctgcgggggcaggcgcagctgctgccgcggatcgtgcgcaagaagaagaagggcggggcggcgccggggtgcagggagctgtgcgaggaaggggaggaggtgcggggcaccatcgaggcggtgcagcggctgcgggaggagcagaggggcatggaggaggagctccaggccatggaccagaggctgcgcgccgccgagagccgcccgggccagatgatggcgttcctcgccaagctcgccgacgaaccgggcgtcgtgctgcgcgccatgctcgccaagaaggaggagctggccgcggccggcaacaacgggtccgatccctgcaagaggcggcggatcggggccgacacggggcgcggcggcgtggcgaccggcggcgacgcggccgagatggcgcagagcagaggcaccgtgccgttcccgttctctgttcttggccaagtgttctactagccgcaacagggccagataggtgtacacgtacgcagtcccccgttgtatatataacaacagtgtaacttcgcctcggtttagttgcctactgttaagttagtgtacttaagcataataggagagtttggctaagtagctatcgttggatttgtgtgtatatatcgactatcgaggggctaataacgcctattttgttc

SEQ ID NO: 5432 - DNA, 412 bp, Oryza sativa
  misc_feature (405)..(405): n is a, c, g, or t
  Predicted polypeptide sequence is orthologous to G811
gatcgcttttgctgtactttgccttccgcttttcttcccctctcccttaccacatttaggagcccgcccccccccccccccatcacatatctccatctcgatccgcaacaaagatagtttgtagcggagatggcggcggcggcgggaggaggggcggcgccgttcgtgtggaagacgtacaggatggtggaggaccccgggacggacggggtgatcgggtgggggaaagggaacaacagcttcgtcgtcgccgaccccttcgtcttctcccagaccctgctccccgcccacttcaagcacaacaacttctccagcttcgtccgccagctcaacacctatgtcagtctcgtcactcccagttctatttcatcgtctcatcatactccccccctctctgcacttcanatcatgc

SEQ ID NO: 5433 - DNA, 3215 bp, Oryza sativa
  Predicted polypeptide sequence is orthologous to G812
attccattcgacaaactcgacatcgcgctgcgacgctccggccgacgcaacgcaccgctacaaacgcattctcgagtccacctgtgctcacctcggtcgttcctacaccgactcggtcgactcgtcaatgtgcgcggctttggccagcattcgctcttttcacctctcgtgagcttcggcattggccgagcatcatatcgctccttctttgcaacgcaaccaaatccttccatcggccacggccggtcaacgtctcagctgcaattcagccttcgcctcgtccggtcctcggcaagtccgaaccaagaatcggctcgattccgcacaggtgcttccgcctacatcgcttcgccttgctccatccttacgcctcgtaagcttctcttcgccctcttccgtgcgtgtcgaagacgagtgtcgattgctcgctcgaactcgtctgcacccatccttttccaacgtgacaatcgcccggtaaggccgaacgacaatctcacgcacaacgccgaaaagatcgctgtcgacagctcctgcacccgcacttgccctctgcgcagcatcttctggcctgttgccggagcaggaacgtagcgctcaagcaggccgtcacgcccatcattgatacccttggtgcgccaccgacgctcgccactcgcagctccaggacgccgttcggttgcctctgtggtccgcctttgctcaacatgaacggcatggaacacggtcaaagctttgaccccgcctttgatgccttctttcaggctccgtcctcatcctctccacatcaccaacttcagcattccgccgccggctcgcctgcgtccatccagcagatcggcaacatgagcgcagccgactcttcgctcagtctgtacgctcaagacacctcggcgatgcgcccgagctcctcgtcgggcggcaatctccatctcaacatctccaacctctcggtcacgggcggtgaagccgacgcctcacacgcacaggcacaccagcagcagggcgtcgccagctcgctcagtttcgcgcctaacaacacggcctcacctcagtccaccctcgcgtcaccggccgatgccactgcttcattcaacatgcccagcaccacatcaacctcgccgctcttgcatcctgatgcaccggtgggcacagccacagaagcccacctcggcgttcctaccgcatcgtctcctctcaagaccgagtacaacctcggaaacgagtcggctggcctgacgtcgacgatgcgctcctacagctctacttcgatcaaaagcgccgcgggatcgcagaatgccgacagcccaagctccggcttcggtgccggcggcgcggcaaatcagagcatgggtgacgtctcgatcgatgatgccaatgtcgctagccagtcggaagccgagctggcggccgagaaacgccaaagcagcaaatttgtctacaagctcttccgcatggtcagcgaccccgactaccagcatctcatcagctggaaccgcaacggcaccagcgtcatggtgtgcaactttgacgagttcgccaaggaggtgctgggcaagcactttaagcacagcaacttttccagctttatccgacagctgaacatgtacggcttctacaaggtgaacaagacgcctcgcggccatcgacagtcggtggacgcgcagatctgggagttctcgcatcccaagttcctgcgcggccgttcggatttgctcgatgacatccgtaggaaggccctggactctgaacacgcgcgggtcgaagctcgcgatctgcagtacagcgtcagtgtggggcagatgcagctgcgtcagcaggtcgacgagatgcaattccggctcgaggagctcacagagcagaacatggcgctgcgaacctttacaacccaactccgagacgtgcttggcctggtgctcgagcacgtcaaaaagacgagcggcggcaacattggtttcgacgtgcgcatccccacgctggacctgccctcgcccatgccgccgcaaggcctgtggacgccgcagggtcacgatggcccgcctatctttgtcaccgagcccgagttcggcgctggtgtcggaccgggtgggctgaggatgggcccgacgcctggcatggtgcctgggccgggccacgctccgccaccgatgcatgcaccccaacaccactttggcggtgcgccggatgggttcgccatgacgggcacgcccatctcgcgtcgcgtgtcggcgagctcggcgcatagcgagagcatgcttgccatgaacggctcgcccatgcacggatcgatgcagggtgagatgggcatgctgcctgctggtctgccgcagcgctcggcttctttcggcgagggacagatgcctgcaccccacttcaatatcggccgcggcggcgtcaaccgaccgggcctggcggggctcgcaattgacacttcggctgcatctggcatgtttggcggcatgcatccgagcgtgagcccgacatcagcagggctatcggcaagcaatgcagggctgggcgtgatgagcatgccgccgtcgccgctgacgccacagcatcaagcgatgatggcagcgatcaacactccgctgcctccgtcgccggcgccggggtcattggcgggtggccagttcaagccgttcgatggctcgccgttcgtgaccaataacggattcccctcgtacggccatggtctttctcttgccgaccagagcttctttgggccggaggccgatggtcccaatgccaaggcgatgcgcacgcccatgaagcacacggcgtccaattctgggcctagcgcgcagggcacgccagtgctcatgcagtcaacgtcgcccgggcttgccaagcgcaagtcgccaatctgaacgcgatgtcttctttgatacccgggtggctggcgcacgtcgtcgccatcccagtgattctccccttcgtttgtctccacaatcctttcccctcaaggacatcccctgaacccaacttctcttcttccctctccacgattgtgcctacgctggcatttcccaccatcttggccgactgtggctttcccctcagcactgctggcacagtgtgcagcggggctagtgtcgggagagtctgaccacgctcgttttttcgatttgatcccccctctgtctctccgccttgcggcctgtacaagttcggactctcgtcgtcgtttaatgcccgaagtcaccttctgtacctttttt

SEQ ID NO: 5434 - DNA, 1874 bp, Oryza sativa
  Predicted polypeptide sequence is orthologous to G869
ggctcctctcgccgttttggtcggggttttagcgagcgcgtgggaggccggaggcgacgacgacgaccgcgccgccgtcggagaagaaggccgcggaagcaccagtaccagcacccgtatatgtcttctagccccttctccgatctggtggtagtcgtgctcctcgtctgcgccgtcgtcgccgcagccgtcctcctccccctcgtctgcgcccgccgatctatgcaccagaggctccacggctggaacaagtccacgtcgatgctcagggacgggttcggggtcaagtattccgggttcctccacataaggccgtgtggtttctgtcgaggagattgacggattcgatcgattcgtgttcgtctccgtcaaatttttgcacaagagaaaaaaaaagtttcccccttttagagtttttccccttcagttttgtcagttttggtgaggaattttagagttcttttccggcaagagttagaagaagagagaaatggccccttccaagcagcagcagatgctcctcaagaaggtgatggcgaagaagcccaagacgaagaggctatccgggtttggccttaaaccctctgctgctttctccaggccccatgtgccgtcggcggcggcctccctgcagccaagccgtcgcgtccgcgtcgtgttcgaggaccctgacgcgacggactccgactctgacgacgacgaggacgccggcgccgcctcaaagaagcgctactttgagctcttcattggcaagccagcttcgtcgacgaagcaggcctctccggcgtccaccgtcgctgcctacgccaacatcggcaaggttgggagcacctgctaccgtggtgtgcgcctccggaagtggggcaagtgggcggcggagatccgcaaccccttcaccggccatagggagtggcttggcacctttgacactgctgatgcggcctccgccgcctaccagtctgcctcccgcaacttcgccgaagagaagcgccgccgtggtgtggcctcctctgcctcacctgctagttcggcgacccctactccgactgcgtcctcgtcgtcctcgacttctgccgcgccattcgcccacccttcgccgtcgtctgtgctcgaagccaccaagccagctccaaagccagagtcgccgccgctgccggagcaagctgcaactcccctcctggtggaggctgccaacgagaccgccgagctgccggatgacccagagttctacaaggatatactgcgcggtctacagctgccggacattgacccgatggatttccgagctgggctggatgctctggatatctccgatgtgccggcttacatgaatggcgaacaagacgtactcttcactgaggacatgctgcttggagacttcgctgaagaagatgacctcgacctcgacgacatcggtgatgacttctgcgaggatttcccagagatacccagcggctacgacttcggccgtggtgatatgttccggcaggtggatttctgcgtgtgaattaagagcttgctaaagttattcatgttggtgtgatgggcctgtgagtgtgggtgcttgggaggagatttcttgggttttttccccgagcaaaatcaatctgctcgtgcccttgagatttcagttccgcccataagaactccaacgcacatttagcattcggagagtaattttgttaggttaaaagtatggtaagttataggtggtatgttatgtttttctttttcttttctcaatgttatctggtacctaagtttgtcaagaaaatcatagtggacaagtcaagtatttggggctgtcgtctctgttatggaaagaaaaataagttttgattacattacatatcttttgctctcgagatctggcc

SEQ ID NO: 5435 - DNA, 2123 bp, Oryza sativa
  Predicted polypeptide sequence is orthologous to G869
gacacatcacacgtttcgcctccctcctccgctcgtcttcttcattctctctccttcgcttcgcttccaaatcgcccgcaatttctcccccaaaaacctcccctccccccaccaccaccattaataaacccctcctcctcctcctcttcttcctcctccgcctcgccatctcaccgccaccgcctcctcactcactcacttcctgccacgtcattcgcgccatcgatcgcgtcgtcgcctcagctgcctgtaagtgagaggaagaggaggagtagagctcgtcgtctccgccgccgcagctggtgctcgctgttgatttatgtcgcctgctctacccccgtttctccatggttctgagctccagtcgccgccaacggtttcttcctgctcccttctcatcctcctccttcaaaattggtatacgaggggcgcaagaacacagcaaaatcccttcacgatctccagatttggatttggggtgaaatactttggctttcttcgtttagactggtgacaattgaagatagcccccaaattgccttaagatttggtttggcttgagtggatcaagtacagaatccgaacttttgcaacctgacattcttctagttcacaaagtcggccagatttgagatttctctcggacatctctgtacacacaggagctctcttttgctccagttttaaacagaagttggacaaaggctctgtttctggttttttgagtttctgcgataagcttagagagcagacaacaaacttttgtcctgattcatctaaactcttacctgactgcaatcaaggccaattgtaatccaataatctctgatcttgttctggttgcacgttgagatgatggtgccctcttcacggaaagtccgtgttttctgctctgatcctgatgccactgactcctctgatgaagatgaccagaataagaaggaaaggagattttcaagggaaatactaattccaatggaaaactccaaggcatccaaacctgttaagacccttgttcaatgtggcacaaagactgtaaaggattccgagaaggaaccgacgagcaaatacaggggtgtgcgccggcgggcgtggggcaaatgggctgcagaaatacgtgaccctgtgcgaaaatcaaggaaatggattggcacatttaacagtgaggaggaggccgctgcggcatatcttgcacaatcaaaccagttccatgaagagttgatggccttgaaaatccaatcttctgtatcagagcaggaagatttgtcaagctctgttactatatcctgcgtgtcctcatctcagtcatgtgaccagaagattcaggcaaagccacaagaacacaagagagtgtcagtggtggttaaccgtgagaccgttgagcagaagtttaaggcacagccacaagctcagaagattaaggcacagccagaagtgcagaagagagtgtcagtgaagattagccatgagactgaggatgagcacttgctgaacttgccgtccacgcctaaaggcaaagagatttcgatgggcgctgttcttggcaggatagatgagattcctgtgagcaactgtgtgggccatattgatgaatttccacctgatgatttcactaggcttgcagatgcgttcccagttagtgattttatcggcatggcagatgtgccactgggcgatgattacattggccttgcagacatcagccacctgccgctgcctatcacagatctgaagttcgacctcaatgcagaactcaactgggacgggttcgactttgcttcattggaacaagaactcaactgtctttgatggcttgaatcctgttctatgtgaaaacctcttgttgattgaattgagtgcaggaggtagattcaggtatccatctttcacattgctggcaggccgagtgtatgatctggagattttcatctccaattttgccggaaaattgtacagtccccctacggcaaacaaatgagtaccgcagtatttatgtatatgttcaccaatctcaaaaatgttaatgagattgtggtgacagaccgtccttgatctcagtttggttgtgtatttgttggacgccattattatatttgttaattttgatattgttcttgtgatcc

SEQ ID NO: 5436 - DNA, 706 bp, Oryza sativa
  Predicted polypeptide sequence is orthologous to G869
aagcactttcgaagctaaggatacagtacatgcaggtattgagcaattaacatcgtgttccccttacaaggtaaataattttgaggcacatattgttgaagcagactccattgatgaatttaactcattgtttaagtgtcgtatggaggaagtactagtgcaatccatctcaaagtccagtatcagtcaacccttgacagttaaacttgaagatgaattgagtgaaccattatctccagattctgggactgggacacatttcattgacgggagttcagttgaagattcggatccacgatttgcacagctcaatgatgaagcactggtatcttctacttctaacgcaacatgtcgtaatgagtcaattgaagagaaatcaagtgaagcattactggcaggaaacgaagattattcagaactgccaaatgaactgttaaaatcaggagatccacagactgcagatagttctgagattcaagtgcaggttattgatgctacaggtcactgaatgatgagacaagggcctaaaacaaggccaaacagccaatttctcagagagatctgtaaagcatagatagtccagtattagttctctgaaccaggtttcttgcccccctttgttccaacttgctctatggcgtctggatttaacttttcctcttcttaatacaaaatgtgcagcaatcatgctgtttttcttcaaaaa

SEQ ID NO: 5437 - DNA, 1347 bp, Oryza sativa
  Predicted polypeptide sequence is orthologous to G896
agcagctcatctcaacacgcgcgcacggggcggcatggcggtcgtcagcggcgggaagcgcgcgctcctcgtcggcgtgagctacaagggcgacaccagcagagagctgacgggcgcggccgaagacgtcaagaacatgaacagcctcctcaaaaaattcctcttccccgaggaatccatccacatgctcaccgaggagttgggcgccaaggacccgttgaaggcgccgacgagggagaacattatgaaggagatgcggtggctggtggaggggtgccgcgccggcgactcgctggtgttccacttctccggccacggccggcagaggaaggacgacaacggcgacgaggtggacggccgagacgaggagctctgcccagtggactacaaggtgagcggcaacatcttggacgacgacatcaacgatgccatcgtcaagccgctcacccaaggcgtgaagctgcacgccatcatcgacacctgccacagcggcaccatgctcgacctcccctacctctgccgctttaacagaatgggtctatgttcaagatacaagtgggttggccaaacgcgttggcgactatccccaaagaaagagtgggcgatggtccccgtaggcggccacgccatctccatcagcggctgcaaggactaccagaattctctagagccagacaacaccgccggcggcggcgtcatgacatggagcttcctggaggcagtgggatcgcggaggacgatgacgtatggggagctgctggactcgatgcgggcgaaggtacaccataggttgcagcaaagcagctccggcaagtgcctcgtaacgggctgcctcggctcgctcgccgccaagtgtctcccctgctgcttcctcagcgtgcaggagccgcagctctgttcgtcgaaggagttcaacgtctacgaggagcagtttatcctgtgaccgaccgcattgtcccgggcacaagctccattcagatgaaaacctctgctcctccagctccattctaattgcggatgctggatatcatacacgtaggctcgctttcttaaaataaaatttaaatattattgttcgtagaaaagagtatgatagtgtgatatcaaaatgtggacgaggaaaaaaaccgtgttctaagtatcgtgtattagcgaaggatatatgttgctctgttgctgcggccatggccatgcatgtgtgttcttacaaaaactcaagcgtgtgatcatatttataataaggtagcgcagagcgacggattggaactgaaattgtgtaattgagcgtgtactttgtattgtccaaatctgtttttataatttgtaagtttgttaagcttcggtcac

SEQ ID NO: 5438 - DNA, 1137 bp, Oryza sativa
  Predicted polypeptide sequence is orthologous to G896
atgatgatgctgatcgactgctcgggctgccggacgccgctgcagctgccgcacggggcgccctgcatccgctgcgccatctgcggggccgtcacctacgtcgccgccgccgcgccgccaccggcccacggcgaccccgcccgcggcgccgcggggccgggggcggtggcgccccagcaccaggcgccggggtgggggccgcctcccccgcccgcgcacgggcggaagcgcgccgtgatctgcgggatctcctacaagttctcgcgccacgagctcaagggttgcatcaacgacgccaagtgcatgcgccacctcctcacgacgcgcttccacttccccgacgactccatcatcatgctcaccggtaactacccgatattacctccctattggttgaattctggttcggaagaacaaactgacccttacaagattccaacaaagcacaacataaggatggccatgtattggcttgtacaaggttgccagcctggagactcattggtattccattattctggtcacggagcacaacaaagaaactacagcggagatgaagttgatggaatggatgaaaccctctgcccattggattttgagacacagggaatgattgtggatgatgaaataaatactgctcttgtcagaccacttactcctggagttaaacttcatgcactgatagatgcttgtcacagtgggactgcacttgatttgcctttcctctgcagaatgaacaggagtgggcaatatgtatgggaagatcatcgacctcgatctggtgtctggaagggcactagtggcggcgagtgtatttcatttagtggttgtgacgatgatcagacatctgcagatacttcagctttgtcaaagatcacttcaactggcgctatgacattttgctttatccaagcaattgagcgtgggcagggcaccacctatgggagtatcctgacctccatgcgttcgacaatacgcagtacaggtgattcaatgggcagcggaggtggtgctgtaacatcgctaatcacaatgcttcttacaggaggcagcgttagtagtggcggcttgaagcaggatccacagctaactgcaaacgagccattcgatgtgtatgcgaagcccttttctctatga

SEQ ID NO: 5439 - DNA, 855 bp, Oryza sativa
  misc_feature (231)..(231): n is a, c, g, or t
  Predicted polypeptide sequence is orthologous to G896
tgcgcgttaacgactcaccacgagccgagccgagccaacgaagaaatcgttgccaaccaaatcacccgccgattcgcctccccctcctcgccggcggcggcgaccccgcggcggcggagagatgatgatgctgatcgactgctcgggctgccggacgccgctgcagctgccgcacggggcgccctgcatccgctgcgccatctgcggggccgtcacctacgtcgccgccgnccggcccgcaccgtgcccacggcgaccccgcccgcggcgccgcggggccgggggcggtggcgccccagcaccaggcgccggggtgggggccgctcccccgcccgcgcacgggcggaagcgcgccgtgatctgcgggatctcctacaagttctcgcgccacgagctcaagggttgcatcaacgacgccaagtgcatgcgccacctcctcacgacgcgcttccacttccccgacgactccatcatcatgctcaccgaagaacaaactgacccttacaagattccaacaaagcacaaacataaggatggccctgtattggctttgtaccaggttgccagcctggagactcattggtattccattattctgggtcacgggagccacaaagaaactaccgccgcattagtgcatgcatggtttaacctttgccattggatttgggcccccgaagattgggtaagacaaaaatcggctgggaacaccctaacccggagaacacacccggaagggcgattcatcgttagcgggggtaaacaaagatccggggggaaacggtgcccgaagacctgaccgggcgataggccccccaagcgagtaggaacgcggttgtcctgtgtgataatatt

SEQ ID NO: 5440 - DNA, 1558 bp, Oryza sativa
  Predicted polypeptide sequence is orthologous to G904
aagatgacaatttgacacgaaagccttcctgtgcctttttatggtaattacgtttatacccctgcgatccaccggtacagcaccatgaacgccgtctcctcctcctccgtccccggcggcgacatcctcaccgcctccgcgtcccacagccatggctcctcctggctgtggctatggtggctctggtagctctggctccaccgggagctccaccgcccggagaaggacgatagggatgacgcggaggtggccagccgttccacgtactcccgcagccagccgcgcgtcgcgcccgccgcttcggccaccgcctcgccgggaggcggtggagactgctcggctgctggcttgtcttccttgactgcggcggcgctcctggttgtcatgggcgcggcgcgggagacgacggcctcgacctcctcgtcgatgtggtagtcgaacgtgccgagcgagtaggtggggcgggcgttgccgccggtggccgtcgacgcgctgcggttgctgacgctgcccatctcgacgcggaagctcctggaacggtccctgctcctcggctccggcggcggcggctgctcggcggcgaggatggcggagatcgaggggtgcgggagcgtgacggtggcgcggcagagcgggcaggacggggtggtgcggagccacgcgtcgacgcaggcggcgtggaacgcgtggcggcacgccgggagcagccgcagctcggcgtccagcgtgaacggcgacaggcagacggcgcagtccggtgagctcttggggagcgccgccagcgacgacgccatcgtgaacagcggcagcgactcgatcagccgctgcttctcgtcgcccaccacctccttcttcccctcacaaaccccattacgccgcaccggagaagcgtccgccgcctcgacgttgtgcacctcacggcgcgtccgtgggagcggcggcggcggcggcggcggcggcgacgacctggacagaagtctgagaagtaggtggatcgagaccgacgctagtagaacgaaggcaagaagagcagcgatgatgaggagagacgggaggaaggacgaggcggcgtcggaggatccggtgacgggatcggcagacggcggcgacggagacgagagagtggacgccatggcgaggcttagccttagcttgagaatggtttaacttaacccgcccgggaatgagacctctcgcgccttttatccccgggtttctttggagtgcgcggtggtggtggtgcggatgcagaggccggaagtaaatagtggcgggtttgcactctcctgatggagagatcccagaaatggtggaggtcagccttggaaaccaatccacgtctcggtttctacttttctacctctgcctgccctttgcaacctgaaattctgctactactgctacgtggaaaatttcgcatagcagttgagcagacagcagctcaactgtttgcaattcgatagtttgttgcacaatagtacaatgttgtacactggttagtgaacttaagtacgtgcaaagaatcaaatccgcagtaaaaatactgcattacagcagc

SEQ ID NO: 5441 - DNA, 1562 bp, Oryza sativa
  Predicted polypeptide sequence is orthologous to G904
agctcaccttcctcctcaccgccaagatcgcaagaacgcaacaagagaggaggagattgatgtcgtcttcggctgtgattccgccgccgtcgccggagaggagggtgccgatggtggctgtgccggtggtggccgacgatggaggcggagggcatggggcgaagggggaggagagtgtgagcgggagcgtcgcgggcatttcgccgagcatcctcatcatcgccgtcatcgtcgtggtgatgctcctcgcctccgtctccatccactacttcatccgccacctgtgccgccgctcgtcggcgtcggcggccgcgtcgtcctccgcgccggtgctccccgtcgtggtgcgccccgcgtcgtcggcggccgtgggggagcaggtggtggggaaggcgtcggcggagcgcgcggcggagatggagcggctcatctcgcggctgccgctgttcacgctggcgtcgtcgctggcggcgctccccaagtcgtcgcgcgactgcgccgtgtgccagagcgcgttccgcgacgacgacgagctccgcctcctcccggcgtgccgccacgcgttccactcccgctgcgtcgacccgtggctccgcgccaacccctcctgcccgctctgccgcgcctccatcgcgctcccgcacccgcccctcccggacctcctccgcgtcgagctcggcagcgtcagcagccgccgctccaaccccaactccgccgccgccgtcgccagcgcgccgcccgagggcgccgccgtccgcgcctacccgctccccaccctccccaactccgagtacctcgtcgaggaggagctcgaggtcgtcatcaagcaacccgccgccgccgctgcgccaagaaccggcgagccaagccagcatccgctgccggcggcgcaggcggagcgtgggcagccgtcgtcggtgaccccgacggcgtcgttcagctcggcgaggtcgcaggagcggtggagcaacaggtggagcagcagatggagcagccggtggagcagcgggcggtggagcagccggtacgacgccggcacggtgacggcggccgccacggcggagtggtggtgggacatggacggcggcgcggcgcccgccgcgcggcggcgcgaggtggaggagcagggcaacgcgttccacggcttcatgcgctggctcacaggggcatactagtaatttaccactcgatcaatgcccagttcactcgctcgtcaacctcgccggcgccggcgatcgccggagaattgaattcaactgaatttgaaatgaattatgaatttctgatgcggctcggctctgcttttgggcattcgtgattaggagtaattaatagtgtctccttttctcttttttttggctgtgaattcttgtattatttttttcttgagtgcgtggatttcgagggtggaggatgcatatggtgggaaggtttttgatgccgtacggatttgaaaactgcttcttcctccgaattggagaatgtcggcgggaagattgaggaattcggggactttgaggcaaatgaactgaactgcccaataaaaaaacagaattatttcc

SEQ ID NO: 5442 - DNA, 1296 bp, Oryza sativa
  Predicted polypeptide sequence is orthologous to G904
atatctgtttagagcttttctggtgaggactaatacagtgtggtttgttcactctgttgtttgtttgaaggcaagaaaaagaagccgccatggcagtggggagaaggggatgaaggaatacttagacacgtggcatgatctcaggagccgaggggcctcaagtcggtacagctattgaaccaagagagcaagaaccaccggccgtgaagttcgcagcggggaaatggaattcgaggaggattcggcctccttccatggcggcgagggcgtcaccggcgtactgcgctggcacacgacgacgctatcggattcgcccatcggcgattaagaacccctctcactgggccacgacgtcaccagcctcttctccttgtgccgcgacttccgccggtgcagggttgtgattccgaaccccatctacggcggtgacgccggccttctacatgtgcacaacaacaagaagacgctggccatccgcgagcaggtgtcagtgtcgcctggccgcgaacccggcgtcaagaacaggacatccgtgtgcaagcggcgtcctcggacgtttcatctcccttcgtctgcttctcagaagcagtgggctccatatacatcacattgtatcagattacaaggataggaatgaagaggaatatgagggaatgaacatatcactcttggaggaggcctcagtgcagaaggctgatgcaaaacctgtgtactgcacaaagtttctatctgactgggtttgcagcttaagaaattttaagtggaaagtagtggcagggattcaccaagcattagtaccgaatgaatacagttgggaagaagtaatgggctcaccaattattcaatacgcaggaggctgctcgctctcggcgtgcagtgtatgtatcgaccggcttgcgtttgagagaatccatgggagaggatcctttgcatggagggtagaatcaccccctgcaaaactcagaaaagaatgccttaagaggaatgcctggtcacaggaaagtggtgggaaatctgacagggtgctggatgtaatcattgacaacggagggctaccaacgactgacggaattatcatgttaccttggttgctttgcagcgtcaaatggtagatgtccaaaagcatttcaggggtggctcataatccggctgcaatagatttgatgctgcatgttttcatttaacactgtaaaatgatgaatccttctttgtgatgttgatcagggataagatgcccatactatatatgtttctttgtcatttgagatcaagcattatgttccatttacgtgaact

SEQ ID NO: 5443 - DNA, 1509 bp, Oryza sativa
  Predicted polypeptide sequence is orthologous to G904
atgttattaatcagagaagaacgagacggatacaactcatgtcctacacctccaaaaaccacatctcgacacagagaaatgacactgagaacaatcaaggtcagaaaaagcaaccaaagtcagagacacaaatcacagatgaacaaggaaagtagagagaaaaaactggacatgttcactcaccggaaagtaatctccgacctggtctctagtgatgtgtgtgcttgtgtgtgctctacttctactcgtctcacggctaatcacctggtatttgcgctccgatttcgctcgctctccgtgccaacgccgcgcaccccaaaacccataaataaaggcgcgagaccacacgcagggccgagccttaaacacaccgtctccttcccccccatggcctccctgccgccgcccgcgccgccggccatcggcggcgacccgctcgccgccaccattccgccctcattgccgtcgccggcgccgtcgtcgtcttcgctcaacctctccccgtcgcttctcatcatcaccgcgctcctcgccttcgtcttcttcgcctccgtgtcgatccacttcctcctccgctgcctcgcgcggccgtcgcacccggctccgagcccgctgcccagggcgtcggcggcggcccaacgcgcgacgacggcgtccgccgtcgaggctggggaggctaccgccgcgtcggcggtggggaggagccatgagggggaggcggcggcggggggtggggaggaggtcgacgacgagaaggagcggctgatcgcgtcgctgccgctgttcaccatggcgtcggcgctggcggcgctgcccaagagctcccccgactgcgccgtctgcctctcgccgttcgcgcccgaggccgagctgcggctgctcccggcgtgccgccacgcgttccacgcctcctgcgtcgacgcctggctccgcaccaccccgtcctgcccgctctgccgcgccaccgtctcgctcccgcacccgccactccccaccgccgccgccgccgccgcctccaacgcggcgcaacaggatcccctcgactcgcggagcagcaacaactcgaggagcttccgcgtcgagatcggcagcatcagcaaccgccgctcctccgccgcggccgacgaccggcgcacctactcgctcggctccttcgactaccgcgtggacgaggaggtggaggccgtcgtgtcccgcatcgcgcgccccgcggcggccaagtcaacgaccggttccgtgacgccggcccccggcgaggcgctggcggaggcggcggggtcgcggggatggctgcgcgagtacgtggaccgcctcgcctcctccgcctcgtccctctccggccggtggagcgggcggtggagcgcgcggtggagccagagccaccacagcaaccggcaggaggactcgtggcggtgggacccggaggcggcggtgatgtcggcgccgcgcggggtggacgacgacgagccgggcttcgtcacgctgtaccgttggatcgtaggcgtatag

SEQ ID NO: 5444 - DNA, 777 bp, Oryza sativa
  Predicted polypeptide sequence is orthologous to G905
atgtcctcgccggcggagaagtcgacgagcggcggcggcggcatgagcatgaacacggtgacgacggtgatggccttctccgtcagcgccttcttcgtgctcttcatcttcgtcaggctgctctgcgcccgcatccacctcagggcgggccaatccgccgccgcagccgcggcggcgcacggcgacgccttcccggccttcagcgtggagcgcgggatccgcgggctggagccggcggtggtgacgagcttcccaacggccaagttcggcgacggcggctcgcggcctcgcgcggcggcggcgctggaggaatcgcagtgcccggtgtgcctggaggagtacgaggcgaaggacgtggtgcgcgtgctcccctcctgcggccacgccttccacgtcgcctgcatcgacgcctggctcaggcagcactccacctgccccgtctgccgcgcctccctccgcgccgccgccgccaacgccaagcacccacccccctcccccgccgccatgctgccgccgcccctctactgcccccccgccgccgccaggccctccaccccggcccccgcgcgtgcaaccttccggcagcagcagcagcagctctccgccaccgcgtcctcgtcgtcggacgccgacgcgctccaaccggcggcagccgcagacgaccggctggagatcgtcgtctccgatgagcagcccgcgccgtccgccgccgccggcggacaggcagaagaacatcctcatcctcctcctcctgccgctgccgcgggccatcgatga

SEQ ID NO: 5445 - DNA, 1413 bp, Oryza sativa
  Predicted polypeptide sequence is orthologous to G921
actagctcatgcgcatttcggctctcgccttcttcgccttcttctcctcctcctcctgttcttgattttcagtatattcaattcatggattcgtggattgagcagacttccctgagcttggacctcaacgtcggcctgccgtcgacggcgaggagatcatcggctccggcggcgccgattaaggttctcgtggaggagaacttcttgtccttcaagaaggatcacgaggttgaggcgctggaggcggagctccggcgagcgagcgaggagaacaagaagctgaccgagatgcttcgggcggtggtggccaagtacaccgagctgcagggacaggtcaacgacatgatgtcggcggcggcggcggcggcggtcaacgccgggaaccaccagtcgtcgacgtcggagggcggctcggtgtcgccatcgaggaagcggatccgtagcgtcgacagcctcgacgacgccgcccaccaccgcaagccatcccctccgttcgtcgccgccgccgcagccgcggcctacgcctcccccgaccagatggagtgcacgtcggcggccgccgccgccgccgcgaagcgcgtcgtccgcgaggactgcaagcccaaggtctccaagcgcttcgtccacgccgacccctccgacctcagcctcgtggtgaaggatgggtatcaatggcggaagtacgggcagaaggtgacgaaggacaacccgtgcccgcgagcctacttcaggtgctcgttcgcgccggcgtgcccggtgaagaagaaggtgcagcgcagcgccgacgacaacaccgtcctcgtcgccacgtacgagggcgagcacaaccacgcccagccgccgcaccacgacgccggcagcaagaccgccgccgccgccaagcactcacagcaccagccgccaccgagcgccgccgccgccgtcgaccggcagcagcaagagcaggcggcggcggccgggccgtcgacggaggtggcggcgaggaagaacctggccgagcagatggcggcgacgctgacgagggaccccgggttcaaggcggcgctcgtcacggcgctctccggccggatcctcgagctctcgccgaccaagaactgatccatcgttagaacgccgatgaactttgctcgatttagctgagatcgatcgatcaatttacacggtaaaattttagagttgatcgatttgcatggctttgatcggagttaggctagagagagagaggattaactgtgtatatttagtgattgattttaattagctcgctctacacgtgccaaggtggcagtttaagcaaaacgtacgataattcgttgcaatttgtaattcagctagaagattagtgtattcatggagatctattcagagtctcccagatatatatatagagagagagatagtagcattgatgtt

SEQ ID NO: 5446 - DNA, 1343 bp, Oryza sativa
  Predicted polypeptide sequence is orthologous to G921
gaagtgtttgtacttggctttgctggcctgtttctgttttgattactcgagctccagagcacagcagcagagagacgcgagctgttcgtggtcgtcgtcgtcgtcgatggacgcggcgtggcgcggcggcgttggctgctcgccggtctgcctcgacctctgcgtcgggctgtcgccggtgcgggagccgtcggcggcgaggcacgagctgcttgaccggccggccggctgccgcggcggtggggattccaagtcgatgaccaatgacgaggcgaagatcgtcgaggcgaaggtcactcagatgagcgaggagaatcggcggctgaccgaggtgatcgcccgcctgtacggcggccaaatcccgcggctcggcctcgacggctcggcctcgccgccgcggccggtgtcgccgttatcgggcaagaagaggagcagggagagcatggagacggcgaattcctgcgacgccaacagcaacaggcatcagggcggcgacgccgaccacgccgagagcttcgccgccgacgatggcacctgccggaggatcaaggtcagccgggtgtgcaggcggatcgacccgtcggacacctccctggtggtcaaggacgggtaccaatggcggaagtacgggcagaaggtgacgcgcgacaacccgtcgccgagggcctacttccggtgcgccttcgcgccatcgtgcccggtgaagaagaaggtgcagcggagcgcggaggacagctcgctgctggtggcgacgtacgagggcgagcacaaccacccgcacccgtctccgcgcgccggcgagctcccggcggcggcggggggggccggtggctcgctgccgtgctccatctccatcaactcctccggcccgaccatcacgctcgacctcaccaagaacgggggagccgtgcaggtggtcgaggcggcgcatccgccgccgccgccggacctcaaggaggtgtgccgggaggtcgcgtcgccggagttccggaccgcgctggtggagcagatggccagcgcgctcactagcgaccccaagttcaccggcgcgctcgccgcggcgatcctccagaagctgcccgaattctagcttcctttacaattctccaattcttcttacaggaaaaaacatagaggcgcatttcaatagagattagagcttaatctccccccaaatttgaaaattttatacagggtaagaattccgaatgcttttctgctgcttttaggatgtgaattgtactctctcataataacctgttggtccttgggccgtcggaagaagattgcgggcttctatcgggcctcacgatcctgagcccaattgcgaggctccttgagcc

SEQ ID NO: 5447 - DNA, 1192 bp, Oryza sativa
  Predicted polypeptide sequence is orthologous to G921
gaaagttcacgttttggtccccctcctgttcggcgacgggcgacgtacggcgccactataagaaacgtgccctattgctgtcacgccgtacttcctcccgcccaccgggcagctagcttagctgccgccatggacgacgacggcgacggctcatcgtcaccgaccgacgacagcgccgccgccgggcttttgccgctcttcagccgatcgccggccgaggatcttgaggagaagctgaggcgggcgatggaggagaacgcgcggctgacgcgagcgctcgacgccattctggccggtcaccacgcccaccagcgcgcgctcttggcgccgtcgctgtcgccgccgccgccttccgccacagcaagggcgccgagcgtgtccaccagctgcgcggcgagggaggacgccgcaccggcggtcgccgccgccgccgcgtcgacggcatgtccgtcgagacagcagccgccgaccgcggagccacggcccaaggtcaggacggtccgcgtgcgcgccgacgccgccgacgccaccgacgccaacagcatggcggagaccgtgaaggatgggtaccaatggaggaagtacgggcagaaggtgacgcgtgacaacccctaccctagagcttacttccgctgcgcattcgcgccgtcttgccccgtcaagaagaagctccaaagatgtgcggaggataggtcaatgctagtggcgacctacgagggagaacacaaccatgccctgtccacgcagacaaccgaattcgtcgccagcggctgcactacgagccagcacgccggggggtcgtcgtcgtcgccgctgccgtgctccatctccatcaactcgtcgggccgcacgatcacactcgacctgacgaaccaagcagggtccggatcgatcgcgagctgcggcgtcgaggcggccgccgtctccggcgagctcgtcacggtgctctcgccggagttgaggaggcacctcgtggaggaggtggtgcaagtgctcaagaacgacgccgagttcgtggaggccgtgaccaacgccgtggccgctagagttgtggatcaaatcccacacattcctgttcatttgtagttgtttttttttttctctttgagaacgttgatttgtagtttgtaggcagtatatatatcccaaaatgcttgcaagtatatgtacacatgtattcgcaaatgtgagt

SEQ ID NO: 5448 - DNA, 1078 bp, Oryza sativa
  misc_feature (735)..(735): n is a, c, g, or t
  misc_feature (812)..(812): n is a, c, g, or t
  misc_feature (969)..(973): n is a, c, g, or t
  misc_feature (975)..(975): n is a, c, g, or t
  misc_feature (1014)..(1014): n is a, c, g, or t
  Predicted polypeptide sequence is orthologous to G921
cgggtcggtcggaattccgggtcgaccacgcgtcgcggacgcgtgggttctctccttggctcagcttgacatcgtcggagcagcagaaaagtttgctcgatcgagctagctaactaggtcgtcggatcagtgataaatcgttcgccgatggatccgtggattagcacccagccttcgctgagcctggacctccgcgtcgggctgccggcgacggcggccgtcgccatggttaagcccaaggtgctcgtcgaggaggacttctttcaccagcagcctctcaagaaagacccagaggttgcggcgctggaggcggagctgaagcggatgggcgcggagaaccggcagctgagcgagatgctggcggcggtggcggccaagtacgaggcgctgcagagccagttcagcgacatggtcaccgccagcgccaacaacggcggcggcggcggcaacaaccagtcgtccacctccgagggcggctccgtctcgccgtcgaggaagcgcaagagcgagagcctcgacgactccccgccgccgccgccgccgccgcacccacacgcggcgccgcaccacatgcacgtcatgcccggcgccgccgccgccggctacgccgaccaaaacgagtgcacctccggcgagccctggaagcgcaatcgcgaagagtgcaagcccaagatatccaagctctacgttccacgccgaccaatcgaactcaggctggtggtgaacgatcggttnccttggcggaggtttgtccaaagtgtccaggaaaccctgtcaaaagcctattaaatgccattgtcccgctgctgttnagaatggttaaaccgcgggaacagcctgtgcagtcagggggcaacgacgacccgcgcgtttgcgggaaacatgctgcagcgagccaccctgcgggcgcggtgtctcacaacattaaccgggtgtgttgaacagtcaccgccccttcgtcttttcttnnnnngntgcgctagacactatgtagatacatgtccgtacacatgncgtgagtgctacactagcgacatatacataattacatagtaaggactcatacactgactagtgt

SEQ ID NO: 5449 - DNA, 2034 bp, Oryza sativa
  Predicted polypeptide sequence is orthologous to G927
caaaagcagcagtggcagcagccaccactttgcacaaaagaagcaaagtaaatggatggccatcgccgttgaggaagggttggtggccatctagagagagagagagaaactagagagagagaggggtgagcagctgagctctgcatctatatacagcactgcatctctctctatttctctctctatatatatctctatctacagtggattttctctctcctctctctctcttgccgttgctgttcgatactgttgttgtcctctcgtggccattattagatggcctcctgctgctgaaatgtgagtgagagctttgctttgcttgcttgctggctggctggctggctagctgggggttggcttcccctcatcctcgtgcatcatccactgtgctcggctcagctgtctgccctgttcttgctttggtggttggacggttagcatcttcctcctcaagctgagatccttcttgacgccattggaggggtcgctgtcgcctgcgtccttgagcctccctgcttttctttttctctctctctctcctcggcgagggagacgacgacgacggtggcggcggcgatgctgagcttcaagcagagccacgaggggttcggccatgtcgccgccgctggagctggaccgcagcagcagcagcagccgtggtgggcggggtcgcagctgctgtacggggaggcgtcgccggaggaggcggcgctgcgcgacggcggccagttccaggtcgtgcccggaggccgcgccgcgctggatccggcggcgccggagccggagaagacggcggtgccggcgatgcccaagagaggaggaggaggaggggctcctgaggtgctgaaattctcggtgttttcaggtaatttggagccgggagatacaggagagaagaacagagagcactctgccactattgcaatgcaatcgccgttgccagaatacaacggccatttcgagcttggtcttggtcaatccatggtctctcccaattatccttgtattgaccaatgctatggtcttatgaccacctacgcgatgaaatcaatgagtggcgggcgaatgctactgccgctgaacgcgccagccgatgcgccgatctatgtcaacgcgaagcagtacgaaggcatcctccgccgtcgccgtgcccgcgccaaggcccagagggagaacaggctggtcaaaggcaggaagccctacctccacgagtcgcgccaccgccacgccatgcgccgggccagaggctccggcggccgcttcctcaacaccaagaaagaagccaccgccgccggatgcggcggcagcagcaagacgcccctcgcgtccctcgtcagccccgccgacgtagcccatcgtccaggctccggcggccgcgcgtccagcctctccggctccgacgtgtcgtcgccgggaggcgtcatgtacgaccaccaccgccacgacgacgccgacgcggcggaccactacaacagcatcgaccaccacctccgcacgccgttcttcaccccgctcccgatcatcatggacagcggcggcggcggcggcgaccacgcctcacactccgccgccgccgtcgccgcccccttcaggtgggcgacggcggccggcgacggctgctgcgagctcctcaaggcgtgacagccttgaggcggggatctccaggcgtgcccagagctgctgctgatcgatcaccatcagctttggctgcctgtaggcaaatcattcttggctctttacttgcattggggttcttgcaagcaactctcctcgtcacctaccaaaactgtccctgaaacttctctagtgctggggtctcgatcagggatgatgatgtgatggaggagaggcttacccatatgcctgtaaattatggttagtgttctgattaagcaactagtagtacttggtaattactggctatgaattagtagtatggactctggtgtcaggttgctctttgtctgaataaactggagtcgtttgaagctttgcaacagctgtgagtgaaactatgtgcttgcttgcttg

SEQ ID NO: 5450 - DNA, 1640 bp, Oryza sativa
  Predicted polypeptide sequence is orthologous to G927
ggctgctgctgaaagcctgatgaaattgggtgattaggtgcttaacataatcccaatcctagaaaaatacattcggagtggttgctgctgagctcaaccaatcaagcttgttggggaggcaagcagtcacaatgatgagcttcaacaagagccaagaaggatttgggcaggttgctgctgtggccaccctggcctccaatggaggaggctctctaccatggctgctgtacggcgagccactggggcaggggaagccggccatgtcgccggagggcgtggtgccgagagcacagactcctctggatcctcctcaggttccagccatggacaggggtgtccctgaaattctgaacttctccatggttccaggtaaaggagaaaaatgttctgagcactcaactactattgctctgcagtcaccatttgcagaatataatggctgttttgagctgggccttggtcaatctgtggttccctctaattatccttatgctgaccagcactatggcctactttctccttatggagtgagaccaacgcctagcgggcgaattcttattccaccaaatatgccagctgatgcaccaatttatgtgaatgcaaaacagtgttcagccatcattcgacgtcgccatgctcgtgccaaggcagagagggagaataggctggtcaaagctagaaaaccatatcttcacgaatcacgccatcttcatgcaatgcgtcgtgcaagaggctctggtgggcgcttcctcaacacgaagaaagagaccaatgggaaaaccactggtggaggcaggaaggtgatggacatcatcatcccgcctctgtgccccgccgcatctcccagctcggagcagtgcaacccaagcagcgtttccagcctgtccgggtcagaggtgtcgagcatatatgaacacgaagacatggaccacttccatagctttgatcatctccggacacacttcttcaccccgctcccgagcctcatggatgtcgagcacggggctggtaaccccttcaagtggacagcagcctctgatggctgctgtgacctcctcaaagcatgactagaggggggatacaccgggcagccgaagctggcaaacatcagcagtttctgctggatacattgcccagctccaggtcagggattgtccctgctggtattggctgtctgtaggcaactcattcttggctgatcggttccgctcatcgcctacttgtcccggaaactccagcaccggtttctgggatcctgcggtgatcagaacaacccatcgcgtgtaaaaaaaaaaaaaaatcatctatgctatgctgttactgcttgctaccattatctgaactgctactactaggtagcaagcttaatctggcaaggtaaataaagtctggaactttgaactggttccagtggtgatgattgtggtgtgcttgtatcctgataactattgtgagtttgagacctggctttgttgatctactgaactactactgtagcactatgcttgaagtttgtgtgggcttggtttgcagtttgtattgttaaaaaaaactcaaatctagtgatgtattaagaccttgtttgtgtgtatcttgttaatgtggtatatctgcaagaaggtataatctgtttgggagtg

SEQ ID NO: 5451 - DNA, 1125 bp, Oryza sativa
  Predicted polypeptide sequence is orthologous to G927
atgggcttcaggcgatcaccggccgtggcggcaatggcggcgccgccgctcacgcattgccatggaggaggagaagaatcattctgccaattaagcaacacaatcatggaggacacccgaatcctgcaaaaccaccaccaccagatcctcgccgccggccggcagctgcagcagcgccaccacttcccggcaatgccgccggagcgacaccaccaccctcctcctccagctcctggaagccctgccatgaagttcccaatcatctcaggtgactctgatcttggcaaagatctgaagttccatgagtcctccgcgccgaccatcgccgcgtactcgccattgcaggagtaccaaggacactttgagctagcccttggccactccatggtttgcaccaacttctgcaactctgaacaaagctatggtgtttactccccctatggagctcaaaccatggctgggaggatgctgctgccgccggcgatcgccaccgacgtgggtccgatctacgtcaacgcgaagcagttcaacggcatcatccggcggcggctggcgcgcgccaaggcggagcgggagcaccgggtttcccggagccggaaggtaagacggcggcgacggcgacggcggcggcgagtgctcgtcgtcgtctccttcccttgtcaattcgccggcgaactggcagtgacagtgactgactcgtcttcttcttcttcttcttcttcttcggcgacggcgcagccgtacctccacgagtcgcgccaccgccacgccatgcgccgcgcgcggggcagcggcggccgcttcctcaacaccaagaacgcctcctccgccgccgccgcggccgccgacgcggcgccggtgagctccggtggcggcgaccacggggcgagcaacaagagctcgtcggcgtcggaggcgacgcgcgtgtacgacgacgacgacgacatgggcgcgggcggcggcggcgacggcggcgacttccaccacgcgatgggtcacctccgctcgccggcgttcttcccgtcgctggccgcgatgatggacggcggcggcggcggcggcgaggggaagtgggcgaccgcgacgcctcaccatggctgccgcgtcgacctcctcaaggtgtga

SEQ ID NO: 5452 - DNA, 456 bp, Oryza sativa
  misc_feature (43)..(43): n is a, c, g, or t
  Predicted polypeptide sequence is orthologous to G927
cccccatctgcatgctttgaaaagggcaagggggtccgtggtncgatttctcaactctaaggctgtggaggggaagcaagacactaaatctgtagataaaaaggatggagctgtgccatctgaggagaagagagacaagaagttggcaaatagcattatcaaattggagaactcgagcccaacaacacaaccaggttgaacaatagttccttggaaataccatgagaataacttgtttacagaacggtttgttcattcccgaattcggtgaggacttgcttggataaaaatgtgtcactgttgttcggtgtgattgctaaccgtatatgataaaaatttcatgcgcttaaaagaagcaagaaagcgtctggagcaattcagcaatatctgtgtgcttagctgacctacgtgagcatacttggtgcacgttatgaactttttactcttcgccttgac

SEQ ID NO: 5453 - DNA, 560 bp, Oryza sativa
  Predicted polypeptide sequence is orthologous to G938
ctcacccttcctcttctctctctcttctctagctctgggcaggccggcgcccgggcgaggccgggggaggagatccagcggccggcgacgtggcggcggtggcggcggcggcggacaccacgctgggtttgctgctctcggcgctgatgcagcactacgacccgtcgtagcgccacttcctactggagaaggacgtgccgtcgccgtggtggccggagcggacagaggcgtggaggagtcatcggcggcctggatgcgttgacggtggagcacccgtgcgtagcgacgtagtaggtccggagcacgtcctggcggacgcggagcttgccaaggtagtcgaggacggagaccatgttcgctgtagtttgagcactggatttgtgatttcttttctttttttttttttgccttttcatgatttgctcgatgtagatgggcatggagctctgatttgctcgctgcagtttgagcaggatctctgattttctaatttgatttttcatttgctcgcatgttgatattgaaggatttagcctaaaaaattaaaaaaaaaaaaaaaa

SEQ ID NO: 5454 - DNA, 2435 bp, Oryza sativa
  Predicted polypeptide sequence is orthologous to G938
gatattctcatctgattactccgcggcggcggcggcggcgggagcggcatctcctacgagattcctctcttgatggtatcgttgaacaagccaactaagcacaaggagttgtctcgggtgatgagataatttggttaaggaaggtaggaaacagtaaattcaatgggcaatccttctattctcacggaggatttaggcgatacgtctgactttgaggttgatggcgtcgagaacctcacggagaatgatgtcagtgatgaggagattgatgccgaggagctggcccgacggatgtggaaagacaagatcaagctgaagaggatcaaggagaggcagcagaagcttgctctgcagcaggcagcactagaggagtccaaaacaaagaagatgtctgagcaggctctccgcaagaagacggcgagagtccaggatgggatcttgaggtacatgctcaagctgatggaggtgtgcaatgctcgtgggtttgtttatgggatcattcctcataaagggaagcctgtcagtggtgcatcggataacattagagcttggtggaaggagaaggttcggttcgatgtgaatgggccggttgccattgcaaagtatgaggttaagaactcaatgctggttgatgctaagcgcagaggggtcttgaaccagcatagcttgatggatctccaggatgctaccctgggatcattgctctcatcgttgatgcagcattgcagcccgcagcagcgcaagtacccactggataagggtgtccctcccccatggtggccatcaggaaatgaggattggtggatttctttaggccttccaatgggaatatcaccaccatacagaaaaccgcatgatcttaagaaggtttggaaggttggcgtgctgacgggtgtgatcaaacacatggccccaaactttgataagatcaggaattgtgtaaggaaatcgaagtgcttgcaagacaaaatgactgctaaagagagcttgatttggctgggagttcttcgaagagaggaaatatattttcgcagttctgacaatgttggatcacagattacacaccgtagttctcgtgagggaaaaagtgatgatatatatagcagcagtgatgagtatgatgtcgaccatttggaggaacctcctcgctcttcatcatccaaagataatgtggggcgtcgtcagccaactgcgcagatcagagaggagcatacctctagtcgacacaacagaggacgccatgatcagcaacccaatcaagtacttcctagcaatgaagggaccaatgaatcaaggaagagaaagagacctagtggtcatttacttactgctgaatctgaggttgaggtaacacaaaaagatgacaatcaactagccattgtgagcaatgcattgcccaatatgagcagaataaaccaaacggagatgatgggcatggctaaccagatgacaagcctcagccatgtcaatacaactgaaactctacagcatcaatatgttcaagggaacttcgtatcttctcctgctgctgtggttaataactataacagcaaccagattacaaatgttaatccttcaaggatttatatgggatatcagcctttagcatgccaaaataatggtcacacaaatccatggtctgaagacacttttcaggttgatgttggtccaccacctattggttttactactaattcttcgtcaggtggtaatcattcttttcccatgaaacaatcactaccaaaatctatagatgatcatgtgcctattacggagacaggggtgttggctgatagcagttcatatggttatcatatcacagccacaggtagtaggaattcaacctctgttgctggccatggaaatcagctcatgggagatcctttcgacagtggtactgctgataagttcaatgggaattcgtttgatggattgccttttgacttcattggtagtagtccaatccctgacatcggtgtattgctagatgatgatgatataatgccatatctgggaacataacctaggcaactcttttgcaattgtaagaactgcgacatccagaaatgtaaatggtggcagaagttcctgtatcgttcattagctaatcgctgagaacttgagaagggcgcgctcatcatggcatgctggtgttccgcttaacctgctgcaaccagtgaaggatgcgtcgtgccaatgatctgtaatttgtacctatcgcttttaattagcctgttctggattatttagcctggctgtaaaaaagctcatagaaactcgcttagctggagaatttcctgcaatgctggatggttgtatacatttttacctgtgctaccatgttaattttgctcagttactcatagataaatcttgatgtatatgagacatgttcattgcagctagctcagacataataatacctgaattcttgc

SEQ ID NO: 5455 - DNA, 2991 bp, Oryza sativa
  Predicted polypeptide sequence is orthologous to G938
ggcctttgcttgcttgctgctatccccttctctttctgttgtgggcttgctgttctccatgtcctcctgttgatggttgcttgtgttcgagtttttttctttttttttctttttttttcttggagaggatgtggttgtgttcatgataggttggtggtctgtgatctgtttgggtagatcttttgtcctctttttcagatatttcgtggatgctagagctgcctgcggtagccaattcctgtttggctacttcttcgttgccctttattcccttccaattttattccgtgattttctgttcttgtgcgtagaattgtttctgccaagcttgagtaaatccatggcagaggtcaaagcttagcttttttcagattatacgatttgctgccagccaaaggagaaagggaaaaaaacttagaaattttctactagttttctcttgttgtgttcattagatctcagagattaacctaatttaaggaatacatgttgtaaatcctgctctgggaatgttaagtggttgggtgtaaggaagcatcttgttttgcatcgagtttatggccaaaaacaatcattgatgcttcctctaaggcggtgtatgttttcctctgttctccatttgatgtgttcttgatccattttcgtctcttgttttcttctgttcttttagatggcctccgattccttttgataagcacatgggtacatgttcttgtttccaacagtccatgccggtcgtggtagaccgaaaaaataatccataaaaatatatcctttttctgaaatgtttttcccgtgcttttctattcctttttcatctcccactttgatctgatcaaggcttgttgtttcatgtgtttcaaaatacttcacggaaaggataagaaaaggagaaatttcacatgtttaagtttcttttgatccctacttgtttcaaagcagcatgaaaataccgtttcagctaatcccgtgcatcgcaaaatgttttcatgcttcggctttgactaattcttccgttagtactttatttatgatcatgtctgaatcatgatacctttatgctgtgtagtatgattatgtcacaacaaaagataaccatgtcctatatgactgttaattgcgtgctcttaactctgtgagaggattgcaggagatatgtctgatcagataaagatctctctgtttcaccaaacacatgcaaaattaggctctggcccttgcttcaataggcaaacctaattttactcgcgcgataatctcctggtctcctggctttctagatcttagaatgttttctgaagggaaacaaaccagtactgcctctttatttttggtaatggcgtaattgccgcattaggatgctgcggtaaccgtagtcgtgttgcgcatgtattctcagttaaggaggtagtagtaacacttattgcgtttagacgaagtaatcagttgcttaaacttggttttgatttctgtaattaacatcagcttcttctcttgcttgtgtgcaggtgaattactacttgagtagaagtggtacaagaagagtcgtcgtctacctgtgggcgaattatttcgaggttgtgcgttgcgatgatgggaggtggtctggtgatggaccagggcatgatgttccccggcgtgcacaacttcgtggatctcctgcagcagaacggcggcgacaagaacctcggcttcggcgcgctcgtgccgcagacgtcgtcgggggagcagtgcgtgatgggggagggcgacctcgtggacccgccgccggagagcttcccggacgccggtgaggacgacagcgacgacgacgtggaggacatcgaggagctggagcgccgcatgtggcgcgaccgcatgaagctgaagcggctcaaggagctgcagctgagccggggcaaggaccccgcgggcggcgtcgtgggcgacccgtccaagccgcggcagtcgcaggagcaggcgcggcggaagaagatgtcgcgcgcgcaggacggcatcctcaagtacatgctcaagatgatggaggtgtgccgcgcgcaggggttcgtgtacgggatcatcccggagaagggcaagccggtgagcggcgcctccgacaacctccgcggctggtggaaggagaaggtccgcttcgaccgcaacggccccgccgccatcgccaagtaccaggccgacaacgccgtcccgggcttcgagagcgagctcgcctccggcaccgggagcccgcactcgctgcaggagctgcaggacaccaccctcgggtcgctgctctcggcgctcatgcagcactgcgaccctccgcagcggcggtacccgctcgagaagggcgtccctccgccgtggtggcccaccggcgacgaggagtggtggccggagctcggcatccccaaggaccagggcccgcctccgtacaagaagccccatgacctcaagaaggcctggaaggtcagcgtgctcaccgctgtcatcaagcacatgtcgccggacatcgagaagatccgccggctggtccggcagtccaagtgcctccaggacaagatgaccgccaaggagatctccacctggctggccgtcgtcaagcaggaagaggagctgtacctgaagctgaaccccggtgcccgccctccggcacctaccggcggcatcaccagcgccatatcgttcaacgccagctcaagtgagtacgacgtcgacgtcgtcgacgactgcaagggcgacgaggccggcaaccagaaggctgttgttgtcgccgacccgaccgcgttcaacctcggcgcggctatgctgaacgacaagttcctcatgccggcgtccatgaaggaggaggccaccgatgtcgagttcatccagaagaggagcgcgtctggcgcggagcctgagctgatgctgaacaaccgtgtctacacctgccacaatgtccagtgcccgcatagcgactatggatacgggttccttgaccggaacgcgcgcaacagccaccaatacacttgc

SEQ ID NO: 5456 - DNA, 3156 bp, Oryza sativa
  Predicted polypeptide sequence is orthologous to G938
gtgggaagagaagcgaatcttttccacctccactgggcaaaaaaaattaaaaaaataaataaaattccccattcccccgaacagattgattcgcttcgattcgagggaggaggggagcacagcgatttcttctctctctttcgccgtcgcattcgcctcgcgccgcgccgcgcacaatcccatccgctgctgcccaaggcttgtttcgcggattcggattggtgctgactcgctcccgattggcaccgggaggtatgaattctcgctaggatttcggtgggcggattgctgacgaggagagggttgggggggagtggagttggatgtgatcgggttgtgggaaatccctagtttgtggtgtagtgatggatcatctggctatcattgcgacggagttgggggattcgtcggacttcgaggtggagggcatccagaatctgacggagaatgatgtcagcgacgaggagattgaggccgaggatctggcccggcggatgtggaaagacaggatcaagctgaggaggatcaaggagaggcaggacaggctcgcccttgcgctgcagcaggctgagctggacaagtccaaggggaagccgatatccgatcaggccatgcgcaagaagatgtcgagggcgcaggacgggatcctcaagtacatgctcaagctgatggaggtgtgcaacgcgcgcgggttcgtttacgggatcatccctgataaagggaagcccgtgagcggcgcttccgacaatattagagcttggtggaaggagaaggtgaagtttgataagaacgggccggcggcaatcgcaaagtatgagtcggagaacttggcgtcggctgatgctccgagcagcgggatcaagagccagcacagcttgatggatctccaagacgccactctcggttcactgctttcgtcattgatgcagcactgtgatccaccgcagcgcaagtacccattggagaggggcactccacccccgtggtggccttcagggaacgaggattggtggattgcgttgggccttccgagggggcaaattcctccgtataaaaagccacatgatcttaagaaggtctggaaggttggggtgcttacaggtgtgatcaagcacatgtccccaaacttcgataagatcagaaaccatgttaggaaatcaaaatgcttgcaggataagatgactgcaaaagagagcctgatttggttgggtgttctacagagagaggaaaggcttgttctcagcattgacaatggcatgtcagaggttactcaccacggtgctctggagtacagaaatggggacacacacagcagcagtaatgagtatgatgttgatggttttgaggaggctcccctttcaacatcatctggagatgatgaacaagatctttctccggctgcacagttgagcgaggagcatgccccaacaaggagagaaagagctaaagtcaaacgccctaatcaggttgttcctaagaaggcaggaacaaaagaaccaccaaagagaaaaagaccacgccacagtgtcaccgtaattgagcaggaggtacaaagagctgatgacgcatcagaacattcaaggaatatgattccagatatgaaccgactggaccaggtagaaatccaaggcatggctaaccagattacaagcttcaatgaggaagctaatacgagtgaagctttgcaacacagaggaaatactcaagaactggcccatcttcctgccgattttaatcactatggcaatgcgcaggcaacaattgctactcctgtaagcatatgcatgagaggccaggctgtaccttatgaaagcagtgacaattccaggccaaaaactggaaatatcttcccacaggattctgattcaggctttaacaatatgcctagtagttaccagaccatacctcctaagcaaccacttccactatctatcatggagcatcatgtggttcccttgggtatcagaacaccagctgacaacagtccttatagtgatcaaataattggtagtgggaattctacttctgttcctggagatatgcagctcattgattaccctttctatggcgaacaagataagtttgctggcagttcctttgcgggattacctttagactatatcagtatcagtagcccaatcccagatattgatgatttgctgctgcatgatgatgatctaatggaatacttgggaacataacataggttaggctccaatgcctccttgcatttgtttctgtcgcccattttgtcagtaggattaccatcgtaacttgagtatggaaggctatacttcttattttgccatcaaatatcaatcttgttagttgataccgtttctagcatggcaaattatacctgacttgcattctttggaaatgatatatcaaatgatgaccgaattgtaaatgggaaaggtgtatatgatttaagtttgaaatatggccttttctgaagaaagatatctagtgaagaatgaacatagtttttgtaatttttttagcctgcgagaaatgaaagttttggtctcctgctttctctcactctctccccttatgcattctacagaaacattgagaattcacctcaacattttatatgcgactaataaatgaaaaatcatcagttgataggaacctcctgtatccgatctgtccatatgttcaattacaatgaagtagagaactgttgtagcagatcaaaagctctttgccagtgccattttctaatagttacaaaagtgaagcaattctataagtgcatataaaattttaggatactctaatgtaatggcactatctaccaggtggcaatgggggctgctactaaatcacaccaacactatcctcctctgtccccttgtgctacttggcaattggcatagttatttttggagatagctgagagaaaagaacccttgatgcaacgatacatcatacatggcaatatggcatagttacttttggtggtctcatgcagctgtgaagttagatcgatgtaattgaacatcagtacccaggcttgatgtgatgatagacaagtctttgtgcattccctaaaagaaaataacccttaaatctgtatgatactatgatagcttgtcctgctggacattttgtatgactggtacattttccaatttgtagaatctgttt

SEQ ID NO: 5457 - DNA, 2103 bp, Oryza sativa
  Predicted polypeptide sequence is orthologous to G938
ctagctgagtgccaagcttatggaaagagtggtagagtaatcagaaggagatagataagggcatagagagagtcagagagaggtggatctatagatagctactgctctgctgctgctattaagtcagtctgtgctacgatcgaggagatgatgggagcagcggtgaccatggtggatcggcgcatggcgttcgcggcggaggccgacgttgatagcaaggccgcctttggattcttcggaggcgagtgcttcgtcggcgagggcgacctggtcaacccggcgccgccgccgccgcagcagcagcaggtgcacgagggcggattcgccgccgaggacgagagcgacggcgacgacgacgacgacgacgacgacgacgtggacgacatcgaggagctggagcgccgcatgtggcgcgaccgcgtccggcacaagcggctcaaggagcttcagcagagccgcgccgggagggagagccgggcgggcgacgccggcggcggaggcaggcagcagcggcagtcgcaggagcaggcgcggcggaagaagatgtcgcgggcgcaggacgggatcctcaagtacatgctcaagatgatggaggtgtgcaacgcgcaggggttcgtgtacggcatcatcccggagaaggggaagccggtgagcggcgcctccgacaacctccgctcatggtggaaggagaaggtccgcttcgaccgcaatggcccggccgccatcgccaagtaccaggccgacaacgccgtgccggggtgcgacggcgacgccggcggcgccgcgccggcggggccgcactccctgcacgagctgcaggacaccacgctgggatcgctgctctcggcgctcatgcagcactgcgacccgccgcagcgccgcttcccgctggagaagggcgtgccgccgccgtggtggccggaggggagcgaggcgtggtggcccgaggccggcgtgcccaaggagctcggcccgccgccgtacaagaagccgcacgacctcaagaaggcgtggaaggtcgccgtgctcaccgccgtcatcaagcacatgtcccccgacgtcgacaaggtccgccgcctcgtgcgtcagtccaagtgcctccaggacaagatgaccgccaaggagatcgtcacctggctcgccgtcctcaagcaggaggaggacctctatctcaagctccatcccggcgccctccccccgccgctctccgccgcgtccttcaacgccagcgtctccggcgagtacgacgtcgaaggagtcgacggcgacgaggccgggaacaacaacctgcagaaggcgcagaacgacgcgaccgcgttcatggacctcaccaccaccatggatgctgctctgagcaacaacaagttcctgatcatgccgctgatgaaggaagaggccatcgacgtcgacttcatccagaagaggagcgagccggagctgatgctgagcagcgacagccatgcccgcgtctacacctgcggcaacgtgcagtgcccgcacagcaactacgcgctcggcttcctcgaccgcaacgaacgcaacgcccatcagtacgcctgcaagcacaacgccgccgccgccgccgccgagagcaagccgccgccgccgcacatcttcgagccactcggcagcttcgacttcgacctccccgtcgacggccagagatgcctcgccgggctgatgaccatgtacgacaacgacgtcgccgccgccacgcagatgcaccaccaccaccatcagcagcagcaggctaatttcttcatccgcgacgacgcgccgttcggaggcgacgtcgccgccacggcggcggcggcgccggagttcaggttcagttcaaatttcaacgtgacaggagggggcgccgtggactacggcggcgccatgcagcagccgccggcgaagtacgccggatccaactggttctactgaaacgaattcgaatcgaatgggaaccaaaagaatcaccacccctagttcgattcgatcagtagcttgtagctgtaggggattagaggagctcataagcctgattaattttcagtgtgcttgtaagaattattggttaataatttttcagtgtagatccatgctatgcaagcttgc

SEQ ID NO: 5458 - DNA, 1299 bp, Oryza sativa
  Predicted polypeptide sequence is orthologous to G938
atggcgttgtcgagcttgcaagattctgccttgggcggtggcggtggcactagcgccgctcgcgactgctccgccgacctctcgcgcaacggccaggcgtgtggccccgtcgccggcaacttcaagggctcctacctcgccatgctcagctcggggggactcgtcttcggcatcatcaacatcgtcggcaacttcggaacggtcttcgtcgacaacgagcaagacgggatcctcaagtacatgctcaagatgatggaggtgtgcaacgcgcaggggttcgtgtacggcatcatcccggagaagggcaagccggtgagcagcgcctccgacaacctccgctcctggtggaaggagaaggtccgcttcgaccgcaacggcccggccgccatcgtcaagtaccaggctgacaatttgttggcgacaatgccgtgccgggggccgcacttcctgcacgagctgcaggacaccacgctgggttcgttgctctcggcgctcatgcagcactgcgacccgccgcagcgccgctttctgcttgagaagggcgtgccgccgccgtggtggccggaggggacaggcgtggtggcccgaatccgtcgtgccctcaccatcgcggcccccgcccccgtttccaccgtcctccacgccgccctccgacctcgacggcatcctcgccatgggcggcgacggcatcctctcccgtcggcgccggcgcgcgccgctccctctccgtcacgcctgagagagagagaggagagacaggaagagaggggagatagggaaagaggaggaagaagaggatgggacgcgccggatctgggcaaggagccagatccggctgtcttcctctccaccaacgccggccgacgcctagaggggcgccggaggacgccagtggcagccgcggggtgcctgcgtgctctggccaccaccggccgccgccggatccgggtgcgccaccgccggatccgcggcctccaccattgccaccccaacgccgtcaccatccccgccgccatcacccacaacaccaccccgcgcaactcacctcgaccgccaccgtcgcccgtccccgccgccagcccatcccgtcagatccggccggaacggcgcggatctggcggacaccgccgtcgccactccgggcggctccccaggccgcccgagcgcgaggagacgaggagcgccccgccgccgccgtccttgtggctgcgcggcttcgccggcggccgctcgggcgacggcgaggcggagaagggggtgggggtgggggagaggggcggccgggtcgttgcctcctga

SEQ ID NO: 5459 - DNA, 739 bp, Oryza sativa
  Predicted polypeptide sequence is orthologous to G961
gacaaagctgggtaccgggccccccctcgagttttttttctttttttttaaactgtcttaatgtcttaccaccgtgccaccgttgacaagtacgtacatgtctaagggcatcaagcatgacgagtagaatttacattttccagacttcactacagtttatgaacaaagttcaagcccaaaatctgtataatacagcatggatgcctctacctacatctctggtttattatgaatagctgaattctttggtcttcgcaccgttccttccaacatctctggtttttgcaatttgcattgcccagattgcctactccagtttgtgaaagatgtcagaagaggatatccggaaattatgcacacatcgcctttccaaaattttgtacatgacacagttttcatttgtccaacgatgaaatgccatatatcagatagagataggcctgcaactctcatgcaaatgaatgctagcaaatcgtggcatgcaggtctgctagtctgctactgcatcgaagttggaacttggaacacaaactcaaggtcatccatgcaagggcacttcaaattcagacggacctcccactattgtgcactgaagcctgaagccggcaacactggaaaaatcgggagcactggcatgtcactaacaaacctgcagtcggatgatactatggggacaatttcttagcgatatgcttaaggaccgcaacacaatgtcctgacattagaagcccaatattct

SEQ ID NO: 5460 - DNA, 763 bp, Oryza sativa
  Predicted polypeptide sequence is orthologous to G962
cttgcatttgctcccccccaaattctcttctcctcctgcttttccagctatagctagctcgccgtcgctgccgccgccgcgccacagcgcacgctatgccggtgacgaccgcgagggagaggaggagggagccatgagcagggacgacgtcgacgacgtcacggcgggcgccgccgggtcaggggaggaagcggcggccgatcaggaggaggcggccgccgctgtcgccggcgactcgcacgagaacgacctggtgatgccggggttccggttccacccgacggaggaggagctgatcgagttctacctccggcggaaggtggagggccggcggttcaacgtcgagctcatcaccttcctcgacctctaccgcttcgacccatgggagctccccgcaatggcggtgataggggagaaggagtggttcttctacgtgccgcgggaccgcaagtaccggaacggcgaccggccgaaccgggtgacggcgtcggggtactggaaggcgacgggggccgaccggatgatccgcggcgagaacagccgccccatcggcctcaagaagacgctcgtcttctactccggcaaggcccccaagggcgtccgcagcagctggatcatgaacgagtaccgcctccccccgcccgccgcagacgccgatctcttctacaagtctgagatctcgctctgccgcgtctacaagcgctccggcatcgacgacggccacggccaccaccagcgccccgccggcaacgtgcaagcgtcg

SEQ ID NO: 5461 - DNA, 1631 bp, Oryza sativa
  Predicted polypeptide sequence is orthologous to G962
gtgcctgtcatccctttctctcttcttccgccgccgcgttctgcttcccaacttgaacactactactactcccccacggcgagctcgcgttctccgggaccaactagccctagcgacggatgcatatgcggagggggagagcggctggaggcgaaggagaggcagctgcggtggtggtgatgaacaggtacgacaacaacgggcatgcggcagcggcggcggcggctgcggtggcgggaggaggaggaggaggaggagggaataaggcggcgggggaggtagatgggcatgaggatgacctggtgatgcccgggttcaggttccacccgacggaggaggagctgatcgagttctaccctccggcggaaggtggagggcaagcgcttcaacgtcgagctcatcaccttcctcgacctctaccgctacgacccctgggagctccccgcaatggcggcgataggggagaaggagtggttcttctacgtgcctcgggacaggaagtacaggaacggggaccggccgaaccgggtgacggcgtcggggtactggaaggcgacgggggccgaccggatgatccgagccgagaacaaccgccccatcgggctcaagaagacgcttgtcttctactccggcaaggcccccaagggcgtccgcagcagctggatcatgaacgagtatcgccttccccccgccgacaccgaccgctaccacaagactgaaatctcactatgccgcgtgtacaagcgcaccggcatcgacgacggccatggccaggtatccacggcgcggtcgtcggcgcactcccgcggcggcggcgcggcaccggtacaggacaacaagcaaggctcctcgtcgacgtccacgccgacgccgcctccaactccgtccaagctccacctcctcagcagcgagtgcacgtcgccgcccgccatcgtcacggaccacgccgccatggtggcgcacaaggcaccgtcgccgcggcaccatcagcagcagcagcagctccacgctgccaagccttgcggcggctacctgcagaattcctcgatggcttccgctgccggcggcgatcagcagcagcaatttcagcaagacttcgcggcggcattgtaccagcagtactccaagaacacgagcggtgccttcgcctccacgtactcgctgctcaacctcgtcaacgcggcatccatgggcagctccgccgctgccattgatgagctgagctcgctggtgggccacggcacgccgtcctacattaaccccgcggccggcagccacaactatagtcaattccttcacctgcctacgacgccgtcgtcgcatcaaccaacgccggcgccgctcgggacgacgacggcggcagcggcggcgacgctgccgatgtcgctcgccgccttctccgacaggatctgggactggaataatccgatccccgaggccggaggtagggattacagcaccagtactggattcaagtgaatcagctatagctacagttcatgcacgcgtgcatggcattctgatcagatggtaccaccatgtactacctctctctctctctctctctctctctctctctctctgtgtgtcccactctctggttcacagttattaattctgatgaaacgatc

SEQ ID NO: 5462 - DNA, 2424 bp, Oryza sativa
  Predicted polypeptide sequence is orthologous to G962
gactggaaggtgatgagagtactcaagttgatcgccggagcagcatcagcatcagcatcagcttcaccatgcggggatcagatcatcatcaggatgtcgtcgcggcaccgcggggcggtggcggtggaggagacgacgggcaggcgcacgacatggtgatgccggggttccggttccacccgacggaggaggagctcatcgagttctacctccggcgaaaggtggaggggaagcggttcaacatcgagctcatcgccttcgtcgacctctaccgctatgacccgtgggatcttcccgctctggcctcaattggggacaaggagtggttcttctatgtgccaagggaccgcaagtaccgaaacggcgatcggcccaaccgagtgacgccatcggggtactggaaggccacaggggcggataggatggtgaaggtggagggtgaccgtcctatcggcctcaagaagacgctcgtcttctacgtcggcaaggcgcccaaggggcttcgcagcagctggatcatgaacgagtatcgtctccctcatggcgacgctgaccgctaccaaaaggaaatttcgctgtgtcgagtctacaaacgcccaggaatcgaagacaacttccacctcaccggcacaaccactaaatcctccggctcaaaggcggcggcggcgatgggcaagaagcacgccgccgcgaaccggacgtcatcgacggcggcggctgcggcgccccgcctcgccccgatgttcgacggcggcggcggcggccaccactaatccgccctcatgggaaaggcaacatacaacgcatcacacaccgccgccgaagggacgaacgccatcgccatgtcactgtcggcggcggccgcgctgcatcctccggcgccggcgatgttccggtcgacggcgtcggtggcctcgctgagctccaccacgtcgacggaggaggacggcacgtcgctcttccacctcaaggccggcgcgacgacgacgaacacgacgacgatgcatcatcaccatcatcatcagcagctgcctgcttcaactcatgctctgctcaacaccaactcgtcagcaatggcgaccatccccatcgacgagctgagtagggcgattggatcttacagcaacatccaccatcaaccaaactctactacaactcatcaatcaactgctttgccgccatcgcaacaaagccctcttcttccattcgctagcatggagaagatttgggattggaaccctctcctagaatctcccaaggtttgcacaaacttcaagtaactttgattatgatctactcttggatgatggattaatgtttgtatgcatgaatgcatctatgcaactatgcatatatatgcattgcatggatgcaaaaaccatatggtattatatgtgtacttaattaattatgtatatgtataacacatatttgggctaggacagggttatctatctatataatggaacatggtaaggtagttctagtcccatgcaattaccggcttaccgcgccattattttagttcacattagtggatggaagtaactgtatgtcaatttctattggatatgatctcgaggacaatgtgtagtgttactcgtcgatctagagttgtaataaagatgaaatagcattatatatgtgatcttttttcgcttccatagtatttattctacatatatataaattatccatgcagccggcagcatatatgcatatgcatgaactgcaggtgtgtgttcataatttatgtagtatatttgataggtgatcttggaagatatctagtgttttggttgcatgaaatgatattgcgcgcgctcattactctggaaaaccacgcatgcatatggtatgaaattaatactgtgttacaaattaaaatggtattggtggtttttgctactcttttcccattatttcgaattttaaacatcacaataatataatcaattttttgctagttaaattggtttgtgcctcgaacagatatatagccactgtatctaattaacatttcttatgtgttcttatggatttatagtcagataataatcggccggttggatggataagtactgatcatatgcagtcttttcacaatggttgacaattttctgcatattgctttgtctatgaataaatgaggagtgcaaaacatcgatccacctgaattaatttaactcagtaaatacagataaatactgctatttgtagtatttcttagcaggagcgttgccattttgcgtcacttatttcttctcagatttaataatgtattttactttaattagttgtgagaacctggtggataaattaatatgtaaacatataataatgtggaatgggtggaatatgatttgacttgattattccctacaattaatatataacacaagctggcagcagtgtatatattct

SEQ ID NO: 5463 - DNA, 651 bp, Oryza sativa
  Predicted polypeptide sequence is orthologous to G962
atgcatatgcggagggggagagcggcgggaggcgaaggagaggcagctgcggtggtggtgatgaacaggtacgacaacaacgggcatgcggcagcggcggcggcggctgcggtggcgggaggaggaggaggaggaggagggaataaggcggcgggggaggtagatgggcatgaggatgacctggtgatgcccgggttcaggttccacccgacggaggaggagctgatcgagttctacctccggcggaaggtggagggcaagcgcttcaacgtcgagctcatcaccttcctcgacctctaccgctacgacccctgggagctccccggaattgagcatctaattaacaagctcgatgggggtgcagcaatggcggcgataggggagaaggagtggttcttctacgtgcctcgggacaggaagtacaggaacggggaccggccgaaccgggtgacggcgtcggggtactggaaggcgacgggggccgaccggatgatccgagccgagaacaaccgccccatcgggctcaagaagacgcttgtcttctactccggcaaggcccccaagggcgtccgcagcagctggatcatgaacgagtatcgccttccccccgccgacaccgaccgctaccacaaggtacccatccatccatga

SEQ ID NO: 5464 - DNA, 1305 bp, Oryza sativa
  misc_feature (178)..(178): n is a, c, g, or t
  misc_feature (188)..(188): n is a, c, g, or t
  misc_feature (217)..(217): n is a, c, g, or t
  misc_feature (268)..(268): n is a, c, g, or t
  misc_feature (306)..(306): n is a, c, g, or t
  misc_feature (363)..(363): n is a, c, g, or t
  misc_feature (415)..(415): n is a, c, g, or t
  misc_feature (417)..(417): n is a, c, g, or t
  misc_feature (463)..(463): n is a, c, g, or t
  misc_feature (507)..(507): n is a, c, g, or t
  misc_feature (549)..(549): n is a, c, g, or t
  misc_feature (650)..(650): n is a, c, g, or t
  misc_feature (777)..(777): n is a, c, g, or t
  misc_feature (818)..(818): n is a, c, g, or t
  Predicted polypeptide sequence is orthologous to G962
ttttttttttttttttcggcaagttgccatagttattgcaaacatactcgcagtacacatataccattactcccttaaaagcagccatcggcccaccagcataagcaattctcactcaccaatcgtgcacattggctccacatcaatgagccagcaccgcccagccaacaccccatcntacagcagcncactatcaataattgagcgcccagacacncagcataaataacacacaggcacacgacattagcacaccataggttaacanccattcatcagcgtcatattgagcatgtgctcccagcncacacaagaagagaaggcagttgcgttctacacaagcggagcacacaatttgagctnacaagtcaagcacaaggcacagacgtcaaatattcagcaggtgcctggtacntncagcagacaacatcacgtcatcgcaaggcagtaagcgacatttcanaaacgaacgttatggggcccacaactgtattggacaaggtggtntctagcaaacagagcaaagacattagaatccctgagcaatantatatcagttacacaaaagagagcgcaatttctataaggccagacttaccttgatatagcattcatccattacaaccaggccgcaaggactcattattacntatctatactccatatttaccgcgcacaggaacaaaagaaccgccacatatccacagttcctatcaatataataggacgaaccagttatccaaggaaacaacacgcacaagtactatcacattgcgnagaccacaaaatacaggaagtatgtgattactcccatgagncgccaatactccacacagcgggagttcctgaacccacatcacagaggttggaaccaaacaacagaggcaccgcaccagcggcacagtatacagcacaagcacaccggacaacaacaacgtctcttgtcatgtaacacatttcaatgacgaatacacgacagcaacacaactccaagagcacaaggacttactcatggggtcttacaacaccgaagagaaatacacatatcgcggatgacattagcatatgtggagaacaatcacaagactccctcatctagtcgacccgacatatgtgatggccaccacccaaaatatatttgagtggtgaccaatacaccaaatgagatacgccactccagcgacacatacagtggactatcatgacgtcacacaaccgcaaacaccaagattcatgtaacaggtgtggctcagaaacaccaacgtgaacatgacagtaccgtcatcactgagtaatgcaccacct

SEQ ID NO: 5465 - DNA, 1599 bp, Oryza sativa
  Predicted polypeptide sequence is orthologous to G963
atggcagaactaccaccggaaggccgcggcggcggtggcaacaacaatgggaagtggaaggggaaggaaaaggtggtgcccgagtacggcaagaaccggcacggcatgtccgtcggctggtacttcgtccccaaggatctggagctctttgccatcctcaagtgcaagctcgtccgcggccagctccccggcgccctcaacaacgtcttcgagcatatcaggatcctcgaattccaccccgccctcctgcatgagatgtacatcaagaacgaggaggatgggtacatctacttcttcagcaagaggcagttcacgacgaaggcagggaacaagaggcggccgacgcgggtgacaaagggcgggacgtggaaggcgtctggcgggagcaagacagtgaggagcaagaaggtcggcggcatcgacgttggccagaagctcaccatggtgttctacgagcgcaggtttgagggtgaccggaaccccatcaagaccaattggggcatgcatgagttcaccaagatcattgatggcaccaaaaaccagcttgaggaccttgccgtgtaccgcctgtacaagatcaaaaggaaggaggacgaagaaccgtcgaacactgccgccgcggcgtcgagcaccgacgagccctccacgtcgtcggcattgccacctcctacgccaccgcggccattgccggacatggccggaccgtcgtcagcaacgccgctactgccactgcaattgccgggcctggccgggtcgtcgtctgcgatgtcgctgcctgcactgcagctgccgggcatggccgggtcgtcgtcggcgatgccgctaccgccactatcgttgccgggcctggctggagggatgatgtccatggcggaccaggcgaacatggcctcgacgtcgcaggcgtccacaccgtcgtcggagctcctgcaagactggtacgacgagttcgagatcacgtacggcgccgtggctccgccgtctcctagcacgatcagctgggtggcgccgcagagctcgccgacggggtggtggccgtcgccgaacggcgggccggtgcagcacgacggctacctcgggatggcagcggatccaacgtcgtacatgctggaaaacctgttgcccaccgcggcgatcccgccggagccgatgatgccgccgacgagctcgccggcgccaccaccagccgtcgaccaccaccaccggctctcgcctccgcatgacgccgccggcagcaactacaaccacccggagctcgccgactacaacggcggcgtccaggcgcagcacgagcatcagtatcacccacaggagccgcaggcatcgctggtggatgccgaggacggctacagcgccatggccggtggcgacgacgcgcagctgggcggcgcggagcttgacaccgaacgaatcgccgaaatggtaaaccatataatggatggcgaattcgagttcaaattcgaggacaacaccgtccttaagtacaacgaagtctttcctgacaatgatgaggtggtggcggcgccgatgatgatcgacggtggtagggatggcgatggcgcagatggaggtgatggagacgacccattcgacaattag

SEQ ID NO: 5466 - DNA, 1205 bp, Oryza sativa
  Predicted polypeptide sequence is orthologous to G975
gattgaacgcacgctacactgcaagaaaggcaagtataggggtggcaggtagtttatattcactggaaaccgagaacttcactcctcccagcactccacactaggaggatgctcactgtctgaatgactgactggctgctgctgctgctcattccttctcctactctgcctgcctcctctgctgtgtccttgggagaattcttcagggacagtatccctgcagaggtgagatcatgggacagtcgaagaagaagttccgcggagtcaggcagcgccactggggctcctgggtctccgagatcaggcaccctctccttaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctgaattccggaagaacaggaaagaaattgaaaatgcaaggttaaaacagcatgatcaggtcaccatctaagatcaaggatctggtagggtggttggtgcacaggcagttaagattgctacatatgataggtatatctctattactactacatatccagcttaattaggaaacaattataagatcgattactactgtgtgaagtgaagctgtgtatttattaaagacttacttgtatgtacaagacgtccccgtcattatagtcatactggtgaaagctctgctatgtatcaacgtcatcagagatcagactacatatatataagtggtgtcaacttctaataaaagtaaataaaaacattgtaattgtgt

SEQ ID NO: 5467 - DNA, 1328 bp, Oryza sativa
  Predicted polypeptide sequence is orthologous to G975
gaacgcacgctacactgcaagaaaggcaagtataggggtggcaggtagtttatattcactggaaaccgagaacttcactcctcccagcactccacactaggaggatgctcactgtctgactgactgactggctgctgctgctgctcattccttctcctactctgcctgcctcctctgctgtgtccttgggagaattcttcagggacagtatccctgcagaggtgagatcatgggacagtcgaagaagaagttccgcggagtcaggcagcgccactggggctcctgggtctccgagatcaggcaccctctccttaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctccgcaagtgctgcaagacgccgtcgccgtcgctcacctgcctccgccttgacccggagaagtcccacattggcgtctggcagaagcgcgccggcgcacgcgctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctgaattccggaagaacaggaaagaaattgaaaatgcaaggttaaaacagcatgatcaggtcaccatctaagatcaaggatctggtagggtggttggtgcacaggcagttaagattgctacatatgataggtatatctctattactactacatatccagcttaattaggaaacaattataagatcgattactactgtgtgaagtgaagctgtgtatttattaaagacttacttgtatgtacaagacgtccccgtcattatagtcatactggtgaaagctctgctatgtatcaacgtcatcagagatcagactacatatatataagtggtgtcaacttctaataaaagtaaataaaaacattgtaattgtgt

SEQ ID NO: 5468 - DNA, 955 bp, Oryza sativa
  Predicted polypeptide sequence is orthologous to G976
atgatcacttgcatttcatcttttcatgaacgtttttttgtgcatgttgtttactgcatttttcagtttcagctgtgtagtagcacactctgtttgcttcatcgtttgtgttcgagatggatcgagacgagagcttgggcacgcagccattgaccgggaggcgggtgcgcgcggacacaaggcacccggtgtaccgcggcatccggctccgcagcggcaagtgggtctcggagatccgcgagccgggcaagtccagcaggatctggctcggcacgtacccgacgcccgagatggccgccgcggcgtacgacgccgcggcattggcgctgcgcggcgccgacgccgcgctcaacttccccggcacggccacgtcgcgcccggcgccagcctccggctcccccgacgacatccgcgcagcggccgcggccgccgccgcgatgatcggctccggtcaccgtggcaaccagcgcgccgccgacgcgagcacgtctcgcgcggcgacggcggcgccggaggccgccgtcgccgctggggcgggcgatcagaagcgcgtcgtggacgaggacgacgtcttcgagatgccgcggctgctggtgagcatggccgagggcttgatgatgagcccgccgaggctgagcccctcgacggacggcgtcggcggcgtgtcgccggaggacgacgaggacgaggacggcatgagcctgtggaaccattcctgaaatgggcttacgggtgcatagcatttgcaggaggacaccatgtattttccatgtgttcgtatgaattctgtgcctacgtacagtacgtactcggcacgtatgcgagataggaacagagcagagcaggatactgaattttatcgtagttgtcctgttacgtgtatacggtatatatggtcactccactgatgtataagccatccgtagacgaattatggctgaaaacgatgcccctg

SEQ ID NO: 5469 - DNA, 582 bp, Oryza sativa
  Predicted polypeptide sequence is orthologous to G976
atggagcaacgggcggcggcggcggcgcagcagcggcaggggaggaggcagagcgcggcggcgtgcgggatcaggcgggcgagggcggagacgcggcacccggtgtaccgcggcgtgcggttcagggcggggaagtgggtgtcggagatccgggagctccggaagccgagcaggatatggctcggcacgtacgccacccccgagatggccgccgcggcgtacgacgccgccgcactggcgctgcgcgggcgcggcgcggcgctcaacttccccgacgccgcgcggtcgcgccccgccccggcgtccgcgtccgccgacgacgtgcgcgccgcggccaccgccgccgccgccgcgatggcacaccaggaggaggacgacgacagtcggcgtcagctcgaggacgggggcggcggcggcggcgtggtggacgaggacgacgtgctggagatgccgaggctgatggtgagcatggcggaggggctgatgatcagcccaccgccggtgatgctcggcctgcaggcggacggcggtggaataatggacgagggcggcggcgtggtgaggttgtgggatcacagctga

SEQ ID NO: 5470 - DNA, 546 bp, Oryza sativa
  Predicted polypeptide sequence is orthologous to G976
accacgcgtcgctggtctcgatctcctcttcccttccctatctatactctctctatctccctcttgttgcataatcatatcgacttcttgcaagctaggttcgattgtgttgagacgcatactagcttaattagcagctggccggcagatattctcttggtacagcagccatagctaggggggagtaggtgcactgtagcttaatttggcggatataggtcatcccaaggtgtatatatgtcgatgggtgtgccctaatggtacatggctgacctgaccgagcatccgtcgccgactgctcctcctcaagtgcaaacagctggcctgccggtggcggcttctccgggtcctgcctcgcctcattcaccgtcggagcaaggggacaagacggcgcccggggcagccacggcgtcgacgatgacgacggcgagctcgggcgagccgtcgccacggtcctcggggaagcacgccttctaccggggcatccggtgcaggagcggcaaatgggtctcggagatccgcgagccgcgcaaagagcgccgcata

SEQ ID NO: 5471 - DNA, 868 bp, Oryza sativa
  Predicted polypeptide sequence is orthologous to G979
ctacattccacttccccaatatgcgccgctgcgtgcaggacttcgtgcgggaatgttccacctgccagcggtacaagagcgagcaccttcacccggccgggctgctgctgcccctgccgattcccacagcagtctgggccgacattggcctcgactttgtggaagcgctgcccaaggtgaacgggaagtcggtgatcctttccgtcgtcgaccgcttcagcaagtactgccacttcatcccgctggcgcacccgtacaccgccgagtccgtggctcaggcgttcttcaccgacatcgtccgcctccacggcatgccgcagtccatcgtctccgaccgcgacccggtgttcacttcactgttttggcgtgagctgatgcgcctcatgggcaccaagctgcacatgacgtccgccttccaccctcagtctgatggccagacggaggcggctaaccgcgtcattgtcatgtacctgcgttgttttacaggtgaccgaccccagcagtggctccgctggctgccttgggctgaattcgtgtataacacggcctaccagtcctcgctcaaggagacgcccttccgtgtggtgtacggccgtgacccgcccaccatccgctcgtatgagcctggtgagacgcgtgttgcagctgtcgcaagggacatggaggagcgagagaccttcctggctgaagtccgccaccgcctggagcaagctcaagccctccagaagctctactacgaccggcagcaccgcccggtgtcctatcaggttggcgactgggcgctgctgcgccttcgtcagcgcaccatggcgtccctgcctcaagcgcagccccggcagctgaagccgcgcttcgtcggtccctaccg

SEQ ID NO: 5472 - DNA, 1866 bp, Oryza sativa
  Predicted polypeptide sequence is orthologous to G979
aaggctagccgcctcactccctctctctgtttcctcttcttcttcttcctcccgccggtcagctcagctcgcctcgtctcctccattttggcgacgcgagcgagcatattaaagctgtgccggcggctgcaactttgccgccatttatttagctccggctcttttaaaagctctcttctcctgctgccatcttcttctggttggcaccaccattccatatataccatctccctcctcctcccgcgctcgctcttcgccaatggccaagcgacgcagcaacggcgagaccgccgccgcgagcagcgacgactctagctccggcgtctgcggcggcggcggcggcggtgaggttgagccgaggcggcggcagaagcggccgcggaggagcgccccgcgggattgcccctcccagcgcagctccgcgttccgcggcgtcacacggcaccggtggacggggcggttcgaggcgcatctctgggacaagaacacctggaacgagtcgcagagcaagaagggcagacaagtttacctcggggcttacgacggcgaggaagcggcggcgcgcgcctacgacctcgccgcattgaagtactggggccacgacaccgtcctcaacttccctctgtcaacatatgacgaggaattgaaggaaatggaggggcagtccagggaagagtacatcggatcgctccggaggaagagcagtggcttctcaagaggggtgtccaagtacagaggagttgcaaggcatcatcacaacggcaaatgggaggctcggattgggcgtgtgttcggcaacaaatacctctacctaggtacttatgcaacacaagaggaggcggccgtggcgtacgacatcgcggcgatcgagcaccgcggcctcaacgccgtcaccaacttcgacatcaatctctacatcaggtggtaccacggctcttgccgctccagcagcgccgccgccgccaccaccatcgaagacgatgatttcgccgaagccatcgccgccgcgttgcaaggcgtcgacgagcagccgtcgtcgtcgccggcgacgacgcgccagctgcaaaccgcggacgacgacgacgacgacctcgtggcgcagctcccgccccagctgaggccgctggctcgcgcggcgtccacctccccgatcggactgctgctgcggtcgcccaagttcaaggagatcatcgagcaggcggcggccgcggcggcgtcgtcctctggtagcagcagtagcagcagcacagactcaccttcttcttcgtcgtcgtcatcgctgtcgccgtcgccattgccatcgccgccgccgcagcagcagccaaccgtaccgaaggacgaccagtacaacgtcgacatgtcgtcggtggcggcggcgaggtgcagcttcccggacgacgtgcagacgtacttcgggctggacgacgacggcttcgggtacccggaggtggacacgttcttgttcggggatttgggcgcgtacgcggcgcccatgtttcagttcgagctcgacgtctgaactctcaactccgaccagggtgtttcgggaggcccacaatcccagcctgttcccgtagatgggctggaaagatcgaatcaaatttgggcctattcaggggatgggctgggagaattgatatgggccggcagggatggccgaaagggaaggcctcccaagttttggctgtcaagaagctagaactgagttctctctcaaaagagagagagagagagaagctagaactgaggattagttgcttactcgcaaatactagtagtttggaggaagagtaaaatattggtttatttgttgcccatctctgcgaaggggaatttaccgtaataaagagtacatattgccgtttt

SEQ ID NO: 5473 - DNA, 1272 bp, Oryza sativa
  Predicted polypeptide sequence is orthologous to G979
atgaggaagaagaagaaggcctttgctgttgcagctgcaaccaccttgctttcccctcctcggtcctcctcctcctcctcctccacggcgtcctcctgcattgtgccgccgcgcactgagagcggcaagaagaagagtaagcacaggaagagggccaaggatggcaccggcggtgacgacgacgacgccgccgttgctgctgcgccgaggaagggatcctccatctacaagggcgtggcaaggcacaggggttcagggaagtacgaggcgcacctgtgggacaagcaaggctggaacccaaaccagacaaggaagagaggcaggcaaggagcttatgacacagaggaggctgcagctcgcacttatgatcttgcggcactcaagatctggggctcagaccatgtcctaaacttcccgattgacacgtacaggaaggagcttgagaggatgcagcgaatgacaagggaggagtacctggctactctgaggcgcaagagcagtggcttctccaggggtgtctccaagtacaggggagtggcaaagcatcaccacaacggccggtgggaggccaggataggccgagctgtaggcaagaaatacctctacctgggaacattcgatacccaggaggaggcagccacggcctacgacctggcggcgatacagctccgcggccgcagcgcggtcaccaacttcgacgccagctgctacacctacacggaccacctgccgccgccgccgccgccgcagccaccgtccgtctgcaagaccgagccggagctggagccgccgcagccggcggcgcctccaggctcggagtcacttctccggcccaagatggagccctgcgacgactgggagccgccggcgatttgcccgtcgctccgtgacgcggacgacgcggaccacgccatcgccgagatcctgccggcgctctgcatggaccgcgccgacttcgaggccaggtaccctgcccgccgcgcccgcgacgccgccgccgacggctggtcgacgtcgtcggacgacgtcgccgccgcctccgtcgacgatgacgtgctgcgtagcctgccagacgacgtgggcttcgtcgacgacgtcgagagcctcttcctggacgcgcccggcccggccgccgccgccgccgccgccgcgatgccagacgacgtggaacgcgcggtgcagcgcgcgccttctgccgcgtctcgtcgggccaacgccgcggcggtctcctacgcgatcagctcgttggcgtccgggcgctggtggtattga

SEQ ID NO: 5474 - DNA, 1910 bp, Oryza sativa
  Predicted polypeptide sequence is orthologous to G979
gttgcctctcctcctcctcgtcacctcacctgcacctgcaccaacgcgagagatcatggcgaagagatcgtctcctgatcccgcatcatcttctccatctgcatcatcctcgccgtcgtctccttcctcctcttcctccgaggattcctcttcgcccatgtcgatgccctgcaagaggagggcgaggccgaggacggacaagagcaccggcaaggccaagaggcccaagaaggagagcaaggaggtggttgatccttcttccaatggcggtggcggcggcggcggcggcaagaggagttctatctacaggggagtcaccaggtatgcgtctctgcatggcatcggtggactggcagatttgaggcccatctgtgggacaagaattgctccacttcacttcagaacaagaagaaagggaggcaagtctatttgggggcttatgatagtgaagaggcagctgctcgtgcatatgaccttgcagctcttaagtactggggtcctgagacagtgctcaatttcccactggaggaatatgagaaggagaggtcggagatggagggtgtgtcgagggaggagtacctggcctccctccgccgccggagcagcggtttctccaggggtgtctccaagtacagaggcgttgccaggcatcaccacaatgggcggtgggaggcacggatagggcgggtcctggggaacaagtacctctacctgggtactttcgatactcaagaggaggcagccaaggcctatgatcttgctgcaattgaataccgaggtgccaatgcggtaaccaacttcgacatcagctgctacctggaccagccacagttactggcacagctgcaacaggaaccacagttactggcacaactgcaacaagagctacaggtggtgccagcattacatgaagagcctcaagatgatgaccgaagtgagaatgcagtccaagagctcagttccagtgaagcaaatacatcaagtgacaacaatgagccacttgcagccgatgacagcgctgaatgcatgaatgaaccccttccaattgttgatggcattgaagaaagcctctggagcccttgcttggattatgaattggatacaatgcctggggcttacttcagcaactcgatgaatttcagtgaatggttcaatgatgaggctttcgaaggcggcatggagtacctatttgaagggtgctccagtataactgaaggcggcaacagcatggataactcaggtgtgacagaatacaatttgtttgaggaatgcaatatgttggagaaggacatttcagattttttagacaaggacatttcagattttttagataaggacatttcaatttcagatagggagcgaatatctcctcaagcaaacaatatctcctgccctcaaaaaatgatcagtgtgtgcaactgattctctctgtgtgtgtttctgggtgttgaaaatcttgagatatacagggaagttttcaggtttttatcttggggtatatttctctgtccaatggcactgccacaaagaagcaaagcttctgtaggcgttctgttcaggtggggaagattcatatgcttctccctatggtcctagtctcctagaaacccaaaggcattcaacttggcatgagacaagtgtctgtgttccttttcttgtaatacccccaaggctgattgattaactagggagacaattttctcccttaccctagattgagctagttaattctgattactcagaatcttgaatgcttgagtagtactataggtattcccacaagaaaactctgggtagttcacagttttataaggtaatggagcatatgttatacagaaatcacaatatgtaaatctatctaactttcagaataaactatactatacatcttggttgaggcatgaatgcat

SEQ ID NO: 5475 - DNA, 1572 bp, Oryza sativa
  Predicted polypeptide sequence is orthologous to G979
gagcagcggtgtcgccgccgccgccgccgcggcggcggtgaagccgaagcgcacgcggaagagcgtcccccgcgagtccccctcccagcgcagctccgtctaccgcggcgtcacccggcaccggtggacggggcggttcgaggcgcacctgtgggacaagaacagctggaacgagtcccagaacaagaagggcaagcaagtttacctcggggcgtatgacgacgaggaggcagcggcgagggcgtacgatctggcggcattgaagtactggggacccgacaccatcctcaacttcccgttgtctgcatatgaaggtgagttgaaagaaatggaggggcaatcaagggaagagtatattggatccctaaggaggaaaagcagtgggttctcaagaggagtatcgaagtaccgaggcgttgcaagacaccatcacaatgggagatgggaggcccggattggccgtgtttttggcaacaagtacctctatctcggtacttacgcgacgcaggaggaggcggcaatggcgtacgacatggcggccatcgagtatcggggcctgaacgccgtcaccaacttcgacctcagccggtacatcaagtggctccggcccggcgccgacggcgcgggcgctccccagaatcctcaccccatgctgggtgctctgtcggcgcaggatctcccggcgatcgacctcgacgccatggcgtcgtcgttccagcacgacggccatggcgccgcggcggcggcggcacagctgatcccggcaagacattcgctcggccacacgccgacaacgtcggcgctcagcctgctgctgcagtcgcccaagttcaaggagatgatcgagcggacgtcggcggcggagaccaccaccaccagcagcacaaccacctcctcctcgtccccgtcgccgccgcaggcgaccaaggacgacggcgcctcgccgcagtgcagcttcccggaggacatccagacctacttcggctgcgccgccgaggacggcgccgccggcgcgggatacgccgacgtggacggcctgttcttcggcgacctcgccgcgtacgcgtcgccggcgttccacttcgagctggacttgtgacggcggcgccgccgctgccgcagccgagcagtgtcagcttgtgcctcgccagtagcccaacggccacggcgcaatacagttacaggccgttaattaaattctttaattgggtggatttggtccataggagaatgaccaaaaaaagagaaggaacagacgaacagacaaatggaaggcaggcaagaatgcaagatactcttatagcacaagctagtgcttacagagttaatgacagtattatagtgacaagctgaagaccgagaattacttcaagattgattttcttaccttgacaatccgaatgagagagagagagatagtgggtgtgtgacagtgtgaggagaggagattgtttcatttttgcttcatccctgacaaaatgaacaactatatagtatcttttttttttgagaacgactatatagtatctataatctacataaatacttgatagaaggatttgtgagtttctg

SEQ ID NO: 5476 - DNA, 1296 bp, Oryza sativa
  Predicted polypeptide sequence is orthologous to G979
atggatcatagcatcatgatggtgaagaatgagattgaaaactactcaggatcatctccagcaatgatcatcaatgcgctggaaggcggcgccgaggcgggcccggttgtcaggaggagaaggagggagccgtctttgctcgcaccgatcaatggtgatggtgacaccaatggtggtggcattggcaagtcgtccttgtcaggcatcactgtcaagaggagctctaggtttcgtggagttagcagattcagagcttgtagagatgacaagaagatgttgtcatgtaggcatcggtggacaggtcgtttcgaagcacatttgtgggacaagaactcgtggaatcctacacagaggaagaagggcaagcaggtctatcttggagcatatgatgaggaggaggcagcagcaagggcttatgaccttgctgctctcaagtactggggaccaactacctatacaaattttccggtaatggactatgaaaaggagttgaagataatggagaatcttactaaggaagagtatcttgcatctctaaggaggaagagcagtggcttctcaagaggtgtgtccaagtacagaggggttgcgaggcatcatcaaaatggaagatgggaagcaagaattgggcgtgttttcggaaacaagtacctctacctaggaacctacagcactcaagaagaggctgcccgtgcctacgacatcgccgcgatcgagtacaaaggcgtaaacgccgtcacgaacttcgacctcagatcatacatcacatggctgaagccaacccctgctcatgttgccatgaaccctgcagaagctcttgcaatgcagatccctgtagatcacttcctcccaatggaaacccagatgatgatgctccctcagagcaatcctttcacctcatatcacaatgcacaatcactgggtggtggtgacggtggcagtagcagtactaataatcaagaagcctccatgataatctctcccagtggctcatctagaaagagatcatcatccactgctcttagccttcttctgaaatcgtcgatgttcaggcagctggttgagaagaattcagatgcaggtgaagaaaatggaggtgagatgagagagccgggtgcccatccaggagaaggatatgaataccacaacttcttccagggagatgctgctccggacatggacatgtgtgatctgctttcatcaggaaatgtgcatgctgcaagtggtagtgctggatttgaagaggacatcgcatgttatagtggttttggaagcatgcagtcgctgcagcaatag

SEQ ID NO: 5477 - DNA, 678 bp, Oryza sativa
  misc_feature (678)..(678): n is a, c, g, or t
  Predicted polypeptide sequence is orthologous to G991
ttttttttttttttttttttttttttttttttttttacgaaaaaaatcatatgttattcatggagatcgatataaaaacactgaaatggcacaaggacaatattattctacccctggtcaggagtaacaactgcaacgcttaatttttttaaccgatgccatttcagcacttaaaagctaattaaaacattattagtctcttacaagggtagcaacaacggatgatggtagcagcatatatttggagctaattaaaagcggcagagaattaattattggagatagatagattggacgaaatgacgcggttgcagctatgcttgcgatagccatgtagctatatcaggcgaagcttgggtcatcgttgctcgcggatcccgcaacatcgtcaacggcgtcagctgcagaagcaacgccatcgtcagcagcaactccatctccatgttcggcagcagtagcagaagaagcccggttggcctcttcctcctcctgaaatgattttcattctggtgttcggcaggggacaatggagatgtttttgactgggggggggagaacctcccatgggacatcaccaaggaagcaccgacccccttccatttttgcgcacaagagggtcaaggactgtgatattgggaccatgtttttacttgttaccaagatgcaataagtgttggn

SEQ ID NO: 5478 - DNA, 661 bp, Oryza sativa
  misc_feature (147)..(147): n is a, c, g, or t
  Predicted polypeptide sequence is orthologous to G993
ccgtcgtgggcgcgggagccactgttcgagaagccgtgacgcccagcgacgtcggcaagctcaaccgcctgctggtgcccaagcagcacgcggagaagcacttcccgctgcgcggacgagctccgacgcctccgccaccgccgccancgccacctgcaactctgcaagggcgtgctcctcaacttcgaggacggcgaggggaaggtgtggaggttccggtactcagtgctggaacaagcagccagagttacagtgctgacacaagggatggagccagattcagtgagggagaagggcctccagcagcacggcgacaccatagtcttctccggctcaggcagtatggccccgacaagctgctcttcatcgactgcaagaagaacaaacacggcggcaggccaccggcgacgagaagccaaattacaagcaggcgaagcaacacagcgtcagtgaggctgttcaggcatggacatcaccggcggcggcggcagattgccaggaagcgggagaggcaggtggaaatggggcaagaggcagttcttgatgaagaggcaatgcagtggttcatcagcagtactcctgcccttggtgcccctgctgttataacatcaaatcaattcatatatacatcataaatcttccatctaaaaaaaaaaaaaaa

SEQ ID NO: 5479 - DNA, 801 bp, Oryza sativa
  Predicted polypeptide sequence is orthologous to G993
gttcttctctcccccttttctcttccccgttcgaacgcctcggcggcagcggcggccgggggccggagtggcgacggcggccgcgccaccgcctgccctgtctccaagctggcctaccatcgcgcaagctccgccaggggctccgccgggggcgcggcatgggcgcccgcgcgcagcccacgccgtcgtgggcgcgggagccactgttcgagaaggccgtgacgcccagcgacgtcggcaagctcaaccgcctgctggtgcccaagcagcacgcggagaagcacttcccgctgcggcggacgagctccgacgcctccgccaccgccgccgcggccacctgcaactctgcaagggcgtgctcctcaacttcgaggacggcgaggggaaggtgtggaggttccggtactcgtgctggaacagcagccagagttacgtgctgaccaagggatggagccgattcgtgagggagaagggcctccgcgccggcgacaccatagtcttctccggctcggcgtatggccccgacaagctgctcttcatcgactgcaagaagaacaacacggcggcggccaccggcgacgagaagccaattacaagcggcgaagcaacacgcgtcgtgaggctgttcggcatggacatcaccggcggcggcggcgattgccggaagcgggagagggcggtggaaatggggcaagaggcgttcttgatgaagaggcaatgcgtggttcatcagcgtactcctgcccttggtgccctgctgttataacatcaaatcaattcatatatacatcataaatcttc

SEQ ID NO: 5480 - DNA, 1512 bp, Oryza sativa
  Predicted polypeptide sequence is orthologous to G993
gatcatcttctttggcttctccctcttcactgccctaattacaacccatttgcttatctctctcctctctctctctctctcgctgcagccatagcttagctagagctagagctttcttggtgccgagatgggggtggtcagcttctcctcgacttcctccggcgcgtccacggccaccaccgagtccggcggcgccgtgcggatgtcgccggagccggtggtggcggtggcggcggcggctcaacagctaccggtggtgaagggagttgactcggcggatgaggtggtgacgtcgaggccggcggcggcggcggcgcagcagtcgtcgcggtacaagggggtggtgccgcagccgaacgggaggtggggggcgcagatctacgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgctccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatagcatcaaatcaaattcatatatagatcaaatcaaatcttcttctcttccatcttttttgttgttcatcgtctgttgtttcatcttcgatttagagctgttctatcttcgactttctttttttgttttttgtctttattttgcatagaagtttgtcaggtcagagattgcaaatgatcgatcaagatcgagctgtatatgtacagccttattaggaaattaagtctagagatcattcaagtatgtacaattatctaatagtacatagtaataagttctgtttctttccg

SEQ ID NO: 5481 - DNA, 1182 bp, Oryza sativa
  Predicted polypeptide sequence is orthologous to G993
atggacagctccagctgcctggtggatgataccaacagcggcggctcgtccacggacaagctgagggcgttggccgccgcggcggcggagacggcgccgctggagcgcatggggagcggggcgagcgcggtggtggacgcggccgagcctggcgcggaggcggactccgggtccgggggacgtgtgtgcggcggcggcggcggcggtgccggcggtgcgggagggaagctgccgtcgtccaagttcaagggcgtcgtgccgcagcccaacgggaggtggggcgcgcagatctacgagcggcaccagcgggtgtggctcggcacgttcgccggggaggacgacgccgcgcgcgcctacgacgtcgccgcgcagcgcttccgcggccgcgacgccgtcaccaacttccgcccgctcgccgaggccgacccggacgccgccgccgagcttcgcttcctcgccacgcgctccaaggccgaggtcgtcgacatgctccgcaagcacacctacttcgacgagctcgcgcagagcaagcgcaccttcgccgcctccacgccgtcggccgcgaccaccaccgcctccctctccaacggccacctctcgtcgccccgctcccccttcgcgcccgccgcggcgcgcgaccacctgttcgacaagacggtcaccccgagcgacgtgggcaagctgaacaggctcgtcataccgaagcagcacgccgagaagcacttcccgctacagctcccgtccgccggcggcgagagcaagggtgtcctcctcaacttcgaggacgccgccggcaaggtgtggcggttccggtactcgtactggaacagcagccagagctacgtgctaaccaagggctggagccgcttcgtcaaggagaagggtctccacgccggcgacgtcgtcggcttctaccgctccgccgccagtgccggcgacgacggcaagctcttcatcgactgcaagttagtacggtcgaccggcgccgccctcgcgtcgcccgctgatcagccagcgccgtcgccggtgaaggccgtcaggctcttcggcgtggacctgctcacggcgccggcgccggtcgaacagatggccgggtgcaagagagccagggacttggcggcgacgacgcctccacaagcggcggcgttcaagaagcaatgcatagagctggcactagtatag

SEQ ID NO: 5482 - DNA, 954 bp, Oryza sativa
  Predicted polypeptide sequence is orthologous to G993
atggagcaagaagctgccatggtcgtcttctcctgcaactccggctccggtgggtcgtcgtcgacgaccgattcaaagcaagaggaggaggaggaggaggagttggccgcaatggaggaagacgagttgatccacgtcgtccaggcggcggagctgcggctgccgtcgtcgacgacggcgacgcggccgtcgtcgcggtacaagggggtggtgccgcagccgaacgggcggtggggggcgcagatctacgagcggcacgcgcgggtgtggctcgggacgttccccgacgaggaggcggcggcgcgcgcctacgacgtggcggcgctccgcttccgggggcgcgacgccgtcaccaaccgcgccccggcggcggagggcgcgtccgccggcgagctcgcgttcctggccgcgcactccaaggcggaggtcgtggacatgctgcggaagcacacctacgacgacgagctccagcagggcctccgccgcggctcgcgcgcgcagccgacgccgcggtgggcgcgcgagccgctgttcgagaaggccgtgacgccgagcgacgtcggcaagctcaaccgcctcgtggtgcccaagcagcaggccgagaggcatttcccgttcccgctccgccgccacagctccgacgccgccggcaagggcgtgctcctcaacttcgaggacggcgacggcaaggtgtggcgattccggtactcgtactggaacagcagccagagttacgtgctcaccaaggggtggagccgattcgtgagggagaagggcctccgaccaggcgacaccgtggccttctcccggtcggcggcggcgtgggggacggagaagcacctcctcatcgactgcaagaagatggagaggaacaacctggcaaccgtcgacgacgatgcccgtgtcgtcgtcaagctgttcggcgttgacatcgccggagacaagacgaggtaa

SEQ ID NO: 5483 - DNA, 1185 bp, Oryza sativa
  Predicted polypeptide sequence is orthologous to G993
atggacagcacgagctgtctcttggacgacgcgagcagcggcgcgtccacgggcaagaaggcggcggcggcggcggcgtcgaaggcgctgcagcgcgtgggcagcggcgccagcgcggtgatggacgcggccgagcctggcgccgaggcggactcgggcggcgagcggcgcggcggcggcggcgggaagctgccgtcgtccaagtacaagggcgtggtgccgcaaccgaacgggcggtggggcgcgcagatatacgagcggcaccagcgggtgtggctcggcacgttcaccggcgaggcggaggcggcgcgcgcctacgacgtggcggcgcagcggttccgcggccgcgacgccgtcaccaacttccgcccgctcgccgagtccgacccggaggccgccgtcgagctccgcttcctcgcgtcccgctccaaggccgaggtcgtcgacatgctccgcaagcacacctacctcgaggagctcacgcagaacaagcgcgccttcgccgccatctccccgccgccccccaagcaccccgcctcctctccgacgtcctcctccgccgcgcgcgagcacctgttcgacaagacggtgacgcccagcgacgtcgggaagctgaaccggctggtgatccccaagcagcacgccgagaagcacttcccgctccagctccctccccctaccacaacctcctccgtcgccgccgccgccgacgccgccgccggcggcggcgattgcaagggcgtcctcctcaacttcgaggacgccgccgggaaggtgtggaaattccggtactcctactggaacagcagccagagctacgtgctcaccaaggggtggagccgcttcgtcaaggagaaggggctccacgccggcgacgccgtcggcttctaccgcgccgccggtaagaacgcgcagctcttcatcgactgcaaggtccgggcaaaacccaccaccgccgccgccgccgccgccttcctcagcgcggtggccgccgccgccgcgccgccacccgccgtgaaggctatcaggctgttcggtgtcgacctgctcacggcggcggcgccggagctgcaggacgccggcggcgccgccatgaccaagagcaagagagccatggacgccatggctgagtcacaagcacacgtggtttttaagaagcaatgcatagagcttgcgctaacctag

SEQ ID NO: 5484 - DNA, 802 bp, Oryza sativa
  Predicted polypeptide sequence is orthologous to G993
ctctcttctctcccccttttctcttccccgttcgaacgcctcggcggcagcggcggccgggggccggagtggcgacggcgaccgcgccaccgcctgccctgtctccaagctggcctaccatcgcgcaagctccgccaggggctccgccgggggcgcggcatgggcgcccgcgcgcagcccacgccgtcgtgggcgcgggagccactgttcgagaaggccgtgacgcccagcgacgtcggcaagctcaaccgcctgctggtgcccaagcagcacgcggagaagcacttcccgctgcggcggacgagctccgacgcctccgccaccgccgccgcggccacctgcaactctgcaagggcgtgctcctcaacttcgaggacggcgaggggaaggtgtggaggttccggtactcgtgctggaacagcagccagagttacgtgctgaccaagggatggagccgattcgtgagggagaagggcctccgcgccggcgacaccatagtcttctccggctcggcgtatggccccgacaagctgctcttcatcgactgcaagaagaacaacacggcggcggccaccggcgacgagaagccaattacaagcggcgaagcaacacgcgtcgtgaggctgttcggcatggacatcaccggcggcggcggcgattgccggaagcgggagagggcggtggaaatggggcaagaggcgttcttgatgaagaggcaatgcgtggttcatcagcgtactcctgcccttggtgccctgctgttataacatcaaatcaattcatatatacatcataaatcttc

SEQ ID NO: 5485 - DNA, 881 bp, Glycine max
  misc_feature (777)..(777): n is a, c, g, or t
  Predicted polypeptide sequence is orthologous to G1006, G22, G28
ccatcaatttgttatatattcttcattattttcattgtcatgagatacaactattcatattacaaagaaaaaggaaaaaaaaatactatgacaaactatcctcacacttctgcaatgccataagaatggcaagatagtagtaatacatttcatatatatatatatatatatatatattcccttttattattgccacctcgtgtctattgaaaactgccacatatttttgaatcatatatccagctccaaatctgtcaaggagctatctttactccgctttatggctaccgtggatgacaaaggacactataaagaaacatccgacaaatgtttcaatgtttctttagcgtaaccttaattggctcatgatccgagccaattaaatgaggaaaattcagcttagcttttgagccccgcatcttaaatgcagctcgatcataagctaaagctgcatcctcagcggtttcgtaggttccaagccacactctcacaccattcctcttagtgtccctaatctccgccgcatacttcccccacggcctcctccgcacgcctcggtagctcaaccccttctttggaggcgtgcgagtgccacgcgcggctgtagttttactattttgaccctcattttccattttcacagctacactaacattactcacctcatttccattggcggggaaccatccggtggcagcagcatcacgcaaagcaccgtagatgaccatgtcattggtgtcgttctccttcaacggcagctccgcccaattctctgtncagaaaatgttccggaagctagaactccggcagaacgctgctatggacggcaccgatgcagaaacgtcctgaaacggcgtcgttacgggtatctcaaagtgatc

SEQ ID NO: 5486 - DNA, 761 bp, Glycine max
  Predicted polypeptide sequence is orthologous to G1006, G22, G28
atacagtgagcaaagttagctgaaaattaaaacatggtttccgccaccgtggattccgattttgcattcttggaatctgttcaacaatacctacttggacatgattccatcaatctcatgtctgaaacccaccaagctgcatctcatgatccattttcagaccctaataaatgtgatggtgattcagggaacattgctttccgaagtgaggatgcaacggctgtggtagcgcgtgatcatgcgccaccaacatggaagcattacagaggggtgaggcgtagaccgtggggaaagtttgcggccgagattagggatccaaagaagaacggagctagggtttggcttggcacgtatgataccgaagagaaggccgctttggcatatgacaaagccgctttcaaaatgcgaggccaaaaggccaagctgaattttcctcatcttattgattccgacaattccgatgaattgtcggagccagtaatgatgacaacttccaagcgaagtttgttagaaatttcatcaccgtcgtcctcgtgttcagatgatagctcagaatcacaagggacaaagaggaggaagagcctggctgaactactgaataaattagccaagaatagaagccaagtcaaggtggaatgttgaagtggctagaggaatatgcatgttgtacaatttgatcaatcattaatatgagacttcaacgattgtaatgtaatctggtgttcatagaattaatgcaattttgttcccaaaaaaaaaaa

SEQ ID NO: 5487 - DNA, 825 bp, Glycine max
  Predicted polypeptide sequence is orthologous to G1033
aatgaacaaagtagtttttgctcgagcactactacttgtatatatatgcagatagctacaaagaaattaacaagtttttttctgcccaagctacggataacatgatgtaaacatatcatctaactaacctaaagctaaggccttgggtccagtctcttaggttggcaggtagatgctttaaatgagttcatctctaagcctcatccaattactttgggtctcctttcttcttaagttcttttacatttaaacagcaaccaaagctgcgtgttccaggatatgtctttacaaggccacgtataaaaacaacaacatttgcatcaacaagaccccaccctttttttctgctcaaacttcaactctcaagggttcctcaatcatgccttaacaagctctcatcatcattgacttcaaactttaacttgtcagactcgtattcctctggattcttcccctccaatttcttattgtaagccaaaatagttttcttatactcttgtttcttctttttggccatagcaacgaagggactttttcatgaaacattaaattaatgcaaactaggttacaaaaatgtggatatcatcaataaattaggatgctccttcttgaactgctctctgaactcggacatgaaaatgaaaaaaacgcttggaggtctctttcgcttgttaggaaccttagcagctttcttcgattgtttccttccagcagcaccagtgcccttgcgcttcaaccacaaagttgctgattcccgacagcatgcgtcgttgaggccgatttcagcgacggtgcagatcttatggttgtttggtgccagtgcgc

SEQ ID NO: 5488 - DNA, 1003 bp, Glycine max
  misc_feature (1)..(1): n is a, c, g, or t
  misc_feature (675)..(675): n is a, c, g, or t
  misc_feature (685)..(685): n is a, c, g, or t
  misc_feature (687)..(687): n is a, c, g, or t
  misc_feature (689)..(689): n is a, c, g, or t
  misc_feature (706)..(706): n is a, c, g, or t
  misc_feature (722)..(722): n is a, c, g, or t
  misc_feature (770)..(770): n is a, c, g, or t
  misc_feature (793)..(793): n is a, c, g, or t
  misc_feature (935)..(943): n is a, c, g, or t
  misc_feature (945)..(945): n is a, c, g, or t
  misc_feature (947)..(953): n is a, c, g, or t
  misc_feature (955)..(956): n is a, c, g, or t
  misc_feature (958)..(964): n is a, c, g, or t
  misc_feature (966)..(968): n is a, c, g, or t
  misc_feature (970)..(972): n is a, c, g, or t
  misc_feature (974)..(978): n is a, c, g, or t
  misc_feature (980)..(981): n is a, c, g, or t
  misc_feature (983)..(1001): n is a, c, g, or t
  misc_feature (1003)..(1003): n is a, c, g, or t
  Predicted polypeptide sequence is orthologous to G1033
naagtcggggcgcgttcttttttgaaatcccgcctgcgcgcattaaccctcactaaagggaacaaaagctggagctccaccgcggtggcggccgctctagaactagtggatcccccgggctgcaggtgctagtggtactgtcttagctttgattctctgttctctgttttgttctgtttcgcgtattgtcttcatacaggaacttgaacaatgaagaatgcaaagggcaagggagcagcaagggcctcaaaagaatcactgaagcccgttgatgaccgaaaggttggaaagcggaaggcttccggtaagcctgggagaagtagtgcaccaaagaaggagaagaaggccaagaaagaccccaacaagcctaaaagaccacccagtgctttctttgtgttccttgaggagttcaggaagacctttaaggctgagaatcctaatgtgaaggctgtatcagttgttgggaaagctggaggagagaaatggaaatccttgtccagtgctgagaaagctccatatgaagccaaggctgcgaaaaggaaagctgagtatgaaaaacttatcaaagcttatgataagaagcaggcaagcttcgcagatgatgaagaatcagacaagtccaaatctgaagtgaatgatgaagatgattgtccagtgagagaggggaggaagagngagatgtagnangnagaaagcgagagatatngacttgagaatgtgtncaaaaactttggttatgatggtttgttgggaagagggctatatatatntgattggcatactagctactttntaattttgtgctggtgaaaggaattcttcttttgtggcatgattacctaccaactcttgacttccttacttactttcgacctgatcacttttggcatggacccttaaatggtggcttagtaattattcttctggcacaacannnnnnnnnanannnnnnnanncnnnnnnnannnannnannnnncnntnnnnnnnnnnnnnnnnnnncn

SEQ ID NO: 5489 - DNA, 965 bp, Glycine max
  misc_feature (1)..(3): n is a, c, g, or t
  misc_feature (188)..(188): n is a, c, g, or t
  misc_feature (198)..(198): n is a, c, g, or t
  misc_feature (209)..(209): n is a, c, g, or t
  misc_feature (758)..(758): n is a, c, g, or t
  misc_feature (768)..(768): n is a, c, g, or t
  misc_feature (798)..(798): n is a, c, g, or t
  Predicted polypeptide sequence is orthologous to G1033
nnnggggatagaacgacgtaggagcagagatgcacaattcaccctcactaatgggaacaaaagctggagctccaccgcggtggcggccgctctagaactagtggatcccccgggctgcaggaattcggcaccagctagtctcgcgtttttttttttttttttttacagcagaaaagcgaatgataagnccaattatanttgatacaaancttaaccagatttcaacaagaaaactctaaatcaaactaaaagctctacaagagataaacaccccttaactaaacagttggatttagaagtacaaataaagaactcccttctttaaactattcacgttttggaaagacaaccaatttacggagggagcagggaaatattttttggaagcaagaaatatgtttatcaggaaatgaccagaccacctacaacagatgatcaaaatcatcagaacctacataaatgcaattatcagtccattctctaatcgtcatcctcttcctcgccactgccttcctcatcatcatcttcatcattcacctcagatacagacttctcagattcttcttcatccccaccagtaggaccttccgcctgtttcttgttataggctctcatgttcttctcgtactccactttccttttctcagactttgccacataaggtgctttttcagcatcagacatggtctccattttgctcagcagctttgccacagcagacactggcttgttttcagatgttctttgtggataccttnctgaactctncatgaaaacgaagaaagcacttgaagcctnttttgcttggtaggtcttcgctgccttcccttgcccgcggttcctaaacttgtgcggctccttctattaccagaagagttgatcgtctctaagatcgccttgacttctcctcatacgaaacaaaggggacaggtcgcctcagttaccttaacgtgtatttcactgtt

SEQ ID NO: 5490 - DNA, 909 bp, Glycine max
  misc_feature (1)..(1): n is a, c, g, or t
  misc_feature (10)..(10): n is a, c, g, or t
  misc_feature (812)..(812): n is a, c, g, or t
  misc_feature (909)..(909): n is a, c, g, or t
  Predicted polypeptide sequence is orthologous to G1033
nttttttatntttttcttccctcccccccccccccccccccccctgcgatgaaaagtagacgatacgatatcgtcaagctctaatacgactcactatagggaaagctggtacgcctgcaggtaccggtccggaattcccgggtcgacccacgcgtccggcaaagtctgagaaaaggaaagtggagtacgagaagaacatgagagcttataacaagaaacaggcggaaggtcctactggtggggatgaagaagaatctgagaagtctgtatctgaggtgaatgatgaggatgatgacgaggaaggcagtggcgaggaggaggatgacgattagagaatggactgatgataatagcatttatgtaggttctgatgattttgatcatccgtgtaggtggtctggtcatttccttataaacatatttctctttccaaaaaatatttccctgctcctccttccgtaaattgctcgtctttccaaaacgtgaatagtttaaagaagggagttctctttatttgtatttctaaatccaactgtttagttaagggatggttatctcttgtagagcttttagtttgatttagagttttcttgttgaaatctggttaagtttgtatcaatataattgacttatcatcaaaaaaaaaaaaaaagggcggccgctctagaggatccaagcttacgtacgcgtgcatgcgacgtcatagctcttctatagtgtcacctaaattcaattcactggccgtcgttttacaacgtcgtgactgggaaaactctggcgttacccaacttaatcgccttgcagcacatacnccttcgcagctgcgtatagcgagaggccgcacgatcgcctttccacagtgcgcagctgatggcgatgggagcgcctgtacgcgcataagcgcgcggn

SEQ ID NO: 5491 - DNA, 914 bp, Glycine max
  misc_feature (332)..(332): n is a, c, g, or t
  misc_feature (351)..(351): n is a, c, g, or t
  misc_feature (579)..(579): n is a, c, g, or t
  misc_feature (657)..(657): n is a, c, g, or t
  misc_feature (666)..(666): n is a, c, g, or t
  misc_feature (683)..(683): n is a, c, g, or t
  misc_feature (694)..(694): n is a, c, g, or t
  misc_feature (728)..(728): n is a, c, g, or t
  misc_feature (738)..(738): n is a, c, g, or t
  misc_feature (743)..(743): n is a, c, g, or t
  misc_feature (811)..(811): n is a, c, g, or t
  misc_feature (879)..(879): n is a, c, g, or t
  misc_feature (914)..(914): n is a, c, g, or t
  Predicted polypeptide sequence is orthologous to G1033
tgatccatggtaggatccgccaagcgcgcaattaaccctcactaaagggaacaaaagctggagctccaccgcggtggcggccgctctagaactagtggatcccccgggctgcaggaattcggcacgaggcgcactctctctttttctctctgttttttgttctctcttcgcttaaaccctatcgttcttctcgttttcgccgattctcgccatgccgaaagctaaatccgacgccaaagccgccgatagcaggttgaagcggaagggcgctggtgctgggaggaagcaatcgaggaaagctgctaaggaccctaacaagccgaagagacctncaagcgcttttcttcgttntcatgtccgagttcagagagcagttcaagaaggagcatcctaacaacaaatccgtcgctgttgtcggcaaagctggtggtgaaaaatggaaatcgctatctgatgctgaaaaggcccctttcgttgctactgctgagaagaagaaacaggagtatgagaaaactatttcggcttacaataagcaattggagggaaagaattcagaggaagacgagtctgacaagtcanagtctgaagtcaatgatgacgaggaagatgatgaggaggatgatgatgagtaaagatgtgatacatgatggagcgtangtggatgcngggaaaagaaaatgttntgcatagttgntggtttagaattcataggatgtccctaccacatnctttctgatnatagnttctgaattttatttgtcttactcagtagttagataggcacatcgtaaataggttatatcatgactgnactaagtcaagtattatcgtctatctatctcaaaaaaaaaaaaaaactgaaggggccgtcccaatcgnctttaagtatcatagcccttctgtgcggtttaaan

SEQ ID NO: 5492 - DNA, 988 bp, Glycine max
  misc_feature (47)..(47): n is a, c, g, or t
  misc_feature (50)..(51): n is a, c, g, or t
  Predicted polypeptide sequence is orthologous to G1033
cgtttatcatcaaccgcccccaccttccgctgcccacctgtcggtgngcnncccccgcagtccatctaaaatacatgaacatacatatacacaggagcggcgcgttgtgcctcatgtatggggacatcccctgcagctcccccgcggtggcggccgctctacaactatatgatcccccgggctgcaggaattcggcgcgaggttttcatgtccattcagagagcagcttaagaaggagcatcctaacaacaaattcgtcgctgttgtcggtaaagctggtggtgacaaatggaaatcgctgtctgatgctgaaaaggcccccttcgttgccacggccgaaaagaagaaacaagagtatgagaaaactatcttggcttacaataagaaattggaggggaagaactccacagaacacgagcctgccaagtcaaagtctgaagtcaatgacgatgaggaagatgaggaggaggaggatgatgatgacgacgagtgaagatggtgacacaagatgaagcgtaggaggatgtgggaaaagaaaagtgtttcgcatatgtcactgatgggtgtagaatgtcataagacgagtcccaacccacatccgtctatgagaatgtggatttgcgtcaccactgagaaatgactccaaacatgctgagagagctgtccagcagacagcttgcgatatccacttgcgacactgcattcgtcatcactcgcactcgtctcacgtccactttctcgagaactaccactccgctccacaccatgtatcgtgtatgatgcgtccgcaccaaaccggcctaaacagatgtgaaataccatcactacttgcctctattcccacgacatctctcggaacacctcgcattcccaacttatcgccttgcgtactaccactctccccagcggcggtgtagcgagaaggtccagccggatcgcctcgcaccaacgcgccgctgatagtggaagcgaccgacgcttcacgccc

SEQ ID NO: 5493 - DNA, 875 bp, Glycine max
  misc_feature (603)..(603): n is a, c, g, or t
  misc_feature (611)..(611): n is a, c, g, or t
  misc_feature (808)..(808): n is a, c, g, or t
  misc_feature (822)..(822): n is a, c, g, or t
  misc_feature (833)..(833): n is a, c, g, or t
  Predicted polypeptide sequence is orthologous to G1048
cgagtgacaaggtaggactactgctagaatacgccaagctctaatacgactcactatagggaaagctggtacgcctgcaggtaccggtccggaattcccgggtcgacccacgcgtccggctttgcggctttgcttgcaattgcgtggtacatatggtgcttcaatgaccatgcaggagtctgctgtgctcttgttggaacctctgctgttgggttccctgctgtggtgcatgggcatcatatgccatctcagtctgcctctaatgctgtgggttgcagcagtacttccaagagaaaacatcgagcagaagggcctaagaagggtaactcaaaaaggatcagaaagtaagatctctgagtgtttccagatgcaatcatttttaaagagtagaaaaagccgagcttcaagaacaaagatgaaattcaattttatagtgttctaatgttctataacttctgaagtgggggctctaaggttttctattcatctcttctttctttcgttcgttttctcttttgttttattggatttataaatacggtcgaacttgttagaggttctgtgatatgcttttttaggtgctgttcttgtaacttatattgngaccatanacatgtgcgttcttatctttaacatagacgtcgttttgagttaaaaaaaaaaaaaaaagggcggcccgctctagagatccaaagctacgtacgcgtcattgcgagtcatagctctttctatgtgcacctaaatcaaatcacttggccgtcgtttacaacgtgtgactgggaaaacccctgcgtacccaacttatcgncttgcacacatccncctttcgccgncttggcgaataagcagaggccggaccgtcgcctttcccacgt

SEQ ID NO: 5494 - DNA, 796 bp, Glycine max
  Predicted polypeptide sequence is orthologous to G1062
ttcagaaatgtccctgaactaattgaactcgaagtagtagcatcaagattcggttcgacatgagcaagtgaaaggtaccaaatagtaactgccgctgcagggggtaaaattcatgtgaaaatttcttctacctcaactttaactcaagttaccagagctagtatcgtacacttgaattgtgaacataacaaagtaaaaactgattctgatttaacttgccaaattgactgtgaaatagcagctaccagtttgtttcttgtcaaaactagttacatcatgccattgtagccagctgaatccaagagtactgctttgatttgctccggatggacatcctgaccttctttgcattgctcggctcgaaaaatatccatagcaaatccattgaagcagctgataacagcctgctgaatgtctaatccaaggttatccaaagccctcatggttgagagcaacagactaggcttgcgggcacaaaacatgtggatgttaacagcccttccttcgcgcagccgaacctcaaccctagcaggttggccattggggctgggcaatgagctggggcacagttcttccttgattcggcttggcagcgtaggaggagtaggcgtcaaaggatggaaacttgagacaggagtgagtgaagaacccactggtgtcgattccaactcgttatgcagatcattgatcctttgcagaagctccttcagatactcaattgcatccccaagaattgaagccctgtccattttgctaatcttgggaacaacggacctcaacatgtagagtctatcat

SEQ ID NO: 5495 - DNA, 897 bp, Glycine max
  misc_feature (817)..(817): n is a, c, g, or t
  misc_feature (834)..(834): n is a, c, g, or t
  misc_feature (841)..(842): n is a, c, g, or t
  Predicted polypeptide sequence is orthologous to G1062
cgcgaacaaaacaatttattccataacaattaacaatataagtttgctgaaattcaggaaaataaaggagctaattcctcccaatgcagatattggctaacccttcttgatcttagcctagacacagctttacagactagaataagcaatggcatttacaaactgcatgctacagcaactacagttagtgcgtctattgggatagcatttgtcaagaactactctcacatcattccatggaaacctgctgtgtccaacaatacttctttaatttgctctggaaggacatcctggccttctcggcattgctcagctctaaacacatctaaagaaaaaccattgaaacaactgattacggcctgctgaacatccaatccaaggctatccattgccctcatggtagaaagtaaaagacctggtctgtgggcacaaaacatatggatattgacagctcccccttcccttaccgtaacctccacctttgctgattggtttttaggacttggcagagagataggacatatttcttccttcacccggcagggaagggtaggcagagtgggtgtcacagggtgaaagcttgcagcaggtggaagggatgagccaggcgggcctgactctagttcatgattaagatcagtaattcgcacttgtaactcccttaagtagtcaatggcatcccctagtattgaggccctatccatcttgctaatattaggcacaacagaccttaacatgtacaacttatcattgagcttcttcctccgcctcctctccgccatgagattcttcgccggcatcttcttcctcttcttcntcttccccttctggtcntcaccanncacaccaccatttccattcccattatcaccatcaccatcatcatccgacagcaac

SEQ ID NO: 5496 - DNA, 785 bp, Glycine max
  misc_feature (11)..(11): n is a, c, g, or t
  misc_feature (14)..(14): n is a, c, g, or t
  Predicted polypeptide sequence is orthologous to G1062
ggccccaagcnctncaggcgaatacgtgtcactatagggaatttggccctcgagttttttttttttttttttttaagaaacgaaaagaatgataacgatttattacatctgttaataataaagacaacagcataagttcgctttcgtcagaagcagaattgaacaaaatatcaaagctaactcctaaaactacagatttaactaacctatttgatctgggcctaaacagttcaaaggagaagaagaagcaatgcatttacaaactgcaagctacagcaactacggttggctcctctatcagggggaagcatttatcaagcattccaatcacatgataccatggaagccagcagaatccgagagcaccgctttaatttgctcagggaggacatcctggccttctctgcattgctcagctttgaacacatctaaagcaaagccattaaaacagctaataacagcctgctgtacatccaatccgaggttatccaaagccttcatggtagaaagcaaaagacctggtcggcgggtgcagaacatatgaatgttgacaggtctcccttgcgttactctaacctcagccgttgcagcttggtgtgtagagcttggcaaagtgccaggataacagtgctgcttgacccgacagggaagggttggcagggtgggtgtttaaggctgacagcttgtagaagaggaagtgtctacgacgagccatgtggagaggactgcagctcgggatggtgatcatatatgcgcgtgcacaacttcttcacagatgcacttgt

SEQ ID NO: 5497 - DNA, 770 bp, Glycine max
  misc_feature (1)..(1): n is a, c, g, or t
  misc_feature (758)..(758): n is a, c, g, or t
  misc_feature (762)..(762): n is a, c, g, or t
  Predicted polypeptide sequence is orthologous to G1076
ngcgtgagaaaccctttgagtgagcgcgcgtaatacgactcactatagggcgaattgggttccgggcccccccttgaagttttttttttttttttttaattatccaaaatatatattttggttattgatttgagcctatgatttattcaactcaaggttaatgcacaacagtctagtctaataactccagcaaccaagagaaaacgttttacagttgttcctagaaactgatcgtccttacaacaaacctagccaaacaaaacgattcttcaatagaaaaatcagtacttcttcacaagcaatattcagaggaaagattagagaagaccaatatatatgagatcaattcaacttctcacctttgtgcccccaaagactctggatcagtaagattgccttccaccagagttgccagcccaaccatcaacaggtaactgaggcatgtttagtggcaaattgaagaatggaagcccggaagacggatccggaaaagagttattactaactccaccaccatggtcaccgctaccatcaccagctgatgattgcccttgttgcatctgcatagattcatcttcatccaaaggcaacctctcatatgctacattagtaaaagatgaagcaataacaataacaggcccagaagccaccaaaggaccaacaacatttccttccaccacttgaccctgtcctccaccaaagaacacagtcaaacttgtagcacctggtggagcctgaagtgggaggatgatcctgancaanaagagatc

SEQ ID NO: 5498 - DNA, 737 bp, Glycine max
  misc_feature (2)..(3): n is a, c, g, or t
  misc_feature (9)..(10): n is a, c, g, or t
  misc_feature (615)..(616): n is a, c, g, or t
  misc_feature (656)..(658): n is a, c, g, or t
  misc_feature (673)..(676): n is a, c, g, or t
  misc_feature (708)..(710): n is a, c, g, or t
  misc_feature (716)..(717): n is a, c, g, or t
  misc_feature (721)..(723): n is a, c, g, or t
  misc_feature (725)..(727): n is a, c, g, or t
  Predicted polypeptide sequence is orthologous to G1076
anntttttnntatttatttgagcctatgatttattcaactcaaggttaatgcacaacagtctagtctaacaactccagcaaccaagagaaacgttttacagttattcctagaactgagtccttacaacaaacctagccaaataaaacgagtcttcaatagaaaaatcagtacttcttcacaaacaattcaaaggaaagattagagaagaccaatatatataagatcaattcaacttctcacctctgtgcccctaaagaagctggatcagtaagattgccttccaccagagttcccagcccaaccatcaacaggtaactgaggcatgttaaggggcaaattgaagaatggaagcccagaagacgggtccggaaaagagttattactgactccaccaccactaccaccaccgccagcagatgattgcccttgttgcatctgcatagattcctcttcatccaagggcaacctctcatatgctacattagtaaaagatgaagcaataacaataacaggcccagaagccaccaaaggaccaacaacatttcctcccaccacttgaccctgtcctccaccaaggaacacggtcaaacttgtagcacctggtggagcggganntgggaggaacgatcctgacaaagacaggatctcaaacctnnngtgcagcgtgacgannnnacctgctgcagctggctgtctcaacgtcacgnnntcttgnncttnnngnnnctcatcgtct

SEQ ID NO: 5499 - DNA, 693 bp, Glycine max
  misc_feature (256)..(256): n is a, c, g, or t
  Predicted polypeptide sequence is orthologous to G1084
tactaaattcttcttcctacaaagaagagaaaaaatgcaatttctgaaaattcaaacattgtaaatctgttcttacaataacagagaaaatatgaaagctattcttgaaagttgaaacttgaacctaactcaattctgaacactatgaaatgcagaagcatgctagaacactttcaagtttcaacaaacctgacagttcgttagatgttgataaatactgagctttcttggcctctaacaatgctgagacatcatnggctgcattgcagattattgtgaattgagcttcaagatcctggatcacttcaaccatgcttgtgggccttcggtttacataaacagtaaaaccaggtgtttcctcctttgcttcttgattaccagttgccatttcctggcccacagtttgagctttagatgcttgaaaacattcactgccattggcttgtgagtctgagacttcatttgcaattccagtttcagcacctgttgcctcctcttcctcttcctcctcatgttcataaacatcttcaactgcgacttcttcttgggaggggtttacatcaattttggctctttcttctgctacatttctctttatagcaaattcttctggttcagtttcatcttcttccaggtctggtattccttcttcttctcgaaccttcctcagtcctctgatctcatcatcagttc

SEQ ID NO: 5500 - DNA, 803 bp, Glycine max
  misc_feature (37)..(42): n is a, c, g, or t
  misc_feature (747)..(749): n is a, c, g, or t
  misc_feature (758)..(758): n is a, c, g, or t
  misc_feature (788)..(788): n is a, c, g, or t
  Predicted polypeptide sequence is orthologous to G1089
actggaattaattgcttaaattaaagaaaaataaagnnnnnnaaagaaaaagaaaaactaaagacaagaaacataaataaacaaaagaaaaaaatcctggtaaaaaaaattgggtttcaatcttgtgtgggccctggatcccaagctctatgagcatcattaatgtctgcaacataatcatcatcagcttcaacatctgcggcatcatcatcaactacaccaaaggtgtcaccccccccccccccctaacaaaaggaagttggactcctagccaagcaacctgggctaggaatgcctttggtgtcatcacgggctgctggagggagagatggtggaggctctacattagtaggtactggccgtggtggagactatgcagcataggaaggagccgctccagctgagaaaaaagcataaaggtctagcggagggatcgctagtggaatgtcaagagtggctcgagtcttgacttgttttggccctagaaagaccctaaaagagtctgtagaattctcaactggcttggcttcatcttcttctaggaacacagaattcaagtgccccccaacgagattaattttttgctcaatttcctccaccttaaaacaagttgaatgtggctttttggtcttccacactcatctccaagttacctttccccatgtccacaacacactttgcagtcaccatgaatggccaacccagaatcaagcggatctcagcatcttcttcaatgtccatgattannnagtccaccngaaaaatgagttgatggactttgactaggntgtcttcaactaccc

SEQ ID NO: 5501 - DNA, 941 bp, Glycine max
  misc_feature (70)..(70): n is a, c, g, or t
  misc_feature (72)..(72): n is a, c, g, or t
  misc_feature (74)..(74): n is a, c, g, or t
  misc_feature (784)..(784): n is a, c, g, or t
  misc_feature (844)..(844): n is a, c, g, or t
  Predicted polypeptide sequence is orthologous to G1089
aggaccccccccccccccccccccccccgtgggcgtgagcggctacgcaactgctcccgcgcgcttgaancntnactcaggggaacaaaagctggagctccaccgcggtggcggccgctctagatcttgtggatcccccgggctgcaggaattcggcacgagtccgttataagaggaagaagatgaacagcgactcggcgacgcgtcggagaggaagagttggaaaagtttgaagcggcaaagactcggcggagaaaggcctccacgtggtgtcgaactcggacggtggtggcggaaaggagaatgcttcacgaccgccacttggagaccgcgggggaacatggaagaacttcgtaaacgacgacgacgatgctcgctggttcccaccgcgggttcgacgcgtcagtggcaaggtgggtttcacgttttctgtatttgtctctggctgggtgtggttttgtttggcttaggtggtggatttgtgatttgaaggttatcagggcttgtagtaattggaattcagtggtgcagagaattgtgctatccaccgtagtctaatgtgtttgataattattttagtagtttataacctagttgtacagtccattattttagtagtttattattaagaacttttttttatccataagcactttgctgtgcgccacacacaaaaacatatacaaaaaaaaactactcgaggggcggcccggtacccatttcgcctatagtgagtcgtattacgcgcgctcactggccgtcgttttacaacgtcgcgactggnaaaaccctgtcgtacccaacttaatcgcttgcagactatcccctttcgcagctgtcttantagcgagagggctgcaccgacgcccttcctacaggtgcgcagcctgtatgcgaatggaccgcgcctggacgcgcattaatacgcgcgggtggtggtc

SEQ ID NO: 5502 - DNA, 842 bp, Glycine max
  Predicted polypeptide sequence is orthologous to G1133, G1137
aaaagaagccccccccccccccccccccccccccccgccatgggttagacggtcgctagatacgccagcgcgctattaaccctcactaaagggaacaaaagctggagctccaccgcggtggcggccgctctagaacttgttgatcccccgggctgcaggaattcggcacgaggctcgtaacttcaatgcaaaggaaaaactccctgctggccacgcgaaagatttaggcgaggaaattgcgccgaatggggaactgggtttccctcagaagcaattcctggttattgatcaaacgggtgatcaaacaactcttgttcatagttcaaggtttgggggtcctcttgcttcctggaattcaaagctgcatggtttcaacaatttgaacaatgggaatgaattgcttaatttaaggagagatgtgaatcatgtggttggacttggaccaactttgaacgataaagttgatgaaaatcaaagaactgatgatgacattgaaagcgagatgcatgaggacaccgaggaaatcaatgcattgctttactctgagagtgatggttattccactgaggatgatgatgatgatgaagttactagcacaggacattcacccagtacaatgaccacacacgatgataaccaggaagaaccggataggtgaaccgccaaagaagttgctagctccgttggagagacacagaagcgaaactatgggacggtgctcatgacgacagcgatatgcagttcatggacactgctaatgctctgaatgggacaagactgctcggagctggagatgatgccgaatgaaaatgctccagtggctgccactgtagtagagggta

SEQ ID NO: 5503 - DNA, 1086 bp, Glycine max
  misc_feature (1)..(2): n is a, c, g, or t
  misc_feature (589)..(589): n is a, c, g, or t
  misc_feature (595)..(595): n is a, c, g, or t
  misc_feature (598)..(598): n is a, c, g, or t
  misc_feature (619)..(619): n is a, c, g, or t
  misc_feature (711)..(711): n is a, c, g, or t
  misc_feature (989)..(990): n is a, c, g, or t
  misc_feature (1001)..(1001): n is a, c, g, or t
  misc_feature (1037)..(1037): n is a, c, g, or t
  misc_feature (1046)..(1046): n is a, c, g, or t
  misc_feature (1049)..(1049): n is a, c, g, or t
  misc_feature (1079)..(1079): n is a, c, g, or t
  misc_feature (1082)..(1084): n is a, c, g, or t
  misc_feature (1086)..(1086): n is a, c, g, or t
  Predicted polypeptide sequence is orthologous to G1136
nnccgattaacgtcgatttcaatgcattacgcaagcgcgcaattaaccctcactaaagggaacaaaagctggagctccaccgcggtggcggccgctctagaactagtggatcccccgggctgcaggaattcggcacgaggtttctcggagcagcattgacgatggaatgctttccttcacttccctgccggctgcaaatataaaatcagttaacggtgcttgtgtcggtgccggtgattcggatcactcggatctggaagcttccgtggcgaaacaggtggtggagcccgagaaacggccccggaagagagggcgaaagccggctaacggaagagaggaaccactaaatcatgtggaagccgagagacagaggagagaaaagctgaaccaaagattctatgctctacgagctgtagttccaaatgtatccaagatggacaaggcatcgctgttgggggacgccatattgtacattaacgagttgaaatcgaagctcaacgtgctggattcagagaaaacggaattggagaagcaattggattcaaccaagaaggaactcgagctcgcaactaaaaaccctcctcaccgncaccgncgncaccaccaccaggaaccgctncatctaatagcgtagaaccaaagaagacccacagcaagctcgctgatttggagttagaggtgagatcattggtggggatgcatggtagaatncatgcagcaagaagaacaccctgcaggcaggtgatggcgcatttgaagatctgccttgaatgcataccccagcgtgctgtgtgatggattatatcaccagcccgtgacatggaacagtttaccgcagaccgctctgcgacttaatcaaagtgcagacctcgtgttcttcgccttatggagatactgacttcttgaatggtcttatttgtagccttgggccgccaaaaaattatggaatggttggagcagccaccggtggttttttgaacaaaaaaaanncaaaaaaaaanagaaaagataaagaaagtaaaaatctgggcgccccnctttttggntgngccgcctggtttagggggaacctccaattngannncn

SEQ ID NO: 5504 - DNA, 939 bp, Glycine max
  misc_feature (76)..(76): n is a, c, g, or t
  misc_feature (597)..(597): n is a, c, g, or t
  Predicted polypeptide sequence is orthologous to G1136
cgccaaggggctgacgcactgcgcggcgcatttgattcctcactacagggaacaaaagctggagctccaccgcggnggcggccgctctagaactagtggattccccgggctgcaggaattcggcacgaggagaagctgaaccagaggttctacgcgcttcgtgctgtggttcccaacgtgtcaaagatggacaaagcgtcactcctgggcgacgccatatcttacatcacggagctgaagtccaagcttcagaccctcgaatcagataaagatggaatgcagaagcagctggaaggtgtgaagaaggagctcgagaaaacaaccgagaacggttcttctaatcacgcgggtaatagtagtagttgtaacaacaacaacaagttgtcgaatcagaagttaattgacgtgttggagatggacgtgaagatacttgggtgggacgcgatgataaggatccattgcagcaagaagaaccaccccggggcgaggttgttgacggcattgatggagttggacttggacgtgcaccacgccaacgtagatttggtcaacgatatgaccatgctacaagcaacggtgaagatgggaagtaggttntacacgcacgagcagctacgtgcagctcttgcagctaaggatggcgatgcacgatgatgttagctctgcactatgacggcacagatagagattatgtgtgtgattgtgtcagtgtattagctagctagctcattgtacgttggctgctctggcatatttcaagcactccgggtagctgatctagcaaaatatacgctatattgcttgatgggtgacgtagtaatgaatatgagtgatcacgatggcagctccatgagtagtacactagctaggtaactatcataccatactgtggtgaatgacatagcaccagccttattggaaatcgcgtcatctatcgct

SEQ ID NO: 5505 - DNA, 700 bp, Glycine max
  misc_feature (303)..(303): n is a, c, g, or t
  Predicted polypeptide sequence is orthologous to G1140
tttttttttaggtaagaataatttttttatgatgacaaagtatagaaagtaagaaacggccaaagcatgaccattaactcgggcatatataacacttcctatgaatcaatctacgaaaagaaaatagaatacgaattcaagtacatgcaattctgcctgcagaacctcatccctaggatttacttactttgcaggagtagtttttaaacagcaaacatcactggagctcaactggttttgagtgaaacacttaaaacatatataaaggaagcgaacccggtcacttctaataatctacatttngttgaatacttaaggtaaccccaacttgagagatgtgtcgctaccaccatcttcaggaaggttagatgaattgctaagaatggattccgatgattgcctatgtacatggataaggctcggtaccacctgtttcagtctttggttttcctccattagttccactccctttctcttaagcgtgctgatctcttgcataagtttttcatcctttacttttgaaacattgatcaaacctcttttaaggtgttcctctagtttatgcagttctggtaatgtcaatccttgcagatcttccccattcatctgcctcagctcacggttcttatcttctactttcttgcgcaggatttcattggagtcattctcaatctgcagctcaattgaggggcgatccagt

SEQ ID NO: 5506 - DNA, 722 bp, Glycine max
  Predicted polypeptide sequence is orthologous to G1140
tttttttttattttttttaaagacaaataatatttatttatttttcaaaaaataaaaatataccaaacactgggttatcacatctgacataatggcaactgcaatgttctgtttagtttagcaaataagttgctccagctgtgaattttttcccgtggtaaaatctagcattacatgcactccactcaccagcaaatggttaaatacgaaaaaacaacattgatcttggctgagacagaaatagaaccaaatgcgttaacttctcactatagtcttctgaaccaacatttttgtttcattcaaataaagacaaccccagcttgagagatgtgtcagaattaccacagtctggaggaaattcagatgaactgcaggtaaatgactcgtatggttgcctttgttctcgtacgaagctctgcttcaatttctggttctcttccataagtttggcttccttggttttaaggtgattgatctcttgtataattttttcatccttaatttttgaaatagtggtccaacgtctttgaagaagttcctccactttctgcaattcttttattgtcaatccttggatctcttccccattcaactgactcatttcattagtcttatgttctatttcctttcgcaggatgccaagggagtcacttccaagctgttgaccaatagatggattaactaatccttgaatccctgaatgccgatcacgcctttcaagt

SEQ ID NO: 5507 - DNA, 742 bp, Glycine max
  misc_feature (1)..(1): n is a, c, g, or t
  Predicted polypeptide sequence is orthologous to G1140
nggagtatcacagaaacaccagagggggctaatgaaagcgaaggaggctggagctccaccgcggtggcggccgctctataactagtggatcccccgggctgcaggaattcggcaccagtggagaagaactgcaaggattgaccctaagggaacttcagaaattagaagaacgacttgactcatccttgaaccgtgtttataaagcgaaggttgaaaattttataaaagagatcggtattcttaaggaaaagggaaaaaaactcatggaagataacatgctgataaaccagatgataaaattaccgaggaatgaaatatgttcggtccagagacatgagcatgaacaaggccagctctttgacacctccctcacgttggggctaccttttcctgctggctcaaagtagagtttctgagcaatgaggggaccatgatgctgcgttttaattagtgtgaaaactgaaaaggaagagtgaatcaccaaggataaaatggttcacgtatgttcaagtataatagattctagtaattcatgtttgttattagtgggaccgtaatggatatggtttagctatgatattatttcaaaagcatatgtttagactgattgctatgtatcatttataggtgtaagagttaattatgtacatgataaccctattgaacacccttgacatttagaagtcatgatgtgcactagatatgcatgattgttgcatgagtgtatgcagaatagatgctg

SEQ ID NO: 5508 - DNA, 594 bp, Glycine max
  Predicted polypeptide sequence is orthologous to G1140
ctttccttcattggtggctttcaacccaaagctgaaatcatctaaacatggcaaaccaaaccgaaccaaaaaccaacattcctaatatcaacgccttcccccaataaggaaagtaaaaatcaacaagtacatccttactcagctctctctttcaacaacatcccaccacacactaacaccaactccaactccaactccaagtcttcccctaactaacaccactaacaacaatcactaaaaaaagaaagaaaatttaccctgatcgcaggatctccgaacaaagctttgatttcacaaaagctaaatttagataaacacctgcatattaaatttttctgctctatacatgcatcacatgtccctcacactaaacaaaagaaaaacaccaccaccctttgcttttgcttttctataagtagtcaacggctcagccttaatttctttgctttttttaggttaaggtacatggtcagggagaagattcagattaagaagatcgacaacgccacggcgaggcaggtcacgttcttccagcgtcgcagagggctcttcaagaaagctgaggagctttccggtatgtgtgatgctgatgtt

SEQ ID NO: 5509 - DNA, 484 bp, Glycine max
  Predicted polypeptide sequence is orthologous to G1140
tgaaaggcatcatttgcactcaaagaatctagcaaggatggagcaaccatctctcgagttgcagctagttgaaaacagcaactgctccagattgagcaaggaagttgccgaaaagagccatcaactaaggcagctgagaggagaggatcttcaaggcttaaacatagaagaattgcaacaattggagatgtcacttgaaactggattgggccgtataatagaaaagaagggagagaagattatgagtgagatcgctgatctccaaagaaaggggatgctattgatggaagagaacgagcgactcaaacgtcacgtggcggggataattaatggtcaaaggcatggtggtgccgaatctgagaactttgttatggatgaaggtcagtcttcggagtctgtcacgtacgtttgcaattccactggactcccccaagactatgaaagctcagatacttcgctcaaattggggctaccatactccgcc

SEQ ID NO: 5510 - DNA, 847 bp, Glycine max
  Predicted polypeptide sequence is orthologous to G1146
tgcagaattttcttacaatatgaacatggataattttttcacctctaattagtttctgtctactatatatatgctgctgtttctctactttgaagccttttattgtgcctaattcaactgtaaaacataacattcttcaccctgctctattcaacagtaaaacataacattcttcaccttctctttcagagcaggcagtggccgaacaggcccttctttcaatcttgttcctcgcagttttgtaatctcagcaacatcaggttccatgtagaatcgagccctgtaggctgctagatgagcataatatgctggaggcactactgaaacagaccgtgtacatcttgcataagtgtagcacaaattattggttagagactgaatttcatctgcagtgaaattgttctcgtcccagaggacatgatagtgtgctggtctacttgtaccctgaattcctgcatgactgcataagtagaagtcgaattcggaaggatgacagatcttagaatctaccacagtaccaggtaagatattcccactcttatcagtgctatttctgtcgtcatgattgtttgcgaagagtctagtgtgatgccgtttttgaacaactacaaatgttactggaggttggtaactaggttccaaggatgcacaagccttgcgaatggcatcaagctcatatagcaaaacctggtagaactgtccctcacttaccccatccctgtaaaagattattctcaatggtttttgtcctgttgccttcttaaatgatagtaaaagctccctgcagtttcacaaagtagtatgaactaattagcatgcagacgttagataacatcaaataataaat

SEQ ID NO: 5511 - DNA, 975 bp, Glycine max
  misc_feature (801)..(801): n is a, c, g, or t
  misc_feature (898)..(898): n is a, c, g, or t
  misc_feature (957)..(957): n is a, c, g, or t
  Predicted polypeptide sequence is orthologous to G1146
acaaagattgacagagaatattttttacaatgctaaatttggcatctatataaaacctaataatgcttgtagaaattcattctaaactatggctcaagaactgtaatcatggatctaccacagcaaaacctacacgactaatgtacaaagtaatgtgaggtgaacattgcactccatgatttgaaaacttgcttatcatgttgatgcttgccccatatatctatcattctaccaaggccaagccactaagcagtctaacagtaaaacatgactctcttcacattttctttcaagtctggcaatggcttgacactataatcaccagctgctcgtgttgctttggcaccatgaccattaccgtcacctgcagagccattgtcttgcatatctggttccatatagaaacgtgctcgaaacgctgctaaatgtgcataatatgctggaggaacaactgatactgagcgtgtacacctggcatatgtataacaaaggttgtttgtcagagactgaattccatcaggtgtgaagttgttttcatcccacaggacatgataatgagctggccgactagtaccctggatgccagcatggctgcagagataaaaatcaaattctgttggatggcagattttggtatcaacaacagtcccaggcaatatattcccactccgatctgtactgcttctgtccctgtagttgtttgcaaataaccgggtatgatgtcttttttgcacaactatgaaagttactggaggctggtagtttggttctaaggaagcacatgccttccgaattgcatcntactcataaagtaaaacttggtaaaattgtccttcacttacaccatccctgtaaaatataatttcgtagtggcttttgtcctgttgcctttctgaangaaaacagtaaatctcggatcatgccaccactaactgtgccacgaacagggtcttgccnagttttgtacaatcttgt

SEQ ID NO: 5512 - DNA, 995 bp, Glycine max
  misc_feature (1)..(7): n is a, c, g, or t
  misc_feature (14)..(14): n is a, c, g, or t
  misc_feature (19)..(20): n is a, c, g, or t
  misc_feature (795)..(795): n is a, c, g, or t
  misc_feature (880)..(880): n is a, c, g, or t
  misc_feature (995)..(995): n is a, c, g, or t
  Predicted polypeptide sequence is orthologous to G1146
nnnnnnnaaccccnccccnnttaccgcccccccctataaaataaacaaaagctggagctccaccgcggtggcggccgctctagaactagtgtattccccgggctgcaggaattcggcacgagatcaggttctactgtttgagcttgatgctattcgaaaggcatgtgcatccctggaacccaattatcagcctcctgtgacttttgtggtggttcaaaagcgtcaccacacaaggctctttgctagcaaccatcatgataagagttctgttgacaagagtggcaacatattgcctggcactgttgttgactccaaaatctgccatcccaccgaatttgacttttatctctgcagccatgctggaatacaaggtacaagccgtcctgctcactaccatgtgttgtgggatgaaaacaattttactgctgatgccttgcaaacactcaccaacaatctttgctacacatatgctcggtgcacccggtctgtttcaatcgtgcctcctgcatactatgctcaccttgctgcattccgcgcaaggttttacatggaaccagagacgtcggatagtggctctatgacaagtggtgctgttgcacgccgtgcgatgggcggtgtatggcgtagcacgcgtgtacctggtgccaatgctgctgtgagaccattgcctgcactcaaggagaacgtcaagagagttatgttttattgctaagacatgactgccacagattactgttagaacctcgttagtggagtgcttcttttgcttcaacgttctccagcagtcgtcattangtattgagttttttgaactactccacgagtgtggtgcgtcgaattacgtgtgtcgccttgaaagcatctcctgcgacgagtgctntctactttgctgtgtgaggaatgaagttgatgcaatatgcttatgtcgaagtactcgtcgtgccgttggaggtgcataaataaaacaaaaaaataaacttaggtggtccgtcccn

SEQ ID NO: 5513 - DNA, 829 bp, Glycine max
  misc_feature (728)..(730): n is a, c, g, or t
  Predicted polypeptide sequence is orthologous to G1198, G1806, G558
ttaaaaacttgtacagatcaacaagatgcagtaagtagcaacttccagagaagattatatcatggaaaacaagtattgttctcggtgtggctggcacctagtactctctaggacacgctaaccataatgaattaagagctctaagccgtgaaacgtaatcatttatcacaagtagcgcacgagcagcttggaaagtggtcaaaattcgacgcatctgttgcagagtttgttgcctcaataggtcagcctgatgaaggaaattctctagtgtggccagcttgcccagtgcaattgccatttggcccatgtactcagcaacatttccagaaccagagggccctaaagaggaggaagaaagtgtctctgaaagagactgctgcaatgcatccatgccttgtgataatgcatcctcagcctgctgggaagactgctgcagattgtaaatgcccatcaactgctgttcggttaacggctcaagctggtttctaactatcttgagaagttccgaagatcgaaaaccaccgagccatatgaagcatctttctgcaggtgtcttccacatcccagaaagtatgtgaaatacatcagcctttgcccctatgctcttcaacctaaataattcatcataatgtgccatcactccatctacaagaaggtgcagttcattctcatccatttgagaatttatagctgatcttatatcattgatcagccgttgatgctcatcnnnccaacgggcatagtccatgtcaaatgctagggcaccatttccaacagcagaatgactgcgatccccctggtttccagttgcaataaatgcaccctgctg

SEQ ID NO: 5514 - DNA, 873 bp, Glycine max
  Predicted polypeptide sequence is orthologous to G1198, G1806, G558
agttagtaatgtctttctaatataccaaaagagaacgtataaatacatacaccatggagccttatgtgcaaccaaccacaaaccattaagcaggaaatgaaactaaagagaggtaaataccccctcaaataaaagctgatttctgaaatacaatgaacagctataacctaaaaatacagatacactatttctacatttttcccttcaacagcttctatctatcatacacctatataatcaaattattgagactattttaaaaccacaaaagcttaaagaaaaatgttgcaccacaccagcagttggcagagtagaaaaatcatagcatttaatgtttatagcatcacaactaggcttcaagaggaattcattgtcaaaagacaccagcttccattgaactcattcagagcacaagattcaatgatcatcggtgtttaagggagtcaggcatgaaagaagtccactaatggggctgtgaaatgcttcactcccttggcctggcaagccacaaagaactcagcgctctcagccgtgagaaataatcactgatggcaagaagagcacgagccgattgcctggtcgttaatattcgaagcatttgttgtaatgtctgctgccgcagattgtcagcctggtgaagaaacccctcaagtgtaccaagctttcccatggccatagccatttgccccatgtaatttgccacatttcccgaggagcctgatgagctgggcgaaccattagccaatgtctcagatagtgattgctgcaatgcatccatcccttgggaaagagcatcttcagtctgctgggatgattgctgcaagttgtaaatgcccatcaattgttgctcggctaaaggctccaactgactta

SEQ ID NO: 5515 - DNA, 968 bp, Glycine max
  misc_feature (864)..(864): n is a, c, g, or t
  Predicted polypeptide sequence is orthologous to G1198, G1806, G558
ccccccccccccccccccccccggccgtggggcttgatgatcgcctggtaggatcgccgcgcgcaattagtcctcactaaacggaacaaaagctggagctccaccgcggtggcggccgctctagaactagtggatcctccgggctgcagggaaaacacctgctgagaggtgttttttgcggcttggtggctttcgctcatctgaactcctcaagctgctggttagtcaattggagcctctcacagagcagcagctgatgggtattaccaacttgcagcaatcctcccaacaagcagaagatgcattatctcagggcatggaagcattgcaacagtcccttgcagagacattgtccaccggagcacctgcctcatctggttcatcagggaatgtggcaaattacatggctcatatggccatggccatgcgtaagctagggacacttgaaggcttcattcaacaggctgacaatcttcgccaacaaactcttcaacaaatgcaccgtatactgacaactcgccaatcagctcgtgcactccttgctatacatgactacttttcgcgtctgcgtgctctcagttcactctggctagctcgccctagagattgatggacgcgctaaatagtatggcaaattaattatcatggatccatcactagcaatacttgctcatcataactcttgacatgtcttcttgttgttttgctgtcctctctgcatcactgacggtagtgcttcattgagtcagtctatatacgaaatcgatgacatgatgtatgaatattactactaatattgttcattgtaatgatgaaaacaaatagaaacactcgatgtgggcccggtacccacttcgcctatgntgagcgtatacgcgcgctgactggtcgcgctctacacgacggattgcacttccctgcgtacccaacttatcgctgctctcatcctcttcctcatgctgcgaatt

SEQ ID NO: 5516 - DNA, 793 bp, Glycine max
  misc_feature (1)..(2): n is a, c, g, or t
  Predicted polypeptide sequence is orthologous to G1198, G1806, G558
nnaagtgaagtagcacctggacatgcttccgccaagcgcgcaattaaccctcactaaagggaacaaaagctggagctccaccgcggtggcggccgctctagaactagtggatcccccgggctgcaggaattcggcacgaggaagctctcactcaaggtcttgaacagcttcagcagtctcttgttgacaccatcgccggcagtcccgtcgccgacggtgttcaacagatggtggcagccatgggtaagcttggcaaccttgaaggatttgttagtcaggctgataatttgaggcaaataacccttcaccaattatgtcgattgctgacagtccgtcaagcagcacggtgttttcttgtgattggagagtattatggccgtcttagagcccttagttctctttgggcatcaagaccacgagagacattgataagtgatgataactcatgccaaacaaccacggaattgcaaatggttcaatcttctcaaaatcatttctcaagtttctgaaatacatatatatatattgtgtagtaattgaaacccggtgcaagtggatttctttgggctgctttagaaggaatggaaagagtgtcagcgtcatcaaagaattaatatctttttttttttcctttcaatcttctgctcttgtgtctcttatgttttgtataattaaatggaattcgggttttatgtgaatgaccaggaagcttctactttagcctaaaggagtagagaaaattaatgttaaacgaacaatatgacctgccagatgtagatttttttgtacccta

SEQ ID NO: 5517 - DNA, 1774 bp, Glycine max
  Predicted polypeptide sequence is orthologous to G1198, G1806, G558
cgttcttctgcagttctgatagctagccatgttggcatgaagatttaagcgggaaaataataagacaacgtatataacgttttcacaaagtggcttttttttttattatcacaaggagtatgtgttgaatgattattgagttgcagcactgatcagttcttagaacatgaattcagcatccccgcagtttgtttccccgagaagtatgagtgtgtacgacccgatccaccagattagtatgtggggagaaggcttcaaaagtaatggaaatttaagtgcagccatgcctttaattgatgaggcagacatgaagtttgatagtcagtcagaggatgcttctcatggtatactgggagaacctaataagtatgaccaagaagctagcaaacctactgataagatacaaagacgtcttgcacaaaatcgagaggctgctcgtaagagccgattgaggaaaaaggcctatgtgcagcagttagaatcaagtcgtttgaagttgatgcagttggagcaagaacttgaacgtgcaagacagcagggaatgtatataggtggtgggttggattctaatcatctgggttttgctggatcagtaaattcaggaattacaacctttgagatggagtatggacactgggtgaatgagcaaaatagacaaatcacagaactgagaaatgctttaaatgctcatattggtgacgtagagctcaggattttagtagatggtatgatgagccactatgccgaaatgtttcgcatgaaatctgctgctgcaaaagcagatgttttctatgttatgtccggtatgtggaaaacaacagctgaaagattttccctgtggattggaggctttcacccctcggagcttctaaaggttcttggtcccctgattgaacccctgacggagcaacagcgtttgaatatctataaccttggacaatcatgtcagcaagcagaagatgccctttcacaaggtatggacaaactccgccaaacacttgctgatagtgtagcagctgggcagttcatggaaggaacgtatattccacagatgacttctgcaatggagaagttggaagatctggtgagctttgtgaaacaggctgaccatcttcggcaagaaaccttggagcaaatgtctcgaatacttacaatccgtcaggcggctcgatgcttgcttgctttgggggaatatttccaacgcctgagggctttgagctcactgtggtctaatagaccccgggaacctgcttagtctcacaacaagattacaagagcgcaaactcataacatgaacgtgatgtgatgatgaatatgggtcagtttctttggcaaagagcatcaaaaccatgtgtcatgagaggtccaggttgctcacatttttcctgcagttttgcgttatggagaagttgtaaatatgactgctagctcattttatgcatacgggcttgtaaataaattgattttggacgcatggtgtatatcggattgttgcaaaaaatgaaatatttagaatctgccatgagtctgtgtggaagttggtcatgtaaaattcatataatgttatgttgggtgttttggaaaatgaatcaactctagactctcttagtggacgtaatttattttttgtgattgctaagagtagtttattaaaaatatcagttgttattagtttgttagaaagttgttaactctaataggctctatatttagagcattcatacagtcttattgtatctttattcaatcaactacaaaatgattttcttatgat

SEQ ID NO: 5518 - DNA, 901 bp, Glycine max
  misc_feature (573)..(573): n is a, c, g, or t
  misc_feature (703)..(703): n is a, c, g, or t
  misc_feature (717)..(717): n is a, c, g, or t
  misc_feature (719)..(720): n is a, c, g, or t
  misc_feature (842)..(842): n is a, c, g, or t
  misc_feature (901)..(901): n is a, c, g, or t
  Predicted polypeptide sequence is orthologous to G1246
aatgacgactgatgtagacaccccgcgcacttaatcctcactaaagggaacaaaagctggagctccaccgcggtggcggccgctctataactagtggatccctcgggctgcaggggcaagggtgtcaaatgatgcctgttgtattatgtatgttaaattgtaagtcactgttagcttagaaagtatagggattctgcaggtcatttgttgtgagattaataatattcacgaatgagtctacgtcaacttagacaggtttatttttttctttcatttgttctctttttttttggtgattacgttcagggaaatcaggttcaggaattggaaatgtatttgctgtataaatagttaaattagcgacattttttttttacctaagtaactaggtaacatggatttatgacatgcacgaacatgtgcagcctgaatggtaacactggtccttgcactagcaaaaaaaaaaaaaaaaaactcgagggggggcccggtacccaattcgccctatagtgagtcgtattacgcgcgctcactggccgtcgttttacaacgtcgtgactgggaaaaccctgncgttacccaacttaatcgccttgcagcacatccccctttcgccagctggcgtaatagcgaagaggcccgcaccgatcgcccttcccacagttgcgcagcctgaatggcgaatgggacgcgccctgtagcngcgcattaagcgcngnncggtgtgtgttacgcgcagcgtgaccgctacacttgccagcgccctagcgcccgctcctttcgctttcttcccttccttttctcgcacgttcagcggcttttcccgtcaagctctaaatcgnggctccccttaggttccgattagtgctttacgacctcgaccccaaaaacttggattagn

SEQ ID NO: 5519 - DNA, 805 bp, Glycine max
  misc_feature (4)..(4): n is a, c, g, or t
  misc_feature (6)..(13): n is a, c, g, or t
  misc_feature (562)..(562): n is a, c, g, or t
  misc_feature (600)..(602): n is a, c, g, or t
  misc_feature (645)..(646): n is a, c, g, or t
  misc_feature (678)..(682): n is a, c, g, or t
  misc_feature (724)..(724): n is a, c, g, or t
  misc_feature (726)..(726): n is a, c, g, or t
  misc_feature (762)..(763): n is a, c, g, or t
  misc_feature (768)..(768): n is a, c, g, or t
  misc_feature (781)..(783): n is a, c, g, or t
  misc_feature (798)..(800): n is a, c, g, or t
  misc_feature (802)..(802): n is a, c, g, or t
  Predicted polypeptide sequence is orthologous to G1272
atcntnnnnnnnngaaagacttcgctcgcaacagtatcaaaatagttaaagactaaacacatgtaaaggcataagcaaaatgcctttttacatgtataataatcctttcctactaccaatggcgcccatagtcaacggttcaaacaaaaaaactatcctatgaagtcttataaacagcactgttatcagttatcactatccctagaactgcaacagatccttcaacaaaagaacattgagctcgaaacattttcctgcaatcttggcaactgagggacgggaggagcaggcataccagaaccaccatgactcgaagatgtctcagatttgtcttcaaatttcataaactgacccatctgagtagcagccagatgagcatagcaaattggagcaacgacagaaatggcagtggtgctcctctgatacacatatgataatgaatgtacaagctcttgtagatcatcaggtgaaaagccaatctcgtctaacagaacatggtagtgtgtgggcctgctagtaccaatcattccagcatgtgcacacatatagaaatcataattcngaggatggcaaattttgttatcaattacagttccaggnnnaacattgtcaggagctccaggttgaaagaatttagtatgatgnntcttttgagcaacaatcaccaaaaacttgggnnnnnacttttcatctaaaaacttgcaagcctcgataatttgatcangntcaatgttcaaaacttgattgaactgggactcactnncaccntccctgaatatgnnnatattatcgggcttnnnantcc

SEQ ID NO: 5520 - DNA, 929 bp, Glycine max
  Predicted polypeptide sequence is orthologous to G1274, G1275
aggaggcaaaacttttattattaaacagagtacaagagagatactctaatcctaatacaagatacttacttttaagatttgaacaactttacacatggagaatcatgttccttgttacatgaactagcaaaggctgatttttaattgagagatatattaaacgtggaaccaaaaaaaggtatagaaactctcttcaacctattacagcatgaaaataaattatgattgattagacaatgcaatgatacatagcttcccctgctcgatcgaatcttccaagctttttcttggcacataattaagctagggaggtgtaaatgcccaaaagggtttgaagttggtgtcatttgaaagtagtatcagaatgtacgaaggagatggggctgtagtatgtggtaaatgggctctcatgattgtgcacaccttcatatgttgttatcacgtagctgtagtcatctctatccctttccacccttttcttcacactgcatcctccacttgaacatttgtagtagttccttagattgggactgctcttcacggacttcttgccgtacttcctccacttgtatccatcatccatgatctcaagctctgatttggttctaaacgcgatccttggacccactccacctttgttttcattaatcccatttttgcagtttatgttattattcttagaggttgcaccagtactgaatccgtgagtggcatcattgaaggttgctttttcagatgactcggtgctttgtgatgatcgagaatcttgatgatcaacatagtcatcgagcatgagataatcggatagtgcaatctcaggggaagatagagccatattaagagaattatgagcataattattgggataaggaggagagttccaaagtagaaagtcattgctgataactaaatatggtagcgacagcaac

SEQ ID NO: 5521 - DNA, 813 bp, Glycine max
  misc_feature (18)..(18): n is a, c, g, or t
  misc_feature (25)..(25): n is a, c, g, or t
  misc_feature (27)..(27): n is a, c, g, or t
  Predicted polypeptide sequence is orthologous to G1324, G2893
cccctgcatcaaaccccnttaggcnancaattcttgggttgaccctcactaacgggaacaaaagctggagcttcaccgcggtggtggccgctctagaactagtggatcccccgggctgcaggaattcggcacgaggcaaaaattgcacaacatttgccaggcagaacagacaatgaaatcaagaactattggagaactaggattcagaaacaagcaagacatttgaaaatttacactgacagcagagagtttcaagaacttgttaggcgtttctggatgcctagattgcttcagaaagcaaaagaatcatcttcttcaaacatgtcaattcaaaaccaggcaattcctatgccttttgattatgtttctcagcatttaactgttgggaccatacctccttggcagggaccttgtatgaatgaagctggtcccacttacatggaccaacatgagcagaactcatactcggaacacaacaatggttcatgcatctccttgtttgagttcagcaaatataccaaaagtgcctcatcatatgtggacacaccatcatcaccgcaattcatgccttgaataccaatgactttggcacctttacatatgaaggctataatgtagacagacatgtttatgagatggcgtacttcagtatgactactacatgggtggctgtagatgctcaataaccacatgattgattgccacatgcgtggcaagcatataggtacacgactatatcgcatgtagtatggtgaacattgatgacgcggcgcgatgctacgagtaaccagaactacattatacggcttaggc

SEQ ID NO: 5522 - DNA, 815 bp, Glycine max
  Predicted polypeptide sequence is orthologous to G1335
aagggtttaaagatatagacaaaacatataaaaccacagatgtgacaatcagaatcccaatagcaggatggccaggcagatacagatattttgaaggattaatacagcgtttaggcgaattagtaaattgattaaatcaagcattaattaagccgtccgttgcgcttcaatcttcatattcaagaggaggaacaagcataatgaatcacactttgttgaaaagaagcgcattagataaaacaattagcaaagccctggaaaaacatatttggaaggaaggaaggaaatgccaatggctagaaacaaaaataacagaatccatttaaccaaccccaactaacagtaacagactcaattcaatagaagaaaccataacacattctcactcatttccttttccaacattcggacattccctcgcaaaatgcccttcctccccacagttaaaacaccctcctcctcctccaccaccaccgccgcgtctccgattcctaccatcatcaccaccaccaccaccctgtccatggtaacaatcccttgccaagtgacctattcttccacagttataacactcagggcctcctcctctccgaccgaaccctctgccacggccttccccgcccccgtagcgtcctcctcctctgcccctcccaccgccgccgccgcgaaatcctccgggaagacgagatctaacggctgaggtgacgtcgacggccatggtgcggccgtcgtcgccgtaatcgaggagaaactcaacggactgaccgtcggacaaagaacggtagccgtcggatcggatggaagtgaagtgcacg

SEQ ID NO: 5523 - DNA, 368 bp, Glycine max
  Predicted polypeptide sequence is orthologous to G1335
cctcgtgccgaattcggcacgaggggtacgttggtggtggaggcggcggcggcggcggaggaagctgctacagctgtggagagtctgggcattttgccagagattgcccatcaagtgctcgttgaatttactgttagggttgtttatgttttgcggattgttttaagtttttactttaatatgtcttagggattttaatggtttctgtccaaactatgggttcttatgagtagatgtgtgggatttttcttttttggttatttaaatgaagggtttctgtgttatcgttacaatctgcaaactaaaatctgtttgaacttacattttgctataatgaatcgtatgattgctatcaaaaaaaaaaaaaa

SEQ ID NO: 5524 - DNA, 1064 bp, Glycine max
  misc_feature (1)..(1): n is a, c, g, or t
  misc_feature (42)..(46): n is a, c, g, or t
  misc_feature (49)..(56): n is a, c, g, or t
  misc_feature (58)..(58): n is a, c, g, or t
  misc_feature (60)..(61): n is a, c, g, or t
  misc_feature (64)..(64): n is a, c, g, or t
  misc_feature (127)..(127): n is a, c, g, or t
  Predicted polypeptide sequence is orthologous to G1341
ntttccggttggttgtggtagtggtgggtggagtggttttgnnnnnaannnnnnnnancnnccncccccccccccccccccccccccccaagcgaggcgatggactgcagttctaatgtacataccncaagcgtcgcattaaccctcactaaagggaacaaaagctggagctccaccgcggtggcggccgctctagaactattgtatcccccgggctgcaggaattcggcaccagctgattcccattgttaagcctataccaaacccattaagagtgaaaaagtctatccctgcttttgggtcagaggaatttttaaaaccaaaacctttctttgaaaagcctattcctaaactaccacttgatcctaaattcaagaaacctcttctaccaccattgccaattcacaagccaattccaaccccataaaatgataacactctacgccataaagctataaggatattcctttccgttcctaatgcctttatatatataaatgcaccgcattaatttcaacctgaatcatgatttcgataatcctttcgtacccctcttgtgtactggattggaatatatatgtacttgatgttttctatgtaatgaaggtctcaatattattatttgtaagattaattatattattaagaaatggttcgctttttttgttttgtttaagtaaaaaaaaaaaaaaaaaactcgagggggggcccggtacccaattcgccctatagtgagtcgtattacgcgcgctcactggccgtcgttttacaacgtcgtgactgagaaaaccctgggcgtacccaactttaatcgcttgcagcacatcccccctttcgccagctggcgtaatagcgaagaagcccgcaccgatcgcccctacccacagttgcgcagcctgaatggcgaatgggacgcgccctgtagcggcgcattaagcgccgcagatgtggtgttacgcgcagcgtgaccgctacacttgccagcgacctagcgcccggtctttcgctacttgcttacttctcgcacgtcgccgcttccccgcagctctaatcgggcttcctta

SEQ ID NO: 5525 - DNA, 853 bp, Glycine max
  misc_feature (16)..(16): n is a, c, g, or t
  misc_feature (727)..(727): n is a, c, g, or t
  misc_feature (853)..(853): n is a, c, g, or t
  Predicted polypeptide sequence is orthologous to G1341
cccaatcttaagtganctactcctggattacgccaagcgcgcaattaaccctcactaaagggaacaaaagctggagctccaccgcggtggcggccgctctagaactagtggatcccccgggctgcaggaattcggcaccaggtggagcacatggtggtggttttggaggaggtggtggaagcttgggagtgaaaagggtttgtttagggatgagaagaacttcttccatcgtccagggtttggaggagggttaggtggtggtgcagaatgatggttatgctattaataacaggatcataataattaataacgtaacaatcatatcatcaccattaattctaagcacgttgttatcaactcgtgatttttatgtaacaaaagtatttccataattattatttgcattatcgtgaaactactatcatcttgtaattgctcttctgattatatatatttgcataaaagaaatatgtttagagtttaaaaaaaaaaaaaaaaaactctagggggggcccgatacccaattctccctatagtaagtcctattacccacgctcacttgccgtcattttacaacatcataactgagaaaaccctgacattacccaacttaatcacccttcaacacatccttctttcaccacctgtcataataactaaaaatcccccaccaatctccctttccaacatcttctcaacctgaatgcaatttgtacacactctatancacttcattaatcacagcattattgtagttactcacaatcttaaccctacactaccacaccctaacaccactcctttcctttcttcctttctttctcaccctttccccactttccaccaaactctn

SEQ ID NO: 5526 - DNA, 807 bp, Glycine max
  misc_feature (366)..(366): n is a, c, g, or t
  misc_feature (612)..(612): n is a, c, g, or t
  misc_feature (803)..(803): n is a, c, g, or t
  misc_feature (805)..(805): n is a, c, g, or t
  misc_feature (807)..(807): n is a, c, g, or t
  Predicted polypeptide sequence is orthologous to G1341
gaatcatgacgccagctctaatacgactcactatagggaaagctggtacgcctgcaggtaccggtccggaattcccgggtcgacccacgcgtccggacttaaagaagagttaagggaaaaaaaataagatgaacactattggagttatgattatgatcatgtctatgttagggttcgcacaagctaataattacaatcctccatttgtgcaagttgagtcaatcagtgagactaatagacttacttgtccacaagcatgcagagtacaatgtgcagctttagcaccagttgaaccatggtatgacaaatgtgttaaagaatgcactggcaatggaagcatgatgtgtccgttgctaaggattgctntactagttgtgccttaatcaagtccattaacatcaacaatgatgttcgtgatctttcgaccaatattgtgatgaattcctgcttgcaagaatgtcaaaacaagaaataagttgttacaagaatcttcaagaaaaaggttgttaattgtaataaaataaattttaatcaataagtaatatctatttctctaaaaaaaacaaagagaggggggggaggggaggggggggggggggggggtggaggaanggtggatgaagaagaaagggtgaggtgagttgtgtataggatgtgggatatagagactctagtcgatacgcaattagtagtggtatggtgagagttgagatgatggtcgtggtcacaagcgacagcacgtgaagtactgacgtcatcatgtatagaggagggcgcaaatcctgtatgagcgggctgcgaananan

SEQ ID NO: 5527 - DNA, 690 bp, Glycine max
  misc_feature (22)..(22): n is a, c, g, or t
  misc_feature (28)..(28): n is a, c, g, or t
  misc_feature (31)..(31): n is a, c, g, or t
  misc_feature (33)..(33): n is a, c, g, or t
  misc_feature (44)..(45): n is a, c, g, or t
  misc_feature (122)..(122): n is a, c, g, or t
  Predicted polypeptide sequence is orthologous to G1341
gggggggggggggggggggggngggggnggngnagggggggagnngttggcggccccagaagggctaaacgtgttagaacctcctgctggccgagacgcgcaattaacccctcactaagggnaacaaaagctggtagctccaccgcggtggcggccgctctagaactagtggatcccccgggctgcaggaattcggcacgaggaaggaatgctgtgccaaacttggtcactcatcaagacctagatttgtaggaggtttgtcagaaattattacagaataggtgcagttgactccagcgtaagcaacagatgtcagcatgctagcttgttcttgcaaatttatatttatttagaagatttttagtgacatgaatgaaagcccgtaaaatattactgctcatgtatatagtttgaggagcttgacatgaccaacatagatttttacgtaagtctggtatggccctttattttggggttttagttatagggaattgggctcctaaaggagaaggggaattcactttggcagttgtttggatatatgttaagggcttcttcctttttttatatttaaaaaaaaaaaaaaaaaaaaaactcgagggggggcccggtacccaattcgccctatagtgagtcgtattacgcgcccccactggccctcgttttacaacgtcgtgacttgaaaaacca

SEQ ID NO: 5528 - DNA, 830 bp, Glycine max
  Predicted polypeptide sequence is orthologous to G1361
ataaacacattttacgaatatacatgtaccctaaaattaaaatcaaactacagtaccgcaaatatatataccttcttgcttgtctctcaacttcaaccagggtcaattatgggaaagtccatcatgcctgcgccatattgatctcaataattcaaggaaaaacctatatttttccaacccttggaattccttcagtctaatttcacatataaatactattactcaattagtaatggaaacaatatggaggacatgctgtaaatcattgtcactgcttgtctacctagaagctcttcccagtgttactttcaaatcttgctttctttgcatccattgttgagcgaatataagagccatcaacctgaacaaccgagctgggaattattagttgtgaggaactttccctattatgactcgcatgggcatgatcataatctatgtaaggagcattgtagcaatccaaaagagttgcagtagttttagttattgatgtatttgtgctgtcttggacacttccaccattcaacattttttcgtacgggtcctttatgataatgggattaacacattgtctaggttgtgtttggtagaagacttttgaaacaactagttctccatctttctcttcttcagtattgccaagatggtattgatgcatcacccagtaagttttctcaggcttcttttgccttccatagttggtgtagagtactagtattttcttaaaacctttcactgcaccaccagatgcaaaaactgctctagtttttcccgttttgtgccatcttgtttcattccttcatcatcagtgtgaacctttcttcttttcc

SEQ ID NO: 5529 - DNA, 740 bp, Glycine max
  Predicted polypeptide sequence is orthologous to G1361
atataataataataatggaagccttgtctttcttccaacttatcgtcccatatatagaataaatacatgttatatatataatagtaatataaaaaaaaaaaaaacatcaacatcaatatatggtcattgtcactactatatgttctaccaagaaagttcttccagtaaggagctattttctgtccatcttggctttggttgcatccattgctaatcgaatgaaagaagagctatcaccttgcatgaccaaatttggaataagttgaggtgaattttccctattactacaaccacccaattggtcataatttatgaaaaaaggattgtagtagtccataagagcacttgcattattatttctaggtattatattgttgtcatcatcattatggacactttggttagtcatcaatctttcttcatcataaagatcctgctttataatggaattaccacattgccgaggttgtgtttggcagaaaacctttgaaaccaccaattctccatctttctcttcttcgctagtgccaagggggtattgatgcatcacccaattggtcttctcaggcttcttttgccttccatagttggtgtagaggactaggattttcttgaaccccttcacagcaccgccaacaaaaacgggtctagtttttcctgttttgtgccaccttgtctcgcttccttcttcgacggtgtgaacctttcttcttttccttgttcctgttgagtatgcttta

SEQ ID NO: 5530 - DNA, 886 bp, Glycine max
  Predicted polypeptide sequence is orthologous to G1364, G481, G482, G485
ctgcaaatattatatattatataataatctaaagaaaacactcaaagcaagtgcttctcaccatgacaagctacatggcgaatcacatgcaataaccccaaacacatctctcccttgagttggtcaggcagctaaatatgacatgtataatgtattaataaaaatctaccttagtaccgtaacaaaattctgacactgatgccttctaaacgagaacctaaatattaaatcaccaaaccattgtttccacccattccatgcgtacaagcattcaagggaaataaataagatgcgtagaagcatctaaactattcatggccttgcattgaaggcataaccagatgttgtggttgcacctgcaaaccaatatagttcagcgaaccctgatgaacaagctgagcattttgacctgcaaggccaacttgatctggtctagcagatccatcaccacttctagcagatcctttagtgtcaccctccgcctctctgtacctagccaggtacaccttaagcggctcaatgtagtcttcaaaccctaaagttgccatggcccatagtaaatcgtctccattgattgtctttctcttctccttctggcatttctcactcgcctcgctggtaatgaagctgatgaattcagaaacgcattcttgcattgtgtcttttgcatccttcgcaatcttgccattgggaggcagagccttcttcatgatgcggctgatgttggcaatgggaaggtaccggtcctgctctctagccgcgccggacaacgagccgcgagggctctgctcgccaccactctcgtgactcggactcgccggtgcatccgacatctcacaaaccctacaaattacaatacaaaatatttctgatttccgacagcaac

SEQ ID NO: 5531 - DNA, 940 bp, Glycine max
  misc_feature (1)..(2): n is a, c, g, or t
  misc_feature (61)..(61): n is a, c, g, or t
  misc_feature (922)..(922): n is a, c, g, or t
  misc_feature (940)..(940): n is a, c, g, or t
  Predicted polypeptide sequence is orthologous to G1364, G481, G482, G485
nnaaggagggggtggggggggatgaggcgctcttctgtgggggcggctgtcgcgccttttnctcctcactcacgggaacaaaagctggagctccaccgcggtggcggccgctctagaactatttttatcccccgggctgcaggaattcgacacgagtctcccagttcatcagcttcatcaccagcgaggcctctgattagtgtcagagagaaaagagaaagactattaacggcgatgatttgctctgggcgatggccactctcggtttcgaggattatatggatcctcttaaaatttacctcactagataccgagagatggagggtgatacgaagggctctgccaaggctggagactcatctgctctgagagatgttcagccaagtcctaatgctcagcttgctcatcaaggttctttctcacaaaatgttacttacccgaattctcagggtcaacatatgatggttccaatgcaaggcccggagtaggtatcaagtttattattgaccctcttgttgtaacgcttgttttctacgccagttaccaagtgctcacggcatattgaatgtctttttatgttatgtgaatactgacaggagatgttggctcttgtgtccgttattcttttgacattaaggttcgtatattatctctggattcgaattattatttgatagctatgattatattgttaatcctagagccctgttgtctgaatccatcatgctgcttgttcaagaccgagatgttaggactgatcgaagcataataccgaatattctctgcctaattcctctcacaatgatcgatgatgaatgctcgaagctctctcatctagagaactaacattactcgaggaggggctcggtactccattcgcttatagggatctattatctcgctactgatctcgtttacacgntcggactgtaaactctgn

SEQ ID NO: 5532 - DNA, 906 bp, Glycine max
  misc_feature (538)..(538): n is a, c, g, or t
  misc_feature (683)..(684): n is a, c, g, or t
  misc_feature (702)..(702): n is a, c, g, or t
  misc_feature (706)..(706): n is a, c, g, or t
  misc_feature (709)..(709): n is a, c, g, or t
  misc_feature (715)..(736): n is a, c, g, or t
  misc_feature (739)..(739): n is a, c, g, or t
  misc_feature (741)..(741): n is a, c, g, or t
  misc_feature (745)..(745): n is a, c, g, or t
  misc_feature (758)..(759): n is a, c, g, or t
  misc_feature (767)..(770): n is a, c, g, or t
  misc_feature (780)..(780): n is a, c, g, or t
  misc_feature (786)..(786): n is a, c, g, or t
  misc_feature (797)..(797): n is a, c, g, or t
  misc_feature (867)..(867): n is a, c, g, or t
  Predicted polypeptide sequence is orthologous to G1364, G481, G482, G485
acatgatctgctgtagttacccccagcgcgcatttaaccctcactaaagggaacaaaagctggagctccaccgcggtggcggccgctctagaactatgtggatcccccgggctgcaggaattcggcacgagagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatgacgtgctcctctattcgccactccctagactttntatattatattatttaattaaactctcttctccactcaacctttgcaagatcactgggttggttagtcttgttacttgttactgtttctctctatcatacctatactcactcttcctcctcatctattatttacatccaatgcannatctcaaatatttctttntcanaanaaaaannnnnnnnnnnnnnnnnnnnnnaananaaanaaaaaaaaaaaannaaaaaaannnnacaaaaaaanaaaaanaaaatcctggnagcgggggagccggacccaatttcgccctataggagtcgataccgccgtactgtggcgggttttaaacgntgacatgaaaaaccctgcttaccaacttattcccttacc

SEQ ID NO: 5533 - DNA, 931 bp, Glycine max
  Predicted polypeptide sequence is orthologous to G137, G145
gagatgggaaggggaagagtggagttgaagagaattgagaacaagatcaacaggcaagtgacctttgcaaaacgaaggaacgggcttttgaagaaagcttatgagctttccgttctttgtgatgccgaggttgctctcatcatcttctccaatagaggaaagcagtacgagttttgcagcggttcaagcatgctcaaaacgctggagaggtaccagaaatgcaactatggagcgcctgaggacaatgtggcaacaaaggaagccttggtattggagttaagcagtcaacaagaatacttgaggctgaaagcacgttatgaagctctacaacgttctcaaaggaaccttatgggagaagatcttggccctctaagcagcaaagagcttgaatcacttgaaaggcagctagattcgtctttgaagcaaatcagatcaataaggacccaattcatgctggatcagctttctgatctacaacgtaaggaacactttctaggtgagtcaaacagagatctcagacaaaggttggaagagtttcaaataaatccactccaactgaatcccagtgctgaagatatggggtatggacgccatccaggtcagccccaaggccatgctctctttcaaccattggagtgtgagccaaccttacaaattggatatcatcctgatccagtatcagtggtgacagaaggcccaagcatgaataattacatggcaggatggttaccatgaaaagagtgtcaagtgtggagcgtaattaagatcctgccgtttaatttcaaatttatttgaagttaggaaacggaaatttgtaatagcacgtaatggacttacactagactctaccttctaattaagctaggaacaatataagcagtgattttgtgtgtgagctttcataaacagtacctagctagcctcttccttg

SEQ ID NO: 5534 - DNA, 675 bp, Glycine max
  Predicted polypeptide sequence is orthologous to G137
cggcggggggtgtcaggtagtacatcgtagtagacacgccaagcgcgcaattaaccctcactaaagggaacaaaagctggagctccaccgcggtggcggccgctctagaactagtggatcccccgggctgcaggaattcggcacgagaggaaatcaatgtagccctacaaccaacatgggaagctagggagcaaaatgctccctacaattgccaccctccccaaacagagggatattatgagacagcaacagcacattgcagcagtacattgagaattggctatgattcttcaggattaaatgaagcaggaggagctgcaggagcctcagcccaaaatgctagtgaattcatgcatggatggatgaactaaatttatttccaatttagtacttaaattcatgatcatcagaaaaatgatgcttttgtagagatcttggcctacaagaacaggctctaataataggtgtcatgcagcataaaatatacttatgctattcttaatattccaaaaaaaaaaaaaaaaaaaaaaaaaaaaaaaaaaaaaactcgagggggggcccggtacccaattcgccctatagtgagtcgtattacgcgcgctcactggccgtcgttttaaacgtcgggactgggaaaaccctggcgttacccaacttaatcgccttgcagcacat

SEQ ID NO: 5535 - DNA, 927 bp, Glycine max
  misc_feature (1)..(1): n is a, c, g, or t
  misc_feature (653)..(653): n is a, c, g, or t
  misc_feature (668)..(668): n is a, c, g, or t
  misc_feature (699)..(699): n is a, c, g, or t
  misc_feature (704)..(705): n is a, c, g, or t
  misc_feature (712)..(712): n is a, c, g, or t
  misc_feature (714)..(720): n is a, c, g, or t
  misc_feature (723)..(723): n is a, c, g, or t
  misc_feature (835)..(835): n is a, c, g, or t
  Predicted polypeptide sequence is orthologous to G137, G145
naagtgctcagtcggtggcatgagccccgccagcgcgtaattaaccctcactaaagggaacaaaagctggagctccaccgcggtggcggccgctctagaactagtggatcccccgggctgcaggaattcggcacgaggctgatcttcagaataaggagcatatgttggtggaagcaaacagatctttgaccatgaagctggaagaaatcaattcaagaaaccagtataggcaaacatgggaagctggtgagcaaagtatgccatatggaacccaaaatgctcactctcaaggcttcttccagcctttggagtgcaaccccacattgcagataggttctgactacaggtacatccctgaagcctcagagcagcagctagctgccacaactcaagctcaacaagtcaatggatttattcctggatggatgctttgacctaagatctcagtattttagatggctacataaataaaattagcaaacacctaaggccaaagtcaaaatgcctcttgctgttggaaatgtgtaaatgctgttgttcttctgttaatttgttttggcataaaaacagcagtgactgacttaaaactattaaaactttagccatagacataggatgtggcatgaaggttatagtatttaatttgaatattntggaaggacaagttntatctgactgaatgaccagttagtgtcattntttannaaaaaantnnnnnnnaanaaaaaaaaaaaaaaaactcgagggggggcccgtacccaattcgccctatagtgagtgtattacgcgcgctcacttgccgtcgtttacaacgtctgactgggaaaaccctgcngtaccaactaatcgccttgagcacatcccctttcgcagctgcgtaatagcgagagcccgcaccgatcgccttccacagtgcgcacctgattg

SEQ ID NO: 5536 - DNA, 792 bp, Glycine max
  misc_feature (1)..(3): n is a, c, g, or t
  misc_feature (531)..(531): n is a, c, g, or t
  misc_feature (581)..(581): n is a, c, g, or t
  misc_feature (792)..(792): n is a, c, g, or t
  Predicted polypeptide sequence is orthologous to G137
nnnaaggatgatgcgctgcgatgaaccctcactaaagggaacaaaagctggagctccaccgcggtggcggccgctctagatctagtggatcccccgggctgcaggaattcggcacgagcagccattggaatgcaaccctacattgcagattggtcctgattacaggtacaatgatgtagcttcagatcagataactgccacaactcaacctcaacaagtgagtggctttattccagggtggatgctgtgaaattaggctcagtattcagttggagacataaaagcaaacaccttacaaaagggcaaagccaaaaatgcatcttggtgttggcaaggtgtaaatgtaaccctgcttctattattattttggtataagaaacagatgtgttgtgacttgttcaaacttgtgagaacctttttagccatagacatatggcaatttataacattcggaatcttttgaaggatccttttttattatttaaatatccgagcgaccggtttcaattaaaaaaaaaaagagaggagganagaaaagaaaaaaactcgagggggggccccggacccaattcgccctatantgagtcgtattacgcgcgctcactggccgtcgtgtacaacgtcgtgactgggaaaaccctggcgttacccaacttaatcgccgtgcagcacatccccctttcgccagctggcgtgatagcgaagaggcccgcaccgatcgcccttcccaacagttgcgcaccatgaatgcgaatgggacacaccctagaacgcacatttaagacaggaggn

SEQ ID NO: 5537 - DNA, 2226 bp, Glycine max
  Predicted polypeptide sequence is orthologous to G1382
gtacaatgctatctttgtcaaactgactccaaataaacaacatgcaatatcatcagcaggagaaaatggagaactttgcttaggctcaattataatgggctgcttgcatcactgactgataaaactgttcaattagttggcttattcataagattatatatatatatatatgctctctttccgctgttattactgatatcataggttgattgattgctgtttgaggcctttagggtttgcaggtattcaggaacttgcttgttttggtttccccccctctctttttattgtttttttgagaatattttttttccagtatctttttgtgcattttaatttattattattcatttgactcaacaaccgttgctcaaagaacattatagtttaaatattatttgtgccatgcattgcaggtggaggcttcaccaactacaggttccctccgtaagctccaacaaacaatgcatggttctatggcctctgctgcatttccagtaaccactgcctgcttcgataccaatactgttgatgacagaaaatcaagtttctttgagttcaaaccactcagcagatctaatatggttcctgcagacttcaacaaccatgtaagtaaacaatctactcaagtagaaggtccaggaaaaactcaatcatttgcttcctcaccattagtggaaagtgagatagcagttccttctaatgaattaagcctatcatcacctgtacaaaaggttagttctagtgctagtgctcctgttgatgttgacttggatgacattaaccacaaaggcaacacagctactgggcttcaagcatcacatgttgaggttagaggcagtggactttcagttgcagctgagaaaacatctgatgatggatacaattggcgaaaatacgggcaaaagcttgttaaaggaagtgaatttcctcgcagttattacaaatgtacacatcccaactgtgaagtgaaaaaactttttgagcgctctcatgatggtcaaatcactgagatagtttacaagggaacacatgatcatcctaaacctcaaccaagctgccgatactctaccggtactgttttgtctattcaaggagagagatctgataaggcttctatggctggccgagatgacaaagcaactgctatgtatggtcaggtgtctcatgctgctgagcccaacagtactccagagtcatcacctgttgcaacaaatgatgatggtttagagggtgttgccgggtttgtgtcaaataggactaatgaagaggttgataatgacgatcccttctcaaagcgaagaaaaatggaacttggaaatgttgacatcactccagtagttaagcctatccgggaaccacgggttgtcgtacaaactttgagtgaggttgacatattggatgatgggtaccgctggcgtaagtatggccaaaaggttgtgagaggcaatcctaacccaaggagctattacaaatgcacaaatgctggttgccctgtcagaaaacatgtggagagggcatctcatgatccaaaagcagtgataaccacatatgagggtaaacacaatcatgatgtaccagctgcaaggaatagcagccatgacatggcagtaccagcagctgcagcaggtggacagacaagaactaagttagaagaaagtgataccattagccttgaccttggaatgggaattagctcagctgctgaacataggtcaaatgggcaagggaaaatgctgcattcagagtttggggacacacaaactcatactagcagttccaacttcaagtttgttcatactacctcagctccagtatactttggtgttctacataacagctcaaatccctttggttctagagacaataggagtgatggtccatctttaaaccgttcctcatatccatgcccacagagcatgggaagaatactaatgggtccatgaagttgattacaccacagatattaaataaaaaactatgagtaacaatttgctttcttttttcttatttttggcgggtatagcttcaaaggtgtaacatctcattttctgtaagaaaatgcagataagttcttttatgtttatatcactattccatagttgctgtttagtagagttggtagcagctccatcttgacttttaaatctaattgccgtttgtaattgtataattataaattataattatatccaaattcttctgtataaaaaaaaaaaaaaaaaa

SEQ ID NO: 5538 - DNA, 890 bp, Glycine max
  misc_feature (1)..(1): n is a, c, g, or t
  misc_feature (49)..(50): n is a, c, g, or t
  misc_feature (59)..(59): n is a, c, g, or t
  Predicted polypeptide sequence is orthologous to G140, G146
naattccaacctcgaacaatatacatggctgagtatggcgacagctggnncgcctgcangtaccggtccggaattcccgggtcgacccattcttccggcacacacaacttgtcacatatcatattttgttcatcaagtttataattccttatctttgaacttacttacatccaagtaaggtctaagctagctggagttgattagatctagctagctagttttcgatctgcttaatttgttttccatgatctcttatatatagtaattttatttccctttaattaattaagaaagagttgaagaagaatgggaagggggaagatcgaaatcaaaaggattgagaacacaacacatcggcaagtgaccttctgcaagagaagaaatgggcttctgaagaaagcttatgagctgtcagtgctgtgtgatgcagaagttgccctcatcgtcttctccagccgtggccgtctctatgagtattccaacaacaacataagatcaacaatagagaggtacaaaaaggcatgttctgatcactcaagcgcgagcactaccacagaaatcaatgctcagtattatcaacaagaatctgcagagctgcgacagcaaatacagatgctgcataattctaacaggcacctgatgggtgatgccttaagcacactgactgtgaatgaacttatgcagttggagaatagacttgaaagatgatcactagtatcagatctacgaacatgagagctactggctgacattgatactccagaacgggacgatgactggatatgaaatcttgctccgactagatactgcctgagagatcacatgtacatgttctggccgactgagcatcagcatagctacgtactttcatcaatagtgcagtggacgtc

SEQ ID NO: 5539 - DNA, 788 bp, Glycine max
  misc_feature (578)..(578): n is a, c, g, or t
  misc_feature (581)..(581): n is a, c, g, or t
  misc_feature (586)..(586): n is a, c, g, or t
  misc_feature (592)..(592): n is a, c, g, or t
  misc_feature (609)..(609): n is a, c, g, or t
  misc_feature (613)..(613): n is a, c, g, or t
  misc_feature (621)..(621): n is a, c, g, or t
  misc_feature (652)..(652): n is a, c, g, or t
  misc_feature (696)..(696): n is a, c, g, or t
  misc_feature (788)..(788): n is a, c, g, or t
  Predicted polypeptide sequence is orthologous to G140
gggagcgctgctagaaggcgccgagcgcgcaattaaccctcactaaagggaacaaaagctggagctccaccgcggtggcggccgctctagaactagtggatcccccgggctgcaggaattcggcacgaggggaaatagagctgcaaaaccataataattttctgagagctaagatagctgaacacgagaaagcacaacaacggcaacaggatatgataccgggaaatgtgtgcgagtcaaccatacctccacaatcatatgaccgcaatttcttccctgttaatctcatagattccaataatcaatattcaaatcaagaccagactgctcttcaacttgtctgataaacgatttgaaattatgccgcagcctttcaagtggtgtgggatcccttacatcgtcctatgtttcgtgaaggagagtgcccttagaaactcctctgctaaagttcttacaacggagaacaagagaaaaactaatcagcatttgtaccaatacatcatttgatattgtttatgtatctttcaatatatatagtttctattcagtcctggcaaaaaaaaaaaaaaaaaaaaganganggggngggggnggggagggggggggaangggngggggagngggagagagaaaagaaagaaaaaaaaaaaanacctccgggggggggcccggccaccaattccccctttgggaggngtaatagcgcccccacatggccttgtttacccaggggggagtggaaaaaagcggggtccccaaattaatgccgttggcgcaaaacccctttn

SEQ ID NO: 5540 - DNA, 1008 bp, Glycine max
  misc_feature (1)..(1): n is a, c, g, or t
  misc_feature (105)..(105): n is a, c, g, or t
  misc_feature (111)..(111): n is a, c, g, or t
  misc_feature (116)..(117): n is a, c, g, or t
  misc_feature (134)..(135): n is a, c, g, or t
  misc_feature (142)..(143): n is a, c, g, or t
  misc_feature (508)..(508): n is a, c, g, or t
  misc_feature (556)..(556): n is a, c, g, or t
  misc_feature (571)..(571): n is a, c, g, or t
  misc_feature (677)..(678): n is a, c, g, or t
  misc_feature (688)..(688): n is a, c, g, or t
  misc_feature (697)..(697): n is a, c, g, or t
  misc_feature (706)..(706): n is a, c, g, or t
  misc_feature (708)..(708): n is a, c, g, or t
  misc_feature (716)..(717): n is a, c, g, or t
  misc_feature (740)..(741): n is a, c, g, or t
  misc_feature (749)..(749): n is a, c, g, or t
  misc_feature (760)..(760): n is a, c, g, or t
  misc_feature (787)..(787): n is a, c, g, or t
  misc_feature (797)..(797): n is a, c, g, or t
  misc_feature (800)..(800): n is a, c, g, or t
  misc_feature (806)..(806): n is a, c, g, or t
  misc_feature (808)..(809): n is a, c, g, or t
  misc_feature (813)..(815): n is a, c, g, or t
  misc_feature (817)..(818): n is a, c, g, or t
  misc_feature (823)..(825): n is a, c, g, or t
  misc_feature (827)..(828): n is a, c, g, or t
  misc_feature (830)..(830): n is a, c, g, or t
  misc_feature (832)..(832): n is a, c, g, or t
  misc_feature (838)..(838): n is a, c, g, or t
  Predicted polypeptide sequence is orthologous to G1419
ngggagtctactcgacgccagcgttcaattaaccctactaaagggaacaaaagctggagctccaccgcggtggcggccgctctagaactagtggatcccccgggnctgcanggaannttcggcacgagggctannaaagcgnncttctaacttaagtgatggctaacgctgtgaagtttcagcgttgaaacgcatcaagttgcatcttttgggtgaactctctccactggccactccccaaaacaaatttgaccaaacaaaccctagcccctctgaatcttccaattccgaatcttcttctatttctcttaaccactacttcactgacctcctcgaacccgaaattgaatttcctctcttcgaattcgattccaaaccccaagtaatcgacctcgaaaccccgaaaaccctaatttcagctgagaagaagcctcaatttaatcggaaaccgtcgctgctaatcgctgttccgaagaagaccgagtggatccaaattcgaaaacctgangtggcggcgccggagaaccagcctgagaagaagcactacagaggtgtncgtcacggggcgtgngcaaaagtcgcgccgagatccgcgacccgaacaagcgcggtctagggttggctcggaacctcgacaccgcatcgaagccgcaagcctacgaccgagcccgcttcanngctcgcgctncagggcatnctcaactcncnctcgaagnntacacccgcgcggagaccgtctnncgtcgcgnccgcgacgtcnagaagaagcgcccgcgcgaagaagatngatgtgtggnttngagatnanngcgnnngnnaagannntnncngncttgtntgagtttttttatggatgcgttaacgcgcaatgtggccggtttggacaggactcaaggatatccacttcccgcgtgcgcgttattctttggatttaccgttcggctggtgattccaattagacgggtttttgggttagtctttagtgcctcgttcagggtatctttactt

SEQ ID NO: 5541 - DNA, 889 bp, Glycine max
  misc_feature (30)..(31): n is a, c, g, or t
  misc_feature (647)..(647): n is a, c, g, or t
  misc_feature (662)..(662): n is a, c, g, or t
  misc_feature (674)..(674): n is a, c, g, or t
  misc_feature (676)..(676): n is a, c, g, or t
  misc_feature (680)..(680): n is a, c, g, or t
  misc_feature (683)..(685): n is a, c, g, or t
  misc_feature (687)..(690): n is a, c, g, or t
  misc_feature (692)..(692): n is a, c, g, or t
  misc_feature (749)..(749): n is a, c, g, or t
  misc_feature (756)..(756): n is a, c, g, or t
  Predicted polypeptide sequence is orthologous to G1419, G43
gggcgagggtcggtgagcgggccgggcaannatccctcactaaagggaacaaaagctggagctccaccgcggtggcggccgctctagaactagtgtttcccccgggctgcaggattcggcacgagggaggttaagaaatgcaatatttctcctgaaccattggtgtcatcaaaagagaagccaaagaagttagaatacgataaggcaaagcgttataggggagttagaagaaggccttggggaaaatttgctgctgaaatccgtgaccctacaaggaaagggacaagggtttggcttggaacctttgacagtgaaattgatgcagctaaggcctatgattgtgctgctttcaagatgagggggcagaaggctattctgaacttccctcttgaggctggactgtctgatcctaagcctaacagttgtggcaggaaaaggagaagagagagccatgatcatgaattggagctgccacaagtccaagttcatcatggtgtttcctgagaaaaagtgagaagatataataatagatttagttgttttgtgagtagcattaagtttgttgcctagaaaaataaggttgctgtgccttttagtttgtacgtagaagcaaggctaatgtgaaatgtctatatgaatctatgcanaaagcatgttacganagtctactaaananaaanacnnncnnnnancaaaaaaaaaaaaaaaaaaaaaaaactcgaggggggcccgtacccaattcgcctatnagtagtngtttacgcgcgctcactggcggcgttttacacgcttgactggaaaacctgcggtacccactaatcgcctgagacatcccccttcgcagctgctattacgaaaagcccgacgatcgccttcaacgtgggcactg

SEQ ID NO: 5542 - DNA, 895 bp, Glycine max
  misc_feature (674)..(674): n is a, c, g, or t
  Predicted polypeptide sequence is orthologous to G1421, G1750, G440
cgtagctcgacttctgctgattacgccaagcgcgcaattaaccctcactaaagggaacaaaagctggagctccaccgcggtggcggccgctctagaactagtggatcccccgggctgcaggaattcggcaccaggtacgacagagccgccgtcaaactcaagggccccaacgccgtcaccaacttccccctcgcgccggaggctacggcgcagtctccaccgctcgccgcggacaacctcagctccgacggcggcgcgtcgtactcggacctagtggcctcgccgacgtccgtcttggcctacgagtgcgactcgacgccgttcgacggtttccgttatctcgacgttgacgcgttcgggttccacatcgacgcgccgttaagtttgccggaagttaacgttaacgttgcgctgacgtgtcatcacgggaagaagcaggaggaggcgtttgatgaattcgatctggacgagttcatgacgtggccttactagtgataaaaatctcagggacagtttggtaaattacaccctgtttgcattgcggaagtgtgagttggaaatcccgaaattgcccccctccccctctcgttgtccaagtttgaaattttgtcgtactcgttggagctttggaagagtgtagagttgttggtacaaaattttatgtagtcgcattntactaccacctgaaacggcgattctttgtgtcgtatttggtagagtttaatttgtagttattatcatgaaaaaaaaaaaaaaaaaaaaaactcgagggggggcccggtaccccatttcgcctatagtgagtcgattacgcgcgctcactggccgtcgtttacaacgtcgtgactggaaaaaccctgcgtaccccacttatcgcctgcagacatcccctttc

SEQ ID NO: 5543 - DNA, 841 bp, Glycine max
  Predicted polypeptide sequence is orthologous to G1451
agtgttcaaacagaagtactaaacatgtggatatgtaatagtcttcttaaccgtaggacctgagagaaaaatacatgttaaaattctctcagtattcaagggagccaattgatggtagtcctgaaacaatttcatgagaatctgcaccagtgctattcagcctctgtcctggacttggaccaagggattccagggcttgttctcccattttatggatatcttcaggtgaaagtattttgatataccatacattattgacaaatgattcccacggatcgtctccaaggagaagaacatcgttctccctgtcgacgaatacaagctgccagcctgatctaagagggtcttctaatttcccctcaataccaaacatctgtgccaactcctcccgcagctcatgataactgctgaaccgggagatgtcaagtgagcgcccaactgaccctgatttgtaaaccttgacgaatgttcgtgtctggttttgagggtcaacttgccctgcactttgcaccaactctgatgaatcttgaccacaaggatataaaggagactggaatccagactctcctaatggcattgctgatgcatcactatccgctgatgcagtagtataacgcgggacagtcgtagggagcagaagaccagatgaatcgatgttgaccccaaatagaataggattttgggtgtccgagttacaatgtggtggcaccattgcggtatcttttccagaatactgcacatgttgcattgagttgccaaaagcattaacctgcaacggtgtgaattttggggcccatgattgttgaggtaactgttcagtcagcatggactgaccacttct

SEQ ID NO: 5544 - DNA, 960 bp, Glycine max
  misc_feature (21)..(21): n is a, c, g, or t
  misc_feature (383)..(383): n is a, c, g, or t
  misc_feature (839)..(839): n is a, c, g, or t
  Predicted polypeptide sequence is orthologous to G1451
ggcgctgcaggaacggaatangtaccgactgcacagtgagcgcgcgtaatacgactcactatagggcgaattgggtaccgggccccccctcgagtttttttttttttttttttttttttttttttttttttttttaagagaagctatctcacgcattgatttcctaacggattaagtatcgtatatattgtagctggcacaatgactagatgccatatagttacagtattagtttatgaattgtcctagcaggaaaaagcaggaaaacaaaatccaaaggctaaagagtaggctatataaactacattttggcaaaggtgcttccaaccgtacactaagggttgagaagcaagggtaataatattaaacatgatagaagaagntcagactattagtagtctaaagaccccacagttgttatcccagtgcttaaatttcttgggtcttgacggctcacatagtcatcacagatgccattagagagcctttgatttggaaccgagttcaacagctcaaggccattgttgcccatttgctgcacttcctgaggagaaagtatctttatgcaccatacactatttacgaattccggccaggggccatcaccaaggagaagaacatcattctctcggtctacaaatacaagctgccagcctgatctcacagggtcctccaactcgccttcaggccaaacattcgacgagtcaccacgcagctcatggtagctgtgaattgtgatatcaatgaccttcaaagaccctgacttataaccttcccaaaagtttgttcatggtttcttgcctgatcttcccgacatgaaggaaaacgagtcgcctatntggtgtgatccttgtccaagaaaaacacccccccgtgagatcaaatattaaaaatgatattggcaggggtgggttatccgtaaccccttagggtgaatccattaggctgaaaagggaaagg

SEQ ID NO: 5545 - DNA, 1057 bp, Glycine max
  misc_feature (1)..(2): n is a, c, g, or t
  misc_feature (519)..(519): n is a, c, g, or t
  misc_feature (684)..(684): n is a, c, g, or t
  misc_feature (766)..(766): n is a, c, g, or t
  misc_feature (773)..(774): n is a, c, g, or t
  misc_feature (895)..(895): n is a, c, g, or t
  misc_feature (1004)..(1005): n is a, c, g, or t
  misc_feature (1047)..(1047): n is a, c, g, or t
  misc_feature (1049)..(1049): n is a, c, g, or t
  Predicted polypeptide sequence is orthologous to G1451
nnggtgtttcaccgtgggagcccctgctcgtaaccctactaagggaacaaaagctggagctccaccgcggtggcggccgctctagaactagtggatcccccgggctgcaggaattcggcacgaggtaaccttctagccaaacacacactaaataattaatatattgtagatagcacattgccaagatgccatatgtttacattgtttatcttaagaatggtcctaggcagcaagaacaggaagacaaaaaaaaaaggcttaataagtagcctataaactacaactaggcagtacttcccaccatttgacaaagggtggagaagtaggagcaataatacaagagagaagagattcatagtatttgattgtcatatcattcagtagtttaaagaccccacagttgttatcccagtgcttaaatttcttgggtcctcacagacaccgttagagagcctctgaatggggaccgagttaagaagctcaagttcattgttgcccatctgctgcacttcctgaggngaaagtatcttgatataccctacactatttacaaattccggccacgggccatcaccaaggagcagaacgtcattctcttgtcaacgaatacaagctgccagcctgatctcacaggggtcctcaactcaccttcaggccaaacatacgagcaagctcgctggtacntagggtagctgtgaatttagtgagtccagatctccaaaagaccctgactgtaacctcacaaacgtttgtgcatgttcttgcncccattnnctgattgcagaagccgtttaccaaatatgtgattcaggatcatgaggatcggttcttgtgtcagaataagattgaaagggtttggggatatttggggcgaccatccccctaaggatatacncgcctatctgcgttttaagtgaatgaaaactgtacaatatctttgacatcctttgccatggttaataagcacatccttcacatgcacttatgagaacctgtggtatatnngggggggtggacgcctacgcacaccctttttttttttttttncngccgttca

SEQ ID NO: 5546 - DNA, 800 bp, Glycine max
  misc_feature (800)..(800): n is a, c, g, or t
  Predicted polypeptide sequence is orthologous to G1451
ccatgtgcacttacgccaaactcgcgggttaaccctcactaaagggaacaaaagctggagctccaccgcggtggcggccgctctagaactagtggatcccccgggctgcaggaattcggcacgagggtcttaagggagttagcagcaacagtgactcacccacaatacctttgcaatcttctaattacctgaacaccacaggacctgattcctcattgaatcctggaatgacacacaatattggtgaaacgggcttcctgcaaactccaaaaaatggggggcaaggaaacccatccaacaaaacctttgtgaaggtttacaagtcagggtcctttggaagatccttggacatcactaaattcaccagctaccctgagctacgcagcgagcttgctcgtatgtttggccttgaaggtgagttggaggaccctgtgagatcaggctggcagcttgtattcattgaccaagagaatgacgtgctgctccttggtgatggaccgtggccagaatttgtaaatagagtagggtatatcaagatactttcccgtcaagaagtgcagcagatgggcatcaatgagcttgagcttcataactctgtcgccattcagatgctatatagctgtgtctgtgaagacacaacacatcgatgcactggtataacaacgtgagggggattataactacatgagtgatagtgccatacaaatactatgacatgactccacgatacgtataatatctcatgaatctcacccgtttgtaaaatgcgtggatagattcagcataggtgtagactattn

SEQ ID NO: 5547 - DNA, 833 bp, Glycine max
  misc_feature (1)..(1): n is a, c, g, or t
  misc_feature (35)..(35): n is a, c, g, or t
  misc_feature (611)..(611): n is a, c, g, or t
  misc_feature (663)..(663): n is a, c, g, or t
  misc_feature (693)..(693): n is a, c, g, or t
  misc_feature (791)..(791): n is a, c, g, or t
  Predicted polypeptide sequence is orthologous to G1451
ntggctgtgaccatgattacgccaagcgcgcaatntaaccctcactaaagggaacaaaagctggagctccaccgcggtggcggccgctctagaactagtggatcccccgggctgcaggaattcggcacgaggagcgtatggtgcataaagatactttctcctcaggaagtgcagcagatgggcaacaatggccttgagctgttgaactcgtttccaattcaaaggctctctaatggcatctgtgatgactatgtgagccgtcaagacccaagaaatttaggcactgggataacaaccgtggggtctttagactactaaatagtcttcacttcttctatcacatgtaatattattacccttacttctcaaccctttctttgtgtacggtgggaagcacctttgcctaagtgtagtttacatagcctactctttagcctttggatgttttcctgttttttcctgctaggacatttcataaactaatactgtaactatatggcatctagtcattgtgctagccacaatatatacgatacttaatccgttaggaaatcaatgcgtgagatatgttctcttaacttgtacagaactttttctttctagtttggttntattttggcttaaatgtttgggggtgcatgatttgactatgaagcatactangcaatggagtggaggtatgttgaacttggntgaccttttattgtcatcataatatttattaaaaaataagaaaaaatattcgaggggggggcccgggaccccattcgtcctatagtgagtctaatacncgccctcactggccgtcgttttagcacgttgtgactggcaaa

SEQ ID NO: 5548 - DNA, 826 bp, Glycine max
  misc_feature (187)..(187): n is a, c, g, or t
  misc_feature (628)..(628): n is a, c, g, or t
  misc_feature (665)..(665): n is a, c, g, or t
  misc_feature (703)..(703): n is a, c, g, or t
  Predicted polypeptide sequence is orthologous to G1478
gcagctatgacatgattacgaatttaatacgactcactatagggaatttggccctcgaggccaagaattcaagcgcttgaaatcaagcctaccaagtagcaagcttgattattattatcatcacatagagcttctgaaaatgtgcaaaggtgcagaaggagaaaagcaacatggtttctgcagcagnctttctacataaagagagtgcaaccagaagtgctatatgttgtgagctatgtgggttacaggcttcattgtattgccaagctgatgatgcctacttgtgtaaaaaatgcgataaacgggttcatgaagctaattttttggcccttaggcacattaggtgctttctgtgcaacacatgtcagaaccttacgcgaagatatctcattggagcatcactagaggtggttcttccggccaatataaactggaccattagaaatctccttaacaacagaggaatctacagaaagtgttcaagaatgcataacagcccttccctctttttataacttccatctttctttattctccgtagaagatcttttgtaatagaaaaggttagtgagtaccatctcaggtatataggaaactgctaaatgtttttattatcatgatttttaanaaaaaatggttggtaatacaaccatgttcaatagaanggaggaatgtccaatggtttttttttctttaatttctngtagatgtagttaattgaaatttgacttctattggtatttttatttttagccaatttccacagcaggagaacgaattttctgccaaaaaagcctaatcccttttagtgagggtaattcaagct

SEQ ID NO: 5549 - DNA, 1077 bp, Glycine max
  misc_feature (55)..(55): n is a, c, g, or t
  misc_feature (75)..(75): n is a, c, g, or t
  misc_feature (135)..(135): n is a, c, g, or t
  misc_feature (786)..(786): n is a, c, g, or t
  misc_feature (884)..(884): n is a, c, g, or t
  misc_feature (935)..(935): n is a, c, g, or t
  misc_feature (943)..(943): n is a, c, g, or t
  misc_feature (994)..(994): n is a, c, g, or t
  misc_feature (1044)..(1044): n is a, c, g, or t
  misc_feature (1077)..(1077): n is a, c, g, or t
  Predicted polypeptide sequence is orthologous to G1480
cattacacatcataacaaacaatacaacggactactttcccccatcctctcctcntctcaagaggccccaatccncgcatcatatatagtggtggctgggtgaaggggcacaaacgctggagcctccaccgcggntggcgagccgcatctcagaactagctggaactccccttcgctcgcaggcaattgcggcaccgagggtagcgcaccaactcatggcgttccaagcctctgccgcactcatagcaaatcacgccatctgctatccttgtacctgccgccactgacgctcgcgttacctctgcggcgcgctgcgattctaaggtccacgccgccaacaagctcgcgtcgcgccacccgcgcgtggcgctctgcgaggtgtgcgagcaggccccggcgcacgtaacctgcaaggctgatgccgccgcgctctgccttgcctgcgaccgcgacatccacttcgccaaccccttcgcagccgccacgagcgcatccccgtctcaccgttcttcgagtccgtacactccgtcaaggcctcctcgccgatcaacttcctagatgaccaccgcttcttctccgacgccgatgctgacgtcagcaccgaggaggccgaggccgcctcctggctgcttcctaatccgaagacagatctaaattcctctcagtacttgttctccgaaaccgagccgggtccttacatagatctggatgatgctgccgtggatcctaacgcggagcagaaaagctccgccaccgccgacggcgtcgttccgtgcagagcaactncgagtcattcgcctacgctacaagtacataccactctctcacagtctcagatgagccagagtgtatcgtcgtcgtcgattgacgctgagtcgtgctgnacgggaacacgatgtccgagacatcgaactgcatctacagcatggtgcctntcgtgacngagactgtgaccgcgccagtcttcgacggctgagtaggacgtcgagatgcntgagttacacgtagtataagaagcatccgaacgttcgatgaagactatcncgttacgccatcgtctaaaggctatgtcggggn

SEQ ID NO: 5550 - DNA, 954 bp, Glycine max
  misc_feature (326)..(326): n is a, c, g, or t
  misc_feature (645)..(645): n is a, c, g, or t
  misc_feature (671)..(671): n is a, c, g, or t
  misc_feature (706)..(706): n is a, c, g, or t
  misc_feature (708)..(709): n is a, c, g, or t
  misc_feature (767)..(767): n is a, c, g, or t
  misc_feature (813)..(813): n is a, c, g, or t
  misc_feature (851)..(851): n is a, c, g, or t
  misc_feature (855)..(855): n is a, c, g, or t
  misc_feature (863)..(863): n is a, c, g, or t
  misc_feature (905)..(905): n is a, c, g, or t
  Predicted polypeptide sequence is orthologous to G1480
ctgagcgattgtatgcgccgcgcgcaattatccctcactaaagggaacaaaagctggagctccaccgcggtggcggccgctctagaactagtggatcccccgggctgcaggaattcggcacgagcaaccatggcttccaagctctgcgactcatgcaaatcagccactgctaccttgtactgccgccccgacgcggccttcctctgcggcgcctgtgactctaaggttcatgccgccaacaagctcgcatcgcgccacccgcgcgtcgtgctctgcgaggtgtgcgagcaggcgcccgcgcatgtgacctgtaaagccgacgccgncgggctctgccttgcctgcgatcgcgatatccactccgccaaccccctcgccagccgccacgagcgcatccccgtcacgccgttcttcgagtccgtacattcagtcaaggcctcctcgccgatcaacttccaccaccgcttcttctccgacgccgacgctgatgctgacgtcagcaccgaggaggccgaggccgcgtcatggctgctacctaatccaaagacagatctaaattcgtctcagtacttgttctccgaaaccgaaccggttccttacatagatctggattacgcggccatggatccgaagacggagcagaanagttccgccaccgccgacggcgtcgntccggtgcagagcaacttcgagccgttcacctacngnntacagtacaacactactctctcacagtcacagtctcatatgagccagagtgatcttcntcgtcgtcgatggaagttgagtgtgccggacggggacacgatgtcngagatatcggactggcagctacagaaagtggcaccggntacngtgaaccntccagtctcggcgcggataggtagggctgatggtgagtacanggagaagaggaggaacgaagttcagaagacattcgtacgcatcggaagc

SEQ ID NO: 5551 - DNA, 970 bp, Glycine max
  misc_feature (49)..(50): n is a, c, g, or t
  misc_feature (53)..(53): n is a, c, g, or t
  misc_feature (790)..(790): n is a, c, g, or t
  Predicted polypeptide sequence is orthologous to G1480
gttccccccccccccccccccccccggggttgggggcgatgagtgtgannganagccatagcagagagcgtcccgcgttttaaccctcctccagggaacaaaagctggagctccaccgcggtggcggccgctctagaactatgtggatcccccgggctgcaggaattcgggacgagagttcaaaaaccctctctcgcccctcccctaatcaataatcaccaccaccaccaatcagaaacttgcttcgacgtcgatttttgtcgctcgaagctctcctcctttaactacccttccaattctcttagccaaagcgtttcgtcgtcgtcgcttgatgttggagtggtgccggacgggaacacggtgtcagacatgtcgtattcttttggtcggaacagttcggattcgagtgggattgctgttgtgtcaggaaatagtgtggggcaaggtgcgacgcacttgtgtggaatggatcgggaagcgagggtactgcgatacagagagaaaaggaagaaccgaaaattcgagaagacaattcgatacgcatcgcgaaaagcatatgcggtaacccggcccaggataaaaggccgcttcgccaaacgaacagaaattgactcggatgtggagcgtctctatagtcctggccctgcggtgctcatgcttgacactccatacggcgtcggaccatccgtttagctaattacaatatgaagaaacgactgcatgcatgaatcctatgattatgattagcgatcctgcgggattgtacggcaaaaaagtgaagcatccgatngctccgaaccgtgatcttagcttgacgccgaccgggcagaataatgtaagatatgctcgatcgacagaacagcccgtctactttcaatacaataaagaatacacatctgagcgtgggcctgtaccccattcgctctataggatcggattcctccactccactggcgtgctttacacgtcg

SEQ ID NO: 5552 - DNA, 883 bp, Glycine max
  misc_feature (752)..(752): n is a, c, g, or t
  Predicted polypeptide sequence is orthologous to G1488
aattcaaaatttttcagataagaaagaaaaaaaggagtgccgaagctgacgatagtttaaagtttaaacttagacctgcacccttaattaaaattaaaaaatttaaactaggtactctaaataacgtgtctaaagtctggcccacaatgctggtgatgatgatggatcaagaactcatccccaccgttggatacgccgaaaattgaactttgactcatcaattgctggtgctgctgtcgctgcagctccttctgccgcctcagctccaaaaccttccgatgcgaattcgaatgcttcgttgacatgaacgttggactcgccgccggtcggtactccggcaccagcctcccggacttgaaccttacgccgcacgcgttgcacagcgtcttcggtcccatcggtcccgttctccactgcggcgtcttctccgtaccgcagtgcaggcatttgcgtccggaacactccgcattcgttccttctctcttcttcgccggctccgcctttagctgcggcagcttctcctgctccgtcgcgaccaggtggagcaggcgcgtggaccagtcccccggcgccgcccgtgagcgcttgctgcgcgccttccccgggagaggcgtttccgagtggagaaacggtgcgtttcgcaaggtgtcgtcggaggcgaacggcggaagcgtgtcggtggaggaggaggactccggcgtctgcggtttcgcgccaatggcggtggacgcggcggcggcgccggagagtanctgcagcgtcttcagctcctcctcggcggagaacgagtcttccacgaagttagagagccattccagttccgccatttcatcatacggaacgcagagttctccggagaaatgaggatcactggggaagccgc

SEQ ID NO: 5553 - DNA, 400 bp, Glycine max
  Predicted polypeptide sequence is orthologous to G1488
ggctggtgccggaataccggccggcggcgagtccaacgttcatgtcaacgaagcattcgaattctcatcggaaggttttggagctcaggcggcagaaggagatgcaacgacagcagcatcatcagcagttgatgagtcaaagttcaattttcggcgtatccaacggtggagatgaattctcgatccatcatcatcatcataatcatcacctccattgtgggccagactttagacacgttatttagactacctagtttttaaattttcattttaattttaatttagggtgcaggtctaagtttaaactatcgtcagcttcagcacttcttttttcttatctgaaaaattttgtcttatgaatttgaattcttagctttttttttcttctaaaaaaaaaaaa

SEQ ID NO: 5554 - DNA, 668 bp, Glycine max
  misc_feature (35)..(35): n is a, c, g, or t
  Predicted polypeptide sequence is orthologous to G1494, G789
cgcccgagagtgtcaatagaacttccgtatgactncaattaatacgactcactatagggaatttggccctcgaggccaagaattcagcactatatgtttcaaatgggtatgggaatggctacaccgcctttccctcctattcacaatccgatgcaattaccgagactgccgcttgatcagtctgtatctgcgtctcagacaccaaaccagacattaatgagccaaaatcctattttgggtgcctttaattaccacaatcagatgcaaaatccagctctttcagagcaatatgcgcgttacatgggctatcatcttatgcaaaatgcctctcagccaatgaatgtattcagatatggtccccagggggtacggcatagtcaaacaatgattacacccagcaacagcagtggaaacatgagtggagcagcaaatattgatgaggctgtgagtggcaaaatgggttaattagtttcaaagcatgcttttgagtacctatggcgtaactaacaagataattgcaagatgatagaagcccttgtaaggcttgtatgctttcacaatatgtctgcctgttcatacagtggctgatctacaggtatgtgagggtctagggtcagcacttgtacttccttatctgtttaatagattattaaatttggtaatcaaat

SEQ ID NO: 5555 - DNA, 628 bp, Glycine max
  Predicted polypeptide sequence is orthologous to G15
agttttcctctcatcgtacgaggaaaatgtttaatgtaacagttaacattttaaacatgggcacaagctccctattgtactagctggaaattcacaccctggtttagtaaacaagcattcaaaacaagcttttgccattttgatggaggtaaaaaaacataggattatgcatcggtccaagcagcaaaaattggcatctgaggaatagaaagcgaaggcctgagattggaagatagatccaaagaatccacgtcagccaataatttggacactgttgaaggcattccaaagagcattggcaagcttgtcttatctgggctctcttctcttgagctactcaaacttgtcaccagagaagaaggatttgacaagtgtgttcccatgttactcgattcctcaacttggtgatgaaacatgttatctaaagcagttgacaaggactcagttctactacactcaattctttgtggattctgatcaagctgttgggaggatggatactgaaccatcttccattctgattggcttctgcatcttttctgcatcagaacggtttcttgagtagtacaaggtttttggttaactgtagcctcgcttctagttccatcatccatctctcttttccgct

SEQ ID NO: 5556 - DNA, 624 bp, Glycine max
  Predicted polypeptide sequence is orthologous to G1506
tcggcgcgcaattaatcttcactaaagggaacaaaagctggagctccaccgcggtggcggccgctctagaactagtggatcccccgggctgcaggaattcggcacgagggtagaagaaggctctagcttcagtccaaaaagcttatttgccttaccccatggtgttggtggcttgcacatgctggattctttcaactttgttggtgagagttctgaggatctgcttttagaggtgccttctaacagttcttttccacaggctgagctcctgcacccatctttaagctatggtgctcgtcaggtcagcaccactagtagctcagtacactcacctgttactcatccttaactaatctttactaggttacttggatgggtatggacacaatattttgtcataatagggtccacatgttttgcatctgaaacaccaaagttcatgtacaagagatatgatgatgattgtgttttttgtttccttgcaaccttgagcttggattgccaaaggatggaagttgaatgggcttttttttttttttcttgtatagattggtaatagattgtaacatatagcatgaaattcggagtgatcatctccggagtttttggaaaaaaaaaaaaaat

SEQ ID NO: 5557 - DNA, 778 bp, Glycine max
  misc_feature (626)..(630): n is a, c, g, or t
  misc_feature (642)..(646): n is a, c, g, or t
  misc_feature (732)..(732): n is a, c, g, or t
  misc_feature (734)..(736): n is a, c, g, or t
  misc_feature (762)..(765): n is a, c, g, or t
  misc_feature (767)..(767): n is a, c, g, or t
  misc_feature (772)..(776): n is a, c, g, or t
  Predicted polypeptide sequence is orthologous to G1506
aagagtttggagagttatgatttaaacctattgggaaataaaagggtgtgaatcattcacaaaacataaactacaactgcatacaaaactccggagatgatcactccgaatttcatgctatatgttacaatctattaccaatctatacaaaaaaaaaaaaaagcccattcaacttccatcctttgtaaatccaagctcaaggttgcaaggaaacaaaaacacaaccatgatatctcttgtacaggaattttggtgtttcagatgcaaaacatgtgaaccctattatgactaaatattgtgtccatacccatccaagtaacctagtaaagattagttaaggatgagtaacaagagagtgtactgagctactagtggtgctgacctgagcaccatagcttaaagatgggtgcagaagctctgcctgtggaaaagaactgttagaaggcacctctaacagcagatcttcagaactctcaccaacaagttgaaagaatccaacatgtgcaagctaccaacaccatggggtaaagcaaataggctttttggactgaagctagagccttcttctacaacttctttgacctcacagctaggctttatgaacacccttttggggcttctcattnnnnncttcaattctgnnnnnttttgattttggctgtcatgctcacgcattctcttggcagttgtaacataactagattccatagcagtagatcccaaaccaatagntnnnccagatttgttttcacatttcttcannnnantatannnnnct

SEQ ID NO: 5558 - DNA, 647 bp, Glycine max
  Predicted polypeptide sequence is orthologous to G1510
ttttttattttttttttttttttttttttttttttgcaagtcacaaccaaacaaataatataattacgaaatactggtatatgaaaaactaaaaccaaaactaaaacaaaaacaaaagcaagaacaaagggaaaaagtatctagatttcttctagctagctaatattataagtggacaaaaccacaagataagtccatcagaagcaatgccgcctcagctacttcatcccgtggaaacatttgttcaaaatcagagttgttactcctcaaacttatggcgaagttgttgaaatattcaagcttcctcactccctcagatgagcctacagtagtagtagtagtagtagtagtggacttgtacttgttcttgaactgtgcaaaatggttcatacgagacttcttttccttgttgtgtagtctggtcttttcacatgctatgggagtgaccaaaccatttgcagcttccgccattgcccttcttgccttcctctgtctaatgccacaggcattgcaaagagacttgggacccttagggccagtcctccaaagtggggtagtgcttgtattgcaatccgaacaaaccctaggggtgctactgccgttgttgttacgagggcttctttggctgtaccttctgctttcgagcc

SEQ ID NO: 5559 - DNA, 631 bp, Glycine max
  misc_feature (111)..(111): n is a, c, g, or t
  Predicted polypeptide sequence is orthologous to G1510
ttggatgataatataaaatttataatttaaactttattaatatcccttgttctattattaaatgagtggaaaatccatggaagaaacattccttcttaacagtaaacaaangcccgcaagataaatccatgagaagcatcgctgcctgagctacttcatccattattggaaacacttgctgcttcaaagccgaactatccctcaaactcaaaccaaaatcgttcaaatcaatcttcacgttctcctgctgagatgttccttcagcagtactagtagttgccaacttgcacttaagcctgaaccgtgcaaaatggtttgtacgagacttcttttccttgtgatgcactctgatctttgtagaagatgaattcacggaaggagcaaaaccatttacagcttctgccattgcccttcttgccttcctctgtcgaatgccgcaggcattgcaaagtgactgcaccaccaagatgttaaaaacttcgtaacccattgcccagagactcttcgctatgcgcttgttatttaattttaattagaactagctatttattaattaatttgtagaactacatgcaagtatccaatgtaaaaaaaaatgacaagcaacaaaatatagctagcgttaattaga

SEQ ID NO: 5560 - DNA, 791 bp, Glycine max
  misc_feature (1)..(4): n is a, c, g, or t
  Predicted polypeptide sequence is orthologous to G1510
nnnnaagagatcagcatcaggatgctgccaagcgcgtagttaaccctcactaaagggaacaaaagctggagctccaccgcggtggcggccgctctagaattagtggatcccccgggctgcaggaattcggcacgaggcaaaggaaggcaagacgagccatggcagctgctgcggcttctgcatcgggaaatggaacagtaattgtggaagctaagaaatctgtgaagggacggaacaagttgcagaagaagaaagagaagaagacaagaactgagggtgcagcacagatgaaaaagaagcggaagcttggagttggatcagcaaaggcatctcaaagtagaaacaagtttggttttgaggatttgacgttgcgcttgagaaagaacttggctatgcatcaagttttccctcaggacgagaaggaggctgcgatccttctcatggctttatcttatggccttgttcattgatgaaccttaattaatagctagctagctagctagctagagctaccaccacttcacttaatttcagttcgttattaattaggttaatttcttgtattgctgtcttatgactagctagttgttgttagattatgattattgtgtgagatcaatggtgtagagtcgttatatgtgtgctaagaaagtatgtcttgcagtctactagtggagtggcaggatagtccaggagaactaacgtcatgagcgggaggcaagaaaagagaagtgctatcgaagagctcggcacgagaggggagcggataaggagagagagaggcgccgaag

SEQ ID NO: 5561 - DNA, 795 bp, Glycine max
  misc_feature (1)..(1): n is a, c, g, or t
  misc_feature (647)..(647): n is a, c, g, or t
  Predicted polypeptide sequence is orthologous to G1510
ncggtgagggtgtcgggggtgcgcgcggcgcgcaattaaccctcactaaagggaacaaaagctggagctccaccgcggtggcggccgctctagaactagtggatcccccgggctgcaggaattcggcacgaggaaaaggtccaaagtcactttgcaatgcttgtggaattcgacaaaggaaggtacgacgtgccattgccgccgctgcaacgtcaaacggaacaaatccggtggaggctgagaaatctcaagtgaagaagggaaacacgttgcatagcaaagggatgaagtccaaaactgagggtgcacaacagatgaaaaagaatcgtaaactcggagccaggtatagaaagaggtttggtgcttttgaggatttgacagtgagattgagtaagaacttcgctctccagcaagttttccctcaggatgagaaggaggctgcaatcttgctcatggctttatcttatggccttcttcatggctttcccacggatcgttatatcacttagatttatgagatattggttgtggaaccataattattgtatgagaccaatgcttagtgttatgctagatttagtgaagttaattaattagtatggaaaactgataatatagggacaataaagttatgaggagggtatcgntttatcaagttaattgtatgttgcatctgaaaaagaagaccaacacaaaatactagtgtcttattgttcatgatcatgagtatcctatattaatctcaataaatatttaattaaaatttcaagagattttatattgtaaaaaaaaaaa

SEQ ID NO: 5562 - DNA, 646 bp, Glycine max
  misc_feature (17)..(19): n is a, c, g, or t
  misc_feature (617)..(618): n is a, c, g, or t
  misc_feature (620)..(620): n is a, c, g, or t
  Predicted polypeptide sequence is orthologous to G1510
tgaacttaatttttaannncatcaagaagagacccacactttttggtcctcaacttgttcaaatcagacataatattatatgaagtacataagatcacccccacacccatgtaactttattttccctcccctttcctaactaactagctagtactgcaatattacatactcttctcgcacatataactcaaaccattgatctcacacaataataataatctaacaaaaactagctagtcataagacagcaagacaagaaattaacctaattaattaacgatctgaaattaagtgaagcggtggtagctctagctagctattaaggttcatcaatgaacaaggccataagataaagccatgaggaggatcgcagcctccttctcgtcctgagggaaaacttgatgcatagccaagttctttctcaagcgcaatgtcaaatcctcaaaaccaaacttgtttctactttgtgatgcctttgctccaactccaagcttccgcttcattttcatctgagctgcaccctcaattcttgtcttcttctctttcttcttctgcaacttctttcccttcacagatttctcagcttccacaataactgctccatctcccaatgctgnngncgcagcagctgccatggctcgtcttg

SEQ ID NO: 5563 - DNA, 481 bp, Glycine max
  Predicted polypeptide sequence is orthologous to G154, G1797
tagtactctaacgaacagtttgaaataatgactgtggtacataaattatttaagtaggcgtacacaaccgccgttgtgattggggtacaacaagaatacatatcttaataagacatgaatataacagtctgcaaggaagctagcagcgtttgtatgggcataagtaatttttaatctttaggattacgctatgtatgcatgagcactatatgttgtaggtatcaactttaacggcatatcttctctcaggtcttcctatgaataagtccgtctccacctcttctccctcctttttggtggcgaattcgacatcctgatcactcaaacaacgttgtcgtacaatccggtactgctcacgtaagcgtttatttacttcgagtaagcacttttcctcttctttgagctgctcgattcgcttcctgaacaattgattcttagtagccctaattttgtccaggctgcgttcgagctggttctctag

SEQ ID NO: 5564 - DNA, 728 bp, Glycine max
  misc_feature (1)..(1): n is a, c, g, or t
  misc_feature (673)..(673): n is a, c, g, or t
  misc_feature (728)..(728): n is a, c, g, or t
  Predicted polypeptide sequence is orthologous to G154, G1797
nggggttttcaatagacgctctgacatgatcacgaatttaatacgactcactatagggaatttggccctcgaggccaagaattcaagctggggataggtggatgaataaggaaagcttggtctgattagtctatactatatgccttgctattccactttttctgagtttttctctgcactcctttgctagctaccctctcttttgggcttttttgggccttcaaatcttgcttggagaaggctcaattttggtggaaacctctcacacaagaaagcatagtttcttttgggttcattctacttggtgtttagagatggtgagaggaaagactcagctgaggcgcatagagaacgccacaagcaggcaagtcaccttttcaaagcggcgtaatgggttgctgaagaaggcctttgaactttctgttctttgtgatgctgaggttgctctcatcattttctctccaagaggaaagctttatgaatttgcaagctcaagcatgcaggacacaattgaacgataccgcaggcataacaggagtgctcaaacagtgaacagatctgatgaacaaaatatgcagcatttgaagcaagaaacagcaaacttgatgaagaagattgagcttcttgaaagctcaaacggaaactcttgggagacgggttgggtcatgctctnagaagaacctgcacgatcgaaccacagtcgaaaggagtgtaagcagtgttctggn

SEQ ID NO: 5565 - DNA, 453 bp, Glycine max
  Predicted polypeptide sequence is orthologous to G154, G1797
aagcagtgttcgtgcaagaaagaatcaggtttacaaggaacaaattgatcaactaaaagagaaggaaagagccctatatgctgaaaatgctaggctgtgtgagcagtatggtggtatccagccacagccagcaacaaaggatccgaaagaaattcaaccctatgcagaaagcagtccaagttcagaagtggagactgaattgttcattggactactcaggtctagctattgaacataatttaatccttgcctatgcaaatatcaaataagaagcccaactgcaatgtataaatatcacatgtttcctaatactgagatgaataatattatcgcttgtattatataaagaactttctagccttatgattagggtttaattattgatatgtttgcctttcctcaaaaaaaaaaaaaaaaaaaaaaaaaaaaaaaaaaaaaaaaaaaaaaaaaaaa

SEQ ID NO: 5566 - DNA, 790 bp, Glycine max
  misc_feature (1)..(3): n is a, c, g, or t
  misc_feature (761)..(761): n is a, c, g, or t
  misc_feature (770)..(771): n is a, c, g, or t
  misc_feature (774)..(777): n is a, c, g, or t
  misc_feature (782)..(782): n is a, c, g, or t
  misc_feature (785)..(785): n is a, c, g, or t
  misc_feature (787)..(788): n is a, c, g, or t
  misc_feature (790)..(790): n is a, c, g, or t
  Predicted polypeptide sequence is orthologous to G157, G1759, G1842, G1843, G1844
nnnaagggtcgctggcattacgccaggcgcgcatttaaccttcattaaagggaacaaaagctggagctccaccgcggtggcggccgctctagaactagtggatcccccgggctgcaggctccagcaccggaaagctctacgagctctgcaacggtgacagtttggccgaggtcgtgcagcaatattgggatcatttaggagcgagcggtactgacacaaagtcgcaggaactatgctttgaaattgcagatatctggtctggttcagcgttttctcaaatgatcaaaaggcacttcggtgtttctgaacttgagcatctgagtgtgtctgaccttatggaactagagaaactgactcatgctgctctttcgcgaatcagatcagcaaagatgcgattgatgatggaatctgtagtgaatcttaagaaaaagattgaggcactagaaaaaactaatgacgtcaataacgtggtgacacggtctattgactgtgatcaaacagatggggtgactcataatctgttcccaggtctctaatgggactgatagccactactctgtgtctaactggacactcaacccttgaaatttccagtgtgtgttttattcctgcattagggaaccattccatggctaactacttgccttttatattttctattttgttgaaccattgagcatcttgaagatatgtagcctggggaacttgctttcacctctacttttgtgctaattatttattatacgtgcttttcatgcccnagacaactnnatnnnnttatntantnnan

SEQ ID NO: 5567 - DNA, 802 bp, Glycine max
  misc_feature (15)..(40): n is a, c, g, or t
  misc_feature (49)..(49): n is a, c, g, or t
  misc_feature (58)..(58): n is a, c, g, or t
  misc_feature (736)..(736): n is a, c, g, or t
  misc_feature (785)..(785): n is a, c, g, or t
  Predicted polypeptide sequence is orthologous to G1635
gaggggggtaataannnnnnnnnnnnnnnnnnnnnnnnnnaaggggggngggtgtggnaaaaacgacctgccatttcctgccaagcgcgcaattaaccctcactaaagggaacaaaagctggagctccaccgcggtggcggccgctctagaactagtggatcccccgggctgcaggaattcggcacgagatgaagtctaattctctgaagtcgtcagactttgatcaagaaaaccaatctccaaaatcagtattatcaggagttggttcagacagccttggctcctctgattcagacacaccaaatggaagtttgtcgcccatgtcatccattagtggcttccatacaagcagttttacacgtgccaaacccaaaacaacaacatctgaggaagaagctgggatggacactgattcaactcatgatgagaaacctcttatgaaattcaagcttcctccaaatggatgtgtttccatcaaagaagacaacacagcagaagaatcttccggtcggactttcaaactctttggaatgactctatttgtaacagacacctgcaaaccatctccaacaatcgaggaatgctaaagatacctctaaacattcgcgcgcaacgcctttcctcctccatggaggatggcaaattggaacttgttggacactctagagcaagtgaaacatcagcaatatccaagctaaaggtgagagtggaacctgaagcatgtgggaaagggtntgtgccatataaaagatgcatatctgttgtgacagctgatgatagagcngagcaatgtattcatct

SEQ ID NO: 5568 - DNA, 764 bp, Glycine max
  misc_feature (1)..(2): n is a, c, g, or t
  misc_feature (764)..(764): n is a, c, g, or t
  Predicted polypeptide sequence is orthologous to G1635
nnaagagagacacaatgacatgcatcacgccagcgcgcaattaaccctcactaaagggaacaaaagctggagctccaccgcggtggcggccgctctagaactagtggatcccccgggctgcaggcttccccacaatactccatttatgccactgcacaaggagccaaaagggaagcatctatattctaatcttggagagtttgaacataaagaagttcaaaaggaaggatcatggactggttcaaacactagttcaattgatgatggagataacactgaaaaatcagatgatcaagccaaaagtcatgtacatggttttagcaaaagtgaaactttaactatatctgagctaagggtgaggcctaaaacatgtggaaaagggtttgtaccatataaaaggtgcatggcagagagggaaaaccagtgctcatcagtatattatgaggaaagggaagagcaacgtattaagctttccttatagtaccctcttattggcttttcttcaaagcaggttcccttttacaggtataatgtacctgtttctgttgctggatgaccttgcatgagaagaaagataacggagctgaaatttttgatatctctactgcatatgtaattctacacaagcctgtgtgttaacctatatgaacttgcagactttgggaaaacactatccaatgaattatcgcacctatctgtatttctttcatgcctagccctttggattgcttcaaatacttcctcagcctccactcggatatatn

SEQ ID NO: 5569 - DNA, 905 bp, Glycine max
  Predicted polypeptide sequence is orthologous to G1638
cgttagcaaagctgcaaaggcctatatttatttgaagcatcaagcatttaaaaaaaagtgaataatcacaaactcaaggtaactcctctcgtcctatacgttttacagataatcctttctgcctaggtggaagatgcatatcactgccaaactctgatattgcatctttggtgccagcacatttaatatcagaatacaatatgaaggctcttcaaagattgagtgataaggaaactcgtgaatccttgaaatatttacataaaaccacccttaagcatctaaaaatcaatccaacatcaatgaataaggtttagcattttagtaccttaactttaatccctgcattctatatagttcattgattttgcatggacggcatttgcataattgtatcataaggtccaaactggcatccactgaggaaatactgctcctgaagtggtttagatccatatgaagaaatcccacaaagtggtgtcatgaacatgtttccatttgtggaattgaaaagcataggcacagtttcacatggcaatttccaatcatgttcctgtttaattaccatagtagtagacaatctttgattctgggatggtggattcacatccttcactgagtgatctggtgaatagggtctgttgttactctctgatgaaggagattttgcttctgggagattcaccattgtgatgtcatggatactggatctcttcttgtcctttcctccacttagttgcctgatgaaatacttctgagcatgacttgcaacctgagttggtgttcttgtggtcacaaaattgcgagagatgtttctccagtctcctttaccatacttcttcagacccatcagaaattgcctgtgctcctctttagtccatggcacacctttcttcctctcctgctca

SEQ ID NO: 5570 - DNA, 784 bp, Glycine max
  Predicted polypeptide sequence is orthologous to G1640
gagttagatggcgatatttattaaagacaaaaaagatctcataactcagagatcatttacagatatatttacatatgatctatcaacaaagtttatatgtaagcaatgtgatcttcatgaactgaacaaatctttgttgatattcttttaatctaataaagattctgcaaatgaattcagttcgaattggccatggtccatgttcaagagctggaaatattcttcatacaattgctgtaggttgccatgatctgtgggaaaataagagtggcattcaatatctgagacgttgactaagtcatggtcctcactgaagaagccaaaaccatcactttcttctcccacattaccaacttcactaaccacgtttgattcttttgtcacggggctttcctccttctcttggcttgttgatccactagctgaattggaatcaaaggtgaaggtgttactatccgttctttgtaaatacattgccttcactctaattggttttggtaggtaaacttgtgtctttggcggctcatcattttctttgcctttgttcttctgcttgttctttttgccaccgttcttcttcttcttcttctttttgttgttgttgccaccatcacttgcagcctcttcttgaggattctctaacattttgtgtgtgtctgtgtcttctgttccttgaattttcagctttttgcttagatgggtgttccagtagttctttatttcattgtctgttctccctggtaaccttcctgctatgagggaccatctgtttcccgacagcaac

SEQ ID NO: 5571 - DNA, 764 bp, Glycine max
  misc_feature (764)..(764): n is a, c, g, or t
  Predicted polypeptide sequence is orthologous to G1646, G715
cgagcgcatgagagggcgcaggctctaatacgactcactatagggaaagctggtacgcctgcaggtaccggtccggaattcccgggtcgtcccacgcgtccgatccgctcctggctccacgccgaggagaacaagcgccgcaccctccagaagaacgacatcgccgccgccatcacccgcaccgacattttcgacttcctcgttgatattgtcccccgcgacgagatcaaggacgacgctgctcttgtgggggccaccgccagtggggtgccttactactacccgcccattggacagcctgccgggatgatgattggccgccccgccgtcgatcccgccaccggggtttatgtccagccgccctcccaggcatggcagtccgtctggcagtccgctgccgaggacgcttcctatggcaccggcggggccggtgcccagcggagccttgatggccagagttgagtgacatcgatgccgatgatggacagtcaggagttatgaagattctgaacttgctgcaatttagaaatggttttgggtactaaatttttatgggatgacactgtgaacctgttaactcgatgaacagcatgatttagctacttgtgtacaagaaatgaaaactaaacactgatccttgtgtgtgaaacatgtatgagcatctgcccatactagatatgtgctcataataagaagagcagtgtagaagatatgagcgagaaggtgaggtagagggagggggggatgctgggtgagcggtgcgn

SEQ ID NO: 5572 - DNA, 497 bp, Glycine max
  Predicted polypeptide sequence is orthologous to G1646, G715
gaacgacatcgccgccgccatcactcgcaccgacattttcgacttcctcgtcgacatcgtcccccgcgacgagatcaaggacgacgccgcgctcgtcggggcaacggccagtggggtgccttactactacccgcccattggccagcctgccgggatgatgattggccgccccgccgtcgatcccgccaccggagtttatgtccagccgccctcccaggcctggcagtccgtctggcagtccgccgccgaggacacgccctacggcaccggtgcccaggggaaccttgatggccagagctgagcgacaaccatgccgaaacggactgtcaggagttatgaagattctgaacttgcttggaattttgattgcttgcaatttggaaatggttttgttaactaaatttttatgggatgacactatgaacctgttaactcgatgaacagcatgatttaactacttctgtacaaaaatttaaaactaaacaatgatccttctg

SEQ ID NO: 5573 - DNA, 732 bp, Glycine max
  Predicted polypeptide sequence is orthologous to G1660
aacatgcttgggtgtaagcagcaaaaggcattgcatacctatgtaaaaacaaacattgacaaggattggctttctttaagagcaccaattgcagcaagaaaatgataaatatgaggaagggacatgaccagttcttcgtatatactctgcttgctcttcagtttttgcagcttgatgatttctattggcttctgctgctgctcgcttttcctcggctttatgccttgcagctgctaatttgttcattagcttatcatgcgccttacctcgtattctttcaacttctacctcaatttttttcatcttggcttctgtttttgctttctgatgattttcccatgcttgaattttcatctcctcacgcctaaacctggccatatacttggccttctcagcctcctcccatgccgctgcacgtgctacaacgacacttttaggtggttctgtttttgttttcaaggaagtggatgcatccttatcctcctcttctttactagcccaggcagcaatgctcattttacctagttgtgtcccgagaaccattatttctcgcctggttttcatttgtagctccttttcggacaactcattcatgttgagattcagattgtcactatgcagatcagttaaagtagatgcaggggaggctctggggggagtagaaggccgggaagaattagggctgcgcatcggtgttgttgccctcactggggtacctgttcttgatggctc

SEQ ID NO: 5574 - DNA, 801 bp, Glycine max
  Predicted polypeptide sequence is orthologous to G1760
gatcacacatatgtatttagaatttatataaaacaacaccagactcacttgtgttatgtttttattgcacaaaatttacaacggcagtcattatgtctgatccttaacagcaattaaatgcttcttgatagataatctcgtaccataaatgcgttgtactgttgaatggaactaatatggttgatgaactacaagatccaactcaaagaagcctgatcattctaaggagaagttgttgctttgttggctggcttggcacaaatgacaacctccctgattactgaacagttttgctaatgcagctgcaatccgagtttcattgctttggttgatggttcactgtatttgtattgagactgtggctgacttagctggagactgatagatgcaagtgaatcatatccatttctgacgttgtaagaaggattggatgccacattttcttcatttgtactccttgcttcataaaccttcttttgtagctctgcattttctttttggatctgctccatcttttgatagagttcaacattttcttgatgaatgatatttcccttttggcgtagttctttaatctcattagttaaaatttgatcctttttcatgcggacaccctttaaactcatctccagttggttttccagattttgtagttctttaatacccaaacccgtaagttcttcccccattaattgccttgtgcttgcatagtcataaagcttcccagtgctggagaacaccatcaatccgacttcagcatcacaaaagattgataattctctagctttcttcagcaatcca

SEQ ID NO: 5575 - DNA, 764 bp, Glycine max
  misc_feature (1)..(1): n is a, c, g, or t
  misc_feature (535)..(535): n is a, c, g, or t
  misc_feature (562)..(562): n is a, c, g, or t
  misc_feature (764)..(764): n is a, c, g, or t
  Predicted polypeptide sequence is orthologous to G1760
naaggatgcagctggtagaagcattacgccaagctctaatacgactcactatagggaaagctggtacgcctgcaggtaccggtccggaattcccgggtcgacccacgcgtccgaaaatgaagaaactagcaaacttgaggatgcaaatattacattccaaatgatatttttcagtcaattctttttccacattcaggcatttctaatggtctatgcaaattatatatctcctaagtaattcatgtgaagattgtaaactcccatgcatatattggcgcaagatatctataataactaccttaatttctgaagctgaactcccaagttgacaaggttcttcttttgatttgttgtatcggtcaattactgatttcatgctggaaaaagtcattcaacaacaaaatgcgtcagatatgtgctctgttgactgtaacattcaacaaaagcaattaggttcatccaatgcagattgtaggaagaaatgtttatacctcaataatcttttatcaattataaacttgttcacatgtcttangaatatgagatttggggatggatgctntaattgatgtagtaattatatccggtctttactgtgtaacttcaaaattactctctctctcttcgagaagggggagtaaattgtgtaatatattagttcatgacaaaaaaaaaaaaaaaaaaaagggcggccgctctagaagatccaagcttacctacgcctgcatgcgacgtcatagccctttttatgggtcaccttaatn

SEQ ID NO: 5576 - DNA, 653 bp, Glycine max
  misc_feature (569)..(569): n is a, c, g, or t
  misc_feature (590)..(593): n is a, c, g, or t
  misc_feature (595)..(595): n is a, c, g, or t
  Predicted polypeptide sequence is orthologous to G1760
aacaccagactcaattgtgttatgtttttattgcacaaaatttacaaaggtaaacattatgtctgatccttaacagcaattgtatgcttcttggtagataatctcgtaccatacatatgttgtactgttgaatggaacaaatgtggttgatgaactacaagatccaactcaaagaagtctgatcattctagggagaagttgttgctttgttggctgcttggtacaaaatgacaacctccccgattactgaacagtttttgctaatgcagctgcaatccgagttttattgctttggctgatggttcactgtattgaggctgtggctgacttagttggagactaataggtgcatgtaaatcatatccatttctgaccttataagaaggattggatgccacattttcttcatttgtactccttgcttcataaaccttcttctgtagctctgcattttctttttggatctgctccatcttttgatagagttcaacattttcttgatgaatgagatttcccttttggcgtagttcttcgatctcattagttaaaatttggtcctttttcatgcngacaccctttaaactcatctnnnntnggttttccagactttgtagttctttaatacccaaacccataagttcttcccccattaa

SEQ ID NO: 5577 - DNA, 736 bp, Glycine max
  Predicted polypeptide sequence is orthologous to G1767
actgaaaagaaaaaaaaaaactccatcaatatatatccttccgcacgtgccaaaaaaaccgagaacacgtgcaaggcattcacccatgtcaaagccacatgatactattacgatacgatcgttatggcctccatgcactggcccacaccaccggcgtgtccttccacgagaggaatattccggcatcggagcacgccgccatcgaccacccttccctgtacctcctcaacagcgccctcacgtcgtcacaaacctcctcgctaaacggcgccgccttcagccctccgttgtgaagcctcgccacccaccgcgccgccgtctcgcggcgctccacggactccgccgtcgagcacgccaccaggtccaccaccgccctccctgccgctcgctccagcatcagcctctcgttgctcgtcttcacaaaactctcgtccaaagcatcgaagtaaaccctaaaccacctcaaacattcctcaaagcctttcacgaactcgtaaccgtcgatcccaacgtccaaatcagcctcctcctccaccaccgtcacaatccgcggctgcaacgcttgcaacgacgatatcaacgcgtcgcggttgtttcctacggcggaaaccgaatgcagcctgttcacacaattcacagccaaagcttcatcctctttgatatcaagttcgttgaaattgaactcggagagatctccgtaatgatgaatgacgttgaacttaaacggaacgcccat

SEQ ID NO: 5578 - DNA, 877 bp, Glycine max
  misc_feature (758)..(758): n is a, c, g, or t
  misc_feature (819)..(819): n is a, c, g, or t
  Predicted polypeptide sequence is orthologous to G1767
cagtcgaaaccaaaccgaaatgtcaaaacttcataaagccatataataaactatatatacagaaatcattgaaatttgaaatataaagccatataagaaactatatatacaatacttcataaagcaaaagtataaaaaacgaaatgtgaaaaaaagttaataatgaaaattaatttacttgatgatgattccttttttgaataatacaggaaaatccccttcctcctatcaccctcataccttccaattaatcccactgccttacgtagcaaactcaaaacaggaagtaaaaaaagccattaattaattaccttaaaagaaaaaagaaaaaaagaaccctcagcgttgggcacgtgtttccggaacagagagcacgtgggaatccgtccctcaacaccttactcacgtcaagtcattctcctctactctacgtcaaggccctccatgcactggcccacaccaccggctgctccttccacgtcaggaatattccggcgtcggagcactgtgtcattgcccacccttccctatacctcctcaacaacgccctcacatcatcgcatacctcttcgctaaacgccaccgtattgaaccccccacctccatgcatcctcctcgcccaccgcgccgccttctcccgcctctctacggaatccgccggagaacacgccaccaggtccaccaccgccctccccgccgccctctcaagcatcaaacgctcgttgctcgtccgcggaaaactctcgtccaaggcctcnaagtaaaccctaaaccacctcaaacactcttcaaaccctttcacgaactcaaacccttccnatccaagtccaaatcagcctcctcctccaacacgtcacgatcctcggtttcacctcct

SEQ ID NO: 5579 - DNA, 721 bp, Glycine max
  misc_feature (721)..(721): n is a, c, g, or t
  Predicted polypeptide sequence is orthologous to G1772
aggagaatctgcactgatagtaggatgcacgccagcgcgcaattaaccctcactaaagggaacaaaagctggagctccaccgcggtggcggccgctctagaactagtggatcccccgggctgcaggaattcggcaccagctcaatcttggcattcatagtattgctccatacaagtcaaagggcattgagagggcatcagaactttcagtttgctggaacaacaaagtcaataatactgtttgactttgtggatgctcatcagaaatcttactgagtgaaaaggattattgtatatatgctgcaagcgtaggtgtaacagaagaacttgatcgaccatctggatcagggagttcagaggatagtggatgctcttctcgtaagcgtcctagaaaagagggtcttggaggaggtggtttttttgatctaaacttgccagcacagtttgtagacagaaattgactttgaaggacaccttattatacggtacaggcgtacagggctaacaacatcaaatagcttgctgtctttgaaaggaagaataatttatttggatgggaaaccgcattgcgtaccgaaggtatatgttaacctgtagtcttgcgtagaaaagaaatggagcaaaggtgttatgtcgatagcatgatacctttgataggagacctacggcaaagtggaagcccgggacattatttgctaggatgtatgtcagaagagcggctn

SEQ ID NO: 5580 - DNA, 815 bp, Glycine max
  misc_feature (1)..(1): n is a, c, g, or t
  Predicted polypeptide sequence is orthologous to G1772
naagggtgatcgccgctgtaatacgactcactatagggaaagctggtacgcctgcaggtaccggtccggaattcccgggctgaaagagactatacaagggaagattgccatttcagaagaaaaagattctacactcagagattatagctgggtaaataatggactctccagacttttcagatctaggcgagtcctatcatattcatatgcatttgcattttatatgtttggagatgagctttttaaggatgaaatgacagatgctcaacgggaaataaaacagaacttatttgaggatcaacagcaacagcttgaggcaaatgttgaaaagctctctaaaattttggaggagccttttgaaaccttttcagatgataaggttgttgagataaggatgcagatactcaacctttcaacaattattgacaaactttgtcaaaaaatgtatgaatgcattgagaatgatctattgggttctctcaatcttggcattcatagtattgctccatacaagtcaaagggcatcgagagggcatcagaactttcagttggctggaacaacaaaggcaatagtactgtctgactctgtggatgctcatcagaaaatgttactgagtgaaaaggattattgtgtatatgctgcaagcgtaggtgtaacaggagaacttgatcgaccatctcgatcatggagttcagacgataatggatgtccttctattaacgtgctagagaataaggcgttgatagtggtgtaattgggttgacgcttgcccgagaccgtgtctggatttattactctacaccgctctttaacc

SEQ ID NO: 5581 - DNA, 893 bp, Glycine max
  misc_feature (651)..(651): n is a, c, g, or t
  misc_feature (671)..(671): n is a, c, g, or t
  misc_feature (677)..(677): n is a, c, g, or t
  misc_feature (694)..(694): n is a, c, g, or t
  misc_feature (706)..(706): n is a, c, g, or t
  misc_feature (711)..(711): n is a, c, g, or t
  misc_feature (722)..(722): n is a, c, g, or t
  misc_feature (724)..(724): n is a, c, g, or t
  misc_feature (730)..(730): n is a, c, g, or t
  misc_feature (736)..(736): n is a, c, g, or t
  misc_feature (781)..(781): n is a, c, g, or t
  misc_feature (783)..(783): n is a, c, g, or t
  misc_feature (805)..(805): n is a, c, g, or t
  misc_feature (815)..(815): n is a, c, g, or t
  misc_feature (817)..(817): n is a, c, g, or t
  misc_feature (819)..(819): n is a, c, g, or t
  misc_feature (821)..(821): n is a, c, g, or t
  misc_feature (834)..(834): n is a, c, g, or t
  misc_feature (871)..(871): n is a, c, g, or t
  misc_feature (890)..(890): n is a, c, g, or t
  Predicted polypeptide sequence is orthologous to G1808
ttcggcacgagctctgctcccttaattaattagccaccatgctctccgccctcactccttccgaccccttctctcccttctcccccttctccgccggcttcacgccgtgggatgacaacgacgattcccacgccctcttctcccccaaaccggtctctgcttctagctccgcctctgactataaatccgaaccgaacccaaccgaacacgtatgcgcctcgtcctcggtgatgatggacgagcggaaacggcgccgcatgatatcgaaccgggaatcggcccgcaggtccaggatgcggaaacagagacacctggagaatcttcggaaaccagttgaacaagtgcagggtcgaaaaccgggaaactcggtaaccggttgcagttcttcctgcaccacctgaaccgcctccgaaccgaaaacgaatggctccgctccgagcgaacctgctacgccaaaaagtcgccaatttaacacaaattttgattttccaacaattccaaaccaccttctcccctgctgcatggaacacatgcaccaacaacaacaccacctcgctcatgaaaattaatcaagtttaattaattaaataatatatatatatatatatatatatatatatatatatatatatatatatatatataaaatanggtcttggtaaaaatctaanaggccnagggtgtcctatgttantatcattaaaantttanataaagaaatntnttctanatggtnagggtgggattttggaaaaatattaggctggttttgggaaaatantnatttcattttttccaaaccatnggggtttttntntntnaccgaatataatnttttgttttaaaaaatacttttctttttttgtttccnaaaaaaaaaaaaaaaaaantcg

SEQ ID NO: 5582 - DNA, 797 bp, Glycine max
  Predicted polypeptide sequence is orthologous to G1821
gggctacctcgtcacgtgtacgccacgcgcgcaattaaccctcactaaagggaacaaaagctggagctccaccgcggtggcggccgctctagaactagtggatcccccgggctgcaggaattcggcacgaggatcacacacacacctaccttaatagctatggaaactggaggctttcacggctaccgcaagctccccaacaccaccgctgggttgaagctgtcagtgtcagacatgaacatgaggcagcaggtagcatcatcagatcacagtgcagccacaggagaggagaacgaatgcacggtgagggagcaagacaggttcatgccaatcgccaacgtgattaggatcatgcgcaagattctccctccacacgcaaaaatctcggacgatgcaaaagaaacaatccaagagtgcgtgtctgagtacatcagcttcatcacaggtgaggcgaacgagcgttgccagagggagcagcggaagaccataaccgcagaggacgtgctttgggccatgagcaagcttggattcgacgactacatcgaaccgttgaccatgtaccttcaccgctaccgtgaacttgaggtgaccgcacctctatgaagggtgaccactccggaagaggactgtggaaacccccacccttggtgttctactgcttttatcgttcaccctatcatcacaccaatggtaccttgtactggccttcccatggggaactacgttaagaaccgccaccaatccaacttcctgccattacacgaccacaccaccaccacaatctcatgaatctcaat

SEQ ID NO: 5583 - DNA, 270 bp, Glycine max
  Predicted polypeptide sequence is orthologous to G1821
agggaacaggaccagtacatgccgatagcgaacgtgataaggatcatgcgtcggattctgccagcgcacgcgaagatctcagacgacgcgaaggagacgatccaggagtgcgtgtctgagtacatcagtttcatcacggcggaggcgaacgagcggtgccagcgggagcagcggaagacggtgaccgcagaggatgtgttgtgggcgatggagaagcttggctttgacaactacgctcaccctctctctctttaccttcaccgctaccgc

SEQ ID NO: 5584 - DNA, 524 bp, Glycine max
  Predicted polypeptide sequence is orthologous to G1838
agaagaaaaaagtaagcatttattatgctgcagcaagttatcaagcaattagaaagcttgtgcatgcttgaaaaagagcaactcaatactcctcatctttgagaagttacttacataatccattccctacagttacgagcaaaagacctatctttctttcttctcagcaaaagggttaaagagggtcagacccagaagcagcaggtgaagctaaattgcaccaaaaactaactttctatttgttagcaaaacagaaaattagctagttgatcgtttcagtaggactggtgaggccatatgaagaacccaggaactgctggtggtggaagggtattgagtgcaatcgcatcggtcactgctgcagcagcagcagaatctgatgagctagttccaccgttggtaggattgaaatggtggtggaagaagttgtgggggtaacatgtgattgcagaatcatagggtatagaagaaactggctgaatggctgagaaattgatgctgctacttgcgtttgtgcctcgtgc

SEQ ID NO: 5585 - DNA, 828 bp, Glycine max
  misc_feature (750)..(753): n is a, c, g, or t
  Predicted polypeptide sequence is orthologous to G1838
caatactcctcaacttagagaagttacttacataatccattccctacagttactatgactcggactttccgagcaaaaaacctatctttcttctcagcaaaagggttaaagaggggtcagacccagaagcaggtcaagctaaattgcaccataaactagctttctatttgttagcagaacagaaaattagctagttgatcatttccacaattcaatagttctgatgaggccatacgaagaacccaggaactgccagtggtggaagggtagcgagtgcgattgcatcggtcatagttgcagcaaattctgcagtgctactttcaccgttggtgggattaaaatggtggaagaggttgtgggggtaacatgtgattgcagaatcatagggtatagaagacactggctgaatggttgagaaattgatgctgctactggcgtttgtgttctgaggtggttgaatggtgctgacaagagctttgttctccgtttctggggaaactttaaagcgttttgctatgccgccaactggaagagagttgttcaatatagcgtcgacgtcatatcgcctcatctcgaaattggttacggcacttgcacctctgaactttatggctgcaatatcatatgcctctgctgcctcctcttcagttgaaaatgttcccaaatatagatccttgtttcccgcaacccggccaattctcgcttgccatctacccttgtaacacccctgtaagcagaagctcccctcgnnnnaccactgcttttccttcgcagtgatgcaataaattcttgctttcctacatgcttcatctcctccaattcctttgt

SEQ ID NO: 5586 - DNA, 641 bp, Glycine max
  misc_feature (8)..(10): n is a, c, g, or t
  misc_feature (12)..(12): n is a, c, g, or t
  misc_feature (24)..(25): n is a, c, g, or t
  misc_feature (75)..(75): n is a, c, g, or t
  Predicted polypeptide sequence is orthologous to G1838
ggggggannngnttgctatttggnnggttaacgggttgaacattcattctccagcgcgcattaacctcataaggngacaaagctggagctccaccgcggtggcggccgctctagaactagtggatcccccgggctgcaggaattcggcacgaggagctggaaacaaagatttatacttgggaacattcgcaaccgaggaggaagcagcagaggcatatgatattgcagccataaagttcagaggtgcaaacgcggtaaccaactttgagatgaatagatatgatgtggaagctataatgaagagttctcttccagtgggtggggcagcaaaacgcttgaggctttcccttgaatcagagcagaaagctcctcctgtgaacagcagcagtcagcagcagaatccacagtgtggtaacgtgagtggtagcatcaatttctcagccattcatcagccaattgcttcaatcccttgtggaattccgtttgattcaacaacagcatattatcctcacaaccttttccaacattttcaccctaccaacgctggtgcagcagcgtctgctgttacttctgccaatgcaaccgcactaactgcactgccagcatcagcagcaactgagttctttatttggcctcatcag

SEQ ID NO: 5587 - DNA, 976 bp, Glycine max
  Predicted polypeptide sequence is orthologous to G1850
gaacgcgaaagtatcgttttcttctgagaagcttctacgaaaaaagtcccaaacggttaacgacgtacatttgccacgcgcgtctccgtgctcaggactctgattctctgcgacgcccctagcttaacctaacgtgttcctagctgctgttacaacgtcgtgtgtcaattacacactctctgatttgctctatgacattgatttagccacggcgtttttttattttcgccacgtcttgcgaaatccaacgcttcggatttcacgtccgcatggaacggctgatgcagactcaaaaccgtatcattctcttctctcgctcgcttcgtaccaatcaccaccccaaacagcttcggattcatctcctccaccgcatcctcgccgaagcaccgcgccgccacccccgcggaaccaccgtccgcttgaacgttagcgtaattcgacatgagattgaatatattgttgcagagcgatctcatctcctccaattccttcgttaacagaatgttctccttcctcagccggtcgttctcatccaacagctccgccggcgacgagttagacgaaatcacctgctcctccgctgagttcgacggcgacacgatcagcttcgccggcggaatcgtagatagcggcagcggagatagaaccgccgcggtcgcagtcgctcgggtcggcggcgttgccgggaggatcttccgtcgctgtatttcgcagaggagccgcttctcgtctcttcggaaatactcgttcgagaactcccagcggtcaggtacaacttttataagtgttgagttggcgaacgaagctggagaaagtgttgtgcttgaaatatttaggaagcaaatccttggcgaaagcggtggtgttccagacgatgaaggacgatccagaatcgttccacgaaatcacatggtcgatggtgtgatcgtcgacaagttggaagggtttggtgagaaacggcgtcgcgacagcaaca

SEQ ID NO: 5588 - DNA, 1386 bp, Glycine max
  Predicted polypeptide sequence is orthologous to G1850
gaattcgctagggatttgcttcctaagtacttcaaacacaacaactattccagtttcgtccgtcagcttaacacctatggtttccggaaggttgtccctgaccgttgggaattcgccaacgactgtttccggcgaggcgagagagctcttcttcgcgacatacagcgccggaaattactgccggttccgcctgcagccgcggcaccgacagcagtcacagctaatacggtgacggtggctgtggcggcaccggcggtgagaacggtgtctccgacgacttccggcgacgaacaggtactatcctcgaactcatctccgattgctgggaataataataatacagtgcaccgtaccacaagttgcaccactgcgcccgagctgctagacgagaatgaaaggcttaggaaagagaacatgcaactgagtaacgagttgagtcaattgaagggtttgtgtaataacatactcgctttgatgaccaattatgcttctggttttagccgccagcagttagaatcctccactagcgctgcgaggaccgtgccggtgccggaagggaaggcggcgctggagcttttgcctgcgaaacatgtttcatcggctgatgaggccgggcatgtaggtggtgccgcgccgtgcgcgacggcgaacgcgggggaagcagaggttccgaagctgtttggggtttcgattggactgaaacgatgtaggacagagtgcgagggcgaagcggagggagaagatcagaatcaaatgcaaacgcgagcacaagcacaaacgcaaacacaatcgtcgcaagaaccagatcacggttcagatgtgaaatctgaaccgcttgatggcgatgactcggatgatcaggatcatgatcctcgttggttggagctaggtaaatgaaatgatgctcctccttcttctaatttggtgaaaatgacagaaggcacgtgacttgggtggggacacgctgtactattagcgctgcgacgctgccattgattgggccatgtatgtaatgtaacattacgctagatggaaagggcggatgaccatccttgtatgtaactcgcggatgggatgaaaagtgtcaaagtcaaagctttgcttgagcgccaaaatttgtaatataaggatttatgtattcttgataagctggggttaaagaacatgtcaaaatggagtaactgaagcaacccctaaaagattcacttctcgttttcctttttaaggaacatttgtgggttacagcaaaatatgtagataaacgtgtctgacatcattacatttttcgaatttgattcgtgtattctaatgtttccatcctttgaaccgagttgttcctaagattcataatcgtaccatgtttctttttaatgaaaaaaaaaaaac

SEQ ID NO: 5589 - DNA, 1207 bp, Glycine max
  Predicted polypeptide sequence is orthologous to G1850
gaattccgcttcattgtatggcgacccgcggaatttgcaagggatttgcttcctaagtacttcaaacacaacaacttttccagtttcgtccgtcaacttaacacctatgggttccggaaggttgtccctgaccgttgggaattcgccaacgactgtttccggcgaggcgagagagctcttcttcgcgacatacagcgccggaaattactgccggttccgcctgcagccgcggcaccggcagcagtcacagccaatacggtgacggtggctgtggcagcaccggcggtgagaactgtgtctccaacgacttccggcgacgaacagccgccagcagttagaatcctccacaagcgctgtgaggaccgtgccggtgccggacgggaaggcgccgctggagcttttgcccgcgaaacatgtttcatcggctgatgacgccctgcatgtcggtggcgccgccggtgccgcggcgtgcgcgacggggaacgcggcggaagcagaggttccgaagctgtttggggtttcgattggactgaaacgatgtaggacagagtgcgaggccgaaccagaaggagaagatcagaatcagatgcaaacgcgagcacaaacacaatcacaatcgtcgcaagaaccagatcacggttcagatgtgaaatctgaaccgcttgatggtgatgattcggattatcaggatcatgaccctcattggttggagctatagggaaatgaaatgatgctccttcttcttcttgatctctctactaatttggtgaaatgacagtgcgcacttgctgcctgtactattagtgctgtgacgctgccattgggccggcacgtgacttggccatgtatttaactcgcggttggggtgaaaagtgcgaaacattgtactataaggaattatgtattcttctgattgctgggggttaaagaaagattatcatcgcgtcaaaatggagtaactgaagcaagggaaggacagacccctaaaagactcacgtctcggttttttatttcaaggaacatttgttggatacagcaaaatgtgtagatatttgtgtctgacatcattaaattttcgaatttgattcgtgtattgtaatgtttccatcctttgaaccaagtttgttcctaagcttcataattgtagcatgtatgttcttttaatgaaatgaaattctaatattatctaaaaaaaaaaacggaattc

SEQ ID NO: 5590 - DNA, 866 bp, Glycine max
  misc_feature (807)..(807): n is a, c, g, or t
  Predicted polypeptide sequence is orthologous to G1863, G2334
gattgttaattgacaatttagtattacttcgaattaatccaaccagggaccgaccatatcctttcatcgcccacttagaaacaaaagtagtctacacagtttgaaaagaacataaccgtggtccaagaatgctccaaaagtggaacttaaacctcgaaacaagaaacagaaaaataatcggggcacccactataactaaattcaggtgctaataaagctggtctcagatccacgaggcaagtgacgatgcaaaacactagtgggagatgaggttgaagtagatgatctgagtgcctcagcaagtggacctcccatcgaagccacttgattagacgaggcccatcctccggcccaattcaactgcagctgctctggctcgaggcttacattctcatttcctgggcccgagtcctctccatagcccgtggacaatttcaatgacacatccgaggaagcaccgggcattgaaatagagaggctacggccagcagcagcattgttttcaacgttgtcagagtcttggagtgatcgtggccaatcatcgaagaaatgcctcagcatatggccaccacctccacctgatctgccatccccacccacatgatcttcgtcttcattcttggtcccagaggaacgttcatcaagatgaagatcaaaaggagatttgaatgaagcagaagctaagggtggtgaacaaatggaagatgatgaagcacctggtcctagggatccaactccagttacaccacaattgttaatagcactagttggtgtgggtagttccacaggctttcttgaacggtttcntccacggtgcatgtggcgctcacagtacttttgcccagccaccacgtccctcgaacagc

SEQ ID NO: 5591 - DNA, 900 bp, Glycine max
  misc_feature (30)..(30): n is a, c, g, or t
  misc_feature (701)..(701): n is a, c, g, or t
  misc_feature (732)..(732): n is a, c, g, or t
  Predicted polypeptide sequence is orthologous to G1888
gtgtggaaagatgaatctacagtaagacanctagcgcgcaattaaccctcactaaagggaacaaaagctggagctccaccgcggtggcggccgctctagaactagtggatcccccgggctgcaggaattcggcacgagctccatcttccaccaccaccaccaccaccagcaacaacaacaacaacaaggttgctgttgaaggaactggttcaactagtgctagcagcatatcggagtatttgatagagactcttcctgggtggcaagttgaagactttcttgattcatattctgttccctttggtttctgtaagaatgatgaagtgttgccacggtttgatggtgaaatggaggggcatctgagttctttctcaaccgagaacatggggatctgggttcctcaagcgccaccaactcttatgtgttcttcacaaatggatcgggtgatagttcacggtgagaccaatatcaaaggtagcagcagatcaaagttgaaggatgataaattcactgttccacagattagtcctccttccaattccaagagagccagatttctgtggtagaaacaaataaacaaacaaacaagcctcagtttccattctcttgaggcagaattaacaaccctctttgttttgttttgtcccttttctctttttcttaccctggcttgtagtttactctgcccatgttttcaattnggttcagtttgacttttttttttttccaaanaaaaaaaaaaaaaactcgaggggggcccggtacccaattcgccctatagtgagtcgtattacgcgcgctcacttggccgcggtttacaacgtcgggactgggaaaaccctgccgttaccaacttatcgccttgcacacatccccctttttgcagctgcgttattacaa

SEQ ID NO: 5592 - DNA, 552 bp, Glycine max
  Predicted polypeptide sequence is orthologous to G189
ttttttatctgaacctggaacaccccatcaattaatctccttcggagataaaactctgcgcgagtaaaagatttcaattgtacaagccatgaatgacatgatcaaaatatactactttgtgatgggaaacgatgattaatttagttaagaggattctaggatgagattagtagcttctgccgcagagagagtgtgattgtgctctccttcataggtgactaccaacatagatggatcatcaagggccctctctacatgcttgcgcgctggacaccctctaacactgctacacttgtaataacctcttggatgaggggatcctttaatgggtttctgtccgtatttcctccaagagtaatcatcgggtggaatatcagccatcttcaagcttatagctggtaccctcagcaccctcttctgcctcatttgtctgctcttctttgaacaatggcatcggctagaggaactggcacacttggcagagcccaagttctcagaactacacttcctcttcaacgaagaggacgaaagtggaggctttcccccggagga

SEQ ID NO: 5593 - DNA, 864 bp, Glycine max
  Predicted polypeptide sequence is orthologous to G189
atagaacatatctgaacctggaacaccccatcaattaatctccttcgagataaaactctgcgcgagtaaaaatttcaattgtacaagccatgaatgacatgatcaaaatatactactttgtgatgggaaacgatgattaatttagttaagaggattctaggatgagattagtagcttctgccgcagagagagtgtgattgtgctctccttcataggtaactaccaacatagatggatcatcaagggccctctctacatgcttgcgcgctggacaccctctaacactgctacacttgtaataacctctgcaattaattattcaaaaaaactcaattcagtgattcactaccactacaactcacttaagccattcagaattaactccacaacatcacataaataaaaactcaaggtagaggacagaaagaaaaaaaccatctcaggatctttctaaatttagaccatacggaaaagaaaaaaaggaaacaaattagggggattcaatttagtaaaacaaaattaattacgggtccattttgaaatttgaaattgaagggtcaacgagcaagccaacatattcaaagataaaatcataaaattattaggtacctaagtcgtgtataattcaaatcagaacacgatgtgaaggtgcttatgatataattataataatgttaagctatgtaccttggatgaggggatcctttaatgggtttctgtccgtatttcctccaagagtaatcatcgggtggaatatcagccatcttcaagcttatagctggtaccctcaccaccctcttctgcctcatttttctgctcttctttgaacaatggcatcggctagaggaaactgcacacttggca

SEQ ID NO: 5594 - DNA, 962 bp, Glycine max
  misc_feature (1)..(10): n is a, c, g, or t
  misc_feature (55)..(55): n is a, c, g, or t
  misc_feature (60)..(60): n is a, c, g, or t
  misc_feature (66)..(66): n is a, c, g, or t
  misc_feature (639)..(639): n is a, c, g, or t
  misc_feature (696)..(696): n is a, c, g, or t
  misc_feature (743)..(743): n is a, c, g, or t
  misc_feature (757)..(757): n is a, c, g, or t
  misc_feature (761)..(761): n is a, c, g, or t
  misc_feature (764)..(764): n is a, c, g, or t
  misc_feature (767)..(767): n is a, c, g, or t
  misc_feature (773)..(773): n is a, c, g, or t
  misc_feature (782)..(783): n is a, c, g, or t
  misc_feature (803)..(804): n is a, c, g, or t
  misc_feature (812)..(812): n is a, c, g, or t
  misc_feature (821)..(821): n is a, c, g, or t
  misc_feature (823)..(823): n is a, c, g, or t
  misc_feature (830)..(830): n is a, c, g, or t
  misc_feature (841)..(841): n is a, c, g, or t
  misc_feature (882)..(882): n is a, c, g, or t
  misc_feature (888)..(888): n is a, c, g, or t
  misc_feature (951)..(951): n is a, c, g, or t
  Predicted polypeptide sequence is orthologous to G189
nnnnnnnnnncccccccccccccccccccccccccccagacgcgcgcggctcaancgtcnagactngatagtaacgcccagcgcgctattaaccctcactaaagggaacaaaagctggagctccaccgcggtggcggccgctctagaattagtggatcccccgggctgcaggaattcggcacgagtagcaccattttgaccaaggcgatatagctaacagctattcgcccccccatactttctttaattttctccttctcccatggtgtaattgctccaactatggccgtggacctcatgacgaccggttacacccgaaacgacaacatcagtagtttcacaaccaaagccgaggaaaatgccgtccaagaagccgcttctggtctagagagcgtcgagaagctcatcagactcctctcccaaacccaagcccaagcccaagcccaccatcaattcaacaacaacaatagctctagtaatgaaatcgccatcgccatggactgcaaagccgtcgctgacgtggcagtctccaagttccagaaggtcatttccctcctcggccgaacccgtaccggccacgccaggttccgacgcgcccctctccccaaccaacaccaacacacccaacctccctccganaccgccgttctccacgctaccccgctgcaccagatcccacctccctcccttcaccanatccccataaccgagaaacacctcaacgattcatcgtctaagacgcnttcattctcatacncctncgncgntacttncttcgtctnnctcctcaccggcgacgccgnncgacacanacaaccatncncggcggncacgaccacgnacctccactttcagatcacgagccctctctcacgtgtcgtnccgggnggaagccttcgctttcgtcttcctctttcaagagaagtgcagctctgaggatttaggtctganagtgcgtagtt

SEQ ID NO: 5595 - DNA, 906 bp, Glycine max
  misc_feature (1)..(2): n is a, c, g, or t
  misc_feature (25)..(25): n is a, c, g, or t
  misc_feature (519)..(519): n is a, c, g, or t
  misc_feature (576)..(576): n is a, c, g, or t
  Predicted polypeptide sequence is orthologous to G19
nnggagatatcgacaatagagacanctgcagattccgccaagcgcgcaattaaccctcactaaagggaacaaaagctggagctccaccgcggtggcggccgctctagaactagtggatcccccgggctgcaggaattcggcacgaggccgccatacgcatccgcggcgacaaggccaagctcaacttcccggccaccaccatttccgccgccgccgctccgccaccttccaaaaagcaacgctgcctcagccctgacatcatcactgaagaaagcagcagcagcagctcacattccaccactggatccaccggcgaaagcggcggaggaaacgacgaactcgacctgaaacaaattgaatggtttctaggtttggagaatgagctgcctgttagcaacaacattggtgctgagtgggacaacatggatgacctgtggatgctggacgacgtcgttgtgcccaaccgtcacttaatttactagaaggctaataattaataaatggcgttttcttaagttntagttttactttataaattgtagtataaaactatgttggtatttgtgttcttagttntcttctgctgttatgtctcttctctggctatggtaatttctgttttggacggttgaatgatttcaaaaataggtacttaattacaccctatcatgattgggatgatgattatatattatgattatgatgattatatataaattaaaggtggataagttaaaaaaaaaaaaaaaaaaaaaaactgaggggggccccgtacccaattcgcccttagtgagtcgaataacgcgcgctacttgccgtcgtttacaacgcgtgactggaaaaccctgcgtccccactaattgcctgcgaacatccccttcgccagctggtaaaaacagaggccca

SEQ ID NO: 5596 - DNA, 899 bp, Glycine max
  misc_feature (1)..(5): n is a, c, g, or t
  misc_feature (45)..(45): n is a, c, g, or t
  misc_feature (765)..(765): n is a, c, g, or t
  misc_feature (767)..(767): n is a, c, g, or t
  Predicted polypeptide sequence is orthologous to G19
nnnnncccccccccccccccccccccccccccccccccgctgaanggattaccgaagcagcgccgccagctctttacgactcactatagggaaagctggtacgcctgcaggtaccggtccggaattcccgggtcgacccacgcgtccgggctcggcaccttccccaccgccgaggaagccgcccgagcctacgacgacgccgccaagcgcatccgcggcgacaaggccaagctcaacttcccggccaccgctccgccaccctccaaaaaacaacgctgcctcagccctgacaccaccaccgaacaaagcagcaactcacattccaccactgaatccaccggatcgccgccttccgccgccttccacggcggaggagatgaactcgacctgaaacaacttgaacggtttctagggttggacaacatgggtgctgagtgggacaacatggatgacctgtggatgctggacgacgtcattgtgcccaaccgtcacttaatttactagaagggagataattaattaattaataaatggcgttttcttaagttatagttttataaaactatgttggtgtatgtgttcttagttgtctgttttgtcttgtcctctcactgtgataatttctgttttgtacagtcaaattatttcaaaattaagtgcaacatatcatgagaagaatgattatatattatcattatgattataaataaaagccgaattaaggtgtattaacagtaggtcatgcagaaaaagaaaactgtggcncngcgcgtgcgactccagccgcaggctcgttggatatcgtatggcggccgggttcgccgagaaaaaaagaaaaaaaaaaaaaggccgccgctgtgtttcttggttttaaaaaaaagaaaaagtatacttccccc

SEQ ID NO: 5597 - DNA, 821 bp, Glycine max
  misc_feature (1)..(1): n is a, c, g, or t
  misc_feature (821)..(821): n is a, c, g, or t
  Predicted polypeptide sequence is orthologous to G194
ngggtgccgaaacttagcaatatgatcttgccaagcgcgcaattaaccctcactaaagggaacaaaagctggagctccaccgcggtggcggccgctctagaactagtggatcccccgggctgcaggaattcggcacgaggccagtgaggttttctatgatgaacagaataaaactgtagatcaagcacctgaacaccaaaagacaaaggaacagttgaaggctaagaagacaaatcagaagagacagagagaaccgagattcgcgttcatgacgaaaagcgaggtggatcatctggaagatggatacagatggagaaagtacggtcaaaaagctgtgaaaaacagcccctttcccaggagctactatcgttgcaccagtgtttcatgtaatgtgaagaaacgtgtggagcgatcttttagcgacccaagcattgtggtgacaacctacgaaggacaacacacgcatccaagcccagttatgggtcgctccaacaactttggttcggtaattatgtctggatctgctggaaactacatgtcccaatattatcagcagcagcatcaacaagtccacatcgatgcattgtcctctatgggtttcctctcttcttcgtcttcaaggaatgccactcttcctcaagagactgccttgttaagtgactatgggcttcttcaagatgttgtttcttcacatatgttgaaagaagattagatgattacttcattactggttgtatgtgatatctcggtattagttactgtagagaatttagaatgaggactttgctgctgccctgtcgatatgaaggtttatatgcatn

SEQ ID NO: 5598 - DNA, 775 bp, Glycine max
  misc_feature (1)..(1): n is a, c, g, or t
  misc_feature (773)..(773): n is a, c, g, or t
  misc_feature (775)..(775): n is a, c, g, or t
  Predicted polypeptide sequence is orthologous to G194
ntggtggctcgagtcagattacgccaagcgcgcaattaaccctcactaaagggaacaaaagctggagctccaccgcggtggcggccgctctagaactagtggatcccccgggctgcaggaattcggcacgagggaatgtgctccgtcagatctcagatttttagagtagatggtgtcttgatgccagcctattttggttttttgaagcttccaagattatggattttagtttaacagtcagattatagaggaagcattctgaaggcccgcaggtgatcctactgatgcagcatgggatttttccttcccatttgtttgaactgcaatgctaatggtggccttgttgcatttcttgacacgaattcttgtataatatttgttagaatttgatgatagttaggtagctagatttccgtagcatgtgtacattgctaactgctgctgcgcattgagttccattgacaacatgtttttttgattttgtgctagcagattcaaaatcttagtaccatacgaagataatatgtaattccttcgtgaagtctcattccgtgtagtttataactgaaaatgcaagtcgtagttagtttaaaaaaataacaacaatgcttgttgcgttcgtgcttgcagcgcgatgaatgcttttgtggctccgaggtacggtgtgggtccatttattaagaagaaaataataccttgtaggggggccgacgcaccttgtcccctttatggatgtttttatcaccgccctctgggcggtgttttaccacggngn

SEQ ID NO: 5599 - DNA, 615 bp, Glycine max
  misc_feature (550)..(550): n is a, c, g, or t
  Predicted polypeptide sequence is orthologous to G194
agtcctcatctatattctcctacaaaaactaattataagaaatcacatagaaacagtagtgaagttattatcatctagtcttctttcaacatatgtgaaggaacaacatcttgaagaagcccatagtcacttaacaaggcagtctcttgagaaaaagtggcattccttgaagacgaagaagaagagaggaaacccaaagaagacaatgcattgacgtggacttgttgctgatgataatattgggacatgtagtttccagcagatccagacattaccgtaccaaagttgttggagcgacccataactgggcttggatgcgtgtgttggccttcgtaggttgtcaccacaatgcttgggtcgctgaaagatcgctccacgcgtttcttcacattacatgaaacactggtgcaacgatagtagctcctgggaaaggggctgtttttcacagctttttgaccgtactttctccatctgtacccatcttccagatgatccacctcgcttttcgtcatgaacgcgaatctcggttctctctgtctcttctgatttntcttctttgccttcaacctatttacccaacaacatcaaccacatcccagaaaaaaaaaaatcatc

SEQ ID NO: 5600 - DNA, 857 bp, Glycine max
  misc_feature (309)..(309): n is a, c, g, or t
  misc_feature (616)..(616): n is a, c, g, or t
  misc_feature (732)..(732): n is a, c, g, or t
  misc_feature (752)..(753): n is a, c, g, or t
  misc_feature (832)..(832): n is a, c, g, or t
  Predicted polypeptide sequence is orthologous to G1944
atacattacgccagcgtcaattaaccctactaaagggaacaaaagctggagctccaccgcggtggcggccgctctagaactagtggatcccccgggctgcaggatccggtggcatgagtgtatctttggcaagccctgatggacgtgttgtaggtggtggagtagctggtctgttggtggctgcaagtcctgtgcaggtagtggtaggaagttttctggcaggaaaccagcatgagcagaagccaagaaaacagagacatgaggttataacaagtgtgataccagctgcagttgttccaatctctaccnttgatcccagtgccaattctatcagccagcgtcttccatccgaaacgataatttggtcttgctattgccagcagaggcgcaagaataagccagctgactttaaaccgtgttcgttctgtcggggtaatttatatattagatcttaatttcatctggattttactttacatggtgcaccatgtaatgtgaatgggtaccctaaatgtggcttgttttcccctggttgggggggggcggaaaatggtggactttctaaccggcccaaatgttttcaaaaggtttacccactctgctcttgttgaaaatnagggtgggggtaaaagaatcgttttatgccgggtggttgtgagcatgacaaaactcttgtggggtatgttttctttgaaaatccttctttcctttggggggttaaaaaaaaaaaanaaaaaaaaaaaaaaaaatanntctcgggggggcgccccccccctatttcccccttaaggatgtgtttcacccgcctctccttgggcgggttttaaaactntgtgaattggaaacaaccttgtttc

SEQ ID NO: 5601 - DNA, 788 bp, Glycine max
  misc_feature (3)..(3): n is a, c, g, or t
  misc_feature (45)..(45): n is a, c, g, or t
  misc_feature (547)..(547): n is a, c, g, or t
  Predicted polypeptide sequence is orthologous to G1944
canaccccccccccccccccccccccccccccccccccggtgtgnaatcagacggctgacactcatcacgccaagctctaatacgactcactatagggaaagctggtacgcctgcaggtaccggtccggaattcccgggtgggtcagtcactatggcattgtcaccaatgccaatttcgtcgtcggctccgccttctaatgacttttcctccgggaagcgggggaaaatgcgggggatggactataagccatcaaaaaaagttggtttggattatctaggtgacttgaatgcatgctctgatggtacaaattttatgccgcatatcatcactgtcaatgctggcgaggacatcacgatgaaggtgatatccttttctcaacaaggaccacgagctatatgtatcttatctgctaatggtgtgatttcaaatgttacacttcgtcagcctgattcttctgggggtactttaacttatgagggccgttttgagatactttccttgtctggatcattcatgcctactgataaccaaggaacaagaagcangactggtggaatgtcggtctcgttggctagccctgatggccgtgttgtaggtggcggagttgctggtcttcttgtagctgccagccactgtgcagtggtggtggggagcttattaccatgccgccagcaagaacatacaatagaagatgcaagatctagcgagagtgcgcaggcacatcaactacacacattgcagtgcttcatcactcgcgcctgcaaccaatgcggagactacgatgtg

SEQ ID NO: 5602 - DNA, 776 bp, Glycine max
  misc_feature (7)..(7): n is a, c, g, or t
  misc_feature (741)..(741): n is a, c, g, or t
  Predicted polypeptide sequence is orthologous to G1944
gagtggngttgattgcctgtcgaagattacgccaagctctaatacgactcactatagggaaagctggtacgcctgcaggtaccggtccggaattcccgggtcgatccacgcgtccggggaactgaaaagaaatcttaatacaagattacaccttcagaagagtcttgctgaagtgtgtgcatggacaggtcatgatctttgtattctgaacagtattcagagtttgatgttgattgtgtagacttaggagtgaatagtttgatatatgcatggaaggaagagaagggataagttctggggttacagtgataggagcagaagctccatcagcctatcacatggcaccaaggagtgaagctccaagccaagttcctccacctgttcctgaagcaacagctggagctattggtgtctcaccagcgagtgtgggattggatggaacagcagctaagaagaaaaggggtagaccaaggaaatatgggccagatgggttgaactctatggcattgtcacccattccaatctcatcttcagctccatttgctaatgaattctcatccgggaagcagcgggggaaaccgcgagcgatggagtacaagctgccgaagaaagttggagtggatcttttggtgattctgttgtacaaactttatgccccatatcattgcggtcaatactggcgaggacattacaatgaaagttatatctttttcccaaacaggaccccgtgctatatgcatnctatctgcttatggtggtatttcgaatgttacact

SEQ ID NO: 5603 - DNA, 622 bp, Glycine max
  misc_feature (9)..(9): n is a, c, g, or t
  misc_feature (52)..(52): n is a, c, g, or t
  Predicted polypeptide sequence is orthologous to G1944
cagctctgnaccatgcatacgccaagcgcgcaattaaccctcactatagggnaacaaaagctggagctccaccgcggtggcggccgctctagaactagtggatcccccgggctgcaggaattcggcacgaggaagtggtggactcactgttgttcctgacgatgctcctcctactagtgcttttgcttattcggcacgaaacaacaacaacgttgctcctccacctcctgttagggtggtgaaggttgaaggtcagagtggtatggagcttcagcttgctcctcctcctggatgggaaaaattaactgctggaggtggagctgttaaaatcaaattggagcctgtagctagctagggtcttaatctcttatcaagggtccagtagttttagtactctgtttaattgttattcatagggtcagattcaatcttcaattgtgtttatggaccacttatacggtctatagtgcttaattaattgggtcttgtcttcattgttcgccttctctcgttgaataaatactggattttatcttcgaaaaaaaaaaaaaaaaaactcgagggggggcccggtacccaattcgccctatagggagtcgtattacgcgccctcactggccgg

SEQ ID NO: 5604 - DNA, 749 bp, Glycine max
  misc_feature (1)..(1): n is a, c, g, or t
  misc_feature (520)..(520): n is a, c, g, or t
  Predicted polypeptide sequence is orthologous to G1950
nggatgaatcgcgccagcgcgcaattaaccctcactaaagggaacaaaagctggagctccaccgcggtggcggccgctctagaactagtggatcccccgggctgcaggaattcggcaccagacgatggagatggaagtagacaccgagaagaagcaacaagacgtggtgaaagagaaggacttattcaaagccgctgaagagggtgacatgtcaacgttcgaagcacactcctctgaaaccctctccaaagccctctctctcagaaacgaagacgctcgctccctcctccacgttgcagcttcttccggccactcccaggtagtgaagatgctattgtcttgtgatgcgtctgttggtgtggtgaattgtgccgacgaggaagggtgggcgccgcttcactctgcagccagcattgggagtgtggagatagtggagactctattgagcaaaggagctgatgttaacctgaaaaataatgggggccgcactgctctacactatgctgccagcaaaggttgngtgaagatcgctgaaatgctcatctcccatgatgccaagattaatataaaggataaggttggttgcactccattgcatcgggcagctagcactgggaaatctgagctgtgtgaatttttgattgaagaaggagcagaggttgatgcctgtgatagagcttgtcaaactcctctaatgaatgctgtgatttgctattacaaagagggtgcccttcttttgataagacctg

SEQ ID NO: 5605 - DNA, 661 bp, Glycine max
  misc_feature (572)..(572): n is a, c, g, or t
  misc_feature (584)..(584): n is a, c, g, or t
  Predicted polypeptide sequence is orthologous to G2057
ccggatttagggcaccaagatctgcggctctcgttgcagtcctttcaggaccctattatgcttcaccaccagcctcatagccaccaccaaccggttccggctggtcagagcacctgcaccagcaccagcaacagaaccaccactcggaggaacagcgattgctctatgctggtggtaacagtggccacggcggtgggtttgtgttcaacacgccggcgccggtgcaggtgccggcgtttggccagtttttttctcagaggggaccccttcagtccagtaacaccccttcgattcgtgcttggatagacccttcggtcgatcaccaccaccaccaccatcactacctatcacagttgatccaccaaggatccgtcgccggtggcggcggattctccggcttccgcattcctgcacgaattcagggtgaagaggaacacgacggcgtgtcccgacagccgtcctctgctttctctgattctcgccattgatttgaaaaacacacattcaaaacccccactttgttctcccctagggttttgtgggtttgattggagattggtcaattggtgganagaaacatattnttggagatcatgattgatggatttcaagcctacacggggaattgagaagatctgaaggggatattcagggttcccat

SEQ ID NO: 5606 - DNA, 731 bp, Glycine max
  misc_feature (4)..(5): n is a, c, g, or t
  misc_feature (9)..(9): n is a, c, g, or t
  misc_feature (16)..(17): n is a, c, g, or t
  misc_feature (34)..(35): n is a, c, g, or t
  misc_feature (581)..(582): n is a, c, g, or t
  misc_feature (608)..(609): n is a, c, g, or t
  misc_feature (613)..(613): n is a, c, g, or t
  misc_feature (657)..(658): n is a, c, g, or t
  misc_feature (694)..(695): n is a, c, g, or t
  misc_feature (701)..(703): n is a, c, g, or t
  misc_feature (705)..(705): n is a, c, g, or t
  misc_feature (714)..(715): n is a, c, g, or t
  Predicted polypeptide sequence is orthologous to G206
attnnatcnttaatanntcatttattgatattannatcaagtaactctagcctaattaaactataattttctaaaatacaaaaatgttagagcatcgctgtcttcaactaaaagaaagaaagtcagtgatttcactagtagattacatgtgtacattacatatcattagccttttcgcattactctggctggtttctttgtcaatggatgcctctagatcttgcagctggtgataatgctgtccccacaccagaaattatcgtaccctttagttgtaacggtcaaattcaagctataccatttcatttaaactactctatctgccaaatttaataataccctcattcaacgtgtcacatgaaaaattcagaactctgacaattctattgaatcattggtcctggtgaatatgtcataccagaaatccatgccatcatcaaagtttgaatcataagcatgactctgttggaaagtttcctcatagttagcaaaagggtattgaagtggcatgtcatttgagattgtgatcaaagattgtgatgacatggtgggggtttcatcatcaattgcagcttctgacnnaaagctctcatctatcacaggcattnnttcnatagactctatgtcttcactcttgataatatttttgctgtcacnnaccgtgactgatgaaaaatcactactagaagtattnnatgctnnngntgttgtgtnnatttctctgaatctaa

SEQ ID NO: 5607 - DNA, 1076 bp, Glycine max
  misc_feature (1)..(1): n is a, c, g, or t
  misc_feature (393)..(393): n is a, c, g, or t
  misc_feature (629)..(629): n is a, c, g, or t
  misc_feature (635)..(636): n is a, c, g, or t
  misc_feature (639)..(639): n is a, c, g, or t
  misc_feature (646)..(646): n is a, c, g, or t
  misc_feature (685)..(685): n is a, c, g, or t
  misc_feature (688)..(689): n is a, c, g, or t
  misc_feature (710)..(710): n is a, c, g, or t
  misc_feature (713)..(713): n is a, c, g, or t
  Predicted polypeptide sequence is orthologous to G2071
natgtgcgatcggctgctgacaactcatatagggcgaattgggtaccgggccccccctcgagtttttttttttttttttttttttttttttttttttttttttactaacacgaaaaagcttttgtgttttcttgtatatcatcccttggtctgcatgcagggtccaaatccttatttttctgcatttccatgatttcttcctgttttctttggaattctctgtttaattccttaagttttgcaacctcagcttctagttcgaaagtgtaggcctgcttacgagcccttgacctcgcagctgattctctattttttatcattctcctttggctcctctcaaccactttctctatggcactgaatttccttcccctgttgattacataatgcggngatattggagagttatcaacattattactccttgtaataacatcaggtgatattttacttgaggcagaagctgtgacattagctgtggctaaaccaaccattccaacattcatcgaatgctcagcaactccaatcaaccctctccttctgccagggctagcaagttgtgcattgttcaacaaatgcataggagcagctgcaaaagttacatttgctggctttggaaaaagtgtggntgctgnntgnggtgctngtgtgctgtcctttgggagtgtttgagttaatgataaanggnnggaagggagagttgactaaantantgtcttaaccaaaatcccgttgtttctatttggtgtgaaaccccaaaagaagccagggtgtattgtctgtcttagaaagcaccaaccctgcggcccgggatcataattctaagcgccccccacgggtgactctcgcttttgtcccttatgggggtattgcccttgcggatcatgccatactgttcttgggaattgtttcctccaattccaaacatcgaccggaaacaatgtaggccggtgtccagtgactacacatattgctgctcattgcccttcacggaacctgtccatcttttataaacaaacagcgggagatcgattgggtcttctttccttctcttaaatccatatcactaactctcc

SEQ ID NO: 5608 - DNA, 803 bp, Glycine max
  Predicted polypeptide sequence is orthologous to G2085
gaacaaaaaatctacgtgtaaaattaaattcaaggtattgggtgagaccatcaccaagtcatcattcaagtttcaggttatacatccagagatcaatggttaatgccatagatccaaccatataaaaacaaagttcttgcattgatgggagtattgttatgtctgtacattcctattggtcaatctgaatggaagaactatagacctacttatgccagagtaaactacttcaacattttctgagactggaaaactttatgatcagctaccaaagctggattatcatgctctgagaaagcaggaagattgttatgtgcagggtcggcagtggcagtccgacagaccgagtcattaccttcatcaacctgctcaactggtggaagagagtgttcctgatttctcttacaaaggtctcgcaaagcacccctatttgcccaaaaaagcccacaaacgttgcaaagtgaccttggaccaaatggccctcgccgcatcattggggtggattttgaactaatgccacaatgtgtacatgaggtttcagattgactatcatcctgtcctgaatcatggtcagtaccataactattaactccatcttgtttcttacatgaagtaaactggcccttgttacggtgcatcctgagcgcaacttcttgccgcacgctatatctcacttttttgtcaaagcatcgctctttcctcttctgcctgaacctatgtaatgaagcagctcggtgtggtagactacatttatgaaattccattgaacccctttgattatgttgagcccccgcgacagcaac

SEQ ID NO: 5609 - DNA, 793 bp, Glycine max
  misc_feature (1)..(1): n is a, c, g, or t
  misc_feature (462)..(462): n is a, c, g, or t
  misc_feature (677)..(677): n is a, c, g, or t
  misc_feature (793)..(793): n is a, c, g, or t
  Predicted polypeptide sequence is orthologous to G2094
naggtcgctcgtagaagacgccaggcgcgcaattaaccctcactaaagggaacaaaagctggagctccaccgcggtggcggccgctctagaactagtggatcccccgggctgcaggaattcggcacgaggcgcgtgtgtctgcgttgcgagtgtcgtcgttttgattcccctctctctctctctctctccaccttcactcactctgcatgcttcttcttcttctctcactctgattccgcgaaatcaaatcaaaatcagcttctcggaatcgaatctcagatctcggagatcagaaatggtggatccaactggaaaaggatcggagattgaagtcgaggactcaaactcaaaccctaacgctccttcctcagggaacagtccaagcagcaacaatgagcagaagaaaacctgcgccgattgcggcaccaccaagactcctctctggaggggtggtcctgcangacccaagtctctgtgcaacgcgtgcgggatcagaagcaggaagaagaagagagcgatcttgggaataaacaaggggagcaacgaggacggaaggaaaggaaagaggaccggcggcgctttggggaaggaggtgttgttgcaccgatcgcattggaagaagctcgagaggaagagagactgcggtcttggtgatgtcgctctcttatggatccgngtatgcctgaactgagccagaattaatcaattatgattatgattctaggtgtagatgaaccattattgaagaaaatacttgaatatggtgtaggatggtgcttccgctaacccctn

SEQ ID NO: 5610 - DNA, 660 bp, Glycine max
  misc_feature (14)..(14): n is a, c, g, or t
  misc_feature (32)..(32): n is a, c, g, or t
  misc_feature (56)..(56): n is a, c, g, or t
  misc_feature (630)..(633): n is a, c, g, or t
  misc_feature (643)..(644): n is a, c, g, or t
  Predicted polypeptide sequence is orthologous to G2094
atctttttctatgnacctccattactttcaancgcgcaattaaccctcactaaagngaacaaaagctggagctccaccgcggtggcggccgctctagaactagtggatcccccgggctgcaggaattcggcacgaggggcattccggtcattgagtagggtacattcacatagtcggttgttgtgctgtgtctccatttttcttttttggtgcatgcgagcgaggctttgcaaatttgttctagtattagtaacgattgatcgagtgaataatattggaaatgatggatctgaatgtgaatgagaaaaagaaatgttgcgctgattgcaaaaccaccaagacaccactctggagaggaggaccagctggacccaagaccttatgcaacgcttgtggaattaggtataggaagagaagggcttgttcgaggaagcgagaggagcagaggtggaagatgttgggggaagaggaacaggccgcggtgtgcttgatggccttgtcctctggttttgttttcgcttgattgcaaggcattccttaatttagtaatccacgacaatcctttttgatgtcgcatacctaaccttgtaaaggtcaagcctctgtttataacatggtggttctttctcnnnnaaaaaaaaannaaaaaaaaaaaaaaaa

SEQ ID NO: 5611 - DNA, 776 bp, Glycine max
  Predicted polypeptide sequence is orthologous to G21
gctctcttaccttttatttttatttaactctgtattttacttgaaaaaaagaaaagaaaaaaaaaaggctctaaaattctaatagttctcccaaaaaaatgattcctcaagcctaaagccactatcaactgcacacaaatgccaagaagaaaaagagcaaagtccattgtttccatcagggaaaagatctggaagatcaaacaaagtgtcatcatcattggtagagtgagaacttgaaggctcttgagtgttgtccattgagagagttgaagatgtttcttgttctgcttggttttgttcttgttcttgttcttcagttatttgacaatgcttaaccacctcaaaggcagtgtttgctgcttttgatgctgcagcttgaatgtccttaggagatgtgctagcaggccttggaagttcttgagccaattcagggaaattgaggtatgctgaatggcccttgatggctaaggcagccacatcatgtgctctagctgccatttctgctgtagggtatgttccgagccatattcttgatttctttcttggctcgcgaatttcggacacccatttgccccaattcctcatccttacacccctataagtagggtggtgattctggttgctattgtctctctgcctcttcttgcactcttttgagtcctctttattttctaatgaggtttgagaaatggttgagtcattttgaggggttttggtgtgttctttggtgcatgaatctttgtttgaggttggagatgttgatgatgatgaggagg

SEQ ID NO: 5612 - DNA, 1205 bp, Glycine max
  Predicted polypeptide sequence is orthologous to G2107
ctcactctatctcttttctccagcagcaccaaaaccacccaacactcgaactcaatatccattattaccaaaaaaaaagaaaaaaggatatcaaacacccttttcatcattaaaactctcagttccctctttccctatcaaaaccctttcccacaacactactcactccagtacaagaaaccctttttcaatttggtttcaacagcacacacacacacacatatatatatatatagcatgtttaccttgaatcattcttctgatttgtaccatgtttcccctgagctctcatcttccttggacacatcctcgccggcttcggagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggtttggtttttgttgttagttttttggagtgaacagtgtctgtactggttttttattagtagtacggatactagttataggtggaaagattgcgagggaccaaaaggaattttcttttgaacccttttttgtcaatgtaatcaatatcacgtatatcatgaagtgaatcccttcaagtttatgtataaattaaataaaagaaaaatctagttttggttatgaatctttgttaaagtaaaaaaaaaaaaaaa

SEQ ID NO: 5613 - DNA, 872 bp, Glycine max
  misc_feature (1)..(2): n is a, c, g, or t
  misc_feature (781)..(781): n is a, c, g, or t
  misc_feature (797)..(798): n is a, c, g, or t
  misc_feature (840)..(840): n is a, c, g, or t
  misc_feature (852)..(852): n is a, c, g, or t
  misc_feature (872)..(872): n is a, c, g, or t
  Predicted polypeptide sequence is orthologous to G2107
nnaaggatttatctctctgatacgcccgcgcgcaattaaccctcactaaagggaacaaaagctggagctccaccgcggtggcggccgctctagaactagtggatcccccgggctgcaggaattcggcacgagatgagaattacaaaaacaactgaatgagaaaatttgcaatgtcttacagttttatgatcctccctatatagctagctccttatatcgtctcggtcttggtacattttcgtactcctccgttcctaattatgtacaaaaaccaaaaacgaaagaagacaaagaacaaactaaacgcactaaattgtgaagctccacaaggatacctcagcatcatccttcacaaagttccagacatccctaacattaacatatgttacaaaagtaggcgatcttaaaggctcatccgccatactctgaagccactcacgcatgtcctcaaaaaccggtgcatctgccattgtaatttcatccaaatcacaaaaaactctcaaacctttgttgctattggaatcttcatcaaagctgacgtcacttctgctaacttcacaatcatcagcaacggcatcattcacaatactattctgtaactgctcgccgcagctgtcttccgccgcaatcgctacagcagccgccgccgccactcgccgtatctccttcgcatttgtcgacgccggcaatggcagccgccacgccgagtcggcgagttgaggcaagccgacttgccccgaagcgcgagcgcccgcgacgcgtggccacgtgcggccatctnaggcacttggatcgtnncagccaaaatcctggtgggacctgtcgtgggacacgaacctngagacccaattngtgtgtccttctcggactcn

SEQ ID NO: 5614 - DNA, 976 bp, Glycine max
  misc_feature (1)..(4): n is a, c, g, or t
  misc_feature (645)..(645): n is a, c, g, or t
  misc_feature (670)..(670): n is a, c, g, or t
  misc_feature (677)..(677): n is a, c, g, or t
  misc_feature (785)..(785): n is a, c, g, or t
  misc_feature (800)..(801): n is a, c, g, or t
  misc_feature (908)..(908): n is a, c, g, or t
  Predicted polypeptide sequence is orthologous to G2144
nnnnaaggcactgctaatggtgacgacgccaagctctaatatcgactcactatagggaaagctggtacgcctgcaggtaccggtccggaattcccgggtcgaccctcgtgtccgggctgtttccggattcgaacccatgaccaacaagtcaccaaggcacaactttaccgctgcaccagggctcgccctcgctcaaaagatcttatcaatgaaactggcagcagttaaccctagaattgatttcagcctcgacagtttattggctactgatggggcatctctaatggataataacttacctagcatggtgacacctctcatgtggccagaaatcccactcaatggcaaccggcagcattatcaacagcagtggcaattggatgcattccaccaacctctctgggagagggaagaagtcaaccataatttcatgactccggaaaactcacttttgagttatgactcgtcggcaaactcagcttctctgcactcaaatcaattgaagatggagctctgaaagcgtacagaagtcgtaccagtagctattagcctagtagtgtatatatcaaatatagtatttgcagttagctgtgatttgagtggtctcaactctccagatttagcagggtttccatgtcttctatntgtcagaggcggttggaaacctggnatttctntggcccggaagtaagatgaataattggcatgctattcttatataaattactatgtatactaactatagggtttattcaatccatgatgtgattgattcatgattgtanaatcatagacggacnntgtactgactataacataatacaaaaaaaaggcggctcgctctagagatcccagctacgtcgcgtgcatgcgagtcatagctctttcatgtgtcactaaaatcaatnaatggccgtcgtttacaacgcgtgactggaaaaaaactgcgtaaccaactaaatcgcttgcagacaac

SEQ ID NO: 5615 - DNA, 781 bp, Glycine max
  misc_feature (712)..(712): n is a, c, g, or t
  Predicted polypeptide sequence is orthologous to G2144
gcgttgggagcctctcgtagattacgccaagcgcgcaattaaccctcactaaagggaacaaaagctggagctccaccgcggtggcggccgctctagaactagtggatcccccgggctgcaggaattcggcaccagatggactgtaacttccctccgacagttgcacctgtcatgtggccagaaatcccacagaacggaaacagacaacaatatcagcaaccatggccgtttgatgcactccaccaacccctttgggggagggaagaagacaacactaatttcatgactccagaaaactcactcttgagttatgactcatcggcaaattcagtatctctgcattcaaatcagttgaagatggagctctaaagggaaactacaaaggtggtggtaccagtagcaattagcctattagtgtatataacaaatatagtattagcaattattcatgattggagcagcctaaacattcagcaggttttccctaactctatttggtcaaagtcagtgggaaacctgaattttattcagccagcaaggaaaaaaaatgggtttgctattttaattaaatatataactatcactatgtttactaactatagtaatcattcaatctttcaagtgatggattgatttagatggtaaaatcattgaacgaactattactgacctatcattgaagttggttgctttgttccaaaaaaaaaaaaanaaaaactggagggggggcccgggtcccaattcgccctatagtgagtcgtattacgcgcgctcactggca

SEQ ID NO: 5616 - DNA, 829 bp, Glycine max
  misc_feature (39)..(40): n is a, c, g, or t
  misc_feature (42)..(45): n is a, c, g, or t
  misc_feature (82)..(84): n is a, c, g, or t
  misc_feature (703)..(705): n is a, c, g, or t
  misc_feature (729)..(730): n is a, c, g, or t
  misc_feature (769)..(769): n is a, c, g, or t
  misc_feature (771)..(771): n is a, c, g, or t
  Predicted polypeptide sequence is orthologous to G2157
cacaaattaacaaaaccatcctaataactaaccttgctnncnnnntagctatgcttgcaagaaaaaccgtgagaaattaatnnncatagtacttaattcgcaagtcagtgagagattaaagacatgatcatattggcaagggtgatcagaaggaaggaggagggcgaggtggagctccccagaacacatcatgaggcatgttctgaccattgtgtagcaaattaggaggcaaattatacataggcattgaaacctgttcccccaaaccttgagattgttgttgctgctgctgctgctgctgctgttgctgctgctgctgctgctgctgcacttgcatttcctcctcaccttgatcatcctccagaggcaacctctcataagtggcattagcgaaagtggcggcgatcaccatcaccggtccggaggcgacgagagagcccgccacgttgccgccgacaacctgcccctgcccgccggctaggtagacggtcagtccggtggcgccggacggcgagggggacggcaaaaaggcacccgagagggagagtatctcgaacctcccgtggagggttatgacgccggcgggggcggcgggctggcggagagtgacgttggctacaatgccactcccgctgaggaccgacacgccacggtggcggcggttggcgaaggcggcgatgctctcggcgacatcgctgccggnnncgatttccaggacgtggcttcggnncgcgttggggctttccttagttatgactatgggcggctngngcttgttcttggaccccgctggcctgccacgtggcctccgaccgctgcttccgggctc

SEQ ID NO: 5617 - DNA, 900 bp, Glycine max
  misc_feature (175)..(175): n is a, c, g, or t
  misc_feature (648)..(648): n is a, c, g, or t
  Predicted polypeptide sequence is orthologous to G2213
gatgagttaaaattcaggttaggattacgcaagcgcgcaattaaccctcactaaagggaacaaaagctggagctccaccgcggtggcggccgctctagaactagtggatcccccgggctgcaggaattcggcacgagggatttgatcatttggaaaaatcaatatgacctttgtnaactactaccttcattcaatcatcttcagatgattctgttttgactttggtttggtagttgtaaacttttggctcactttcattgcacatgttgcttcaaaatgcttgaaaaggaagatcttaagcccccgttgggaacatattttgagtttcagactgaaagttttgaagaatggttcccatttcattgttaaaaaaatttgacacttcattcccaacttttcccgtgcattcttttgtagaacattaacactttcattacatgtttctttaatttatttgccctatgtattttgctttcagcctatgaggaatagcttggagggctaagaggaaatgcaggaaaactattctcccaactcagatataggttaataatattcactgattttatatttttatatctagacatatttatattacaggaatctataaatttattaatattcttgcaggcatctaaacaaaattgntactttttatttcacttggtttatatttttatatctagaacaaagtggtactccctatacaccctcttattttttaatctaagggttataaaaaggaatcctttgcaggtgggatatcaaacaaactccccttcctttattatttgccatcatattataaaaaaactttttttatgggggggctttcttgaccggcccattaaacttaagggggcttaattctctccgcggccccaaataaattttatttgc

SEQ ID NO: 5618 - DNA, 867 bp, Glycine max
  misc_feature (833)..(833): n is a, c, g, or t
  misc_feature (864)..(864): n is a, c, g, or t
  Predicted polypeptide sequence is orthologous to G2226
ggcaaaagcaaaagggtctgtatatgatgtctgtttacatatcaagaggatattatggacaaacacaattatcccaaaaaagtagatccctcgactcatatgtggcaacaccagatacagagaaacaaaggaaaacaagaccctccacacactttaacaatcataaaaaagtaaagggttaaaaaagttagagccaagaccaagggaacatcaacactgccacaactatgtacatacaatatatactgtacatgaatatatctcttttcttttatatgtacatgtttttttaccaaaagcaagatgcatcatcttcaggcatcaaggaagtcctgcaaagtgggcatgtaatgttccaatagtccaaccacttctccatgcacactttgtgaaaaatatggccacatgataaacagtttatctcagattctggttcaaactttgtgagacacacacaacaacattcatgttgaggttgtttactgccacacatgctgccaaacctaagtgttggtgtcctgcttctgaactcttcaatgaaaccctccgaggggctgaggttgaattctaatggctcaggtgggtttcgggagatgtctggtgaaggagacaacgacgaaacgcggataccgacaatttgtagaattgtcctaacaatgcctttgaatatggatatagacaaggcagtgtttacaagaagcacacataacactccttcagatggtgctgggagacttgacaggcccattttgataccaaattgtgttggttgcaagtggatgatgattttttctctttgaatctgaaaccagcagaatgaacaaattgctatngtcacttcatcaatggaaactcttcgacagncac

SEQ ID NO: 5619 - DNA, 757 bp, Glycine max
  misc_feature (1)..(1): n is a, c, g, or t
  misc_feature (704)..(704): n is a, c, g, or t
  misc_feature (756)..(757): n is a, c, g, or t
  Predicted polypeptide sequence is orthologous to G2226
naggatgctgttgattacgccaggcgcgcaattaaccctcactaaagggaacaaaagctggagctccaccgcggtggcggccgctctagaactagtggatcccccgggctgcaggaattcggcacgaggctgagagttacattgaagagttcagaagccggacgccaacacttcggttcgacagtgtgtgctgctgtaaacaacctgagcatgactgctctgtatgcctcactcagtttgaaccggaatcggagataaaccgcttatcgtgcggccatctcttccacaaagtgtgcttagagaagtggctggactactggaacattacatgccctctttgcaggactcccttgatgcctgaagatgacacaccttgctttcagtaagcaaaaacaagggagcatggcaataagagagagtttcatgtacagtgtagtgtacatattcttgagggtttttgatgttcatgcatctgagttctgccacctttataagtttttaacctttttccttttatggtctgagtttgtggaggattttgtttttacctttatctgtctgtgcgtctatagacacatgaggaggatactggttgcttgcatgtaatgtttgttcacaatgcacaccttgtttagaccaccttaaatgtctatatgtgggcagttttgatcctaagtaaggaagcatggattgtagactccatntggtttggcctttcaactctgatcggcgatgtgtatatatagtgatgtgtgnn

SEQ ID NO: 5620 - DNA, 1055 bp, Glycine max
  misc_feature (1)..(1): n is a, c, g, or t
  misc_feature (22)..(22): n is a, c, g, or t
  misc_feature (29)..(29): n is a, c, g, or t
  misc_feature (739)..(739): n is a, c, g, or t
  misc_feature (832)..(832): n is a, c, g, or t
  misc_feature (906)..(910): n is a, c, g, or t
  misc_feature (912)..(918): n is a, c, g, or t
  misc_feature (921)..(922): n is a, c, g, or t
  misc_feature (925)..(926): n is a, c, g, or t
  misc_feature (929)..(929): n is a, c, g, or t
  misc_feature (934)..(934): n is a, c, g, or t
  Predicted polypeptide sequence is orthologous to G2239
naacatgcccatcggcggatgnacactcntatagggcgaattgggtaccgggccccccctcgagtttttttttttttttttttttttttttttttttggatttaagaatctatcgggattcaggatttcagttatttatcttcaaacgcaaaacaagtgtgccaaatattatacacatcttacaaattctagcgtaaaaaaatcgtggcagcaaaaaataattggtaaatacaataaaatattgaaatcttgcagaagggggaatcaaaactcaaacagactccacagcaggcggcggaggcaaagacgcagcagcggaagttccttcgccaccgttattggccaccctgggcgacctaatcgacgacgctctcaccaaaaaaggcggcgccatggtgaaaacccaccggtccgacttaaacccccggtccaaccgccttgacgatctccctctgctacttccttcaccggttcgatacccccgccgcgaactaccttctctcggtaagataacgaggcttctcgcgcgatgcagttgcgggttctgcaatatctgctttctaacttcctcgggaagccgcaaagtgaaccgttcagtgtcttcgcccggcaggactaaagaatgaccggtcgagtgagaccgcgggaatcgccgcggccggcccgaccgggagcctctggtgggttccggttagcgtctgttttatgacagcacttgaagtcagtgggaacggaggcntgggggtctgctgtgctgtcggctccacgaggcgtttgggcttcggtgggcctatgtctcaaggacgttaggattggatcgtgacgactcccngctgaaggacagtgcgcgcaaacgggcagggtgtgagtagcatcctactcactccccctctttctggggaggtnnnnntnnnnnnnttnntcnnttnctttnttttcttcttctcctctcctcctcctcttccttctctctcctcttctctcttctcctctctctctcttcttttctctctctctcttcttctctcttctctttctttctctccttctcctcc

SEQ ID NO: 5621 - DNA, 763 bp, Glycine max
  misc_feature (670)..(670): n is a, c, g, or t
  misc_feature (690)..(690): n is a, c, g, or t
  Predicted polypeptide sequence is orthologous to G225, G682
gggctgagctgctagtggattccgccaagctctaatacgactcactatagggaaagctggtacgcctgcaggtaccggtccggaattcccgggtctacccacgcgtccgggaaatcgagggtcttccaaagttgaattttctgaagatgaggaaaccctcatcatcaggatgtataaactggtggtctataattgctggaaggattcctggaagaacagcagaggaaatagagaagtattggacttcaagattctcgggctctagtgaatgaagctccggagtactacgattggtgttcagtctaggacgagcaagaagattttgggtgcaagattagtgtgattttgtgggacataaaaactgaattaaagttggcatagtttataggtatttgtattggctataaaaaaagaagtggggcagcaactatagaagctggtttgtgttatatttctccatcttgaaatgttccttggtgtgatattttccatcttgaaatgttccttggtgattggtcttttctgaattgtacttagtgctgttcatcttcgtgtatcttattcatttaccattttggctttttatcttgcgtctgaaatctgtattggaaatgagaattaattagagacaggttcagtattgtcaaaaaaaaacaaagaaaaatatatnatttcctgggttgctttgtngtattgtcgcatcgtaagatactgatcgatcgtatcgtgtataaaaaaaaaagaaaaaaaaaggggggggcct

SEQ ID NO: 5622 - DNA, 874 bp, Glycine max
  misc_feature (1)..(3): n is a, c, g, or t
  misc_feature (687)..(687): n is a, c, g, or t
  misc_feature (702)..(702): n is a, c, g, or t
  misc_feature (710)..(710): n is a, c, g, or t
  misc_feature (792)..(792): n is a, c, g, or t
  Predicted polypeptide sequence is orthologous to G225, G682
nnnaattgcttgtcatttgtaccctcactaaagggaacaaaagctggagctccaccgcggtggcggccgctctagaactatgtgtatcccccgggctgcaggaattcggggcgagattcaatatacaacactgaaactttcaaagctcttttgagaacttgttattgcaatggctgacatagatcgctcctttgataataatgtttctgctgtttctactgagaaatcaagccaagtttcagatgttgaattttctgaagctgagaaatccttattgccatggtgtataatcggtgggagaggtgtctttgattgctggaagaattcctggaagaactgcagaagagatagagaaatattggacttcaagattttcgactagccaatgatcggtggcagaaaacgaagcaaggaaatttttggtgcctacaagtcattacagtgactttgtggggatatgaaatggaaattgatcctattaatcatatgggtacttatatttgcattttgcggtaaccaacaaaaaggggcatgccattctaaaagcccttatgtgtaatgttacttaattttatctttgtaatgttcccaagtgttttaggcaatctatgattcagatctgctcgatcatggcaagaacagtatgtacttaattaatgcagatcacctgcatgtgcatgtgtaaanaaaaaataaataaanacaatatnattaataatcactccgagggggggccaggaactccaattcgccctatagggagtcgtattacgcgcgctcacttggcgtcgntttacaacgtgtgactggagaaaccctggcgtaccccactaatcgccttgcagaacatcccctttcgcagctggcgtatagt

SEQ ID NO: 5623 - DNA, 931 bp, Glycine max
  misc_feature (7)..(8): n is a, c, g, or t
  misc_feature (60)..(60): n is a, c, g, or t
  misc_feature (644)..(644): n is a, c, g, or t
  misc_feature (662)..(662): n is a, c, g, or t
  misc_feature (664)..(664): n is a, c, g, or t
  misc_feature (742)..(742): n is a, c, g, or t
  misc_feature (770)..(770): n is a, c, g, or t
  misc_feature (813)..(813): n is a, c, g, or t
  misc_feature (879)..(879): n is a, c, g, or t
  misc_feature (928)..(929): n is a, c, g, or t
  Predicted polypeptide sequence is orthologous to G227, G242
gaattanntccccccccccccccccccccccccccccccccccgaaggaactgaacgagnagcttatctcaagcgcgcaattaaccctcactaaagggaacaaaagctggagctccaccgcggtggcggccgctctataactagtggatcccccgggctgcaggaattcggcaccagaccatagcccgattattaccgggccgaaccgataacgccgttaagaaccactggaactccacgctcaagcgcagagccaagggtattaacgttaatgttaatgatgccgacaacgaggatgacccgttgaccgcattgactcttgctcctcccggtattgctaatgccactttgaccgaagacgccgtaccggaccaccgggcctcgccggagagtgcggcggaggggttttgggatatgatgagggatgtgatcgcgagggaagtgagggaatatgtgtcttctaatttttctgataataactagggttttcattaaatcaatcatcataagcataatttgttattatgtcttccttttttttttaggcaaattattctgcaatttgattttgccttactggactttggaatcggatcagggaaataaattaaaacccttctggcttctgctgttaataacaactntctcttgttgtgaatcananaaaaaaaaaaaaaaactcgagggggggcccggtacccaattcgccctatagtgagtcgtattacgcgcgctcactggncgtcgttttacaacgtcgtgactggganaaaccctggcgttacccaacttaatcgccttgcagcacatccncctttcgccagctggcgtaatagcgaagaggcccgcactgatcgccctttctcacagttgcgcagnctggatggcgaatgtacgcgccctgagcggcgcattagccgccgcgggnngt

SEQ ID NO: 5624 - DNA, 956 bp, Glycine max
  misc_feature (32)..(32): n is a, c, g, or t
  misc_feature (40)..(40): n is a, c, g, or t
  misc_feature (769)..(769): n is a, c, g, or t
  misc_feature (794)..(794): n is a, c, g, or t
  misc_feature (827)..(827): n is a, c, g, or t
  misc_feature (850)..(850): n is a, c, g, or t
  Predicted polypeptide sequence is orthologous to G227, G242
cccccccccccccccccccccccccccccccnagctgggnctcggagctagacatctgcccccgccactaaccctcactaagggaacaaaagctggagctccaccgcggtggcggccgctctagatctatgtggatcccccgggctgcaggaattcggcacgagggagtcgcctcgtgtttccgtttccgtttcaatttcctctcacaggctttaaccttaccagctcgagataagacatggaccggatcaaaggcccatggagtccggaggaggacgaggctctgcagaagctggtggagaaacacgggcccaggaactggtctctgatcagcaagtccatcccgggccggtccggcaagtcctgcaggctccggtggtgcaaccagctgtccccccaggtggagcaccgggccttcacggacgaagaggacgacaccataatccgggcccatgcccgcttcggcaacaagtgggccaccatagcccgcctcctccacggcagaaccgacaacgctatcaaaaaccactggaactccaccttgaagcgcaagtgctcttcaaccatgatcgacgacaacacccaaccgctgaaaagatccgtgagtgccggcgcggctattccagtctctactggactctacatgaacccgcccacaccgggtagtccctccggatacgatgtgagctgagtcagcttacctgttgcatactcttcgcacgtgttccgtcctgtgcctagaaactgcaaagatctaccatccgtaganaccacgtcgtcctccaatgaccctncaactttactttctctatcacttccccgttgtnggtgtgttgactaatcgaagctncaatcggaccactgagccgattcatttacacccgccatgccacatcgtcgatactatgcctctgctggcaatgatgacgtcgtttcagcgacggggatagcgcgct

SEQ ID NO: 5625 - DNA, 702 bp, Glycine max
  misc_feature (1)..(1): n is a, c, g, or t
  misc_feature (238)..(238): n is a, c, g, or t
  misc_feature (427)..(427): n is a, c, g, or t
  misc_feature (444)..(447): n is a, c, g, or t
  misc_feature (533)..(533): n is a, c, g, or t
  misc_feature (570)..(570): n is a, c, g, or t
  misc_feature (671)..(671): n is a, c, g, or t
  Predicted polypeptide sequence is orthologous to G227, G242
nggggaggaagggtcccccattacgctcagcgcacaactaaccctcactaaagggaacaaaagctggagctccaccgcggtggcggccgctctagaactagtggatcccccgggctgcaggaattcggcacgaggaagcaaccaacagaagctcttcctccacttcctcttcctctgattgctgctcttccgagtccaaccccaacaagcccgacagaatcaaaggcccatggagccncgaaaaggatccggatcctgaccggaactcgtcgaacgatacggccacgaaatttggtccctcatcagccgctacattaggggaaaggtccgggcaagtcatgccggcttcgaaatggtgcaatcagcttaccccccgcccggtggagcaccggcccctttctcggcccaaagaggacgacaccatctntcgcggccatggcccgnnnnttggtaaaaaagggtgggcccactatagcccccgattggtaccgggccgaaccgataaaaccgccggtttaaaaccactgggaacntcactcttaagccaaggccaaaaggggttttaaaatntttattgtattagcaaaacaacaaaaaaaaagggggttgggtttttttttttccgcctctcttccttccctacaaaaggagaagaggaaagaaaacgtggnaacccccggttggtcttccttccctctttta

SEQ ID NO: 5626 - DNA, 779 bp, Glycine max
  misc_feature (779)..(779): n is a, c, g, or t
  Predicted polypeptide sequence is orthologous to G227, G242
gggtcagctctaatcgactcactatagggaaagctggtacgcctgcaggtaccggtccggaattcccgggtcgacccacgcgtccgcggacgcgtgggtgggccaccatagctcgcctgctcaacggccgcaccgataacgccgtcaaaaaccactggaattccactctcaagagaaaatcctccgccgttagtgacgacgacgtcgtcacgcatcgtcagcctcttaaaagatccaacagcgtcggcccggcccacttgaaccctgccagcccatcagtctccgatttgagcgatccgggccttcccgctctgtcaaacccctcaccttcggcccattacatgcccaatctcatggaaactgcttcttccgctcccgatccagccacgtcacttagtttgtctctccctgggttcactgtacctcaaccagtgtctccgccgccgccgccactgccactgccggcggagacggtggaggagcgagggaagcaaatgttcaacgcggagttcttgagagtgatgcaagagatgattaaaaaggaagtgaggagttacatgtcatggatggaagaacagaagaatggggtcagaatgcaaaccgaagccattgggaacgcgtggtgaagcgcattggaaattgcaacattgagtggagaaaaagaaaacggtgtggtttcgggattcgatgcagcgcacctgcgacgtgatgatgatgaagtcacaagagtggagaaagggagaacgagaatggggaacggaggtgagagtgttcaattn

SEQ ID NO: 5627 - DNA, 782 bp, Glycine max
  misc_feature (782)..(782): n is a, c, g, or t
  Predicted polypeptide sequence is orthologous to G2343
accttgttggatcaccacaagcgcgcaattaaccctcactaaagggaacaaaagctggagctccaccgcggtggcggccgctctagaactagtggatcccccgggctgcaggaattcggcacgagggggacacagccaagaagatagtctgcaaggaaattttgaattccttgaaggatggcggtgctcataaggacacagccaagaagatagtctgcgaggaaaaattaaattccttgaaggaaggagaatcaaatggtgcataagtttgaaaaacttgtgtactgtgcacaagggttaacctgtcattgtagggctattttgcaggggtataaagtgggggtagttaaggttatactttattttgtattggcttcttggaatataaatacattataaccatgtggggttgttgcaggcatatgcttcgctattgaatctgatgtaaaagggtttttggtacccctggtccatttattagttatatatcatttatttcgccgattcaaaaaaaaaaaaaaaatactcgagggggggcccggtacccaattcgccctatagtgaatcgtattacgcgcgctcactggccgtccgttgaccacgtcgtgactgggataacgctggcgttacccatcttaatcggcttgcacacatccccctttcgcagctggcgtattacgtagatgcccgaccgatcgccttccaacattgcgcagctgaatgcgaatggaccgccctgtagcgcccttaacgcggcagttttgttggaccccacactgacn

SEQ ID NO: 5628 - DNA, 657 bp, Glycine max
  Predicted polypeptide sequence is orthologous to G2394
cagccaacttaagttccagcgagataaagaaaatatatgaacaaaaatgaaatggaatgattgacctcaggatcaaacatccatccaatgaagagttggtagcataggaaaagctttacaagactacaaagtgtgtatatgactctatgtatataaactacattacgatgaggtgttggtgaggccattctcaaccctgctttcaccctcatgttggttggcatctaccccagagactgatcctcttacgttctcactaacctcactcttgcaaagggggcataaagcatttatcttcaaccacttgtcgacacaatctttatgaaataggtgagaacaaggcaattctctcagctcatcgttattttcatacttagccaggcagatgcagcaagctgcatcttctccagagatcatacgttccttttcagttcctgcagccacaactccaccttcaccaacagctgagttgctttcccctttgcttttatttctcttcattttgaacttataagtcggcagagcattaattgattcagaggatgcacctcgggtttgtgccatatcctctctaactccaaggatggaaattatacaaggcaggcagcagcaaattgttgcacagagaatgaagggcatagcataaccgatgcagct

SEQ ID NO: 5629 - DNA, 760 bp, Glycine max
  Predicted polypeptide sequence is orthologous to G2394
ggatagagcttgagcatgattacgccaagctctaatacgactcactatagggaaagctggtacgcctgcaggtaccggtccggaattcccgggtcgacccacgcgtccggttgacaaatggttaaagataaatgcaacctgccctctttgtaaaaacgaagttggtacgagtaatggagggtccccttcagcctggaactccagtacgtagctgaaggcacgtatcccccatcaagttgcagcttttcaagtgtacatcatcaaacttttggattctgctttcaaggtgagatccaaggatagatgcaaatcaagtaattcctttaaacatgtgatgttacgtgctagtgaaaggttgagaatgtgtttctacccgctctggtcacctctctttttgcgcttttttcaccggttttacatactcaccaagtattgtttgtagaaaataggatgtttcaaatctttcttcgtttatcagttctgtatatataacaatttctagtgaaaatgttaatttttttttttaaaaaaaaaaaaaaaaaaagaaaaaaaagggcggccgctctagaggatccaagcttacgtacgcgtgcatgcgacgtcatagctcttctatagtgtcacctaaattcaattcactggccgtcgttttacaacgtcgtgactgggaaaaccctggcgttaccaacttaatcgcttgcagcgcatccccctttcgcaactgggttattaggagaaggcccgactgatgggccttgca

SEQ ID NO: 5630 - DNA, 877 bp, Glycine max
  Predicted polypeptide sequence is orthologous to G241
agtaatgaacacacacacctttattataatcacatcgagtaacagtcgtaatggacacactttattaatttctatctaggaaattaattcaagtccaaacaatagaagaacaatgacatgatcttttgttttccgttgaatgaaggacttggtctctactaattaagagcaacattaactaacatcacaattccaataactgcgtaaattcctcagctctggcataaacattgcaccaaaagtccatgccgtcgtcgcacacactcgacgaactagcatctataaggaccccttcttcggtcattagaggagacatcggtagaaactgatgatcatagtcaatggtcggaaatccgcttgttgtctcaccggaattatcagacgacaacacttccgaccagaaatcctcgtccaatgcaagattattctccggcgtgtcgatatcatcattaacatttaaggacatgtcatggttattgttaatgctaccgttgttgtcactagtggtgagggaggaggaggacatgtggctagaacattgtggaggagatagtggcatcatgtcctctgagttcgatgcatgaaagggaaaattattattcacgggctcttgttgttgttctagtttggcgtcttggtttgatttggaggcgtccacatctaactttggttgttttttgcttcgttttttctggtcgtggctttgtttataattttgtggcagcctcttcttcaagtgggtgtgccacacgttttttatctcgttgtctgttctccctggcaaccttgccgctatagccgaccatctgtttcccaacatttcatgcaaactgattatggtgtcctcttcttctctggaaaagttgccccgtttgat

SEQ ID NO: 5631 - DNA, 1014 bp, Glycine max
  misc_feature (1)..(2): n is a, c, g, or t
  misc_feature (816)..(816): n is a, c, g, or t
  misc_feature (914)..(914): n is a, c, g, or t
  misc_feature (1014)..(1014): n is a, c, g, or t
  Predicted polypeptide sequence is orthologous to G2457
nngggaatggccatgaactagcgcgctattttaccctcactaaagggaacaaaagctggagctccaccgcggtggcggccgctctagaactagtggatcccccgggctgcaggaattcggcacgaggcagcgcgtaccttctgcttataaccagtttataaaggaagagattcagaggatcaaagccaataatcctgatatcagtcacagagaagctttcagtacagttgcaaaaaactgggctcattttccccatattcatttcgggctgatgttggagagtaacaaccaagctaagatggataatgtttctgaaaagcatttaatgccaagggctgcgctattgaataaatgaaggctatcttcatcatatcacaggacttgatcatgagtttcatttgagtctgtcaagtaaacaatgtccctgcctcataagggagttttaagggacaatcatctctatcttcttcgttagtggacttggtactacttactaccttggtcaatggatgttttcacttaatttgaagcataaacaaaaaaaaaaaactcgagggggggcccggtacccaattcgccttatagtgagtcgtattacgcgcgctcactggccgtcgttttacaacgtcgtgactgggaaaaccctggcgttacccaacttaatcgccttgcagcacatcctcctttcgccagctggcgtaatagcgaagaggcccgcaccgatcgctcttcccacagttgcgcagcctgaatggcgaatgggacgcgcactgtagcggcgcattaagcgctggtgggtgtggtggtacgcgcagngtgactgctacacttgccagcgccctagcgaccgctactttcgctatctccatacctttatcgcacgttcgccagctttcacgtcagctctaatcggnggctcctttaggtccgtatatgcttacggactcgactcataacttgataggtgatgttacgagtggctcgcctgaagacgtttcgcctggacgtgatccn

SEQ ID NO: 5632 - DNA, 952 bp, Glycine max
  misc_feature (5)..(12): n is a, c, g, or t
  misc_feature (34)..(34): n is a, c, g, or t
  misc_feature (39)..(39): n is a, c, g, or t
  misc_feature (45)..(46): n is a, c, g, or t
  misc_feature (625)..(625): n is a, c, g, or t
  misc_feature (711)..(712): n is a, c, g, or t
  misc_feature (752)..(753): n is a, c, g, or t
  misc_feature (761)..(762): n is a, c, g, or t
  misc_feature (775)..(775): n is a, c, g, or t
  misc_feature (794)..(794): n is a, c, g, or t
  misc_feature (802)..(802): n is a, c, g, or t
  misc_feature (827)..(827): n is a, c, g, or t
  misc_feature (835)..(836): n is a, c, g, or t
  misc_feature (859)..(859): n is a, c, g, or t
  misc_feature (919)..(920): n is a, c, g, or t
  misc_feature (922)..(925): n is a, c, g, or t
  misc_feature (927)..(929): n is a, c, g, or t
  misc_feature (931)..(931): n is a, c, g, or t
  misc_feature (933)..(933): n is a, c, g, or t
  misc_feature (937)..(937): n is a, c, g, or t
  Predicted polypeptide sequence is orthologous to G2510
ccccnnnnnnnnccccccccccaggtgtgatggnaaacngtacanngactatcccctccagcgcgctattaaccctcactaaagggaacaaaagctggagctccaccgcggtggcggccgctctagatttagtggatcccccgggctgcaggaattcggcacgaggattaatggagcaagagcttccacgcagtagcgtccccgacgacgccaccgccgccaccacgagctccgttgacaagcccgccactcctcacgccggaggcacccgccacccgctcttccgcggcgtccgcaagcgccgctggggcaaatgggtctccgaaatccgggagccgaggaaaaagtcacgcatatggctcggctccttcccggcgccggagatggcggcgaaggcctacgacgttgccgcctactgcctcaagggctgcaaggcgcagctcaacttccccgacgaggtccaccggcttccgccgctcccctcctcctgcaccgcccgggacatccaggccgccgcagccaaggccgcccacatgatgatggtccaggctgcctccgccgactcgccggagaaaagcagcagcattacctccgactgcgacggcagcggtggtgacgacttctngggcgaaattgagctgccagaactgctcaacggcaagtggtgggcctccgaccgccacgtaacgccgtggccggagactgagcttnncgcccagctgcccttcaccacggcgtgcttgtagtagttnngtataatnncatatgctcttcncatgctctcatgacttggntggtatantagtacatatattattgctcatatnattaagtnnactctctttgtgtctcttcacantaattaataaattctaattgtgatgatcaaatgtagtggctgtaaaaaaataaaaatatnntnnnncnnncncnatcnctctcacttcatctt

SEQ ID NO: 5633 - DNA, 787 bp, Glycine max
  misc_feature (1)..(1): n is a, c, g, or t
  misc_feature (633)..(633): n is a, c, g, or t
  Predicted polypeptide sequence is orthologous to G2510
ngagatgcgctgtagaagacgacgcgcagctctaatacgactcactatagggaaagctggtacgcctgcaggtaccggtccggaattcccgggctattatgtacattaaaatctacgaataatggagcaagagcttcaacgcaacagtgtccacgacgacgaagccgccaccaccacgagctccggcgacaagcccgccacccctcgcggcggcggaacccgacaccccctcttccgcggcgttcgcaagcgccgctggggcaaatgggtctccgaaatccgggagccgaggaaaaagtcacgcatatggctcggctccttcccggcgccggagatggcggccaaggcctacgacgtcgccgcctactgcctcaagggccgcaaggcgcagctcaacttccccgacgaggtccaccgtcttccgctgctcccctccgcctgcaccgcccgcgacatccaggccgccgccgccaaggccgcccacatgatgatagtccaggccgcctctgtcaccgccgactcgccggagaaaagcagcagcattacctccgactgcggcgacggtggcggtggagacgacttctggggcgaaattgagctgccagagttgctcaacgccaagtggtgggcctncgaccacgacgtcacgccgtggcccgagtacgagctcccgccccagcagcccttcaccactgcgtgcttgtagtttgaataagaataatgctcttcttcaagctccgacttgggtgtatattattatatatattagtatttgctcatatcataa

SEQ ID NO: 5634 - DNA, 588 bp, Glycine max
  Predicted polypeptide sequence is orthologous to G2535, G961
cataattccagtagagatgggcacggacaatgaagggacattcacaacgcaccaggtgagtggtggtgacccaaacaacaacaacaacaacagcaacattgttcatccattggaggtaggatcaggtggtggaggcctcaccaactgggctgcgctggaccgtttagttgcatctcaactcaatggccaaaccgatgcctcttttttctaggatgtgctttcaacgaccccaccatgtattgcaccagcgtcgaccatcatgatcttcatcatcaaatccccaccctccgatcctcatcaacgtccgctaacacacgaccttcccctgcacccgcattcatcaaccccccaacacaggacttcaccagcgagattgacctttggaacttctcccgatccacgtcctcactgttggcatcctccgaaccactgtgccacgtgtccaacacgtcagtgtagcgagatcaataaaataataatataaaaaaaaatatctcaagtcccccttttcctccatgttcgattgttaaatatagaaataattagcccctacttcatcacatatcatgtttaatatttaatattagt

SEQ ID NO: 5635 - DNA, 900 bp, Glycine max
  misc_feature (643)..(643): n is a, c, g, or t
  misc_feature (659)..(659): n is a, c, g, or t
  misc_feature (666)..(666): n is a, c, g, or t
  misc_feature (672)..(672): n is a, c, g, or t
  misc_feature (685)..(685): n is a, c, g, or t
  misc_feature (710)..(710): n is a, c, g, or t
  misc_feature (714)..(714): n is a, c, g, or t
  misc_feature (785)..(785): n is a, c, g, or t
  misc_feature (857)..(857): n is a, c, g, or t
  misc_feature (883)..(883): n is a, c, g, or t
  misc_feature (894)..(894): n is a, c, g, or t
  misc_feature (896)..(896): n is a, c, g, or t
  Predicted polypeptide sequence is orthologous to G255, G664
ggatgatcgctctgattacgccacgcgcgcaattaaccctcactaaagggaacaaaagctggagctccaccgcggtggcggccgctctagaactagtggatcccccgggctgcaggaattcggcacgagccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccacagcctccttggcaacaagtggtctctaattgctggtagattgcccggtagaactgacaatgagatcaagaattactggaatactcacatacgcaggaagcttctgagcagaggtattgaccctgccactcacaggcctctcaacgattcttctcatcaagaacctgctgctgtctctgcccctcctaaacatcaagagtcctttcaccatgaacgctgccctgacttgaaccttgagctaaccattagtcctcccccatcatcctcaacctgatcatncgcacttgaagacctngtgacanactcanacctttgcttccnctgcagtctggttgcataatagcanaganggtacgtggccctcacactatactgccacgctactgctactgctatgatcttgcctgaaaaacgacgcgtntgatacagaccctgacatgaatgaatcatatactgaatctcttctttcttcttcttctttctcctaataatnctactactactactacttactactgntatgttgatgntntaat

SEQ ID NO: 5636 - DNA, 856 bp, Glycine max
  misc_feature (42)..(45): n is a, c, g, or t
  misc_feature (747)..(748): n is a, c, g, or t
  misc_feature (791)..(793): n is a, c, g, or t
  Predicted polypeptide sequence is orthologous to G2550
gcactcatagattgatgtagaataagagaagaagatcaaccnnnntttttcctctcaacctatacatgacaacaaactattgcatttcattttttttcgtttcctcaaataaatgccaagcatttaatatcccaaaaattaagttaaatataaaataaatgttcatttagcagcaggtcacataatcttctacgttatacagattgctcatctacaaaaccatgcatcattcattcacctacaacctttctacagcttacaacagttattaaccagggttatcattttatcaacatcaacatcaaatccattattctgatctacaagctggaacggtgatcatcagatatggtctcttcagaagaagtgtcactatcaatgatgatcaagttatccggtttgtggacacgttgttccagagacttgttcatcttcaccaccccatattttcttcttgaataggttgaatagtgagacccatttgacatgtatatctcatttggcgtcaaaccattgaaccaattttgaggcacaaagcatgacttaccagcactaaagcatcgatctgaagttcctggtatctcaggatgagaactcaacgaaatcgctgcagacatatttggttgaataggaggagtgttaactgcttctctgagccagtgaggcaaactatttgtcacagccgaacaattaaaggaataatcgttcgagtaagagttttccctagaaatgcccaagcttcctggnnaattgaaaaatcctaattcatacttgtctatattgttgtaagnnncctttctggaatgaatagttggcctatgactgtgtgcagtggtgttactttgaaaattatatc

SEQ ID NO: 5637 - DNA, 798 bp, Glycine max
  misc_feature (32)..(33): n is a, c, g, or t
  misc_feature (93)..(95): n is a, c, g, or t
  Predicted polypeptide sequence is orthologous to G259
taaaccacattacataactacagcatatgctnnaggggtgtcttaattagtttcttgatgcacccaatatgatagccaaaataactacaacannngggcaaaaatactctttgcaagcctagcaagctaattaatcaaatatttgattattactcttcagtatctatacccaatacttttaaaaagcctctatgtatgatatcatatctagctatttgcatgactgagacaacataatgcttgtgctttcactcatctcagccctattcctcttcatctccctccctccttgaacctctaatctcactccaaacaacattggcctttcatcctttttctcctcctttgcatgtgatgaatatgtggcaaccaaatcaagcagttccttgcacttccttttcatgcttgtgagctcagagttcagcaccccattctccttcttgagtcgcttgttttcatccacaagagtagtgtaaccaaaagatgatgaggttgatgaggacctttgatcctcatcagagtcttggggtgtgccttggtttggtgcattaggttgttgcttgctgctccaagctttccttcgccgaatctcatgtagaagttctctttcacctttcttgaacttgtcattgaaaaactcccatctgcttgttgcaactttacgaaagccataagtattgagctggcgtacaaagctagagaagttgctgtgcttgaagagtgttgggaggagatcccgagcaaactccggcggctgccacaccacgaacgccgtccctttggcattccacgaaatga

SEQ ID NO: 5638 - DNA, 1022 bp, Glycine max
  misc_feature (536)..(536): n is a, c, g, or t
  misc_feature (555)..(555): n is a, c, g, or t
  misc_feature (678)..(678): n is a, c, g, or t
  misc_feature (686)..(686): n is a, c, g, or t
  misc_feature (1022)..(1022): n is a, c, g, or t
  Predicted polypeptide sequence is orthologous to G2604
agctatgccttttgcataaactttgctgctaattatcccaagcgcgcaattaaccctcactaaagggaacaaaagctggagctccaccgcggtggcggccgctctagaactagtggatcccccgggctgcaggaggaaacattggtagaagaaattggagagagagagagagagagagggttggattggttttcttcttcctcttcctaaagagaatctaatctcaatcctcattacacacatatctacagatttcttcattcctctctcaatcttttctgttttcttttcccctctttgacatcctcgttttcgccgaaacaaaaacaactaagattttgttttttgttgtatttttcttcctgttgttatttgactcggttgtctgaatcagttgttgcagcagggtcgggagccacagctatgcagagccaagttgtgtgcaatggttgtaggagccttctgctttacccaagaggagcaaccaatgtctgttgtgcattgtgcaacacaattacctctgttcctccacctgngatggaaatgtctcaactntattgtggaggttgtaggacattgctaatgtacacacgtggagctacaagtgtgagatgttcctgctgtcacactgtaaaccttgttccaccagcatctaatcaagtggctcatgtccattgntggaactngccgaccacactcatgtatccttatggagctccctcagtcaaatgtgctctttgtcacttattactaatacaaacaatggaaggcttccaatcccctgccatagaccccatgggacaaacaatgctgggacattaccctctacatcaacattcatgcccccatctaaagttaaaacgggtgtgtagaaaatccaatgcttgtggatcaaggggggaaatggtggagcatatgttgtgttgcggtccaacgggtaagaattaccttattccactttaaaaggtcccgtcccgtcatggacgcatcccccattgctgccccgggaagaatttgtgggn

SEQ ID NO: 5639 - DNA, 886 bp, Glycine max
  misc_feature (1)..(1): n is a, c, g, or t
  misc_feature (12)..(12): n is a, c, g, or t
  misc_feature (17)..(18): n is a, c, g, or t
  misc_feature (65)..(67): n is a, c, g, or t
  misc_feature (71)..(71): n is a, c, g, or t
  misc_feature (326)..(326): n is a, c, g, or t
  Predicted polypeptide sequence is orthologous to G2604
nagtgacgaacngtcanngcactagtccgagtcgcgcattggctattactacacgggggcaaaannngaanctctaccgcggtggcggcctctctagaactagttgatcccccgggctgcaggttttccttcgcttttatttctctctctacttagtcagcagcaactggcaagttatcacaggacatgttataatctaatgtattttccccttccacattacataaatacaacttccactgaaaggccttaactcttagtctttcttattccttctggaatcctcccctttagtttcattcataaggggaagaagcaactcattntgactcttactttatcatctgctttaccatttgatttgctggcaccctcttcttcacgggagctgaaaaaaatgggagaaagtgctttgttctctgtgtagagtttggcagagaaagataacaacattttttagccctttataatgccagttccacttgccccatacccaacaccaccagctccatatacaccaccagctaatggtgtacagagtcaacttgtctgttctgggtgcagaaaccttctagtgttcccagttggagccacctctgtgtgctgtgctgtttgcaatgctgtcacagcagtaccacctcctggcacagaaatggcccagttagtatgtggaggtttggccattacttttaaccttcaatggtctaaccaatttctccggggggtgggcccggccccggaacaccaaaaggtttgggcttgggcccaaaatttggggtcttttcctctttgggtttttgtgcgggtttcccccccaaccccaccaaaccacccttttggtgtgggttttgcccaccacaaaaaaaatttgtactccccctcctta

SEQ ID NO: 5640 - DNA, 844 bp, Glycine max
  misc_feature (414)..(414): n is a, c, g, or t
  misc_feature (416)..(416): n is a, c, g, or t
  Predicted polypeptide sequence is orthologous to G261
cyattccattttctctggaaaaaaaaaccaattcattaatactgtcgaaaaacatggtcagaatttgagcttttggcaactatggacagagatatgaactttccatatttggaggagaagcaatcccttttgtgtttcgctgtttccattttcagcttttttcttgtgtttgagcatttgaatctggacaaaggtttcacctttgggtgagtgattcaacaccagctatagctgggggagtgaaggtaaggttgtgagcattaatttgcttgamggagggtttgtgaattgaattggtaaaaagggtctctgttttatgggaattattaattggtgtttactgggattaatgaaaccyagatagaaaggaaaagggggaagaacaagggagtctattttttatataaatatgtntnttgttttgtagtggttaamtttgtgaaaaggtaaaagcgtttttttctttctttctgggtatactacagggcttttgagagttcactttgctgtgagatttgtgtttttgatgatggaggaagctcagggcaattctagttccctgccacctttcctcaccaagacttatgagatggtggatgatccttccactaattctattgtttcatggagtgccaccaataggagtttcattgtttggaacccaccagagttttcaagggatttgttacccaaatactttaagcacaacaacttttccagtttcatcaggcagctcaacacttatggctttagaaagattgatcctgaacaatgggaatttgcaaatgatgattttgttagaggcmgccacatcttttgagaatatcctaggcgcaacctgttc

SEQ ID NO: 5641 - DNA, 689 bp, Glycine max
  Predicted polypeptide sequence is orthologous to G261
attgaggggcatcacaagctaaaaggaataatcaattgcaactaagtttgctctgctttgctaagaatgccccatctgttctggagggttatttacattcctaatgttccaccaaaatttggcattacttctgccatcagaatcctctctttcagactgagcttcctgcatttctgacgaaccaggattctctgtcaagaatcgttcccagaatatgtcattaacaccagtagtcagaggagctgtttcgacaggttgttcttttgatgcatcaagatcaggagccgcaactacagctggctcagaactcacgttgattccatgtgacttaggctgatcttcaacttctagttgcacacaagatatagctggactatctgcacaacttgtagattcatcaaaatccaagtttaaatgactttgaacaaagacgtcaccaacatcatgtgtaatattctcccaaaacgtcatggatgactcaaggagatccaaccgttctgtgctcgatgagaaaatagaagcaccatctgcattttcccttggtaatacttgggaagtttccatatgatcttcaatgctagcgtcatcactaaagagaccacttcttggcaacctccgttttctatccatgttttctgtcaacagcaagagatttaaggcaatcccaggtttctgcaacacttgagaga

SEQ ID NO: 5642 - DNA, 764 bp, Glycine max
  misc_feature (1)..(2): n is a, c, g, or t
  Predicted polypeptide sequence is orthologous to G2655
nnaagtgatgctagtgtattaccccaagcgcgcaattaaccctcactaaagggaacaaaagctggagctccaccgcggtggcggccgctctagaactagtggatcccccgggctgcaggtgaacgagtaccttgccgtgcttagatccttgatgcctccttcttatgtacaaaggggtgatcaagcctctattattggtggcaccattaacttcgtgaaggagctggagcagcttctgcagtgcatgaagggccagaagaagagaacaaaggagggtagtggcttctctgactcttcacccttttctgagttcttcatgttcccccagtactcgacacgtgccacacagagcagcagcagcagcagcagcaaaggctaccctggcacgtgcgaggccaataacaacatggcacggaacccttcatcatgggccgtggcggacatagaagtgaccttggtggatggccatgccaacatgaagatactctgcaagaaacgaccagggatgcttttgaagatggttgttggtcttttaagtcttggtctcagcattctccaccttaatgttaccactgttgacgatatggtccttacctcagttagtgttaaggtagaggaagggtgtcagctgaacacggtggatgaaattgcagctgctgtgcatcaattatcacgcacagttcaggaggaagctgtgttcagctgatcatttaactttgaaatacttaaaggctacgtattgcaccatctttttttaaataatg

SEQ ID NO: 5643 - DNA, 868 bp, Glycine max
  Predicted polypeptide sequence is orthologous to G268
gcggccgcaccgattttcttttcttttttttggtccaacaataaacataactgatatcaacccgaagatgatgggaggtaagggaaagaccatattacaagtgaagctttattgatacatactaaacaaatttcccgcagcatttggtccattctacacaataacttaagcttacatcacactagaatcaaatagacaaaattatcatctaaacatatctgtttataaaaaaaaaaaatcatctaaacatatctgtttatcaaaaaaaaaaaatcatctaaacatatctagtaattctgtagagattgatacaaggcaagttctttaaagtgtttagaagaaaacctgttagttgggattcaacattgtaattaagactaccgtttctggcaaattatgggttagttttggccaacatttctggcacaaaatgagatttcagttgggagtaccatatatggtgttctataagttactgacgcaattgagcaattcagaaccgtttatcagaccttaatatcttccagcttgaatagggaccctctcctacatcatttatggtagttgaccatcccaatgcagttgcaatttcttgaagctcacctataacaagtgtggtgtcgcgtatatacactcgtcctcccggtcttagcatccgatccatctcaagcataatggttgagatgttacacttttgcctctttttctcaacagagaaaagacctgcagcgtgcagcagatcatatgttcttgggtatgtatcaaatggttcacaccaatcatgcataactcctgtcagcccgcggtcatatataacaggccaggtattaaatccactgacaggaacaacattcataacccaacagtc

SEQ ID NO: 5644 - DNA, 794 bp, Glycine max
  Predicted polypeptide sequence is orthologous to G268
ccagagacatcgccatgactcggccaagcgcgccaattaaccctcactaaagggaacaaaagctggagctccaccgcggtggcggccgctctagaactagtggatcccccgggctgcaggaattcggcacgagggttaattggagttatgcatgactggtgtgaggcatttgacacctacccaagaacctatgatttattgcatgctgcaaacctactttctgttgagaaaaaaagatgcaatgtctcatccattatgcttgagatggatcggatactaagacctggcggacgtgtgtacattcgcgattctcttgatatcatggatgaacttcaagagattgccaaggcaataggcttgcacgtgatgttgcgagacacagaggaggggcctcatgcaagttatagggtattggtttgtgataagcacttgctactctcttaaagctaaatggggtatattgcatgatattttctacgaccctgcaagtggaagtcatcaacagaacatggcaaaatctgtcattgtagaagtgtaggaagatgcaagtgcaagtactactaggcatttgagaagtgcaggaagatgcaagaacacatccttacaaacgtgtaggaagatggtcagcatttattcatcgataccactattcatgagatccctaaagctggatgagatcagtgcatcatctaacctatttgtagattcaatttattttgatattccaaagctgtcgttggctaaataatttgggttgttccaagaatttaagtccctgtaagggctgaacctaa

SEQ ID NO: 5645 - DNA, 286 bp, Glycine max
  Predicted polypeptide sequence is orthologous to G268
tcgacgatttcctccatctccggtggcgaatccagaaagagtccactcctaaccaaaaccaccataaccagagccaccatcgccttccacacgctctgcacttccactcttgttaggggctgtgacccttctttttctttctctcttcttttcagtgtgtgtttgtgtgtcgatagtagtgctaattagggaattgacgccgctctgtgttttaatgtccagagggaaatttataacaacggagagaatcaatttctctctgcttccaaattaaaaaaaaaaaaaa

SEQ ID NO: 5646 - DNA, 652 bp, Glycine max
  Predicted polypeptide sequence is orthologous to G2719
ggtaggttggaccatgcatacgtcagcgcgcattaaccctcactaagggaacaaaagctggagctccaccgcggtggcggccgctctagaactagtggatcccccgggctgcaggaattcggcacgaggatcgtcctccgcgtcagggacgccttgcgaatcaccgcttttacaatcgcactccccacagtctacttcactgcctcaaatcccttcatgccctcctcatcgatgcagaggaaaatgcgattgcgaaagtttctttcccgttagtttggtgggacgcgagaaagaggattatttgaaaggactgtggtaaccacaacaatggcggctacaaggtgtcatcggcgacgattccagtcgaatagagatcgaagactgatttttttcctttttcctttttttttaagttgctaggggaatctttggcattgcgaaattgcctgtaattactgattacctttgtttctgtcttgtgaattaatgagaacggggaagcagatatgaagaaatataaccttgcttggctcggcgctccctcctattgtcccgaccgccttcctcgcggggggccccgtacccaattcccctattgtttgccgtttcccccccctccctgcccgcggttttccatcctcccgctggtacc

SEQ ID NO: 5647 - DNA, 883 bp, Glycine max
  misc_feature (1)..(1): n is a, c, g, or t
  misc_feature (350)..(350): n is a, c, g, or t
  misc_feature (670)..(670): n is a, c, g, or t
  misc_feature (754)..(754): n is a, c, g, or t
  misc_feature (871)..(871): n is a, c, g, or t
  misc_feature (879)..(879): n is a, c, g, or t
  Predicted polypeptide sequence is orthologous to G274
nacgtggatttgatgacatttgctgattacgccaagcgcgcaattaaccctcactaaagggaacaaaagctggagctccaccgcggtggcggccgctctagaactagtggatcccccgggctgcaggaattcggcacgagacatatccaaggacatatgaccttattcacgcccatggtgtctttagtctgtacaaggataaatgcaaggccgaagatatacttctggagatggaccggattttgcgaccagaaggtgctgtcatattccgcgacgaagtagatgtgctaattaaggtaaagaaaatagttggaggaatgagatgggacactaaaatggttgaccatgangatggtcctcttgttcctgagaaggtgcttgttgctgtcaagcagtattgggttactaattccacatcaacacaataagccactatatcaaagttgaagaactggcttggcctttggctgccagtacatttctctatacgatcttcacagaattcatattgtggctcaattggtcattgcaatttgcaactgtggcacagaagaggggtttgatggagttttgcacgattgtcacttacctaaggtttcctatgttgttaatttattgatgaagaaagctacaaagctatgcttaaggtttatgcatgccacttgccatnttttggtcttagttgttatcttgggacattactacattcgaagaaaacacggtctctcttcttttgtaattaaatatatatatnccttattttaatgttttatttgacacccggaaaagttcttttttattattattcttaaattgagtgtatctctatgggccccatgggatttcatttgggatgggacacttcattttnttagcatnctaa

SEQ ID NO: 5648 - DNA, 999 bp, Glycine max
  Predicted polypeptide sequence is orthologous to G2754
gaagaaaataaactgttaaattaaggtttattgtatccaaaccaattcactttcgccactacacaagtagaatgttcaattccaactcgcaaaaaacatatccagagtagcttcatttctaaacatagttccgttagaagcatctacaaaaaatgaatgccatccagggcattaccaccgtgacataaaagaatgtttcaaaaagccattccatcttataccacaaaaagcaagttttttatactccggccataaatagtgacaagaaactagcagttaagagtagagagcatgcccccagtcgcagttggaatcaccacctcccaccccggccctttaagaggaaaggcactgactggagctttgaagttatcatcgtttgagtcgttgactataagatcactgcgatccaagagcttctccaggtcttcatcactaatatctgtatgtatctttttatcttcggctgtttcttcatcacgaagcaatgccaaaacatcatcttcctcaatttcatccatactggcaggttttgtacgttcttgatgaaattgtcctttctcaatcactacatgctcaagcttcaatttgctgaaagctcttttcaacatgcgaccctctatagattgggcagttgagagcctgtaaacatgaacaggtttagtttggcctattctatgacatctatccatggcttgtaaatccatttgaggattccagtcactgtcataaagaatgcatgtatcagctacagtgagattgattcccaacccaccagccctagtagaaagaagaaaactctacaattgctatttacatcattgaagtcctggatctgttgtttcctctcttccagtttcacactaccatcaatcctgcaaactgcaaagcctttttcactaaaaatataatccattatatctaacactttagtccactgactgaagataagaactttgtgaatccttgaaaataaacggtgcagcaatcgatcaagca

SEQ ID NO: 5649 - DNA, 938 bp, Glycine max
  misc_feature (29)..(29): n is a, c, g, or t
  misc_feature (34)..(34): n is a, c, g, or t
  misc_feature (40)..(40): n is a, c, g, or t
  misc_feature (42)..(42): n is a, c, g, or t
  misc_feature (630)..(630): n is a, c, g, or t
  misc_feature (692)..(692): n is a, c, g, or t
  misc_feature (808)..(808): n is a, c, g, or t
  misc_feature (854)..(854): n is a, c, g, or t
  misc_feature (886)..(886): n is a, c, g, or t
  Predicted polypeptide sequence is orthologous to G2754
ccccagaggcgcggggagtggagacgagncctcngggcangnaagtatcgatgcgcgcattaaccctcactaaagggaacaaaagctggagctgcaccgcggtggcggccgctctagaactatgtggatcccccgggctgcaggaattcggcacgagataaaatgatacatacagatattagtgatgaagacctggagaagctcttggatcgcagtgatcttatagtcaatgactttaacgatgataacttcaaagctccagtcagtgtgtttcctcttaaaggaccagggtgggaggtggtgattccaactgcgactgggggcatgctctctactcttaacagctagtttcatgtcactgtttatggctagagtttgaaaattttcctttttgtgggatgagatggaagggcttttctaaacagtctcatgtcacggtggtaatgccctggatggcattcattttttgtagatgcgtctaacggaactatgtttagaaatgaagctactctggccatgttttttgcgagtcggaattaaaaaaaaaaaaaaaaaaaaactcgagggggggcccggtacccaattcgccctatagtgagtcgtattacgcgccgctcactgccgtcgttntacaacgtcgtgactgggaaaaccctggcgttacccaacttaatcgccttgcagcacatccncctttcgccagcttgcgtaatagcgaagaggcccgcaccgatcgcccttcccacagttgcgcagcctgaatggcgaatgggacgcgccctgtagcggcgcattaagcgccgcgggntgtgtggtacgcgcagcgtgaccgctacacttgccagcgccctacngcccgctcttttcgtttctcccttcctttctngcacgttccgcggctttccccgccagctctaattcggggccttcctttaggt

SEQ ID NO: 5650 - DNA, 485 bp, Glycine max
  Predicted polypeptide sequence is orthologous to G2774
ttttttaattttttttttctcagaagggagaaaagaaacttaattttatcaaagagtaagactagtacataattattgatgaatagaatttagtgttgtaaactatgataatagtagttacttttttttcgtttggctgattaaattaggcactaggtaattcaatttaaccgtaagcctaaaaaatgccccttttttgccttcagttgcatgtgcctatgatgacaaatcagaagcttagcaataaaattacaactctacaaaagttggtttcacctttgggcaaggtgagtcatcattgctaacccctaatggacaaaaactagatccttcatttcttactagcataataaacacctttaagaaagtgtggccttggctttctgaatatcctgcagactgacaccgcatcagttcttcaggaggcttctctttatatcaagcttcttcaagcacaaatccgggtacatatttgatcctcgtgc

SEQ ID NO: 5651 - DNA, 783 bp, Glycine max
  misc_feature (7)..(8): n is a, c, g, or t
  misc_feature (10)..(12): n is a, c, g, or t
  misc_feature (18)..(19): n is a, c, g, or t
  misc_feature (586)..(588): n is a, c, g, or t
  misc_feature (608)..(608): n is a, c, g, or t
  misc_feature (622)..(623): n is a, c, g, or t
  misc_feature (656)..(656): n is a, c, g, or t
  misc_feature (658)..(660): n is a, c, g, or t
  misc_feature (675)..(675): n is a, c, g, or t
  misc_feature (678)..(678): n is a, c, g, or t
  misc_feature (745)..(748): n is a, c, g, or t
  misc_feature (750)..(750): n is a, c, g, or t
  misc_feature (755)..(756): n is a, c, g, or t
  misc_feature (773)..(775): n is a, c, g, or t
  misc_feature (777)..(777): n is a, c, g, or t
  Predicted polypeptide sequence is orthologous to G2789
acgaagnntnnnttaagnnagaaggagaatgaacagtgatgataataagagaaagtcgaagttaaaaataaaaaaagacacacaaaaataaaataagaaaaagaagaaaacaaagataaccgagaaaaaaaccatgaaagtaaaacactttgttaaaagggagggcgagcactgccaccccaataaccctcagccggtaattgaattgaattgagaagattctgaggcactccatggaaaagagaagaactatttggatctcccacaagctgttgttgttgctgttgcggctgcgattgtgattgttgctgagtccccgggattcctggggaccctaatccttcggtgccatgatatggcaccggagtttcctcttcctctaagggtagtctctcataagcagcattaccaaatgaagcagccatgatgaccacagggcctgaagccacaaggggtcccaccacacttccacctactacctgtccctgtccgccagccagatatatggctagtcctgacgccgctggcggagccggcggcggcaggaatgaaccggacagggacagaatctcgaaccttccgtgannngtcacgacggcacttggcgnggccggctgtcggnntgtgacgttggtgacggtgccacttccgctgancnnncagatgccacgctgncgncgcctcgcgaagcggtgacgctctccatgatgtcacagccgttggtgatttccatgacatgggatcnnnngncgttnncactgtctcttgtgatnnntnatgggt

SEQ ID NO: 5652 - DNA, 931 bp, Glycine max
  misc_feature (16)..(16): n is a, c, g, or t
  Predicted polypeptide sequence is orthologous to G2791
atgatgcccccttgantttcgcttgtaatttcccccgcgcgcattaaccctcactacagggaacaaaagctggagctccaccgcggtggcggccgctctagaactagtggatcccccgggctgcaggctgggcggtgcagctgctgtcgctccccttgttgctgatatgtactctgagggaggcggtgactgcatccaagccaacggcaacagtaacggcggtggggcccacgctccaaactccaacaccaaccaaacgtcagcgacaacaccctcaaacgacagcctaacgatgacggagcaccaggtagcgaaactaatggaagaagacatgggttccgccatgcagtaccttcaagggaagggtctttgcctcatgccaatctccctcgccactgcaatctccactgccacgtgtcacaccaggaacgttaccgttaacgttaaccccttgatcaatgccgccgccgccgcccagattccgacagccgccaaccccgctggtgacgggccgtcgtctccgagcatgtccgtgctgacggtgcagtccgccgtcgcggtcaacgacggctccgccgccgtgaaggacgctgcctccgtttcgaagccgtgatgacagcgtttgtgtgactttataggaaaaaaaaaaaaaaaaaaactcgaggggggggcccgggacccaattcgccctatagtgagtcgtattaacgcgcgcttcactggccgtcgtttttacaacggtcgtgacttgggaaaacccctgccgttaccccaactttaatcgtctttgcagcaacattcccctttttcgccaggctggcgttaataacgaagagggcccgcaactgatcggcctttcccaacaggttggccagcctgaattggcgaatgggacgcgcccctgtaaccgggcaataaaacccccgcgggt

SEQ ID NO: 5653 - DNA, 745 bp, Glycine max
  misc_feature (1)..(1): n is a, c, g, or t
  Predicted polypeptide sequence is orthologous to G2791
naagatgacaaagctacagacggtgcgtaattaaccctcactaaagggaacaaaagctggagctccaccgcggtggcggccgctctagaactagtggatcccccgggctgcatgaattcggcacgagggttttggagcttcggctccggctaacggtggcggttcgggtcagccgaagcagagggttagagccaggagaggacaagccacggacccacacagcatcgccgaaaggttacggagggagagaatcgcagagcgaatgaaggccctacatgaactagttcctaatgccaacaagactgacaaggcctccatgctggatgagatcatcgattatgtgaagttcctacagctccaagtcaaggttttaagcatgagcagattgggcggtgcagcagctgtggcaccccttgttgctgagggtggcggtgactgcatccaatccaaacgcagcaactcaaacgacagcctcgccatgacggagcaacaggtggcgaagctgatggaggaagacataggttccgccatgcagtacttgtcaggctatggtctatgcttgatgcctattatggtctgacaggcagtctcgcaagccggtgtgacctcttcatgaactgtgtatgggcctctatatccgaatgcctctctaactctgcttactctcgtgtataggagcaagcttctattataattacgataatcacgcgttaccggtaagtagtacctggacttgatagttacg

SEQ ID NO: 5654 - DNA, 952 bp, Glycine max
  misc_feature (1)..(1): n is a, c, g, or t
  misc_feature (13)..(14): n is a, c, g, or t
  misc_feature (19)..(20): n is a, c, g, or t
  misc_feature (27)..(27): n is a, c, g, or t
  misc_feature (33)..(33): n is a, c, g, or t
  misc_feature (111)..(111): n is a, c, g, or t
  misc_feature (941)..(941): n is a, c, g, or t
  Predicted polypeptide sequence is orthologous to G280
naaatgatacacnnaaacnnagcaaanccaccntactgcaggtgcgtatttagaccctcactcacgggaacaaaagctggagctccaccgtagtggcggccgctctagaanagtgcatcccccgggctgcaggaattcgggaccagctataggccacccctgccactggcaggccaagaggaaggcctaagaaggttgctcgctcaccggccgtgccgtctcccaccgccgtctccactggaaggcctagaggcaggcctcccaaagtgaagcctcagttgacagaagtcagggttgagtcatagaatggtttctgtctttctttctaattgatggcaaatgtagggatctactctcgtcgaagggatggcgcgtgtggtcttagatattgggtcaatataatttctttgtaaaatcaagtagtggtagcttgcttattaaaaaaaaaaaaaaaaaaaagtatcaccttgcagtgatctatataaaaaaaaaaaaaactcgagggggggcccggaccccaattcgacctatagagaggcgaattacgcgcgctaactgggctgaggtttacaacgtcgtgactggaaaaactctggcgttacccaactatattgccttgcagcacatacccttgtcgccagctggcgtaatagcgataaggcccgcaccgatcgcccttccaaactattgcgcagcctgaagtgcgaatgggactcgccctgttgcgtcccattatactgcgctgatagtgttggttacgcgcagcgtgaccggtacacttgcaacgcgccctacgtgccagttccttacggtttcatcatttgccttactcgcacgttcgcgcgctataccacgcaggctctaatgagtgcgtaccctcagggttccgattatgcgtacatgtcactcgaacgcaataattgatatgtggatggtcacgnatgtgcatgcc

SEQ ID NO: 5655 - DNA, 710 bp, Glycine max
  misc_feature (28)..(28): n is a, c, g, or t
  misc_feature (710)..(710): n is a, c, g, or t
  Predicted polypeptide sequence is orthologous to G280
ggtggcgggtcagctttggatgaatcgncaagcgcgcaattaaccctcactaaagggaacaaaagctggagctccaccgcggtggcggccgctttagtactagtggatcccccgggctgcagggaaaaagatcccaagccaaaatcaagagtatgaaatgtgtctgttcgtttcctttggctgtatggttaagaaatgttaatgaaacgaaaaaaattgtggtgatgctaagcctaagggtgggtcccatgttgagatgtgaatagaaggaaatatgggattgggttcacatcaccatttattgtaccacttgaaagatttgtcgtcaaacttgggtggggctcatcaaagcactactccttcccacgtaacttcacttcacatttctctcctgcaacatttatatttttttgaaaaatacaagctctatggtgtcggaggatgacatttttataatttcctttttaagtttttatgcctaagctaattctcttatttacaatgtaccccaaccaagaaggattagtatgcctcatatttcttttgcaatgcaagtgaacaagtaaagttcttccttgtaagcgtgtgtatatttgtagtgatttattcttgcgtgaagttctaagcacagaaattgctctgtggtgacaaaataaaacaaaaaaaactcgagggggggtcctggtcccaattcgccctatagtgagttn

SEQ ID NO: 5656 - DNA, 832 bp, Glycine max
  Predicted polypeptide sequence is orthologous to G280
attggaacctgcctctgttaaagtttgtatttttctgagtgggtgggttgattgagagtgctgtgcaagctttggaactttttcccaacctgctacttcaatggccactgaagaggttaacaaacctcaatcacttcctccataccctgagatgatagtgaaaacacttgaagcactgaatgagccaaatggatcgaacaagtcagcaatatcaaagtacatagaaaccacctacggtgagttgccagacgcaaccgttttggggagtcaccttaacaagatgaaagacagtggagagctttctttcaaacagaacaattacatgaaagctgacccaaatgccccaccaaagaggggccgtggaaggccaccaaagccaaagactccattgccaccaggcactgttgtgtcccctccaaggccaaggggtcgtcccccaaaagaccctaatgcccctcctaagtctcccaaggctaaggccacccctggaagtggcaggccaagaggaaggcctaagaaggttcctcggtctccggccgtcgccgctccgaccgccgtctccagtggcaggcctcgaggtaggcctcccaaggtgaagcctcagttgacagaagtcagtgttgagtcatagaatgacttctttctttctaattgatgtcaaaagatgtagtgttctactcttgaagaagtgatgatgggtgtgatcttagattttgtgttgatgtaatttctttgtaaaattatgtagtggtagctaacttatcatgaggttctgtgttggtttttcttcctaaattattatcaaagtgaacagtgacttgaactaatgtgc

SEQ ID NO: 5657 - DNA, 723 bp, Glycine max
  Predicted polypeptide sequence is orthologous to G2826, G2838, G362
ctactctggaaagtactgtttaactattcgagcctttaattggtaaagcaagctcgcataatctgaaggggcgagaaaaaaagataagatctatttggagcaaagaaggctgaagcagctagaaactagcactaaaaaaattaataataatcaatctaagagttataatttgagatggacatcaacttccctgctctcagcagaaaaatcacggacgttaggagcagattgcagtacagagggtgaggcataaagctgaaaaggaaaggatggagtgcaattagtacggtggtaggtggaagaaggaatcaaaatgggccgtgatgggaagtgcttagtgttattgggttgacgaggatggaagatgggtagaagagaagaagtagtaggagggcctcctcgtaagtaaatggaggagggtagcgtagtaactgtaactgaaggtactgatcttattattgcatgtgagttgagaacagaagcagaagatggtgctgcaatggagcgtctatgagtgtggatttggaaacgcctcgccctctgacgctctttcttgtgggcgttttggtggccccctaaggcctgagagtttccgaatactcgtttgcagtagtggcatctgaattttctgtcctctccaacctcgtattttctttctgcatctgaattcaattcctcctgctctgttagtgggaaaccgaatagtttcggtggcgaggtctg

SEQ ID NO: 5658 - DNA, 764 bp, Glycine max
  misc_feature (1)..(5): n is a, c, g, or t
  misc_feature (33)..(33): n is a, c, g, or t
  misc_feature (46)..(46): n is a, c, g, or t
  Predicted polypeptide sequence is orthologous to G2887
nnnnnccccccaggtgaggatgattgaccgtgnatcgtactgcccngctctaatacgactcactatagggaaagctggtacgcctgcaggtaccggtccggaattcccgggtctaccttcgcgtccgcatgaatttagacttgatgacaaggtgctggctgacgaagccgtatcacaggatgcctatgtgatttgtagggtgtaccaaaaggaaggtcctggtcctaggaatggtgcacagtatggtaaaccatatgatgagaaggagtgggaaacagatgaggaaattgattctgtacaatctgcccctgttgctgctgtttgtgcacctgttcctatacaacctagtgaaagccatatttctgttgctaattacacccatccctctacaagtggatgtgctggattgacctctgtatcatgtgtatcagaattgatgccctcatgctcgacacatccttctgcactaaacaatccggttgactctgtatcatgtgtatcagaattgattccctcttgctcggcacacccttcagcaccaaacagtcaagttggctctttatcatgtgtatcagaattgatgccctctttctcgccgccttcaacaccaaaaaatccagtttactctgtatcatgtgtatcagaattgatgcactcttgcttggcacatgctttggcatcaaacaatcaagttgactctgttccatgtgtatcaaaattcatgccctcttgctcagcacatacttcaagaccaaacagttaag

SEQ ID NO: 5659 - DNA, 657 bp, Glycine max
  Predicted polypeptide sequence is orthologous to G2887
tccaaaatcgccaaagcttgaaatctgattgcggcgtctcgcgcttccttcttccaccttccccgggtttcactgtgccgatgacttttcttctgagaaagagatcgtcatccatcgcgtgccttcgttttcccttcatgaaccggggcaggctttggcgttcttggaacttcttcttccgccactggacttgaccctacccccccccaattagggttatctatttcttccattttttttccttagaaaaaaaaaacccgtttcttcttctctcgctgccgacgagtcttctttctcttcgaatctttctggctgctacattctgaagcacttcatatttcggtttttcattttcatttttattttttttttattatctggatggccaaaccaaaaatgccagggtttcggtttcaacccactgacgttgagctgattgagtattttctgaagaggaaggttcggggtaagaaattcccttccgaaataattgctgaacttgacttgtacaagtttgctccgtgggacctcccagatatgtctttgctcaagaatggggatttgaattggtacttcttttgccctcggggaaagaagtattcgactggtgggaggttgaatcgggccacggaggctgggtattggaagactactggg

SEQ ID NO: 5660 - DNA, 999 bp, Glycine max
  misc_feature (65)..(68): n is a, c, g, or t
  misc_feature (70)..(72): n is a, c, g, or t
  misc_feature (75)..(77): n is a, c, g, or t
  misc_feature (918)..(918): n is a, c, g, or t
  Predicted polypeptide sequence is orthologous to G2898
tttccttcgataaaaaatataggatatggatgtattctctaagcacttgaacaggtcggggtatnnnnannnccnnnaagagaacaactacaagcaatacatacgagcgacggtgaaagtaacgctcactaaagggaataagcttttttttttttatttttttttgaacatctaaatacaacaaatttttttaacatatgacacacagaaattataggtttcagcaaggacagaaaaaagctgatgataactgaatgtacaactgttagtccaagtagtttcagttaatacagatccaacctagtaagaaaaataagggtggctttactcatcaaactctgattcatcatcagtttcgtcaaactcgccattttccattttcttgataaattctgccattgcgctatcaaattcttcacgtgttgttggtgctatatcatagaatggtaccttctcctcataagtcattgttttccacttctctccacatgccttgccaatatcacgcattgactttacatctggatttgctcttgaaattctttacgaaaatcctccaagaagtagaagaaagctgcaggaggtttcctgggtttcatagcatcaaactttagtttgttcgctagaattcttggcctcgagggccaaatttcctatagtgagtcgtattaaattcgtaatcatgtcatagctgtttcctgtgtgaaattgttatccgctcactatgccacacaacatacgagccggtagcatatagcgtaaagcctggggtgcctaatgagtgagctaactcacattaattgcgttgcgctcactgcacgctttccagtcgggaaacctgtcgtgccaactgcattaatgaatcggccaacgcgcgggagaagcggattgcgtattgagcgctcatacgctagctcnctccatgactcgctgcgcttggacgatcgatgcagagacgggctgtacttacttcaaggcgtactacggtatcctcataac

SEQ ID NO: 5661 - DNA, 962 bp, Glycine max
  misc_feature (729)..(729): n is a, c, g, or t
  misc_feature (772)..(772): n is a, c, g, or t
  misc_feature (808)..(808): n is a, c, g, or t
  misc_feature (918)..(918): n is a, c, g, or t
  Predicted polypeptide sequence is orthologous to G2982
aaaaaaaaccccccccccccccccccccccccccccgagagtgttgatcggctgcttgaaggcgacgccaagcgcgcaattaaccctcactaaagggaacaaaagctggagctccaccgcggtggcggccgctctagaactagtggatcccccgggctgcaggaattcggcacgagcagcaacaatatgatgagaaaaacatccgccgaagggtctatgatgctctgaacgttctcatggcaatggatattatttctaaggacaaaaaagaaattcaatggaggggccttcctcgtactactgtgaatgatattgaagaactaaagacagagcgtcttgggctcaggaatagaattgaaaagaaaacagcctatctgcaggagcttgaggagcaattcgtaggtcttcagaaccttattcaacgaaatgagcagttatatagctcaggaaatcctcccagtggaggtgtatctttaccttttattttggtacagacacgtcctcatgcaactgtggaagtggaaatatcagaagatatgcagcttgttcattttgatttcaatagcactccttttgagctgcatgacgacaattatgttctcaaggcaatgaaatttggtgagagaccactggaagataatatgacacataatcttactgatggaggtgaaggttctagcatgtcaggcttgtgtcatgccgcagctcctacaattctacatgtgtcanacaggcctacaacatcactcctctccctgcatactaaaggcangagttaaagcagagcattactctgtacggtatcatnatatcgtgtctatgtaaaagcatgttcgtatattttgtagagaaatttgctgcagctgatagaccgtcataatacgtattcatcaggtcagcccaagtcattctggaggntagaagcagatcgggatatccttctttgctaaggggagactttg

SEQ ID NO: 5662 - DNA, 943 bp, Glycine max
  misc_feature (1)..(2): n is a, c, g, or t
  misc_feature (639)..(639): n is a, c, g, or t
  misc_feature (650)..(650): n is a, c, g, or t
  misc_feature (707)..(707): n is a, c, g, or t
  misc_feature (921)..(921): n is a, c, g, or t
  misc_feature (925)..(926): n is a, c, g, or t
  misc_feature (928)..(928): n is a, c, g, or t
  misc_feature (930)..(932): n is a, c, g, or t
  misc_feature (939)..(939): n is a, c, g, or t
  Predicted polypeptide sequence is orthologous to G2983
nnaagtgcgtttaaaattaccccctgggagcaatcaaccctcactaaagggaacaaaagctggagctccaccgcggtggcggccgctctagaactagtggatcccccgggctgcaggaattcggcaccaggtgcatcagttcacacgtggattaatctgggagcacgaacctttcctcacacttggctgcaagagattacgccctcttgctcccaagcttcccaacaccaaaactatcactacccctttcgatctcaagagcttcatcaggcccgaaagtggccccagaaaacccgtttcctctgacgacactaagaaggatccaccttcaccccaaggccagattgaaacgcacccaggagggacacggtggaatcctacgcaagaacagataggcatattggagatgttgtacaaaggagggatgcgaactccgaatgctcaacagatagagcagatcactgtccagcttggaaagtacggcaagatcgaagggaagaacgtgttctattggtttcagaatcacaaagcacgcgagagacaaaagcagaagcgcagcagccttgcatcttctcatagtcctcgaactcccacaattcacagtgttgtactttggagacaacaagggggggagtggangagaggacacngaggagatagtcgtacaaggagagtgcaggagatgggattgactgcttgaagaacanacatgcatcaactgtgaacagaggacatagactcttgacttttcattgacccgaaggcgattgaagggggtggtgatgctttaatatattttacttggctagtcgaatcgagtgataatggatggatgtgtaatatgcttactttctttttttgatgggaagaaggaacagggcttgacgctcttctttatgtttccgcttgaccaaaaaaaanaaannanannnaaaaaanaaaa

SEQ ID NO: 5663 - DNA, 920 bp, Glycine max
  misc_feature (1)..(1): n is a, c, g, or t
  Predicted polypeptide sequence is orthologous to G2989, G2990
naatgttcctacgtataatcaacggtcacgtagagggaataagctttttttttttttttttttcttttcaagaagaagaagaagacccattagttccactcccgttagtcccactatcattctcgtactcgttcacatcatgggaagcgagattgtggttgtggttgttgtcgccgctaccgttaccattaattccgctgtgttcatgtccatgttcggggacatgaacaccggttctaacggtggcactcccaacagctccatccagagaaatcccgttggcgctgacactcagagtgctaccgttaccgttgttaaggttgtcttttttcgcgagagtgttcttgttgttgtgcatccacactttgagaacccctctttcgacgccaatttccgtgcagaactccttaaccatttcaatcgtcgcgcttgtgcatctttcacccaactttgtcggcgaactcatgcatcttctccttttgttcttgggtgaacttcgttcggaagcgtttacgcgagtggttgtgcgccggtgccggctcgccggtgttttcccgcgcgacggagatgccaccgtcgtcggagagggcgaggagcatgtggtgggcggaggagtaggatgagatcgtcgcgcggatgcggagtctgactccttgctactggtccgtgtagacgtgatgcggtggtgtgctgcactctagctgcattctggtcttacgccataattctatatgagtctattatatcgtaatcatgtatagttgttcctgtggacatgtatctgtacattccccaacatacatccgatcctaagttatgcctggtgctcagagtactactccattcatggtgtctcctgccgtttcatctgataactgctgcagcttataatgattgctactaccggtaagtgttcggta

SEQ ID NO: 5664 - DNA, 405 bp, Glycine max
  Predicted polypeptide sequence is orthologous to G2989
attttttttttctctcccttcaacgcaaaaacacacacaacccttagtaatcatcatgtcctctcctctcttcttgccctcatcattagaccctcgctttcatcatcaccaccgcatcttttacctcccaccaaccgcaccaaagccatcatcctcctccgcctctaacatcaccaccacaacaacaagaacaagaagaaagagaagcaaggagagagagaagggttagaagggtgaagaagcatgtcttcactcaagaagaagaaaccctattacccgcttccgttaattcctatctagtactactactttacttctgattcaaaagggtgatcttcttcttccaagcttatcaattatcatgcatatgctactttcttctctcttctcggggaattgaagcgt

SEQ ID NO: 5665 - DNA, 854 bp, Glycine max
  misc_feature (1)..(4): n is a, c, g, or t
  misc_feature (376)..(376): n is a, c, g, or t
  misc_feature (854)..(854): n is a, c, g, or t
  Predicted polypeptide sequence is orthologous to G2993
nnnnaagtgcattgcagtgagaattctactccagcgcgcatttaaccctcactaaagggaacaaaagctggagctccaccgcggtggcggccgctctagaactagtggatcccccgggctgcaggaattcggcacgaggagaactcatcatcatcatcttcatgttcaaactatctctaccgagagtgcctccgcaaccatgcagccagcctcggtagctacgctaccgacggctgtggggagttcaccctggacgtggacagcgtctcgtccccctccctccagtgcgcagcctgcggctgccatcgcaacttccaccgcaaggtcacgtgccccgcggtggaaggagggttgcaggccgtgactggagggagtngggacatgatggagtactccgggggcggagacgtgggaagaataacggagatgggagagaggagtggcggcagcaagaagaggttcaggacgaagttcagtgctgagcagaaggagaagatgctggggttcgcggaaaagctggggtggaagctgcagagaaaagaggtggatgatgagattgagaggttctgtaaaagtgtggtgtcactagacaggttttcaaggtgtggatgcataaccataagaacaactccaacacttctactaattcttctgctaatctctcttctctcactcagtcatgatcctgcacttcccctaacttaattagagagagagtgtgtggcgtgagagaaagatgcatgctcttaataattgcttattgttctctagctcgaggctggaaggcacagtaacgagaattcacactccctggtgctgcctatatcgtcacaaatgaacacaactacttggcn

SEQ ID NO: 5666 - DNA, 704 bp, Glycine max
  misc_feature (38)..(40): n is a, c, g, or t
  Predicted polypeptide sequence is orthologous to G2998, G2999
gaagttatagctgctgtcaaaattaatgtatctatctnnntatagctagctagcttcctctgcttgaataatatatatgcacatctaaatctacaattattattcacttaaaaattaatctgatgtttctttttatttttatttctttccaaacaacaaggaagtctagaaaaaagaagaaagagttttgtaggctaggcttacatttgctgcttcttactactagttgtttgcttgttattgtgcatccaaaccttaaaaacctgtctcttgacacccacttgagaacaaaactgctgtacctcctgctcattgtgtttgtggatcttccaatcaatcttgtcagcaaactccatcatcctatccttctggtgctgagagaacttagtcctgaacctcttcttgctggaagagagtagtggtgcatgctgctgcactgatattaactgtgctcctccagtgttggactgaaacatgttgagatcttcacttgatgactcagctgggcccccaaaggccatcatcactggggagaccaagcttgttggtgtaaccaatctatgatggagggaagatgaagagggtgtagggtagtgaaggtgaccgttgtgcttgttggtgtagtagctgtggtaatttggaacatgtgtttgcggttgtggttgtggttgcggtcgtaattctccttcaacttcttttctgtg

SEQ ID NO: 5667 - DNA, 919 bp, Glycine max
  misc_feature (1)..(2): n is a, c, g, or t
  misc_feature (14)..(14): n is a, c, g, or t
  misc_feature (25)..(25): n is a, c, g, or t
  misc_feature (521)..(521): n is a, c, g, or t
  misc_feature (725)..(725): n is a, c, g, or t
  misc_feature (735)..(735): n is a, c, g, or t
  misc_feature (919)..(919): n is a, c, g, or t
  Predicted polypeptide sequence is orthologous to G3
nncgctacgccctngtggattacgnctgcgcgcaactaaccctcactaaagggaacaaaagctggagctccaccgcggtggcggccgctctagaactagtggatcccccgggctgcaggctgagtctgaacggaatcccacttaaaagtcgttctccttcctcttcgcagctgttatatagtactattttcatttcatatgtttatgcacctctatatatacatagacacatgtaaatggttgcaaaggaagataagataggtaccagctatcacatagtttatttaatccgttatatgccacctgatatataggcatattagctagttaggtaggtatagtagtttaagttaattcaaccatggaagacagggatcactgttgttccaacaattcaacgatgatcacaacaacaaagaaaagaacgggtagaagaagtccaacatcggataagctcaagaatcaacaccgcgagaagcagtcgatgaaaccttaccgtggaataaggatgcggaagtggnggaagtgggtggcggagatcagagaacccaacaaaaggtcgaggatatgtgtgggttcttacacgacacccgtggccgccgcacgtgcctacgacaccgctgtcttttacctcccgggtcccaccgcgcgccttaacttccccgaactcttgttccaggacgacgaccaggaaggcagtggatcggtgcagcacggcgcagcanggaacatgtncgctgattcatttcgcgaaagccacgcagtccgtcgcagagtcgacgctctccaaaccgcgcttaccacccacgcgccagtacccactctctcaactcaagcccgacttgtacgagtccaaaactcgagaagcttcagatgaataaacaaaatcatatcaatccatataataatttctagtctn

SEQ ID NO: 5668 - DNA, 771 bp, Glycine max
  Predicted polypeptide sequence is orthologous to G3
gggggaaaaatatttgataaatattaaatttataatttatctcccccccccccaggtgggtagagcgctgtagcatcagcacgccaaacgctcaattaaccctcactaaagggaacaaaagctggagctccaccgcggtggcggccgctttagaactagtggatcccccgggctgcaggaattcggcacgagggcggagattagagaacccaataagcgttcgaggatctggctgggttcttacgccacccccgtcgccgccgcacgcgcctatgacaccgccgtcttccacctccgaggcccttccgctcgcctcaacttccccgaattgctgtcccaggacgacgacgtttcgacccaacaacagggcaacatgtccgccgattcaattcgcaaaaaagccacccaagtcggcgccagagtcgacgcgctccaaaccgcgcttcagcaatcctcgtcctcacactccgctaattccagccacgtcagcagctctgacaaaccagacttgaacgagtatcccaaacctgaagattagtaattttcttccaccttcaagattaatattgatccaccaatcacgcgtcctgatgtgacatatatatagggcttcaacttgccctcttcacctatgctaatttgaagaagaagaaaaaaaccttattatatttgtcatatgattatatatatatcttagtagatatgtttcttccaaataaaaaaaaaaaaaactcgagggggggcccggtacccaattcgccctatagtgag

SEQ ID NO: 5669 - DNA, 655 bp, Glycine max
  Predicted polypeptide sequence is orthologous to G3021
ttttttttttttttttttttttagcttcttcaataactaatttatcttgaatttaacatagtttatggctcaattaattgtggaaatgcaagacatagaaattaactaacgcgtgtgtggcacagaaactgaagagcgttcacctgcatttgcaaacagcttatgtaactctcaagctctgaaaccatttgttcatcatcacacatctcttctcctccgggtatcaaccttctcagcttcttccactggttgctgatgtcctcatcctccttatcatcatcttctctggctaaatcccttttcatttctgacatgtccttgcacttagactttgagctagggtttgaagagaaatattccattgggagtacaacttcatttttgtcataagcattctttgatgatgaaccttcaccagcctcatcattttcaagaaagctagtgcttttagctgcattgacatgaacgtcatcgctttgaagcttatctttaaggccgttactccatgcaaatccttgtgctgacaacaccattgccatgtccacttcatacttgacagcattgttaatatcatcacaatgccttctatcttcttccacagaactcttttcctttatcttcaccaacgctggaaccaaatgattcaaataattcc

SEQ ID NO: 5670 - DNA, 762 bp, Glycine max
  misc_feature (56)..(57): n is a, c, g, or t
  misc_feature (62)..(62): n is a, c, g, or t
  misc_feature (762)..(762): n is a, c, g, or t
  Predicted polypeptide sequence is orthologous to G3021
ctgcccccccctcccccccccccccccccccccccccccccataaccccggaaacnntacangcaccggtctggcagctctttacgactcactctagggaaagctggtacgcctgcaggtaccggtccggaattcccgggtcttcccacgcgtccgctgaaatgaaaaggggtttgatagaagatgatgatggtggtggtgatgaagatgaagtcatcaagggccaattgaagagcctaagaaggttgatacctggtggagaagagatgtgtagtgaacaaatggtgactgagctacaaagctatgtaagctgtttgcaaatgcaggtgaacattcttcagtgcctcgctgagacacattgaatattgattcatatatgatgctttaatttgccttttccataaacccgttattactattatgtatgtgttccacatataatatatattgtcaattatcaaagcaactatatatttaaaaaaaacaccccccccctcgcagatcagcaagaaaataaatagatattagtcactatctacaaataataaataaataaaagggcggccgctctaaaggatccaagttcaatccccgtgctagcaacggaatatctctttatgaggtaacctaataccattctactggccgccgttctacaacctcgcgaccgggaaaacctctgtgcgttcccccacttaaattggtctgtggagaaaatacctcctttatggcaaggttgggccgcgctgtataaatgctacn

SEQ ID NO: 5671 - DNA, 726 bp, Glycine max
  misc_feature (723)..(723): n is a, c, g, or t
  Predicted polypeptide sequence is orthologous to G3021
gggtggttggacagttatgaccatgattacgccaagcgcgcaattaaccctcactaaagggaacaaaagctggagctccaccgcggtggcggccgctctagaactagtggatcccccgggctgcaggaattcggcacgaggcaaaagaagcttagagagcttcagggagcagttcctgggagtgagggaatggacatgcacactttgttccaaagcattgaacaatacatacttcaacttgaagctaaagtcacggtcctaaggtgtttgtccaatttgtatggagtatagaaggagacaacaacactcctaagcactcaacctatttagaaactacatctgggctctaaagaaagggtgaaggtaaggttaacaccattaccgggcttctttcattggggcgtggagggaataataaggttgtattttatttcaattctataatctataataaaagttaggattatccttttaaaaaaaaaaaaaaaaaactcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgccctttccaacagttgcgcagcctgaatggcgaatgggacgcgccctgtagcggngct

SEQ ID NO: 5672 - DNA, 401 bp, Glycine max
  Predicted polypeptide sequence is orthologous to G3032
cctcgtgccgaatcactaataatctagcacttgacaagttctccgatgaattgaatgagaagctctgggatgatggaagctctgaagatgatgctggtgaggaagtaattgacaacccctcagcatatgaaatattagaagtatggaaggaaatgagagaggaggatgggagtttgttgcactctgaacttgcttgtggctagtgattgtgagttgctttagtgtttaacatatgctagctgaactgtgaacagggataggaagatgtagcaattttatcgtaaattagcttgttctgatcaagtatagtgatatctggtacgatgttattggaacaagagaatgcaattaaaacttgtaaatgttagcaaactttcccttggtcaaaaaaaaaaaaaaaa

SEQ ID NO: 5673 - DNA, 933 bp, Glycine max
  misc_feature (713)..(713): n is a, c, g, or t
  misc_feature (753)..(753): n is a, c, g, or t
  misc_feature (804)..(804): n is a, c, g, or t
  Predicted polypeptide sequence is orthologous to G3055
gttaaagcgtaggcccattacgtgagccgctctattcctcacttctgcaacaaaagctggagctccaccgcggtggcggccgctctagaactagtggatcccccgggctgcaggaattcggcacgaggaataatgttttgtaggtttcagggaatgaatgaagggttgctaagatagtgttctggtttatgagatttggatgagtgctttggttggaaacgtcgtaggaaaacctgctgtaaatatacttggcatcagctaagtggtgagccgattagttgtttgtattttgatttcatgatttcatttcttcttttccccttcttcttctttgtaggataaaattgtgaaatgaaattcgtgtatatagtcaaaaaaaataataaaacaaaaaaataaaaaatttttaactaaaaaaaaaaaaaaaaaactcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtgttgttacgcgcagcgtgaccgctacacttngcagcgccctagcgcccgctcttttcgctttcttccctcncttactcgcacgtacgccggctatcccgtcaagctctaaatcggtggctcnctttagggatccgatttagtgctttactgcaccccgacccccaaaaactggatagggtgatggtcacgtattggccatcgtcctgatgacggttttcgccctttgcctggatccacgttcttattatga

SEQ ID NO: 5674 - DNA, 1182 bp, Glycine max
  misc_feature (1)..(2): n is a, c, g, or t
  misc_feature (7)..(7): n is a, c, g, or t
  misc_feature (422)..(422): n is a, c, g, or t
  misc_feature (532)..(532): n is a, c, g, or t
  misc_feature (534)..(534): n is a, c, g, or t
  misc_feature (541)..(541): n is a, c, g, or t
  misc_feature (589)..(589): n is a, c, g, or t
  misc_feature (633)..(633): n is a, c, g, or t
  misc_feature (702)..(702): n is a, c, g, or t
  misc_feature (706)..(706): n is a, c, g, or t
  misc_feature (856)..(856): n is a, c, g, or t
  misc_feature (861)..(861): n is a, c, g, or t
  misc_feature (863)..(863): n is a, c, g, or t
  misc_feature (867)..(868): n is a, c, g, or t
  misc_feature (870)..(870): n is a, c, g, or t
  misc_feature (912)..(912): n is a, c, g, or t
  misc_feature (1013)..(1014): n is a, c, g, or t
  misc_feature (1036)..(1036): n is a, c, g, or t
  misc_feature (1039)..(1040): n is a, c, g, or t
  misc_feature (1054)..(1054): n is a, c, g, or t
  misc_feature (1060)..(1060): n is a, c, g, or t
  misc_feature (1078)..(1081): n is a, c, g, or t
  misc_feature (1083)..(1083): n is a, c, g, or t
  misc_feature (1085)..(1100): n is a, c, g, or t
  misc_feature (1102)..(1102): n is a, c, g, or t
  misc_feature (1116)..(1116): n is a, c, g, or t
  misc_feature (1128)..(1128): n is a, c, g, or t
  misc_feature (1141)..(1141): n is a, c, g, or t
  misc_feature (1145)..(1146): n is a, c, g, or t
  misc_feature (1165)..(1166): n is a, c, g, or t
  misc_feature (1170)..(1170): n is a, c, g, or t
  Predicted polypeptide sequence is orthologous to G3060
nnggggncgagtgatcttcagctcgataaactctcactaaagggaacaaaagctggagctccaccgcggtggcggccgctctagaactagtggatcccccgggctgcaggaattcggcacgaggttgcagctctgcctcatgtacctaatgggtctgcaccatctgccgttaagacccgcatatgcaacaagtttaatactgctgaaggttgcaaatttggtgacaaatgccattttgctcatggtgaatgggaacttggcaaacacattgctccatcatttgatgatcatcatgccatgggaccccctggagcaggtcgtcttgctggtcgaatggagcctccgggtcctgccgcaagttttggtgccaattccacagcgaagatcagcgtagaagcttccctggctggagctatcattgngaagggtggttgtgaactcaaaacagatctgccgccaaactggagccaaactttcaattcgagagcatgaatctgacccaaatcttagaaacattgaacttgaggaaagntntgagcanatcaaggaagcaagtaacatgggtaaggatttacttttgaccctgcanatgtctgcaccacctaaaacaaccccggtggtccttgtgcaccntgctctcatggaagcaaatttaagacgaagctgtgtgagaattttgcaaagggtctttgaccgtttgangatnatgcacttttgacaatgagcttctgaaattggtaaatcaggagtatgaactttctagtgaagccactagaccagggtataatttatgtggcatgtaatttagcagactgaggaccctttcaattatagtttgtggtagtgttagcacccnggggngnttgnngngggaatgatttttagtattaaaccactatttaaaaaaaaaanaaaaacttgggggccgccccatcccttatagagctaccgctctagtgccgtttaacggggatgaaaactgtacaattaagctgaaatccctttcccgtggnntaataaccacctgcttcaagtngcnntagaaggccctcgnttgtanatatggggggtgaccacnnnntnannnnnnnnnnnnnnnntnttctttttttcttntctttcgtccantatgggtttgtangtcnncccaaaattgaatgggcanncgcntacgctagtagg

SEQ ID NO: 5675 - DNA, 1154 bp, Glycine max
  misc_feature (1)..(3): n is a, c, g, or t
  Predicted polypeptide sequence is orthologous to G3060
nnnaagcggaggtagaatagaatcttattttgacctgtccacgccacgcgcgcaattaaccctcactaaagggaacaaaagctggagctccaccgcggtggcggccgctctagaactagtggatcccccgggctgcaggaattcggcacgaggcgaaggtcggtcccttcccacacatatataacatactgactggatgaggtaagaccagagaagttccgttccgacacgtgacgttcattctgtctgttggaactgttggccttttagggttagggtttcggtttgtggatctattgttgcctctgcgatggatcgcaagaggggaaggcctgaagctgccttcaatttcaatggcggcgccaagaaatcgaggcctgaaacggactcctttccaactggtttaggaagcaaatcgaagccatgcacaaagtttttcagcacctccggctgtccatttggtgaaggatgccacttcctgcattatgttcctggtggctttaaagctgtctctcaactgatcaatgttggtagcaatcctgttactcctcaagttgggagaaaccctgttccaccatccttccccgatggatcttctcctccagttgttaaaacccgattgtgcaacaagtttaatacagctgaaggttgcaaatttggtgacaaatgtcactttgcccatggtgagtgggagcctggcaggcctacagccccatcatatgaagatccccgggtttgggacaatgccaaccacagggtaagtgccagttgagccccccattcactcaaggagcggtgccgctttggaacttgctccgtcaaaaataagacaaggcttcttactgggcctgcatggaaaatggtgcacctcgaccaatttgcgggcaaggacctactttccataggaccggacccgaccaaccttaaacatcgcctgaacggtttgatcatcaacacccggccatgtcaagagtttcaaatgtatttgctttggcccaagaaagttacttcgactttgcctacacattaaaatagttgcaaacttgcaaggctggcttgggaaggtacttccaggactgaaatgccagtgatggatgttatattttacgggtgaggcaaattcagttcaattaaacgtcaatgccggacattag

SEQ ID NO: 5676 - DNA, 749 bp, Glycine max
  misc_feature (1)..(1): n is a, c, g, or t
  misc_feature (12)..(12): n is a, c, g, or t
  Predicted polypeptide sequence is orthologous to G3067
nttggatgtctngttagaatcacccccagctctaatacgactcactatagggaaagctggtacgcctgcaggtaccggtccggaattcccgggtcatgagctgagtgttggagacccatcaagaaaaattgtggagatgatatttcaaaaagcttggtttaacaaatcaaagccagtgaagaaggtcagaacagtcctcagggtgagttactcagaagaagtccttgaaaggtttgagaagtatagagaatatgtcaagaaggtggcctctgagcaaaatccaaggaatccaaggagcgcagttgatgggaacgaactgttgcagttctatggtactacaatgagatgttttcaaggaaaatctgctaagaaagttcatgatctgtgtaaagatccatcttgttatctttgtcaaataattcagtttaatttcaacacacgatatgccgagattcacttgaatacaagtgacaaagagtcgagaaacagaacaactgccactgccagagtacataatgtgaaaaaagctgcaataatttgcaggataattgctggaactgcagtaaatgaagttgatggtgaatatgaaaggtctcactcaactggggttggagaaatgcagtttcccctaacatagtttgtagtaaaagatccccagtctattcttcctggttttgtataattttcagctaccatgtatggtcgtgtaaattgccgatatcctatgatttttgtgaggcgtgtcatga

SEQ ID NO: 5677 - DNA, 884 bp, Glycine max
  Predicted polypeptide sequence is orthologous to G3074
agaaaatagttatatagttatttgcagcaatattaaacaaagtttgcatgcaaaaatttaactcaatctagaattgtgatatacattgtaggcctaaaagtacacgaagctaacattactggtcaaggggaagataaatcagctccacatacaaaccagattaatgaaaaggggcattcagatctttcttcagccaacaacatggtacatgcattgacagctagtggatactcataatcataacactagtatgtacttattctacagttatcatgatgaacttttcactaatctaatcaccaaagactaataatatttacccctcctcttcatcatagtcttcctcctcctcttctagtggcctaccaagttgtgcaagctgcagtgaatcaatggccatcttgtccacatcagaaagtgaccaccccggaatttcttcatgcttgctctctgttgggggttcaggcaatgaggcatcaggttcaggcaccgaggcggaggcatcagcttctgcactagcctttttgtcatcgttttcattcgtgatggcattcagatcaatgttccggagggaatccgtgcttacaacaggaacaacgggagctgcaatattctcctcctttggtatctcctttgactcagaaccattatccattgctatacttgtgtttgtattttgtgggttgctcggctgaacagaagtgcaaggctcagattcagcatcttgatgatatgtctctctatttaaaggtggtcgccctcggccacggcctcttcctctacctcggcctcttcccctaccagtactgccagtgtggcccaactcaagcatcttgctccctctagcctcttcatcgctgtcattaccatcatcaccaatagct

SEQ ID NO: 5678 - DNA, 704 bp, Glycine max
  Predicted polypeptide sequence is orthologous to G3075
cttttcattttttttttttttttttttttttttttttacgggaataggattactaaaataaatacaatatggaaacttaaagtacagcattactcatcatgatgcatgtttccattacaaaatgttacatgattaaataaagtataagcttatattctccactagcttgctttaaattttttaacttcctccttttcctgctgcacttctctctcttaatgcatcctcagcttttactctctcaggaacaaaatcagagagaaagtcatatctcctttgcttacttacaacatgtgctaggtgatcatagctgaggcatttcttgcggtcctgagcacaaaaggcataagcgtcctgcgtgaactgctcaaggaacttttcctgcaatgaaaaggaggaaaacgaagaaggatagagacatcgaaaaagaggagaagaagacgcaaggaatagaaaacctaccacagtgttgttgatggcaaacaatgcttcctgagaaacacgcatttcgggatcttcgcccttaatcatcgtcctgatgcgattcatcggaaacacgttcattttcgcctcttctccgtttccttctgctgctactccctttttggatccctcgtctcgctgttttgaagtgccgttgctgagcttggccttcttaatcttcttcttgttctcctcttgtgagattctttgttcttcttcgt

SEQ ID NO: 5679 - DNA, 771 bp, Glycine max
  Predicted polypeptide sequence is orthologous to G309
gcttatattagctatttggcattaacaaacaactacttgtaattactaattaggcagtggtatgactcaattgactaaaaaagagaaaagcactttggttgggtttttgacaaaaagagaaaaaccccaaccaaagtcacgtgtgatagagaattcaacaacagaagaattttacgcaaaaatgaccacattattattattcaccactcttcccgtgtactactactgctactagttactagaataaacaaaaacaagtgatctgttctgttctgttcttttcctcaatgctcaaaacgcagcgtttcgtcgtctcccagaggcgcggcttgccaagccgaagctgcaattagggggcggctatgccaacccagagtcaaagagccttgattctcttggacgcagaaaccctcagctgagaagagagtgagcaacatgctggcttgcttgtaggcgttgaaacccaaatgcaaggctctgaagccggctttccccagccgatccctccacttagcgagcggctcgtggcgctccagccgcgccggtccctcgcagcacaccacgttgcatatctccctctgcagatacatctccgccaaagcagccttgtccggttcgaccggacacgcgtcgagcgagtcgaaaacgctggaatagtaatgcaaagcctccgtgaaccgctccaaaaacccttccccgttgtggttggcttcttgttccacaaccgtcacgattttagggttcagaatccggatccatcccagaacctct

SEQ ID NO: 5680 - DNA, 906 bp, Glycine max
  Predicted polypeptide sequence is orthologous to G309
caccctctcatttatttatcctcttgctgcctggaaggctcactgactcggtcactgactcagttcactggaacaagtccaattaatctatagttttacattcactgagtcaagccactagactcgctggaggagggaagcttccaagcggaggtagcgatgagtggcctagtgtgccagccaagcatgaggcagccgttattctcctcaaccctatacccatcaccgcctgcgaatagagcaagtagcatactcgcttgcttgaatgcgttggacccgagatgaaccgggtcgaacccggccgagtccaatctccccctccactgagtcaaagtctcgtgccgctcgacccggtccgggccctcgtaagccaccacgttgcaaatctgtctcccaaggtacaactcggacatcaacagatcctgactcggcgagcccaacccggtcgaagaagaagacgaaccctcaagcgagtcgaaaagactggaatagtaatgcaaggcttcagtgaaccggtctagaaaacccggtccgttgtggttcgcttcttgttccacgatggtaacgatctggggattaattttcttgacagtgtccaagaccttgtcgacggatccggaccgggcgagcatgcggtggagttcgaagacggaattcaccgccacggcttccccgggtcggatctcgagcatattcgggtcgagatccgcgaggctgttgcaaacgaagccgcggaattcgaactggacgccgatgatttgggccaattgggctaatttcaagcccacctgctgcagcgcgtcggtgttgtcgggctgtgggggcccgattccggttaaacggaaagtcgggggcccgccgggccgtaatgcgagggcctgcatgagtgccggccactgcatccct

SEQ ID NO: 5681 - DNA, 976 bp, Glycine max
  misc_feature (48)..(48): n is a, c, g, or t
  misc_feature (976)..(976): n is a, c, g, or t
  Predicted polypeptide sequence is orthologous to G309
gggtttcctcccccccccccccccccccccccccacgcggggacttangagaggtgctgggcgcggttgttcctcactaaagggaacaaaagctggagctccaccgcggtggcggccgctctagaactagtgttttccccgggctgcaggaattcggcacgagagatgcagtagtagtagtgggtggtaacagagaagaaaatagggggtttggtttggtgagttacccaagagaaaggatgaagagggaacgcgagcagcttggttccatcgcagggacctcaagctgcggttattcaagcggaaaatcgaatctttgggaggaagaaggaggcatggacgagcttcttgcggtggtgggttacaaggttaggtcatcggacattggcggaaagtggcgcagaagcttgagcgtctcgaagaagccatgggaaatgtccaagatgacctcccggagatttcaaacgacgtcgttcattacaacccttccgacatctccaactggctcgaaaccatgctttctaattttgaccctctcccctccgaagagccggaaaaggactccgcctcgtcggactacgatcttaaggctattccggggaaagcaatttatggagctagcgacgcgctaccaaaccctaagcgcgtgatagccgacgagtcaatgcgcgcggtggtggtcgttgactcgcaggagaacggtatccgcctcgtgcacagcctcatggcgtgcgctgatgccgttgatgacaatcacctcgtcgtggggtagacgctgtgaacacatcggcttctttgtgtgtcgcagatcgtagctatgagtatgtgtccatctactttcgctaccgctcgctagcgattctcgtagctatcctggcacacttttgttcgatcgttcacattagctttactaactgtcatagttagtctgacatctgcggaatcgtgtgatctcatcgtgcaagaatgacgcgtn

SEQ ID NO: 5682 - DNA, 711 bp, Glycine max
  misc_feature (510)..(510): n is a, c, g, or t
  misc_feature (533)..(533): n is a, c, g, or t
  misc_feature (550)..(550): n is a, c, g, or t
  misc_feature (572)..(572): n is a, c, g, or t
  misc_feature (647)..(647): n is a, c, g, or t
  Predicted polypeptide sequence is orthologous to G309
ttgaattcgtgatgaagagggaccacaaagatagctgcggcggcggcggcgccgccggagggactgtgaagggtgagtgttcctcaatgcagtcaaacgggaaggcgaagatgtgggaggaagagcaacagcagcagcagcagcaacaacagcaacaacaacaacaggggatggacgagttgctggcggcgttggggtacaaggttcgtgcttccgacatggctgacgtggcacagaagctggagcagttggagatggtcatgggttgtgcccaggaagacggaatttcccacctggcctccgacaccgttcattacgaccctacagatctctattcctgggtccaaagcatgttaaccgaactcaaccccgaacccaacaacaacctcgatccatcttctttcttgatcgacaacaacaacaacatcatcaacagcacagcccctgttttcaacgacgattccgaatatgacctcagagccattcctggcatagcagcctacccttctnctcttcctcaagacaaccacctngacgaaatcgaaacggntaacaacatcaacaagcgcctnaagccatcttcagcggaatcagcagacttccgccgcgtctgagcccacgcgccatgtcgtcctcggttgaccatnaaggaacccggccgttccgtcttgtccaacacttttcctggcggtgccccggaaggccgtttca

SEQ ID NO: 5683 - DNA, 940 bp, Glycine max
  misc_feature (1)..(1): n is a, c, g, or t
  misc_feature (16)..(16): n is a, c, g, or t
  Predicted polypeptide sequence is orthologous to G3111
naggtgccggggtcangccaggattctgctaagctctaatacgactcactatagggaaagctggtacgcctgcaggtaccggtccggaattcccgggtcgacccacgcgtccgggctccgccggggacccgtcgccggctccggctctggtgccggagaatcgccggcgacggcgaacaagggcctcaagaagaaagtggtgaattcactgccgaagttcacctacgccggcggcggcgaccggtgcaagtggtcggagtgcgcgatttgcctgacggagttcggcgccggcgacgagatccgggtgctgccgcagtgcggccacgggttccacgtggcgtgtgtcgacacgtggctcgcgtcgcactcctcgtgtccttcgtgtcgcgcgcggtttgccggtaccgcgcgctgccataagtgcggccattttccggcggtttccgcagccgccgcatcggagtccaaggccgtcggcggcgacaatgctgccgatagcactgcgaatgcgaatcgtaataatgttattattacgaatggatttagtaattacgggttcttgccttgaaagctgttttagtaattacgagttcgcatgtaagtatagataaaattaagtgcttctttcatcatactatactgttcctcatgtgtgatgtatgacgaatttacgaataccctccttcttttgtatttgtatagagtcaactctttgcgcggcatcgataacaaatttagacttgatcatgtcattgacataagaataaaaagagaaaaaaagaggaaaaagggcgcccggtcttaagatccagacttacctcgcttccatgcaactctaactcttctatattgacctatatcaatcacctgccgctatttacacctgtaacgtgaaaaccctaacttccaatgtaatctcgttatacaattccccttgcaa

SEQ ID NO: 5684 - DNA, 945 bp, Glycine max
  misc_feature (23)..(23): n is a, c, g, or t
  misc_feature (945)..(945): n is a, c, g, or t
  Predicted polypeptide sequence is orthologous to G3111
ccccagtgaaaaaaatttaccancattgttcggttgccttactaagggaacaaaagctggagctccaccgcggtggcggccgctctagaactagtggttccttcgggctgcaggaattcggcacgagtctctctctctctctctctctctgttcactctcactttttgttttcacctcctcctaatttccaagcacactttctttgtttcttatttcttcctgtctcaattataagtaaaagaaaaacatatttttaaggagattactgggacagctagatgacgcgagcgttcagaattctcgggtccgcggacaacgccacctcgctggcagcggtagcggcgccgccggaggcggtggcgcttgagtacgaacttctgggtgattctcgcggggctcctctgcgccctcatctgcgtggtggggctggtggccgtggcgcggtgcgcgtggttccggcaaggctccggcggcggaagctctccccggcaagccttggcgaacaagggcctaaagaagaatgtgctgcagtcgctgccgaagttcgcgtacgtggacagcaaccccagcaagtgggtggcgacatcggaatgcgcgatctgcctcgccgacttcgccgcctgcgacgagatccgcgtgctgccgcagtgcggccacggcttgcacgtctcctgcatctacacgtggcttgggtcgactctacttgccctactgtcgcagatattgccgcgaccagtgtcagagtgtggcgtttcccgcaccgtggcgtacttcagacgcctcgaccgacccgaatgagttacgatagatacacgcccctagatcatattacaaattatgacacccgatgcgctgcatacagtgacgtactcgacatgttcgtctcatgggatggtgctgcgaggactataggcgcttattactctcgatcagctgtgcacttn

SEQ ID NO: 5685 - DNA, 677 bp, Glycine max
  Predicted polypeptide sequence is orthologous to G326
gggaagtcagacgagctgcgccagctctaatacgactcactatagggaaagctggtacgcctgcaggtaccggtccggatttctcgggtcgacccacgcgtccgattcgctatgaatcaaggaaggccagggctgatactagaaaaagggtgagagggagatttgtgaaggcaagtgatgttcaagcgtgatgatgagtgccttttcagaaatctcatccgagttcaatgctcgtgtgtgtgtacataagttacactataagagaaatatggatatattatagttttcatgaactccctgagcattgattgatttgaatcttttttggtagttgatttatttgaatttttgtttgttacattatatgggaagagttttttttgtgtgagattctctcataagagggtgatatataagagagacactgacaataaattggtgagtttgtgttagaaaaaaaaaaaaaaaagggcggccgctctagaggatccaagcttacgtacgcgtgcatgcgacgtcatagctcttctatagtgtcacctaaatgcaattcactggccgtcgttttacaacgtcgtgactgggaaaaccctggcgttacccaacttaatcgccttgcagcacattcctcctttcgccagctggcggtatggcgaagaggcccggaccgatcgccc

SEQ ID NO: 5686 - DNA, 653 bp, Glycine max
  misc_feature (20)..(20): n is a, c, g, or t
  Predicted polypeptide sequence is orthologous to G326
ggtttaagctatgaaccacnattatgccaagcgcgcaattaaccctcactaaagggaacaaaagctggagctccaccgcggtggcggccgctctagaactagtggatcccccgggctgcaggaattcggcacgaggtgctgatggatggttataatggtggaaccatagtgatgcctactgtcccaaaaaaagttgcagaatacatgtgttctcaaagccctgacagtgacataagctgtagtagtcccatgtctgattagaggttagcttgtgcagaaagtgtttccatatgtataccttgtatatttattggtaactgtcttttagaccatgacctagcaattatagagtagttcaacatgaaaactttcaacatttgttccgagctacaatacatcctttacaggaatgtatggtggagcatcaaatagttacttcaaaccgtgctttagctttaccactgtaaagaagttcggattttaatattcaggcaaacgacaaattctgccttcaaaaaaaaaaaaaaaaaaaaaaaaaaaccttgagggggggcccggaacccaattcgccctatagtgagtcgtattacgcccgctcactggccgtcgttttacaacgtcgtgactgggaaaaccctggcgttacccaacta

SEQ ID NO: 5687 - DNA, 945 bp, Glycine max
  misc_feature (1)..(8): n is a, c, g, or t
  misc_feature (44)..(44): n is a, c, g, or t
  misc_feature (705)..(705): n is a, c, g, or t
  misc_feature (801)..(801): n is a, c, g, or t
  misc_feature (810)..(810): n is a, c, g, or t
  misc_feature (831)..(831): n is a, c, g, or t
  misc_feature (834)..(834): n is a, c, g, or t
  misc_feature (859)..(859): n is a, c, g, or t
  misc_feature (878)..(878): n is a, c, g, or t
  misc_feature (886)..(886): n is a, c, g, or t
  misc_feature (892)..(892): n is a, c, g, or t
  misc_feature (896)..(897): n is a, c, g, or t
  misc_feature (909)..(909): n is a, c, g, or t
  Predicted polypeptide sequence is orthologous to G351
nnnnnnnncccccccccccccccccagcgaagtttgacggtcgntggttacgccacgcgcgctatttaccctcactaaagggaacaaaagctggagctccaccgcggtggcggccgctctagaattagtggatcccccgggctgcaggaattcggcaccagcacaagcataagcacaagcacaagcacaagcacttctctaattccctttcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaaacccgctgtctccgacaacaattctgcgccgctatccgccgccaaactgagctacaaatgttcggtttgcaacaaagccttctcctcttaccaagcactcggaggacacaaggccagccaccggaagctcgccggagaaaaccacccgacctcctccgccgtgacgacgagttcggcgtcgaacggtggtggtaggacccacgagtgctccatctgccacaagacgttntcgacaggacaggccttgggaggacacatacgttgtcactacgaaggctgtaacagcgccgttacctgctctgagggagtgggtccactcacacangaagccacncgcgaattcgatctcaacctnccnggctttccggactactcagcagggntcttcgtcgatgacgaggntaccagtnctcatncatnncagaagtcccgnttcattttgaccatacccatgattgaaaatcctcat

SEQ ID NO: 5688 - DNA, 996 bp, Glycine max
  Predicted polypeptide sequence is orthologous to G351
aaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcggcggcaccaccaccgtcaacaaccgccacgtcagccctccgccgctacagccacagccacagccgacaccagatccttccaccaagctcagttacaaatgctccgtttgcgacaagagcttcccctcttaccaagcgctcggtggacacaaggccagtcaccggaaactcgccggcgccgccgaagaccaaccccccagcaccaccacttcctccgccgccgccaccagctccgcctccggaggtaaggcccatgagtgctccatttgccacaaatccttccccaccggacaggcccttggcggacacaaacgttgtcactacgaaggtaacggtaacggaaataacaacaacagtaacagcgttgtcaccgtcgcctcggaaggcgtgggctccacccacactgtcagtcacggccaccaccgcgacttcgatctcaacatcccggcctttccggatttttcgaccaaggtcggagaagacgaggttgagagccctcaccctgtcatgaagaagcctcgcctcttcgtcattcccaagatcgaaatcccccaatttcaatgaactcgttgaatttttagtttatttttcgactatatattttggagaattttgagagttactataatttgattttgtacatagtacttggaagttttgttggaccgtaccggacccagttctctggttgaggttgtactttcacaacagtggcagatttgcaattcaattcaatttatttgtttattttaaaaaaaaaaaaaaaaaa

SEQ ID NO: 5689 - DNA, 706 bp, Glycine max
  misc_feature (591)..(591): n is a, c, g, or t
  Predicted polypeptide sequence is orthologous to G363
gatgcgtgagcgcgcgtaatacgactcactatagggcgaattgggtaccgggccccccctcgagttttttttttttttttttttttttttaatgaaaattcaaataagctaaataagccattgaaaatacaagtctcactgtacagtacaatcaccataaatcaataatttaaagtctgaagagaatgaaactaaagatgaaaaagctttaaagctttacattgagaacatgaggaggcttgtacagatatgtttgtgcatgccacaaaactagtatttgaattcaattaagatgaaaaatctcaaagcctcagagtgagatcaggagacacagatgtttgtgcttgaggtgcagttgctactacaaaactagtatttgaattatgagcatgctcaccatgcctcaaattaacataacccctttcatcaatctgtctgaaacttccaggccaaaacagaccaacatcatcatcttccacgaagatcgtgtccgaaaatagtctttcccgaatttcgctgcagcactcatatcaggagccctcattgaatgatgcacatgcccttggtgcattgcagcatgagcttcgagtncaagcgaccgaaaagcagaaccatggagaggcacctgagccccggggatcactagtctagagcggccgcaccgggtgagctccacttttgtcctttatgaggtaaatgccgctgg

SEQ ID NO: 5690 - DNA, 895 bp, Glycine max
  misc_feature (1)..(4): n is a, c, g, or t
  misc_feature (463)..(463): n is a, c, g, or t
  misc_feature (470)..(470): n is a, c, g, or t
  misc_feature (619)..(619): n is a, c, g, or t
  misc_feature (686)..(686): n is a, c, g, or t
  misc_feature (716)..(716): n is a, c, g, or t
  misc_feature (737)..(737): n is a, c, g, or t
  misc_feature (756)..(756): n is a, c, g, or t
  misc_feature (803)..(803): n is a, c, g, or t
  misc_feature (805)..(805): n is a, c, g, or t
  misc_feature (812)..(812): n is a, c, g, or t
  Predicted polypeptide sequence is orthologous to G363
nnnnggattgaggtcgacctgatacgccagcgcgcattaaccctactaaagggaacaaaagctggagctccaccgcggtggcggccgctctagaactagtggatcccccgggctgcaggaattcggcacgagcacaaacatgatgactccaaacttgaacttggaaatcgaaaatcattcagaaggcagcagccaagtggcttcaaatgtatccttgcatgaagcatctcatgatcttacaaagggcagcaccaccacttcctcctgtctcacaaaggatgaaactgatccaggtttcattacccttgacttgacactcaacttcaataattccggtgatggcgagttgaaagtctcgagtgatgctagcagtgaagttggagctgaagctcctgcttcagcatcagcaactccaagggttttctcttgtaactactgcaggaggaagttctatagctctcangcattanggggtcatcaaaatgcacacaaaagggagaggacgatggctaagcgcgcaatgcgaatggggatgttcactgagagtttacaagcttggcatctctacctcttcatggtcacctttcaggtctcttggccctgaagctcattctgcaantgcacgaagaaccgtgccatcctccgtgacagcactgagggctcctgatatgagagctgctgcaaantttgagagaaaccaaatttggatcactgtnttcaaatgagatgggatgagntgatctttgggcccctggntcaaacagtagaccaacaaagagctctggtaaggtatgagaatgccnanagtcaanagctagtacttccatgtgcctctcacaccagttctgattttctgtctacaatgagaacctagttaggttagacatgcatcctc

SEQ ID NO: 5691 - DNA, 794 bp, Glycine max
  misc_feature (7)..(8): n is a, c, g, or t
  misc_feature (513)..(515): n is a, c, g, or t
  misc_feature (687)..(689): n is a, c, g, or t
  misc_feature (728)..(728): n is a, c, g, or t
  misc_feature (738)..(739): n is a, c, g, or t
  misc_feature (742)..(742): n is a, c, g, or t
  misc_feature (754)..(758): n is a, c, g, or t
  misc_feature (764)..(766): n is a, c, g, or t
  misc_feature (785)..(785): n is a, c, g, or t
  Predicted polypeptide sequence is orthologous to G363
atcattnntccattatcctgaacgctgtatcatggttcatgaataacgaagtaaaatacatatgagaggaaaccattaataacatgtgagattaaaataagctaaaatcgccattggaaatacacatctcactgtacaatgcacgccctattaattaataatttcatgtctgaagagaatgaaatcaaagactaaaaaatctcaagagaagtgatacatacacacataaaaactctgataattaaatccctcacaatgaaaatgagtggttgagaaaattttggctgaatgcaaagcaatggatgagtcagttcttagccacttatttattactttgtgaggcctttgcttgtgtatgtatcatcattcttaagccttaaacttaaagcttcaatgtgagatcaggagatgtagaagcttgtggtggaggaggcaccattggaattaaactagcatttgaactttgagcatgtcctacattaacaccagctccttgttggtctacctgtctgnnnctgccaggccaaaagaatccaacatcatcatcttccacgaaaaccagtgatccaaattggtttctctcaaattttgcagcagctctcatatcaggagccctcagtgctgccgcggaggacggcacgtgtcttcggtgcattgcagaatgagcttcaaggccaagagacctgnnnggtgaaccatgaagaggtagagatgccaagcttgtatanctctcagtgnncanccccattcgcannnnncgcttnnncattgtcctctccattttntgagcattt

SEQ ID NO: 5692 - DNA, 704 bp, Glycine max
  Predicted polypeptide sequence is orthologous to G385
tttttttttttttttttttttttttttttttttttttttgtgaaactgtgacggcggtaacatctgtgacaacactagagaaagagatgaagtttacaatacaataggaaaagtcaacataaccacacttaggaaagtttgctcaatcctacaaatactactccaaaattctacgctaaaataaatagcgagtctgaaatttgcagtttttctaagttaaaatactacagctggatggaaccattttagtcttcaattcataagtgaaagtcaatacccgaacctaagattcttcaaactcctaacgttgaagtgatactccgaggtgcgttcattgacttcttgcccttgttttggaaacgaaataggcaccactccaagctcgatcgttactttctctaccttaatttgttcttctgacatgtttttgaaagttctgaattgaaatcaggtgttgttgttgtcccgtttgactgcaactttgatcctttcaactgtgcacttaattaaactgttaacagtggccactgaacccagagataactttgcggttggagctgaatcaactaagatctggaatccaactgtgagtagagaacctccagatccaacttcatgctttggcccaccatttaatgccggaggcccatcaggaagaatagcaaagcccgaggggagcagggcaacataatctggatctcctc

SEQ ID NO: 5693 - DNA, 802 bp, Glycine max
  misc_feature (612)..(612): n is a, c, g, or t
  misc_feature (645)..(645): n is a, c, g, or t
  Predicted polypeptide sequence is orthologous to G385
aatgaactgcatgagaagactacgccaagcgcgcaattaaccctcactaaagggaacaaaagctggagctccaccgcggtggcggccgctctagttctattggatcccccgggctgcaggaattcggcaccagatcgttctcagtgctgcaacttctttttggcttcctgtgtcaccaaaaagggtttttgaattcctccgcgatgagaactccagaagtgagtgggatattctttccaacggtggagttgtccaagaaatggcacacattgccaatggccgagacactggaaattgtgtctccctacttcgtgtgaatagtgcgaattcaagccaaagcaacatgttgatattacaagagagttgcgcggactcaacaggatcttttgtgatatatgctcctgtagatattgtggcaatgaacgtggttctgaatggaggggacccggactacgtggcccttcttccttcaggatttgctatactcccagatggaaccactgcacatggaggtggcattggtgacactggacatggtggttctctcttgactgtggcatttcaaatattggttgattcggttccaaccgcaaagctgtctcttggatctgntgctactgttaacaatctcattgcctgcactgntgagagattaaagctgcttatctggtgagttgctgacctaatgatcatcctttagaaaaggataaagggtgcaatgcatttggacaaatgggaggtgtggaacttcgcttataccaaaatgataagaattgaaagtcagaacgcctttctggatctt

SEQ ID NO: 5694 - DNA, 1539 bp, Glycine max
  Predicted polypeptide sequence is orthologous to G4
attgagccaaagctttgtattttctgcgataattttccattgggtggaagaaagtctcaacctttattcgaaagagcaaggatctgagttgagttgagtgatcatgtgtggtggtgcgattatctccgacttcataccggcaggtcccgccagcggggcgcggcgcgtgaccgccgacatcctgtggccgagtttgaggaagcgcttctcgaagccgctgctggacgatgatttcgaggctgggttcagagaattcaaggatgattcggaaatcgaggatgttgatgacgaggacgatgaagacgaggaggagttgaagaagaagccctttgggttctctcgctccagcaacaaggctgcttctaagcctctctctcgtggagcaacaactgtgaaatctgtggaatcaaaggggcaagctgagaagtgtgccaagagaaagaggaagaaccagtatcgcggaatccgccagcgtccatggggaaagtgggctgctgagattcgcgacccaagaaagggggttcgtgtttggcttggaactttcagcactgctgaagaagctgcaagagcttacgatgctgaagcaaggaggatccgtggcaagaaagccaaggtgaatttccctgatgagccttcaggcgctgcttcctcaaaacgtctcaaggcgaatccagaggctcagccaatgaagaaaaatctgaactctgtgaagccgaaaataaaccagatgttcaattttggtgacaatcttgagggctactacagccctatagatcaggtggaacagaaaccactggttaaccagtatgttaaccgtgccccgtttgctggaaatggagttcaagtctcacctgttactccatctgctgatgttactgcttacttcagctctgagcattcgagcaactcgtttgattattctgaccttggatggggtgaacaagtccccaagacccccgagatctcatccttgctttctgctgctcctttggagggtgctgctgatcaggttcagaagaccaacaactcgcaggatgtggtggctgcacaagatgattctgcaaaaaccctttccgaagagcttgcagacattgaatcccagctcaagttctttgagaccccttcttttcttgatgaagcctgggctgatgctacattggcgtctttgctcggcggagacgcaactcatgacgccgccggaaaccctatgaacctttggagcttcgacgacctgccttccatggcaggagtcttctgaacaccctttatctccccttttatgtaaataaagctacaagaattgtgatcgtgatgttggtgatggagtccacagccaagaaacctgcttaaagcttatgtggagtttattttatcttgtagctaatgcagtagtataggactatatataggtttttattatagggtatccttttgtgaactcaaagacctcgttttcaggggattttctgtttgatgtccttaaggattatcaattatgttatatatggtcttggataaaaataaaaaaaaaaaaaaaaa

SEQ ID NO: 5695 - DNA, 868 bp, Glycine max
  Predicted polypeptide sequence is orthologous to G409
atagtactaattaaccatgttttaatacttgaacaagaaatatacttactttaattttggcagtacaaccattaaccaacacaagacaccattgaccaaattactactagactttatttattaaactcgggttaaggacacttcaactcctcctaggggtccaagccacccaatccaggcgtttactttttcctccctcgcccacatgatacattatacaatattattacgttttcttaattaagcatctaatttcgaaagcactgctgcattaccattttatccaacataatacatattagtccaccaacccaatgtctctccttcctcatggttttggtgctcagtttcagataccacaaacacatccaagtaactcctcccatcatcactcccatcctcctcctccgactgaaccctctcgaccgggcccacacatccaccatagttgtcagctagaatgtatgaatcaacactgtcaacaaccacctgtggactaccctcatccaccaccgcacttccaacactcccactactcaggtggtcctccacccttgtgccgaaaatcggagccatatcttcatctactggaattggatcaactttcttgtcacataatggttcctcaggcacctctttagcttgaacttgaagcttttcatttaaggataccacctcagatttgagtttctcattctccttcataattgaatcataggatgaaagtagggtatcgtatgaagacttgagaacatcataatccctttcaagttgcttggtcttccatcgagccctgcggttctgaaaccacacagccacctgcctggggctgcatcccagcttcttagccaactgggtcttcctctca

SEQ ID NO: 5696 - DNA, 1252 bp, Glycine max
  misc_feature (1)..(3): n is a, c, g, or t
  misc_feature (595)..(595): n is a, c, g, or t
  misc_feature (689)..(689): n is a, c, g, or t
  misc_feature (902)..(939): n is a, c, g, or t
  misc_feature (1190)..(1190): n is a, c, g, or t
  misc_feature (1194)..(1194): n is a, c, g, or t
  misc_feature (1219)..(1219): n is a, c, g, or t
  misc_feature (1227)..(1232): n is a, c, g, or t
  misc_feature (1235)..(1236): n is a, c, g, or t
  misc_feature (1238)..(1243): n is a, c, g, or t
  misc_feature (1247)..(1248): n is a, c, g, or t
  misc_feature (1250)..(1251): n is a, c, g, or t
  Predicted polypeptide sequence is orthologous to G409
nnnggcgagggtgttttttttttttttgtaaggagaaaatgctcacgccaagcgtgcaattaaccctcactaaagggaacaaaagctggagctccaccgcggtggcggccgctctagaactagtggatcccccgggctgcaggctgcatgcaagttttgagaatcttaagtccaactatgacagcctcctcaaggagaaagacaacttaaaagctgaggtggcgagcctcaatgagaaggtgcttgcaagagggaaacaagaggggcacatgaagcagcaggctgaaagtgaagaagaaacaaaaagattattgcatttgcaggaacaggaaccaccccagaggcttttactggaatcagtttcggagggagaaggatccaaagtctcttctgttgtcgggggttgtaaacaggaagatatcagttcagccaggagtgatattttggattcagatagtccacattacaccgatggagttaactccgcactgctagagcatggtgattcttcttatgtgtttgagcatgatcaatcggatatgtcacaagatgaagaagataacctcagcaaaagtctctacccttcgtacctctntcccaaacttgaagaagatgtggattactccgacccgcctgaaagttcttgtaattttggattttctgaaggagatcacgcactttggacctgngcatactaagttttcttcatggtcatgttgtgtgttgtgtcatatgttttttagtaattagtattagtatttgcactttttgtccagctttcaaaatgctatagctttagcttatcaggaaagaaagtttggtttctttggctcatttggtaagactggaaatcaactggtggttcaaagtaataaatatggctcttgttggatgtaaaaaannnnnnnnnnnnnnnnnnnnnnnnnnnnnnnnnnnnnnaaaaaaaaaaaaaatctggggggcccggccccaatccctatggggggttaccgcctctgggccgttttaaaaggggagggaaacctgtgtcccaataacggtgccaacccttttccggggggtaaaaagggccccagccccctccaatggccaaatagaagggcccctgggcataagggggggggggggacggagcaattccccccacccgcctttttccttttttctggcgctcccaaaaaggggcgtgnggantagtgcccccaaaaaaagggggtgngggccccnnnnnnttnntnnnnnntttnntnnc

SEQ ID NO: 5697 - DNA, 888 bp, Glycine max
  misc_feature (5)..(5): n is a, c, g, or t
  Predicted polypeptide sequence is orthologous to G409
ccccntcaccccccgcccccagccgccccgccgcccgcccggatgaacaacatgccagtccccagctaaaattaaccctcactaaagggaataagcttctctgaggatccaaccatggcggctggaactgtcttctgcgctgctgctactgctgcttctaatttgacaacaaccacttttcttcacaaccaaacacctccttccacctcctctcagcctcctctcgattctcttttcctctctgcctcttcccctttcctcggttcaagatctatagtgagttttggagatgttcaaggagggaaggggtgcaatgattcattcttccggccctatgatgagaatggggatgaggacatggacgagtacttccaccagcctgagaagaagcgcaggctctccgcggagcaagtgaagtttctatgagaagagctttgatgaggagaacaagctcgagcccgagaggaagatttggctagccaaggaactcggcttgcagcctaagcaggtggcgattcggtttcagaaccgccgcgcgcgctggaagaccaagcagatggaaaaggactatgattccctgcatgctagttacaatgatctcaaggctaactatgacaaccttctcagggaaaaggataaactcagagctgaggtggtcacttgttgaattcttggtctcgatggccaaattacctatagtgagtcgtattacattcgtaatcatgtcatagctgcatcctgtgtgaaagtgtatccgctcacaattccacacaacatactagccggaagacatacgtgtaaagcctgggtagcctatgagtgagctaactcacattaactgcgttgcgctcactgtccgcattctcagtcggcaaagctgacatgcag

SEQ ID NO: 5698 - DNA, 1136 bp, Glycine max
  Predicted polypeptide sequence is orthologous to G409
ggcacgaggtcacttctcctccaaaacgaaaggctcccttgctcctctgaagtccttgagtctctttgggctcagacctctaaccctgcttccttccaaggttcaaaacccgtggttgattttgagaatgtaagtgggagcaggatgacggataggcctttctttcaagcgttggagaaggaagagaactgtgatgaggattacgaggggtgtttccaccaaccggggaagaaaaggaggctcacaagcgaacaagttcagttccttgaaaggaactttgaggtagagaacaagcttgaacccgaaaggaaagtccaacttgcaaaagagcttggcttgcagccaaggcaagttgctatatggttccaaaaccgaagggcaaggttcaagaccaagcagctagaaaaagactatggcgtgttgaaagctagttatgacagactcaaaagtgactatgaaagtcttgttcaagagaatgacaagttaaaagcagaggtgaattctctggagagcaaattgattcttagagataaagagaaggaggagaattcggatgacaagtcatctcctgatgatgctgtcaattcttcttcaccccacaacaacaaggagcctatggatttattaattatttcaaaaaatgcaacaacaacaacaacatctgaaaatgggaccaaagtgttgtcaccactcccactccctattatggtaacatgctgcaagcaagaagatgccaactcagccaaaagtgatgtccttgattcggatagcccacattgcacttcattcgtggagcctgctgattcctctcatgcctttgaaccagaagaccactcagaagacttctcccaagatgaagaggataaccttagtgaaaaccttttgatgaccttcccttcttcttgttgcttacctaaggttgaagaacactgctatgacggccctcctgaaaactcttgtaattttggcttccaggttgaggatcaaaccttctgtttctggccctattgaaccaaaccaaccaaccaaccgctagcaatgttttaaaaaactttgcagttgtaaccatgtactagaaagcaataaaaatggtattgttacttctaaaaaaaaaaaaaaaaaaaaaaaaaaaaaaa

SEQ ID NO: 5699 - DNA, 834 bp, Glycine max
  misc_feature (47)..(50): n is a, c, g, or t
  misc_feature (817)..(818): n is a, c, g, or t
  Predicted polypeptide sequence is orthologous to G428
cgtattgccatgaaataatgattcagtaacattgatcgattatcacnnnncgtcgcgtatattagctacagttttttacacttgcatatatatatatatatatagctgaaggacctacttagcatacaaatgtaggttcaaaaaattaatatctcgcggaatagaaggtatacacacatcacacgagcagaagatacaagtattgggaatcaacacggtccatctcgagaaataaatcacataggtcctcctaagccactgccacttacaccatccataatggcaaatcgcatgtcctctgttggtttccaatgccgtttcctttgattgatgaaccaattattgatctgcttttgatcaagtccggtcatttctgatagctgcactttctcttcctccgtaggataaggccacctatagtgtgtgttccaccagtccatgagtatcatccttgcatcctttggtagcttaccttttttccttttctttagaaattcctttctcaagctgctaagataaccaccatacttacgaagaagcatttctttaagctcttgatcacctggacgtgggccagaagattcgtcaccatcaactgcttccaccttctcccaacttaattcatcctctgatattcctgcagcctcatctgagcggttgttattcagtggcattgttagcgttcccttacaaagattgctgagttgtgattcgatactgcacaaaaacaaggtcgcttcgttgaatggcttcgacaactcctgcttgtatctatgaagaacttcgcagtatgactccatgaactcgtcaagctcannatcatttcctatctct

SEQ ID NO: 5700 - DNA, 931 bp, Glycine max
  Predicted polypeptide sequence is orthologous to G450
ggtttttgataaaaaaaaaatcaagatgataacccatgatttccttagaacatgcataatattttacgcaaagtttcttggataaggactagttttgaagtaacattgtgatgtgcatatcaagctcctgtcttcttttttctgccttttgtgttccatattctttttcattgaaactattacaaggtcaaattattgcaaccaaaataatttcgatcgggtcatcaagtggagaaaaaaaaaaattactcccatggcacatcaccgacaagcatccagtcgccatccctgtcttcataggtcgggacatagtcggagctgttcagaagatccatcaacttgctctcattcatgaaatccttgaagccttgggattcacaatttccaatggtgaaggagctaaacattttgcccaaggcatcagagagctcagggtaactcttgtacatcttcaagtcaactttgcggaggtaaggtgctccatccatgctaactttgacaaagcttgcattagggctgttcttctcgctttcctctccgccgctgctcttttgggctgcaaacatgttcttccggaaagaccttacaggtggccatcccaccacttgcgccttggcaggaggctttgcgggatcgagaagaggaagattcttctccttcggcgaagtctttggattctcacgtggatctgctccatcagtagtagcagcagcagaagcttccttgggagagaggttaagcatcaaatcaacggaggttgtttcatcggtttcagtttcagagaaccctctcttcctcactcctaattccgcagcagcttcagttgttggcgcggctccatttcagggagtcctagtctcagtccaagcctcagctcagttttctcaaacaccatcttcttctcctttcttcttgtttcactcgacagcaa

SEQ ID NO: 5701 - DNA, 1052 bp, Glycine max
  misc_feature (1)..(2): n is a, c, g, or t
  misc_feature (583)..(583): n is a, c, g, or t
  misc_feature (703)..(703): n is a, c, g, or t
  misc_feature (712)..(712): n is a, c, g, or t
  misc_feature (730)..(730): n is a, c, g, or t
  misc_feature (750)..(750): n is a, c, g, or t
  misc_feature (917)..(918): n is a, c, g, or t
  misc_feature (993)..(993): n is a, c, g, or t
  misc_feature (1005)..(1005): n is a, c, g, or t
  misc_feature (1030)..(1037): n is a, c, g, or t
  misc_feature (1045)..(1045): n is a, c, g, or t
  misc_feature (1047)..(1050): n is a, c, g, or t
  misc_feature (1052)..(1052): n is a, c, g, or t
  Predicted polypeptide sequence is orthologous to G450
nnccgctctattatcattttcggtgcacgcaacccaaccctcactaaagggaacaaaagctggagctccaccgcggtggcggccgctctagaactagtggatcccccgggctgcaggtggatttgaagcttaacctttcctcaacctcaaacagtgcttcttctgacctgactaaagagaagaacatcactgctgctgcacctcctgctaacgacccagcaaagccacctgcaaaggcacaagtggtggggtggccaccagtgaggtctttcagaaagaacattgttcaaaggagtaacaacaatgagggcgaaaaagccgccacaagtagtagcaacaatgtgaacacgggagcagctttcgtgaaggtgagcatggatggtgctccttatttacgcaaggtggatttgaagttgtacaagagctaccaagaggtgtgggatgcgctggctaaaatgttcagttcattcaccattgacaagtgtggatcccaaggcatgaaagacttcatgaacgagagcaaattgattgatcttctcaacggctctgatacgtaccaacctatgaagacaaagatgctganctggatgctcgtggtacgtaccgtgggaaatgtcgtggatcatgcaagcgcctggtataatgaaaggatctgagcatcggctacaccaagacagtgggaaggcaagacagagctaagcanattgtaatncacttcgacacatctgtntattgtgcttttgcgcacgnaagcatatgtattctcagccaaggtgctaatagaaccagtgtcactatgtcgacattctagatatttctgggttggatggattttatagagaaatttattgattagcagaaaaaagagtgtttttgcccccctttgtaccaaccggctgtaaaaaaaaaaaaaaaannaaaaaatgggccgccatcccttttgagtccctcctgcctttaacgaagaaacgtcattactgacacctttctggngtaaagcccacnccccccatgcgcttaggagcgggtnnnnnnnngggtgccntnnnncn

SEQ ID NO: 5702 - DNA, 1240 bp, Glycine max
  misc_feature (625)..(625): n is a, c, g, or t
  misc_feature (690)..(690): n is a, c, g, or t
  misc_feature (717)..(718): n is a, c, g, or t
  misc_feature (774)..(774): n is a, c, g, or t
  misc_feature (1227)..(1227): n is a, c, g, or t
  Predicted polypeptide sequence is orthologous to G450
gggggggtttgataaaataaagtccgaatcacgccacccgcgcaattaaccctcactaaagggaacaaaagctggagctccaccgcggtggcggccgctctagaactagtggatcccccgggctgcaggctttcaccgaagaataacttgactttcccgaactccacctgagaaaaagatacccttaattcgcaggcgcgtcttgtgttggacaacaaccacaagatgattaacttcgaagaaaccgagttgcgactcggcctccctggcaacgactcagcactcaagggaagtgctgccaagagaggcttctctgaaactgcttctgttgatttgaagcttaatctttcttcttgcattaacgactctgcctcggattcaccctcatctgtgtctacagagaagcccaaagagaacaagactaccactgctgaacctcctccagctaatgatccagcaaaaccacctgcaaaggcacaagtggtgggttggccaccagttaggtcatttagaaagaacatagttcaaaggaacagcaatgaagaagaggcagagaagagcacgaagaatgctttcgtgaaggtgagcatggatggtgcaccgtatctacgaaaggtggacatanagttgtacaagagctaccaggagctgtcagatgcgctggctaaagatgtcagttccttcacgatngaaaagtgtgggtcccaagggatgaanngacttatgaatgagaccaaatgctctgactatgtacccacatatgaagacaagacngagaactgatgcttcgcggtgatgtgccctgggagatgttcgtgaatcatgcaagcggttctcaaattgaaagggttcaggcatccggctttggcccaaaccctgggaaaatgcaaaaccgagctgaaaaaggagttctttctctccacggggaccaattggctggcccgaccggtcttattggggaaaaggtaaacaacggggccttgtctcttttggattttttttggggttattggattagaaaaatgtgaaaaaacaaaaaaaaaaaactggggggggccggcccattccctttgggggtatatccgctcatcgtcgttttacgggggagtgaaacctttaaccatataacctgaaactcctttcctgggtataaagaagcccactgcccttccatttgacataggaagggccccctgggctttgcggggggtttcgccagatcatccnacataccttttta

SEQ ID NO: 5703 - DNA, 922 bp, Glycine max
  misc_feature (19)..(19): n is a, c, g, or t
  misc_feature (21)..(21): n is a, c, g, or t
  misc_feature (697)..(697): n is a, c, g, or t
  misc_feature (922)..(922): n is a, c, g, or t
  Predicted polypeptide sequence is orthologous to G450
cagtcccagtgctattcancntcagcgcgcaattaaccctcactaaagggaacaaaagctggagctccaccgcggtggcggccgctctagaactagtggatcccccgggctgcaggaattcggcacgaggggagctatagccataaggagaaaaactttcaaagaggtgaaagcaaaagagttcttcttttccttttttatatatacttgggtgctaagctgtgtgagttcattgacaagcctgaaatggcaactatgctgacaaaggagcatggtctgaacctcaaggagaccgagctttgcctcggtttgcctggtggggaggcggcggcggcggcggcggcggcggcggcggtggtgaggtggaaactccaagggccactgggaagagagggttctctgagactgttgatctgaaacttaatcttcattccaaggaagatctgaatgagaatctgaagaatgtctcaaaggagaagaccctccttaaggatcctgccaagccaccggctaaggctcaagtggttggttggccaccagtgatgtcatacaggaagaacatgatggcagtacaaaaggttagcactgatgatgtggcagagaagacaacaagcagcactgctaatcctgcggcatttgtcaaggtttccatggatggagcaccttacctgcgcaaggtggacctcacaatgtacanaagctacaaagaggtatctgatgccttggcccaaatgatcaacttcttcaccatgggtaactattgggccccaaggatgatagacttcatgaatgatagcgagttgatgaatctcttaacagctctgagtatgagcaagctataagataatgatgtgactgaatgcactgtgtgagtaccatgcgaatgcggttgatgatgctgctgcttcgatatgtatgggan

SEQ ID NO: 5704 - DNA, 869 bp, Glycine max
  misc_feature (641)..(641): n is a, c, g, or t
  Predicted polypeptide sequence is orthologous to G450
ctggttgatcgccttgttgctgattacgccaagcgcgcaattaaccctcactaaagggaacaaaagctggagctccaccgcggtggcggccgctctagaactagtggatcccccgggctgcaggtgaatgagaggaaactgatggagtctggaaatgggattgaatacatgcccacctatgaggacaaagatggtgactggatgttggtcggggatgtaccctggaagatgtttgttgaatcatgcaagaggataagacttatgattagctcagaggccgttggtttaggtccgaggtctacttcttcaaaatgtacgggttccacctagctagctagaagaataattaattagtgcgtaataatgataagctgatagctgataattaagcattccttggacaccttcaacgtttacaagctccggttagaagaagagtgaatttggtacagggaaatatccatgcatggtgcttgatgtacatgtccctttagcacctctggttaattagttacttttgttttgactttaaatgaagaactagaacaaaaaaaaaaaaaaaaaaaaaaactcgagggggggcccggtacccaattcgccctatagtgagtcgtattacgcgcgctcactggccgtcgttntacaacgtcgtgactgggaaaaccctggcgttacccaacttaatcggcttgcagcacatccccctttcgccagctggcgtaatagcgaagaagcccgcaccgatcggcctttccaacagttgggcagcctggatggcgaattggaagcgctcttgtgccgcgcatttaagcgcgggggtgttgtggtatcccccagcggaaccctacacttgccctcgccttgcgccc

SEQ ID NO: 5705 - DNA, 731 bp, Glycine max
  Predicted polypeptide sequence is orthologous to G450
tactaatccgccagctaaagctcaggtggttggttggccaccagtgagatcatacaggaagaacatgatagcagtacagaaggtcagcaatgaggaagtagcggataatactacaatcagcactcttgctaattctggggcgtttgtccaggtttccatggatggagcaccttaccttcgcaaggtggacctcccaatgtacaaaagctacataagacttatctcatgccttggccaaaatgttcagctccttcaccatgggtacctatggggccctaggaatgatatattcatgaatgatagcaaattgatggatcttcctcccagctctgagtatgtgcccccccatcaaaatactgatggtgactggatgctcgtgggtgatgtcccatgggagatgtttgtggtggtcatgcaaccgcctggcgaaattatgaatggatcagaaacgattggtccttgcgtccaaaacattggaaaaatgcaaaagcagaaggggaagctggcccaatacaacgttctacgagagatcccgtacgccactggacctatggaacaaattatatcacccacttcagctacactatggagcggaatgttgttggttgaatgtgtctggtgtttggcgttttgttcgtataaagattgtgtagtgtaaaacaacggtgccttaacctatacggtctggcgtgtttaggatgtgatcgtccaggctgtccggatggtatttg

SEQ ID NO: 5706 - DNA, 1784 bp, Glycine max
  Predicted polypeptide sequence is orthologous to G450
gaaaggttgaagaattatttagaatgataaaagccatgaaaacagtgagttacttaccctcttgtgtgtgaaatgacgaaaccctaggagaaggagagtaataaagaaagaaatatgtggtgtaagcaagcaacatggagtgtccacttccgcttcttccactgaacaatcataggaagatagcatcaccttgtcgtcagcaagggcagcatgcacagaaaagtccagctcacacattcctccacgtgtcacaaacccatttccctctaaaaagacaggacgcaccatgcgtccttgtattatacgtccccttgtcctgcccctgcccctataccatagaacattagtacccccacacacacccctcctctatctttcactattattgccacacaaatcaattaactgaatgcttagagagagaaagaggagaaggagtagtgataaggtgatcatagagcatattataagagagtgaaaactaatggaggttggcctcaagaaggagaacatggggtttgaggaaactgagttaaggcttggactgcctggaaacggaggcactgaagaagtgctcatcaggaagaggggtttctctgagactgaaactggtcatgaagatgagtctgccaccactgtggatttgatgcttaatctttcttctaaggaggccgcaaccactgctgctgctgctgcagatccaactgataagcacaagactttgcctaaggagaagacccttctgccagcagatcctgctaagcctccagccaagacgcaggtggtgggttggccacctgtgcggtccttccggaagaacatgttggctgtgcaaaagagcgttggagaagagagcgagaagaacagcagccctaatgcaagctttgtcaaagttagcatggatggagcaccttaccttcgcaaagtggacttgaagatgtacaagagttaccgagagctctctgattctttaggcaaaatgttcagctccttcacctttggcaattgtgaatcccaaggaatgaaggatttcatgaatgagagcaagctgaatgatctcttgaacagctctgattatgtcccaacctatgaggacaaggatggtgactggatgcttgtcggtgatgtcccatgggagatgtttgttgaatcatgcaagcgtttacgcatcatgaaaggaaaggaggctattggtcttggtcttgcaccaagagccatggcaaaatgcaagaacaggagctagactagtcgcacaattcatgacctgccccatcctttgtaattgtggtgcccagttggcttagtaactaaagtaaggataagctgcagcagacacggatggacattgcagggtgttgaattatagttaatttgtgtatcattatggtttgttataatatttcaaacaaaacaatgagatgcatgtctaattaagtactaattatgaacaggaacataatgactctcaatcatgttgttagacttggctttcttatatatctttgcttgttctgtgtgagtgcttgcttaataataattttaagatgtgtttgtctgttgtagttgtagcgacatgttatcatgctttacatttaaaattgtcttgtaaaggttttccttatcattatgagattccttggtattaatcatttttcatataataacaaaattgtatttattacatttacgttagtttttgttgtgatcatcaagagccgaatatatagtactggaaatgttccctgaacatggtggatgggaaacaagaacatgtgcgtgttcat

SEQ ID NO: 5707 - DNA, 918 bp, Glycine max
  misc_feature (870)..(870): n is a, c, g, or t
  Predicted polypeptide sequence is orthologous to G451
acaattgaaatagcattagcttttcttatattttctttctctttcttttttagaggattacatataatttagaaagcagacctcaaagccgcctctgctgaaattaataaagcaaaaataatggatacatagataatatccatctattttcctaatatatatatatatatatatatatatatatatatatatatatgagttctcataaacaccatgtatttgcttgcacaacacaaagggtatttgtctttgaagacctcatgtgactattttgatttgatttgcttttgcaagttttgttggtcacaaacaacccaacccctttgcttctgatcctttgattattttcagcctcttgcaggaggatacaaacatgttccatggaacatctccaaccagcatccagtcaccatccttgtcttcataagtaggagcgtattcagatccattgtaaccttccctctctgaatattcaccaaatgtgcacttgaacaaattttgcaaggccatgaggagttctgggtagctattgtaaaccttcagatctatcttcctcaagtaaggtgcaccagccatgctcactttcaaatacgttccacttccatcaccctgctgctccaccttcttctgttgttgcagactgttcttcctaaaagatctaattggtggccaccccactacttgtacctttgcaggttggacactgtcttcatcatgatcacttgtggtggtagaatctgaagaaccattagagttgcacctggactcttccacactgggttctggtgaagatctcttgttgcttctaacaacagatccactactggatgaacttttgtcatgagtttcatcacaggcgggtaatcccancctcaactctgtggccttaagattcagctcagtttcaaagctccccat

SEQ ID NO: 5708 - DNA, 924 bp, Glycine max
  misc_feature (1)..(2): n is a, c, g, or t
  Predicted polypeptide sequence is orthologous to G451
nnttcttggaaggaactttagactaggcggcgcgcgcagttgaccctcactaaagggaacaaaagctggagctccaccgcggtggcggccgctctagaactagtgtattccccgggctgcaggaattcggcacgaggttttgattaacttgaaattgttcaacaagaaatggagaattcattgggaaagtacggaaaagagcttaatctcgaggctacagagttgaggttggggttgcctggaagcgatgagcctgagaaacgttctgctgttagaagcaacaagagatcttcaccagaagcaagtgaagaagagtgcataagcaagggcaacatgaattcttctgatggtgtttgatatcacatgtgatgaccaagacaactttgtgccacctgcaaaggcacaagtagtgggatggccaccggttccatcatataggaagaatagtctacaacaaaagaaagaagaacaggctgaatgggctgggatgtacgtgaagttagcatggaaggtgcaccttacttgaggaagatagatctaaaggtttacaagagctacccataactcctcaagggcttggaaaacatgttcaagtgcacatttggtcaatattctgagtagtaacggtataatggatctgaatatgctccaatctatgaagacgatgatggtgatcggatgctcgttggagatgtttatggaacatgtctgtgcatcctgcgggatgcttagatcatgaaaggtcagatatctagggatcggttgctttgtgctaacactctgtatgactatatggatactctttcatactgctagcaaccatatctgtatctctccgcgcgatctctgcgctgtcacgtccagttgacatctgtatgtctcgtctgatgttggtatatgcatgttcttatatgagacttcttt

SEQ ID NO: 5709 - DNA, 909 bp, Glycine max
  misc_feature (581)..(581): n is a, c, g, or t
  misc_feature (613)..(613): n is a, c, g, or t
  misc_feature (903)..(903): n is a, c, g, or t
  misc_feature (906)..(906): n is a, c, g, or t
  Predicted polypeptide sequence is orthologous to G451
gagagggttgatgaacgccttgtatgatcacgcatttaatacgactcactatagggaatttggccctcgaggccaagaattcaagcgttagttggagatgttccatgggacatgtttgtgacttcttgcagaaggctaagaatcatgaaaggatcagaggcaaggggtttgggttgtgctgtatgaggaaccaaatcactaaaaaattactatgagcagagaattaaaagtgttttgggggtgaagggaaaacatgctgaaaagcttgtgttctcggatctgaagggttttgacttttgaatcactctagtgtatgcttttggcatacctttatacgaagttatactctgaagcaggagaagatggaagatacggtgcaggttcttcctcaagtttggcaacttttctggttattttgccatctgtggttggatgctacatgctatgctgttgtttccactgatcctttttgaagtttcatatgagaaatcttagagagatttgaaaatgaaactttgtgtagaagagagatagagaaaaggttatatgtaatattgtttaatccaagtttttatgttgtngtgatacaagaataccgtgtaatataccaagnttttatgttgtgttaatccaagttttatgtttgcgcctgattaaaaaaaaaaaaaaaaacaaacacacaacaacacaataaaacacccccccgcacagggaaaacgcttatcctttaggggggtaatttgacttgacctggcggtttatacagcgtaattggaaaacctggttaacaactatatgcttggacattcccttttccgttggaattacgaaagccggccatgcctttcaacattgcagctgaaggaaggacggccttacgggcttaaaaccgggggtgtgtcncangta

SEQ ID NO: 5710 - DNA, 701 bp, Glycine max
  misc_feature (1)..(1): n is a, c, g, or t
  Predicted polypeptide sequence is orthologous to G451
nagtgttgtaggccggcggctgtagtacgactcactatagggaaagctggtacgcctgcaggtaccggtccggaattttttggtcgacccacgcgtccggttccatggaacatgtttgtgtcatcctgcaagagactgagaattatgaaagcatcagaagcaaaggggttgggttgtttttgaccaaaataacaaaacaaagcaggaccatcatgcatgcccatatccaaaacatggagcaaagcaattttcagtgacgtcatccaagagaatttcttctgtttggaatatgcaagagctaggcacttggcctctgtgaaatggttatatttagcttattaaaaagagagatgcacatacacgattttattttccctttatttgtttatttcaaaagctaggtgactttttagacctgcttaattaagtatactattccaaattctcaatgcctaaaccagaattgaaaactgtaatgatgaaatgagaagaaaataaaaagcaaaaatgctattttaattgtatagactatatatatagaggataaacatatatatgaaaaactactttcatttgtcatgtgtctggtctacgtacaatatattatatatacaaagggatcaagaaagtggaactttcattactcttctcttgcatttaattaaattgatctaatctatctttctacttggctttaagtg

SEQ ID NO: 5711 - DNA, 770 bp, Glycine max
  misc_feature (647)..(649): n is a, c, g, or t
  misc_feature (679)..(681): n is a, c, g, or t
  misc_feature (689)..(691): n is a, c, g, or t
  misc_feature (706)..(708): n is a, c, g, or t
  misc_feature (714)..(716): n is a, c, g, or t
  misc_feature (719)..(719): n is a, c, g, or t
  misc_feature (721)..(723): n is a, c, g, or t
  misc_feature (732)..(732): n is a, c, g, or t
  misc_feature (756)..(759): n is a, c, g, or t
  misc_feature (761)..(762): n is a, c, g, or t
  misc_feature (764)..(766): n is a, c, g, or t
  Predicted polypeptide sequence is orthologous to G468
gctctatcataataataatttttctttccattcctcgttcctcactctgcgtcagtcttaaaattgaggaaaataagttggaaaagagaaattctaacagttagaagttgagttctagaaagaaaataaatccggtagcccagaatgggtaagaattaatatacaacactattctttttccattatcttgaaagaaagagcagagtgagctatgcatatacatcacctatctgtgcatatacttcactaagatttttctaaattttctgatcagcgacctcattagagtctcactctagaggacaaaatctaaaatcaccggtgaaggaagaggcagtgtcatgttcttcacttaacacccgaatgtgtctacccttgtgatcttcaacctcttcaccgtcgataagaacatctcccaagggacatctccaaccatgaccaaatccccttcttcatcttcataagttagcacatggcatctctctggttgcactccattcatttctgttccccaaagaatggtagtgtcaaacatgtgttcaagagtcctgactaactcatagtagcctccatgagctagtatattgagcttccttccgattggaatcccttccatgtacaccttcacaaagaagctgctatgatcnnngctgcaatcattcacttcagcaggaacttnnnaataaatnnncacaaaagggtggtnnnattgtnnncantnnncccttgaantagaagaggcaaaatgttgagtgnnnnanntnnngagt

SEQ ID NO: 5712 - DNA, 854 bp, Glycine max
  misc_feature (854)..(854): n is a, c, g, or t
  Predicted polypeptide sequence is orthologous to G489, G714
ttttcttctccccgtcgctcccccccccccccccccccccccgatgggctcagcgcactcagtatgcagccgccgagcgcgcaattaaccctcactaaagggaacaaaagctggagctccaccgcggtggcggccgctctagaactagtggatcccccgggctgcaggaattcggcacgaggcttttgttctcgcacttcgctgtctgaggttctggattctcagtgtttgcgaagcgctgcatcatcctttggggaagaatggatcatcaagggcatagccagaacccatctatgggggtggttggtagtggagctcaattagcatatggttctaacccatatcagccaggccaaataactgggccaccggggtctgttgagacatcagttggtaccattcaatccacacctgctggagctcagctaggacagcatcaacttgcttatcagcatattcatcagcaacaacaacaccagcttcagcaacagctccaacaattttggtcaaaccagtaccaataaattgagaaggttactgatttcttgaaccacagtcttcccctggcaaggatcaagaagattatgaaggctgacgaggatgttaggatgatatcagccgaagcaccagtcatctttgcaagggcatgtgatatgttcatattagagttgactctgcgttctttgcttcacactgaagagaacaaatggcgaacactccagataaatggatatgctgctgcaatgacaatgactgacatcgttcatttctcgtgtgacattgtgccttctgatgaccttgaagatgataggcttgcttcatcccaagtagaacacagcctggtgaagggactn

SEQ ID NO: 5713 - DNA, 895 bp, Glycine max
  Predicted polypeptide sequence is orthologous to G519
ggaataatcgtctacacgaaccagcacggacacactcacggatcttcactcagtctcgtgcttccgtgcaaatggtgcagtggagcagctactgcaaaaatgcataatgcatacacacaacacagaacgacgtcgtctcgtcgtggtggtggtgcgtgttaattgcagaaggacttggagaggtacatgaaaatatcctgcagcggcgacatctgattattcccgagagtggcatccacgtaattatatgcaaactcgttgttgttgttgctgcccctcttcggctcgctctgcacctcgctcgcaaactccgccgacaccacctgctcggagcagctcgagtccgtcgtgtgcagccggggcaccgagtcggaagcctcgaagtacaggcaatccgccaccgtcgccgccgtatacggcggatctggcggcagaatctccggcttctcgtcctccatttcggaacattcaattttgcggaccccactcggtggtggtagttgttgcttttcaattgcacctttcttgttgtaaattcggcacagcacccagtcatccagccttaagctgttctttttgcgaacggaacgatccacgtctgcaagacgatactcgtgcatgatccagttagttttctctcccttgggcgcttttccagcgtaaaaaaccaacgctttcttgatcccaaccggtttcggtttaccaactggtttatccgctccggttgccttccagtacccggttcccgcggaccggttcggccgcgaaccgttcgggtacttgcggtccctcggcgtgaaaaaataccactctttctctccgtacaaagccattcctggaaagtcccaagggtcgtacttgtacagatcaatttcggcgattatgggaaccgcga

SEQ ID NO: 5714 - DNA, 813 bp, Glycine max
  misc_feature (813)..(813): n is a, c, g, or t
  Predicted polypeptide sequence is orthologous to G525
atgaaacccaatttggaaaaatctactcgcttagggaaagctggtacgcctgcaggtaccggtccggaattcccgggtcgacccacgcgtccgctaactctcttctaaaacttaccaacacaacagaatcgagtttccaataaagagttttgttgaaatggaaaacgttccggcggtgtgtaaggaagatgatcagatggatttgcctcccggatttcgattccacccgacggatgaagagctcataagccattacctctacaagaaggtcattgacaccaagttcttgcgccagggcaattggaaaagtggaccttaacaaattccagccttggggatttccctggaaacccaaatgggaaaaaaagagtggtcctttttctgggtgagagacaaaaaattccccactgggctgtaaaaccaccgggccccataagctgggttcttggagggcacacggaaaggacaagaggatttcagaggaaaatttctgcgtggaatggagataactctgggtttctacagaggtcgcgcacccacacgagagaaaagcatttgggtctgcactattcctcctcggggaaaatcttggtgcaatcttccataattgcgagaacgagtgggatgtgctcgttgtaagaaacttgtctgcgagaattctcttcttcggcgtatgaatgtgactgtcagtgaataatgttgtctttacgttgcaacacttcaactcactcggctttgtctccagccaacgctctttgaccggctctaggctctgctgccaactgacttgcgtcttaatgccgcttgtacgtn

SEQ ID NO: 5715 - DNA, 719 bp, Glycine max
  misc_feature (490)..(492): n is a, c, g, or t
  misc_feature (577)..(578): n is a, c, g, or t
  misc_feature (598)..(598): n is a, c, g, or t
  misc_feature (647)..(648): n is a, c, g, or t
  misc_feature (652)..(655): n is a, c, g, or t
  misc_feature (666)..(668): n is a, c, g, or t
  misc_feature (670)..(670): n is a, c, g, or t
  misc_feature (682)..(686): n is a, c, g, or t
  misc_feature (705)..(705): n is a, c, g, or t
  misc_feature (709)..(709): n is a, c, g, or t
  misc_feature (711)..(711): n is a, c, g, or t
  misc_feature (713)..(716): n is a, c, g, or t
  Predicted polypeptide sequence is orthologous to G525
ctttgtaggataacattagcttaaaagcaatttatttacatgtataataatatttaatccctaaagtttctctgattttaatctgcatataatttccttcaacctttaaaatccccataggccactagaatacacatgtcctacagaaggtgatgaatattcctggttcccaaatgatctttgaaacatttcattgttgttgtacatcaccgaggacatgtcagcatcaaagtctttattattatcctgagctttctgagttctttggccagtacttgatccatggttttcaatcaacatccccaacatggactgttcctgatgaagcatgaagtaatctgagcagtgtgagtttccaacttggagtgattggtgggacacagtaggggcagatttggaaaaagtccatgagtcaggggaaacatcagaggggtttgaagaatatgaagatgccaacatgatgatttcatagctttcagctatgttttcnnnttctgtttttttatcctcactttggtttggatcagagaagcaggttgcatgtgatgactcccccaaaacaggttttgattcactnntgttgttgttgtttggaganaaatccatcaatgaaggtatgtcctttgcaaaagtgctgaacctcaacnncctnnnnatgggcatttnnntnccacaattactnnnnnggaaaatcctgcagatggnccantnannnntgg

SEQ ID NO: 5716 - DNA, 1235 bp, Glycine max
  Predicted polypeptide sequence is orthologous to G525
cgggtgaaaattgaaatcgcaaccgcaatttaaaaccttggtgtatgttcttatattgaaattgaaattcttggctagggaagcaaaagggtagtaattggttttagagtaagtgagaatggaaaacgtttcggttcttttgtgtaataaggaaaaggatcagatggatttgcctcctgggtttaggtttcacccaacagatgaagagcttattagtcattacctttacagaaaggtcactgacaccaacttctcagctagagccattggagaggtggacttgaacaggtctgagccttgggatttgccatggaaggccaaaatgggagagaaagagtggtactttttctgtgtgagggacagaaaatacccaactggtttgaggactaatagagccactgaatcaggatactggaaggctacagggaaagacaaagagattttcagagggaaatctcttgtgggtatgaagaaaactttggttttctacaaaggaagggctcccaagggagagaaaactgattgggtcatgcatgagtataggcttgatggtaaattctcttttcacaccctccccaaaactgcaaagaatgagtgggtgatttgcagggtttttcagaagagttcaggtgtgaaaaggactcatatttctgggatgatgatgttggactcttatggaaacgaaatggtttattcttcttctgctttgccacctctcactgattcctcaccttccattggcaacaacaccaaagcactgagtgtgactgattctgcttacgtgccctgcttctccaatccaattgatgttcctagaggaatctttgattccttgaacaacatcaatatcagcatcaacagcaacaccctttatggagtttcttcaaaccattcattttacaatactcagggggttcaacttcaggctccaccaactttgccattacctagttcttcaaaccattaccttagagcctttcttgaaaaccaaggaaatggatcgaacatgagcaacaatggttttgagccagagagggaaatggtcagtgtctcacagaaaacaagtctttctactgatgtgaaggctgaaatctcttcattgggtaaaaggcactttgagaatcaaaacaacccaattgcttcagcagctgcagttgcaccaatggaccttgctaccttgtggaactactgatctcaaataaagaattgccattggaaaaaaaaaaaaaaaaaaa

SEQ ID NO: 5717 - DNA, 817 bp, Glycine max
  Predicted polypeptide sequence is orthologous to G559
cacactcttttagctgcacaacagtttcaacagctacaaattcaccctcaaaagcagcagcagcagcagcagcagcaacaacatcagcatcagtttcagcagcaacatcagcatcagcatcagcagcaccaacaatcaagtgacttgaaaatgagagaaacttcacctactccatgccccaaagacaatacttcgtcagatgtaaatccttctggagccaaggattgttgagagttgagactgctcacattgtcttctctatttgcttcgtagattttcctttgtcttgtgtcttagtgtgtttagcctttgttatattttttcattcttaaacagtacaaatggtcctagttagagattgagaataatacatttgcatctttggtattgtgtaatattaaagttgtttaatactctagttaatttctatggatatataggggtaggttcatgtgtgtttagtttgccttaaaagcagggagatataggtgaaggaaatcgtagaggctgcaaaggaaaagggggttggtatgcccactgtcttcttggatagcaggtcccctaaatgctatagcaggggggggggggcatatcagataaaaatcatgatgttttgggtgggttttgcggtttcagcccaggattgggtcttgggcctggggttggagatagtttgcggaaaggctggtgctaagccccccggggctttcatacttatttatggacagtttgggttgatgcttccgaaggttcagttaggagtgacttatgccctaacggtgggcccttgaaatccaagcttcttgaagaaaaattt

SEQ ID NO: 5718 - DNA, 936 bp, Glycine max
  misc_feature (901)..(901): n is a, c, g, or t
  misc_feature (916)..(916): n is a, c, g, or t
  Predicted polypeptide sequence is orthologous to G559
catttaaactcaaactcatatcactttcatttaaattcaaacacaaactcctgtatatgggaaacagaaaaaatagaaaataaatcctaataacaagaaacaaatcctaataagtaataatagtaaatcctaataaatgatagaatcctcattttaatagaagaaacaaaatttaaaaaaaattaaacaaatcttaataaaatcaatcataaatcctaatgaaatctatctcaaatcaccattagatttacaaataataactaaaaaacttaggcaataaaatcaacaattctacactttattttgagtcttcatataatcatatccttgggcttgcacaagtcgaactacaaccttattagataagaattgccttcacatgaactccttttgcctcttgtatcttttgaacttttcttttgttaacaggtcatcacttggaatcgagtcttttttttccttgagcttggccatgcaatatcctattctgattcatatcacaaacattgagtatacatggtagtagaatacttatgtacaatcaatgtaatcagtaagcagtagctttgccattgtggcgctgagactgagtctgtgtctgctcctgggaatgggtattgtgcacttgaacatgtctaagctggttagggtgctgctgttcctttaactgaaacacttgttggctaatagcaagctgttgagccatgcgacttgagagaagagactctccaccaagttctgaccgtgcatcttaaacgccgcacttcagcatccaaggtctcattcagagcatctttcagttgggactgctgttccaaggcttgaatccttaatttgtactcattattctcacttttaagctctgaattattcatctgtaatttggtaaactgagtagacnatgtggttgtctcantctgaagtgtttgaacttga

SEQ ID NO: 5719 - DNA, 955 bp, Glycine max
  misc_feature (1)..(1): n is a, c, g, or t
  misc_feature (558)..(558): n is a, c, g, or t
  Predicted polypeptide sequence is orthologous to G562
nccgggtgggagattaactactggaagattccgccaagcgcgcaattaaccctcactaaagggaacaaaagctggagctccaccgcggtggcggccgctctagaactagtggatcccccgggctgcaggcactgcaggggctaatcaaacaaaaaggaaaagatgccgagagggaacactgaccactgatggagaagggaaaactgagctacaaaatggtccggcttccaaagagacttcatcttccaaaaagattgtgtcagctactccagctagtgttgccggaacattagttggacctgtagtttcttcagttatggccacaacactggaactgaggaacccttcgactgttgattctaaggcaaattccacaagtgccccacaaccttgtgcaattgtgcctaatgaaacttgcttacagaatgagcgtgagctgaaacgggagaggagaaaacaatctaaccgtgaatctgctagaaggtccaggctgaggaagcaggccgagactgaagaattggcacgaaaagttgatatgttaactgctgagaatgtgtncctgaagtcagaaataattcaactgactgaaggttctgagcagatgaggatggaaaattctgcattgagggaaaactgagaatactcaactggacaaagggagagataatttgagtagcatcgagagtagaaggctgcacctgtagtacagaaacctgtatcagaagtataatttagtctatgacagactacaggaatgagaatgatctggagaacaaccattttgtgcaagctgatactattggatcaatccaaacaaatgctggcagtggttgaccggactggctgggtgattgaatttgaattcaacccaaattcagttgggcaacctttcaaggagagacgaataaattaatcatttgaaacccaatatttttggtgtgtttagaaaaacttt

SEQ ID NO: 5720 - DNA, 928 bp, Glycine max
  misc_feature (19)..(19): n is a, c, g, or t
  misc_feature (26)..(26): n is a, c, g, or t
  misc_feature (96)..(96): n is a, c, g, or t
  misc_feature (101)..(101): n is a, c, g, or t
  misc_feature (788)..(788): n is a, c, g, or t
  Predicted polypeptide sequence is orthologous to G562
cgggggatatatgggaacngaatagnagggacatgtgcgttagtaaacctccctagggaacaaaagctggagctccaccgcggtggctgccgctcnagtcnattggatcccccgggctgcaggaagggggcacgtgtaacaatgcaggctgggactcctttgagcatagagacaccacccaaatcatctggaaatactgatcagggtttaatgaagaaattgaaagagtttgatggacttgcaatgtcaattggcaatggccatgctgaaagtgcagagcgtggaggtgaaaacaggctctcacagagatggagaagggaaaactgagatacaaggcagtccaatttccaaagagactgcagcttctaataagatgttgggagttgtccctgccagtgttgcaggaacaatagttggacatgtagtttcttcaggtatgaccactgcactggagctgagaaatccttccagtgttcattctaaaacaagtgccccacaaccttgtccagtattgcctgcagaagcttgggtacagaatgagcgtgagctgaaacgggagaggcggaaacagtcaaatcgagaatctgctagaaggtccagactaaggaagcaggctgaaactgaagaactggcacgacaagttgaatccttgaatgctgagaatgcaacactgcaatcagatattaatcgactgactgatagttctgataaaatgagggtgtaaatgctacattaatggtattgttcaccatactatttctcattacacatgcattacgttggtactntgtactgctgagtgtcatattgtttttgactcatggaaacacttaacaatgctcaactgggacatactccagagataactttggagattattgacagccagaggcctacactcgtagttcagaaaatttattatatagat

SEQ ID NO: 5721 - DNA, 1626 bp, Glycine max
  Predicted polypeptide sequence is orthologous to G562
gggaaacagtgaggaagagaaatctgttaaaactggaagtccttcttcttcacctgcaacaactgagcagaccaaccaacctaatattcacgtctatcctgattgggctgccatgcagtattatgggccaagagtcaacattccaccatacttcaactcagctgtggcttctggtcatgctccacacccatacatgtgggggccgccacagcctatgatgcaaccttatgggccaccttatgcagcattttattcgcatggaggggtttatactcaccctgcagttgctattgggccacactcacatggtcaaggagttccatcttcacctgctgctgggactccttcaagcgtagaatcaccaaccaaattctctggaaatactaatcagggtttagtgaagaaattgaaagggtttgatgagcttgcaatgtcaataggcaattgcaatgctgagagtgctgagcgaggagctgaaaacaggctgtcacagagtgtggatactgagggttccagcgacggaagtgatggcaacactgcaggggctaatcaaacaaaaaggaaaagaagccgagaaggaacaccgatcactgatgcagaagggaaaactgagctacaaaatggtccggcttccaaagagactgcatcttccaaaaagattgtgtcagctaccccagctagtgttgcaggaacattagttggacctgtagtttcttcaggtatggccacagcactggagctgaggaacccttcgactgttcattctaaggcaaattccacaagtgccgcacaaccttgtgcagttgtgcgtaatgaaacttggttacagaatgagcgtgagctgaaacgggagaggagaaaacaatctaaccgtgaatctgctagaaggtccaggctgaggaagcaggccgagactgaagaattggcacgaaaagttgagatgttaactgctgagaatgtgtctctgaagtcagaaataactcgactgactgaaggttctgagcagatgaggatggaaaattctgcattgagggaaaaactgataaatactcaactgggcccaagggaagagataactttgagcagcattgacagcaagagggctgcacctgtaagtacagaaaacttgttatcaagagttaacaattccggagctaatgatagacctgcagagaatgagaatgatatctgcgagaccaaaccaaattctggtgcaaagctgcatcaactactggatacaaatcctagagctaatgctgtagcagctggttgaaaccagtaactgcactggctaattatgtaattttggcatattacaagcccaaaattacagcttggtgctaacagttttcagagggatggatcagctgaattttacaatctaattccatctatatagaccagaactaattctttgcttgtgagtttcttagggcataaactctgtattttactagatttcacagaattgaatgacaactttaaaagtttgtaaattgaagagtattagggatttagtttagactttaagagaggcttgtcggccgctgtataattggttgtgtattaactatattggtgtgatcttcctaatggtatcttagtcaaggcattctgactttgggt

SEQ ID NO: 5722 - DNA, 884 bp, Glycine max
  misc_feature (35)..(35): n is a, c, g, or t
  misc_feature (792)..(794): n is a, c, g, or t
  Predicted polypeptide sequence is orthologous to G591, G793
tctttacaaggtaactaaccatattttaattcaanttgtattaaagttttctcccgatacatcatgcgtacccatcctttccttttaaatggtcccacttcccactgactaaaaataaaaaaactttggaaagagcttccactacaaatattttggtcttccaccaccaaccccacctacagatatttggaagaaaaaacatcaattaggccattgaaaatattgatcttcaccatgaaaaaagacatttgctgggctcctccgattttacttaataggaataacaattactccttgtttgacaaaacttgagaagagtgaaccagctgcaccgactagatccttctccctccaatcaggaaaattatacaagaaagtagaatacccttgtcataaaggatgaagaaatttaattatgtaatgtctgtcatgatactttaattttgtttcggttctatcactaatatcagtgactgttagattcaggtttgatgcctgttgatgcttccgattgaggcatgcggaaaatggatgaggctagagatattggcatgatacaaagtgccttggactgaagaaattgcatagctgctccaacatcttcttccataagcttagccacctgttgttctgtgccatcattggaccacttgtcccaggcttgctcattggatacaccttctatgtcctgatccccctccactgcagaaaggggaacatcagcaacaagctgagcaactgcaccagctcctcccagtctactcatgctcaggaccttaacctggagccttnnnaacttcacatagtcaacaatttcatcaagcatcgccgctctgtccgtcttattgatgctgggaactaattcctgcaatgccttcattctt

SEQ ID NO: 5723 - DNA, 902 bp, Glycine max
  misc_feature (1)..(1): n is a, c, g, or t
  misc_feature (626)..(626): n is a, c, g, or t
  misc_feature (644)..(644): n is a, c, g, or t
  misc_feature (673)..(673): n is a, c, g, or t
  misc_feature (696)..(696): n is a, c, g, or t
  misc_feature (698)..(698): n is a, c, g, or t
  misc_feature (736)..(738): n is a, c, g, or t
  misc_feature (776)..(776): n is a, c, g, or t
  misc_feature (797)..(797): n is a, c, g, or t
  misc_feature (822)..(822): n is a, c, g, or t
  misc_feature (831)..(831): n is a, c, g, or t
  Predicted polypeptide sequence is orthologous to G591, G793
nggtggacaggcggatcgtgattaccccaatatgcacccattgctcactacagggaacaaaagctggagctccaccgcggtggcggccgctctagaactagtggatcccccgggctgcagggttttgagcatgagtagattgggtggagctggtgcagtggcaccactggtaactgatatcccattatcgtcagtcgaggaagaaggcggtgagggaagaaaccagccagcctgggagaagtggtcaaatgatggcacagaaagacaggtagccaagcttatggaagaaaatgtgggtgctgccatgcagtttcttcaatcaaaagcactctgcatcatgcccgtctcactagcttcagcaatataccagtcacaaccctcaggcacttctagtatagttaagcctgaaactaatcctccttcataatcatagtcagaactctggcacagatgcaccatccagtggtcccatcaagggctcacctaacactgctaggacccacgtgtaatttgcctgtttcaaacccccttaaccttagtcattggttcgcatcaagttgcattcaaggttggatgccatagtctttcctttttgcgttctttcaactttttgtctagacagggtntgtgtcaatgcccttcanaacacaagcaaaccccatcttgataaatntcatgtaaagggaaagaaatagngntaggtacttgatatgctctttccctttgtatcaattannngggggggtttaggacgtgatgaagcgctttttaatagnggggggcttggggttatgagnggcagtggacccttcttaaagggtnatggggggnggggtgataatttattaaaaagtgactctttaagggaattgaaattggcgagctggaaatgggatatggat

SEQ ID NO: 5724 - DNA, 826 bp, Glycine max
  misc_feature (531)..(531): n is a, c, g, or t
  misc_feature (583)..(583): n is a, c, g, or t
  Predicted polypeptide sequence is orthologous to G635
atcggcgtgaccatgattacgccaagcgcgcaattaaccctcactaaagggaacaaaagctggagctccaccgcggtggcggccgctctagaactagtggatcccccgggctgcaggaattcggcacgaggctcaaaaattgttggctgatgggatctgcagaagtcctggacagtgcaaatctctgtggacatctttggtagtcaaatatgaggggatcaagaatgaggataggaagaaaagttggccatacatagaggacatggaaaggataatgtctgataaagaagcccctgcaaaatgattggaaatatggtggacactggacaggataagaaatattttggagaaccatctacattaaaattgttgataagtttgagtgtggtgaccgggaagataatccatgacttgcatgacattgaagatccctagtgttttttagggctgagggatagacagcataaaggggttggctttcatactggcacgggaatgtctgagtttatgggacgatttattctccacctncaatgcctgtccccgtttttttattacatttgtgtcataatttataatattntgtggtggcacatattgggtgccctaagcaaccatggaaatgtctacctttttttcagacattgaacactgaaaagaaagttttcatacttttaaaaaaaaaaaaaaaaacttgagggggggccccggcccccaatccccttaattagattatttaccgcgctcccctgggcccggttttacacattggactgggaaaccctgttcttaccccatttattgcctttagaacaatccccttttt

SEQ ID NO: 5725 - DNA, 525 bp, Glycine max
  misc_feature (81)..(81): n is a, c, g, or t
  Predicted polypeptide sequence is orthologous to G653
tttttttttttttttttttttttttttttttttttttttttttttttttggcaaatcacactattattactgaatgtgcantggtcaaatacatcacacacggtaaatggcacactagcgacacccacatataaagtgaacaagaaggaaactggtcatggtaagtagaatcaaaatgaaaaaaacacaaacacttattccaaagatgataataacaacaaaagacaacaccatgactcaagctggtggaacagagttggcttcccgttggattgatgcagatttaataagatgattatagctccctttctccttaaaaagctgggaaaaatggtgcttgcaatacaaaacgccctccagggctgcatagttggatggagttatgggacagctgccatgtgaacatttgaaacaagatttgtgataggcctgaccttccactgttaccttctccaaaggataagcagtttggccacatgtagcacacttttctggggtcccagaaaacatgctagcagctttact

SEQ ID NO: 5726 - DNA, 875 bp, Glycine max
  Predicted polypeptide sequence is orthologous to G653
gcaaatcacgctctcattagtctcgtctttactaaatgtccattatatgaataaaccacacaagatttgcacgccacgcatgtgtaagtaaaaatatcagaaatgatcaaagtcacgagagaacaatcaaaaaccaaaaaggccacacatacaaacacctgcttcacaaaccaaaatgtatttgaaaaagaaaaggcaattgaaggaaccaacattcaagattctggaacagaggcagctgttgttgctgctgctgtggctgcggctgcccgtttgactgatgcagacttagtaagatgattatagctccctttctccttaaaaagctgggagaagtggtgcttgcaatacaaaatgccctcaagggctgcataattcgatggcgttatgggacatccaccatgtgaacacttgaaacatgatttgtgataggcctgcccttccactgttaccttctctaatggataagcagttttgccacatgtggcacacttttcttgtgtgccagaaaacatgctcgcagctttactaggagaccttgtcagctcaggagttgtcttatcagctagctttgcaggtgactggaagttcttgctgaaggagccactctccttgaagagctgctcatagtgaggcttacagtaaagaacaccttccattgaggaatagttactcagctttaatgttcctttgcagtgagagcatctgaagcaagctttgtgataagcagtaccatcagcagaaagctgatcaacgggataaaccgttttctcacaagccttgcacttttgctgggtaccgataaaagacattgctatggcttttagatctaaattcaccacccattccaaatcggttgctgtcgcgacagcaac

SEQ ID NO: 5727 - DNA, 972 bp, Glycine max
  misc_feature (830)..(830): n is a, c, g, or t
  misc_feature (931)..(932): n is a, c, g, or t
  Predicted polypeptide sequence is orthologous to G666
cacaatgaaatacactttattcatatcttactgaatttatttgagttgggtaggagtacaattcaaacaatatgaacattaactttacattgctaaaatttgttttgttttctgtatgtttaattacaaattattcttcctttttgagcagccttgtaaactccttcctagtacttctacataccatgattggttaggctgaaattgctacgtaactcattcccgggaatacaattcatgaaatcacttccatccatttgatttgttgactttatttgtgaattatagacctcagtggttgaactgtgaattagacgattatgatactcctcaccaaagttttcttctaacatatgcattatagcttcttggaaagttgaattttgatcaaattcattccccaagaccaaggaatcatcagaattcactgagattccaccatttacttgatccactgatagccactcagaaaataagagttttggtagtggtagagaactctgataagcctccttggaaaagttatagcttttcgagaaaaagttatcattttgtgctattgatttgtcaaggttttctaacaacccataacttgaatcttgtgttgcaagtttctgaggagagagtgcgttttccactgtgtctgaacttgagccggcatgttgaatttgtttatcagattccatttccttagctttgatgactttctttttcaaatatgaatgccagtaattttttacctcattgtcagtccttcctggcaaatgctgtgctatctgagaccaccatgccagttcatggtttgaccgtcttatctatttttccttagnatttaagtagaacccaattgcttttgtttcctaacatatggtgtagggccatgattgtatctttctcatgtttgctgaacacccctctctttcatcctggnnctcagtagttaatccaccttagtctgcagctcttcccatt

SEQ ID NO: 5728 - DNA, 854 bp, Glycine max
  misc_feature (727)..(727): n is a, c, g, or t
  misc_feature (796)..(796): n is a, c, g, or t
  Predicted polypeptide sequence is orthologous to G666
ggcatctaacacagtatgataacaataatcataatttcaatagttattaacatatacacgtctagcaccaaaggcttgaaaaacttctctctctaaggccaaagcgaagattaattgatgaggccctacctataacttatgaaataaaataaaaaattccacagtctcatatatgtcacaaaatgaacccaacttagaaaaacttggcatcatcaccacaaccaactaatttctcttggcaaccagcctcatcaagaagccatttctcaagcaaagagaatggcataatttctgcaccaataacatcaggcttgctttcatcttgcaaaacagtggcctcaggagacaatgaccgagagaattcatcagagtttgaagactccaaagactgatcaaaatcaaacaatgattcaaaattgttttcagacaattcagcactgcttggtggtccctttgctccaatactagaagcagtatcagcacctgctgcagcaaagttgttgaaggagttctgagtcacagatgatgagtttgttcttgaggactttggtgggtttttcatccaaccctttagcattctagctatgttgtcagcacttgaggcatagcacacagtttgtgttgttgttggttttgtggaagagaaggagctgctactatctgaagggtttgagtttgaggcagataaattacaagatggcttctctggtgaaagagcttcactganggctctcttttgcatttggatatcagtttggagccttcttttccactggcctctagggattgccttgangctgaaacccttctccaagctacccactcacaactactgcatcttctcagcttcttct

SEQ ID NO: 5729 - DNA, 880 bp, Glycine max
  misc_feature (1)..(2): n is a, c, g, or t
  misc_feature (16)..(16): n is a, c, g, or t
  misc_feature (334)..(334): n is a, c, g, or t
  misc_feature (592)..(592): n is a, c, g, or t
  misc_feature (661)..(661): n is a, c, g, or t
  misc_feature (698)..(700): n is a, c, g, or t
  misc_feature (703)..(704): n is a, c, g, or t
  misc_feature (880)..(880): n is a, c, g, or t
  Predicted polypeptide sequence is orthologous to G707
nnaagctgcgatgcangtagataactactgcgcgcaattaaccctcactaaagggaacaaaagctggagctccaccgcggtggcggccgctctagaactagtggatcccccgggctgcaggaattcggcaccagatcactgaacgtggtgatgagtggtggagattctgcatacgttgcactcttgccttcaggctttgcaattctccccgatggccactgcaacgacaacggctgcaacgggactttacagaagggtggcggtggcaatgacggcggcggaagccttctcacagtcgggttccaaatactggtgaacagtctcccaacagcanagctcacagtggagtcagtggacactgtgaacaacctcatctcctgcaccattcagaagatcaaagcttctctcagagttgcatgatgatgacaacaacaaccattttgttaatgcagtaataataatgcaagttaagttaccttaaattattattttgtggtctttatatttttggtttctaagatgaatatttattcggagaggggttatataatttggctgggtgtataggaattataattatatagagagtagntggaagaggagctgaggcagaaaggatcgcgtaagaaaggtttcgagtcaagaacgaaccgcgatggangaacttgtttgcatgcagcttttctgcctcatagtgnnngtnntcggggtttaaaatttttttggggggaaacccttttttccgcgttttttcaaacccccctttggccggggaaaaaaggttttttaagtctctgtgctcttgttggatacattagaaaaacaacacatgtgcctgtgtacttacttaaattattactagtgcccatcctatcatcan

SEQ ID NO: 5730 - DNA, 349 bp, Glycine max
  Predicted polypeptide sequence is orthologous to G707
cctcatctcgtgcacggttcagaagatcaaagccgcgctccactgcgaaagttaaacgtcacgtgatcggtcacgtgagtctggtttttttttgttattttgtatttattgaggttcttgttgaaaattttaacgttgttgacgatggatggaagggtggcgcgtgtgaaagacgcgtgggttggttgagtcaagaacgaaccgcgcgtggggaaaaaaagagaaaactccttgcatgggttatgttccttaacacaaggcaagggtcgtggttcgggtattgactcgggtcgaccttttttgtttgctcgagtacaagaaagcaatagaggaatggaaaaaaaaaaaa

SEQ ID NO: 5731 - DNA, 920 bp, Glycine max
  misc_feature (1)..(3): n is a, c, g, or t
  misc_feature (664)..(664): n is a, c, g, or t
  misc_feature (746)..(746): n is a, c, g, or t
  misc_feature (750)..(750): n is a, c, g, or t
  misc_feature (774)..(774): n is a, c, g, or t
  Predicted polypeptide sequence is orthologous to G720
nnnaagacgcatggcattagactattacgtgcagcgcgcaattaaccctcactaaagggaacaaaagctggagctccaccgcggtggcggccgctctagaactagtggatcccccgggctgcaggaattcggcacgaggaaagggtgtgatgtgaatgatatggagggtatgccatgattggtctttgcatataatagttcctttgcattgcatccccttgattatgccatttccgatcttcttctctgggtgcactttgtctcttgtgtattctatatttctgaagatggcttgccacattgtgccttgtcaaaccttccactttcattatctccaatattctagaaggaatggcttgatcaatacctagttgttcgacagcctttacaaattttttatgcagctcaggtgtccagtctactttcaccttcttccgattagctttaatctcacatgaatcattaagtacacccgttttatttggagatgtattaccatcggcattgctgagaaactttttattatgtggattcagtgaaacagcgctctcacccttggaaacattggcaaaatcatcttcctccctaatcagagtcttatcaggttcccttggctgaggagaacttttcgcattcaaattcccacatgaagcttcgacagatntacattccctatcatgttccctggtgccgaattcggcacgagtccacattcattggaaactcgacctcgattcaagagatgntcangacggtgagttgagcagtcacggnccatcgttaagagaaggtttcttacttaatctatgtgatgcgtaagtgtgttgctctgctctcaactgaggaagattgtattacaatagtgattgaccgttgcgggataaacttgatgagctgtgtgagaatgaaaaaaatagggt

SEQ ID NO: 5732 - DNA, 822 bp, Glycine max
  Predicted polypeptide sequence is orthologous to G730
cccacgcgtccggtggatttgaatccgcatcatcatcaagtacaaggtgttccaagaagcttcaatcaccaccaccacctccttcaacctcacatctatggccgcgatttcaaacgaagcgcaagagtagttaatggggtcaaaagaagcgttagagctcctaggatgagatggaccacaaccctccatgcccattttgttcacgcggttcaacttcttggcggccatgaaagagcaactccgaagtctgtgttagagttaatgaatgttaaggatctaaccctagcacacgtcaagagtcacttgcagatgtatagaacagtgaagagcactgacaaaggcatcagtactgcaggtcatgggcagacagatattggattgaacccaaggctagggattaatgttcatctgcatgcaccttcacctatttgtgacacaccgaatttaccagacccaattcaaaattcacagaggacaccgtggcaatcatcaatagagacaaaaacagacaacagtagacaagaagaacccgaaatcggtttgacgtattctcacctcaagggaaataataataataatgaaaccatggtggatgggcacaacaattctggagggttggattcttcccctttgtcacgttcctccgaggcaatgcttgaccttgaattcacccttggaaggcccaattggcaaaaagaccaccccgaatcatcaagagagttaactcttctcaagtgttagaatcaaattaagggtgttgttaattattattcttaaagatattagttaaaggaccaaaaaaaaataaaagggcggccgctc

SEQ ID NO: 5733 - DNA, 1235 bp, Glycine max
  Predicted polypeptide sequence is orthologous to G732
ctctaaccaagtagaagtgcaataattaaatgtccaacatcttcttgttgttgatgtttgagattcatgtatccgattctcagtgaaatcttcttttccgggtgtatgatcaattccactgctaggcgcaggacccatttagttcaatccttctcagttgccttcctctattggttgtactacgtttcatgatttctaacccttccttagcttaataatcatctatctaaaatatcataatatcttctactagctagttttatttttattatcacaataaaatctatctgcaatatattgttatttttattttctgagaaatttgtgtctagttataagtgtctgggtcctggtcctgcctattgtgtcaattaaattgagaagggttgtattgcatagaatcatatatcgtatcatataaacatggcttgttcaagtggaacatcttcagggtcattatctctgcttcagaactctggttctgaggaagatttgcaggcgatgatggaagatcagagaaagaggaagagaatgatatcaaaccgcgaatctgcacgccgatctcgcatgaggaagcagaagcacttggacgatcttgtttcccaagtggctcagctcagaaaagagaaccaacaaatactcacaagcgtcaacatcaccacgcaacagtacttaagcgttgaggctgagaactcggtgcttagggctcaggtgggtgagttgagtcacaggttggagtctctgaacgagatcgttgacgtgttgaatgccaccaccactgtggcgggttttggagcagcagcatcgagcaccttcgttgagccaatgaataataataataatagcttcttcaacttcaacccgttgaatatggggtatctgaaccagcctattatggcttctgcagacatattgcagtattgattgagatgcttcatctctgagatttgatgaggatttcttcttcttcttcttctgggtttgagtctgtcgagaaattgtaatcactaccatatgatggtgataaggaataatattaataatgaatgtgtatcataaaaacgggtgggattgttaatgttaggtgctggttccgtaaatggggcatggggcatgggccattactgtaatttgtcaccctcctttcctatataataataataataataataataatactgccctctctatgttattattctccccaaaaaaaaaaaaaaaaaaaaaaaaaaaaa

SEQ ID NO: 5734 - DNA, 973 bp, Glycine max
  misc_feature (894)..(894): n is a, c, g, or t
  misc_feature (920)..(920): n is a, c, g, or t
  misc_feature (954)..(954): n is a, c, g, or t
  Predicted polypeptide sequence is orthologous to G748
cgttccccccccccccccccccccccccccggggcgcaggttgatcggcgcgtgaaactaccccaagcgcgcatttaaccctcactaaagggaacaaaagctggagctccaccgcggcggcggccgctctagaactagtggatcccccgggctgcaggccagtcccaattctccaactttggggaagcactcgcgggacagtgacatgattaagcaagactctttgcacaaagaagaagcttcaacgccaagaaacgggagtgttttggtcccaaaaacgttgagaattgatgatccaagtgaggctgcaaagagttctatatgggcaactctaggaattaagaatgagtcagtgagtgggggagctatgtctaaggccttccaatcgaacacggcccccaaccctcatgcccccccctctccacctcgttgatggctaaccctgcagctttatctagatccctcaattttcatgaaaactcctgaattagtggcactggtgaaaagtccttacagcaaagttagtcacttcttgagttatttgtctagctagcaagagacggtgaccatctttgagtgacattgaccttgtatagaagaagcgaaagggtggtagtctctgatttcctcagcacaagtgagacgacgaggactaattctgtctctaatttcattcgacgatattaaaatagagtatataggctctatttcatgagcatagatggatgagtgagctcatgtatatgcacatatatagaaatatgtcagatactgatccttagcctagagagaccggaaagaatctttacgtctcttgtagtataaagtcaaaatcctgactgtagaaaagggaataatctctttgagtacttgtatgtctaactacgcgcgccnacccgccgccgatccccactcgccgnctacactacgtcacaacgaacacgtaggctatgnacgcttcgtagtctgaatg

SEQ ID NO: 5735 - DNA, 927 bp, Glycine max
  misc_feature (18)..(18): n is a, c, g, or t
  misc_feature (927)..(927): n is a, c, g, or t
  Predicted polypeptide sequence is orthologous to G748
cccaaaggaacccttggnaccggagctaaatcgcgcaattaaccctcactcaacggaacaaaagctggagctccaccgcggtggcggccgctctagaactagtgtattccccgggctgcaggaattcggcaccagaaaatgacaaggctgactcagttcctgggggaacactctttaaagccttcccttcaaagcatgatgacaaaaaccattcaatgcaatcctcgcgggtcttgctggccaatccagcagcattgtctaggtcacttaactttcatgagacctcataatcatgtagcttataaatttgtaattgtgttttaggtgcagcaaactgatttggcagtgttcaaccggtcctgagggaaacacaagttgtaaagtcacattggatcactagctttgtttgtaagaagagttagttctgttgtcagtcaactgaagaaagagctggatggttcttcatgcatttccttctaaggtgaaggagcattcttgtgtttgctgagtatctcccttgtcttaggtgtcatctaggcaattttacccacttccctttcattcagatggttttcttagttcatgtacataaatatatataagttcatagtgagacatagtgagtttgttttcctagacctcgtatgtatataaataagactaagaatggaagttcatatcgaacttctttcgtctggtttacaaaaatcaaaaaaaataacaaactcgaggggcgccggcacccattcgcctatagtgagcgtatacgcgcctcactgccgtcgtttacacgtcggactggaaaacctgcgttacaactaatgctttgaacatctcttcgcagtgcgataggaaagccagacgatcgctccacagtgtcatctatgcgatggacgctgatcgcatacgtcgcggttgtgtaccccn

SEQ ID NO: 5736 - DNA, 809 bp, Glycine max
  Predicted polypeptide sequence is orthologous to G8
gaggaaaacagaaacatcgctgtgctagtgcactaaaaatagcatttgcttcaaagatgatgtatccaaacatggggcattatagtttaagcaagagacagcaataaggtgtcgaatctcagtatacaccaatcagtggctgaattataaaaagaatttggaccgaaaacacttttgttttagtttgtctttaatctgtactgcaaaatcagctatggtggtgcctgtgggggcttaacctagtaataatattcagatgcattgcgggtaggcatgctggatgaagtaaaacagagactctggggaattgagttcatagaacttgttggaaagatggcagccgatggaaaggtagctgaaattgagaatcctgatgatgctgcagcagagaacgttggtactggggtagcattgacctggccatgtgtttgccacgcccagttggggagtccgtttgaaggatcaacgccgattctctctgctctttcctgcccattgggaaagaaattaggagacatgccattccataatgaaggacgatcttcagttgcaaccatccttttcaaagatggattaccaattccagaactaacattggtttccatcattgaacttcttccaccatgtgtattgtaagggaaggaggggaactgaagttgcccccaattttctttgggaggtcctggggttgctatgcccaaattgagatcaagattctgactgcctccttcattaatggctgcagatttcagctctccttcataagtacttggctcaaagttggtcactgcttcccttccgacagcaac

SEQ ID NO: 5737 - DNA, 955 bp, Glycine max
  misc_feature (812)..(812): n is a, c, g, or t
  Predicted polypeptide sequence is orthologous to G843
aaaatactataatatattcatttatttttctccacatcacatgggtctttatctagttatttttcttaatgggggaaaaggagaagatttttttttttttttttacaaaaatggccttgtaatcattgcatagcattttattatgtttgcacaactccttttgtcacaagcatatcgtaaactctatcaaccttgcttggctctaccttaaacagtgcatgtgcatcggatttcttggtcacactgccctttgaaatctctaatgacaaggtctgcagcatgttgagatagtgtgagggtagtattctgatctcatcacaaagctttttctcagattcagatagtaattcagcccctgcaaatccactaatatcccactcttctagcgaccttgtgaagacttgtatggcaggaggtgaatccttggcaccagcaaataaagctgcagtccccttttgaagaccctgcgggctactatcaacttctcctttgagagaatttggcctctgtaatgtcttagcacttgttccaatctgaccactttctttacaggcacttggttcagcttcctttgtcctcttttgttcaataaatcgataagcatcagcagcagttacacagcccgcaattcgagcttcctgtaaatcttgtattcttttgacaagcctgtgttcttcaataatattttttagcaaatcttgatgctcttcttttgagtgaaaccgcatgaagaccttgtaacgctgacatatttgaagctcttcaggtaagagagatttctcaaaaggatcaggataaagtaaatctctttncagtataaaattctttctgcgcttccgttcatctaacctttttgagtagatatggagcacctgcagtttcatttcatattcagcttcagtatcagtgtccttaaattcatatcagccacacttgctctgcatcgttgtcgtat

SEQ ID NO: 5738 - DNA, 824 bp, Glycine max
  misc_feature (700)..(702): n is a, c, g, or t
  misc_feature (763)..(764): n is a, c, g, or t
  Predicted polypeptide sequence is orthologous to G881
ctcctacttgatggtatctctatactggtggtacctgtacctgcgactgcacttgacttaaatgactcattacagagtcagtgattaacatgatccgcggaaaaactgaacaaacaaatcaatcgaaattagaggatcatatcatctcacggtcacttcaatttcagatccaattgagacagatagaaaacactaaataaagcagattatccaagccaatcagtatactataaatcaaactgaagaaagtcaagtcagatctaatattaataatgtttcaacatgatttgaactttagaaatcaattgcaacgctaattcgattggaaaaagaagaaagcatgtgtggctgaccttgttcactgggcagcttggggcatatgaacacttgaagtaagccctaggagaagggttatctctggtgacttttttaccatattttctccactgatatctgtccctcacatacttcaacacccaaaaacaaattaaggaacctcagttagtacttagcatcggcaaatacttacacaaaacagtctaaaaagttatataattaagcacatgctattgattgagtaatgggaccaagtaaattaattttacacataaaaatctgtgatggcatatatataatttccttgcaaggatctaattaagtaaataactctagttcatacttacatatatagaactactcnnncaataacagcagcaaatagatagatcttaaaaaatcaaatactagatgacttgatattgannatcaaacttactaagccagtatcaaatgagtacaggacacaaattaaagtctactgtata

SEQ ID NO: 5739 - DNA, 824 bp, Glycine max
  misc_feature (1)..(3): n is a, c, g, or t
  misc_feature (824)..(824): n is a, c, g, or t
  Predicted polypeptide sequence is orthologous to G881
nnnttgggaagcaagcgcgcgctttaccctctacattaaggggaacaaaagctggagctccaccgcgggggcggccgttctagaactagtggatcccccgggctgcaggaacaagggcatgagttcaaatcaaatagggtcagtaacagtaccacctatgtttgatacaaacaagagaccgagactagagcttcccacagcaaaaaagccattacaaatctttgtcagaacacaccccaaggatgatagtttgatagtaaaagatggctatcagtggaggaagtatgggcagaaggttaccaaagacaatgcttcaccaagagcttatttcaggtgctccatggctcccatgtgcccagtcaaaaagaaggtgcaaagatgcttacattataagtcaatcgttgttgcaacttatgatggagagcacaaccatgcggccattcatgagtcatcttcatccacatctaaaggctcatcaccagtggttaataacttacctctgatgacaagcatattaaatgacaaagaacccatgaacattggcttggctctttcaaggtggtctcaaacagatcataggagacattgtgaagatgccatgcaacagaataataataatggtggtagcaacatcacaattgaagaatatgtaagttctctaatagaaaatcctgactttctcatgtcattagctggaggcaggtgggcgcacaatcgctggccagcaagagcgacacgatgtataccgttaatttgcatctttcgtgagagtgagatcgatcattcgttacctacgagcaagtagtgatgatgtaatgatgagn

SEQ ID NO: 5740 - DNA, 976 bp, Glycine max
  misc_feature (1)..(1): n is a, c, g, or t
  misc_feature (362)..(362): n is a, c, g, or t
  misc_feature (576)..(576): n is a, c, g, or t
  misc_feature (695)..(695): n is a, c, g, or t
  misc_feature (744)..(744): n is a, c, g, or t
  misc_feature (840)..(840): n is a, c, g, or t
  misc_feature (842)..(842): n is a, c, g, or t
  misc_feature (844)..(844): n is a, c, g, or t
  misc_feature (850)..(850): n is a, c, g, or t
  Predicted polypeptide sequence is orthologous to G896
naacgtgctttttagttcccccttgcgcgcaatctaaccctcactaaagggaacaaaagctggagctccaccgcggtggcggccgctctagaactagtggatcccccgggctgcaggaattcggcacgagagaaggtcaaacccatcttcgaatcaaattctaggaaagtaccaacgcgtcgctccttttggctttcagaaacaaaaagcttttgcgttcgatttgtttcttcctaaagactaatattctcattctccccaaaacctctgctagtttttggttttgcttcaacaccctcgtcctccttcttcttcacactcccccagaaatcccaattttgcccctaccctcttccccaatntacctacgatgtacagcaacatgctggtcaactgctccaactgccgcacccctctgcagctgccacctggcgcgggatccatccgctgcgccctctgccgcgctgtcactctcatcggcgatccacgcgccctcccttcgcagccaccggcctccacccacgcgcctcctcctccgtcctctccctacagccacgcgccgcccccgcccaaccnccacggccgcaagaaggccgcatcgtcggcatctcctaccgcttctcgcgacacgagctcaaaggatgcatcaacgacggcaagtgccatgagtacctctcatcaacaagtcagcttcncagaatcttcatcatcatgctccacgcagaaagagatcccatggcccanatttccacgaagcacaacattcaggatgggcatgtatgcttgcacacaagatgcacctgagatattccctgtttattaatctggccatgtacaganangnaccacntttgggtataactgatgatatataacctcttgtccctgattgacaacccagggatgatttgagatggataataggcacttgaactatccctaggctaactcaatgccattgtgcgctgcctaaggc

SEQ ID NO: 5741 - DNA, 837 bp, Glycine max
  misc_feature (689)..(691): n is a, c, g, or t
  misc_feature (697)..(698): n is a, c, g, or t
  misc_feature (716)..(717): n is a, c, g, or t
  misc_feature (773)..(775): n is a, c, g, or t
  misc_feature (782)..(782): n is a, c, g, or t
  misc_feature (785)..(786): n is a, c, g, or t
  misc_feature (788)..(788): n is a, c, g, or t
  misc_feature (795)..(796): n is a, c, g, or t
  misc_feature (798)..(798): n is a, c, g, or t
  misc_feature (805)..(805): n is a, c, g, or t
  misc_feature (811)..(814): n is a, c, g, or t
  misc_feature (819)..(819): n is a, c, g, or t
  misc_feature (826)..(830): n is a, c, g, or t
  Predicted polypeptide sequence is orthologous to G896
aattataatttataccttttatcaaatcaattcctaagatttgttgttccaaaaacatactatacaagtaattacatcaaatttatgcacatgatgtatgatcagtacgagaccatcactttcaagtcattattgacacttttcacgaagtaaaattggggtcacacgcacacctcctaatttatccagggttaagatgctcacctcttatgtggaattcaaatctgagtcgaatcagcattttcatccaaggattgcagcagcaaccaaagtcattattacaagagcatgtcacattctcaagggcagacataaattcatccaaacacatcctcagtgatttacgaaaaaagaatcctctctactttataatatattaatcattgtaatcaatgtagtcgtatacaggggcagagcctaggaaaacaaattgcagaataaagaatattgagtatcataatgaaaaaggttttctatgcacatcaaatgcttcgcaagctgttaactgtggttcctgtcccagtccaccgacaccgctgagactccctccagtcaaaagcatggagagaagggatgttaccacatcaccacccccggtaccgccgccgccgccgccaacatttctgatggaagtgcgcattgcagtaagaatgctgccataggtagccccatggccacgctctatggcnnngatganncaaaatgtcattgccccnntcgatgtaatttttgatagagcagatgtatcagctgaagtttgatgatcgtcgcannnactgaancanntnacttctnnancactagntccctnnnntacancggatcnnnnncgatggt

SEQ ID NO: 5742 - DNA, 886 bp, Glycine max
  misc_feature (588)..(588): n is a, c, g, or t
  misc_feature (603)..(603): n is a, c, g, or t
  misc_feature (623)..(623): n is a, c, g, or t
  misc_feature (689)..(689): n is a, c, g, or t
  misc_feature (700)..(700): n is a, c, g, or t
  misc_feature (750)..(750): n is a, c, g, or t
  misc_feature (758)..(758): n is a, c, g, or t
  misc_feature (764)..(765): n is a, c, g, or t
  misc_feature (798)..(798): n is a, c, g, or t
  misc_feature (805)..(805): n is a, c, g, or t
  misc_feature (834)..(834): n is a, c, g, or t
  misc_feature (860)..(860): n is a, c, g, or t
  Predicted polypeptide sequence is orthologous to G921
acatgtcgaatgatcattacgccaagcgcgcaattaaccctcactaaagggaacaaaagctggagctccaccgcggtggcggccgctctagaactagtggatcccccgggctgcaggaattcggcacgagattccaagagcacaaagcctaaaggagattcacctaaagtacctcaggttttggtggaacagatggctacttctttgaccacggatcctaattttagagcagcacttgttgctgccatctcaggaagattgttgcacaataattaaatggaattttggtgaagtgttgctaatttagtgtcaattgtttaagtattccataaaatagagatcattctttagagcaaggggtctctctatgtaaatacaacatggaaggctgggacatatttgatcctttaaagtggaaataaagttccactaaggatgacatgttgagctgattaaacaacagaaaatcaagctctgcaccaccctctgcctcatcatgatggtaaagatttagcaagtcttttttggctaatatatctaggatacctcaaattaaatttcatagtaggttgtagcacacattctcgngaagatctttcatanagtgcatctctacggcaatntaatttctcccttttcttctctcactactctctctggcaagccaactctatatctagtcctagttntagaattgcantcagaaatatattatacattgatcagtattatagtgatggatgtactcanacatgganaatgannaaaaggtcgcatgaataagttcgatcatgattngtatttngagtgggtcgtataatgaattgaatgtanatgggatagtttatagcggtatatanaaaaaaacaaaaactcgagggggccg

SEQ ID NO: 5743 - DNA, 945 bp, Glycine max
  misc_feature (1)..(2): n is a, c, g, or t
  misc_feature (727)..(727): n is a, c, g, or t
  Predicted polypeptide sequence is orthologous to G921
nntttgccaggaggttaggcaggtgcatgcgcgcatttgaccctcactacagggaacaaaagctggagctccaccgcggtggcggccgctctagaactattgtatcccccgggctgcaggaattcggcaccaggagaattacaacactttgcgaggcaatttgatggaatacatgaggaagaatccggataaggagcacagctcatcaaagaaaaggaagtctgaaagcaacaacaatagtattccaatgggagtcaacggaacctctgaaagcagctcaactgatgaagaatcctgcaagaaacaaaaggaagacatcaagactaaaattcaagagtttatatgaggacagaagcatctgataaaagccttattgtgaaagatggatatcaatggaggaaatatggacaaaaggtgaccagggataacccttctccaagagcatatttcaagtgctcttttgctccaagctgcccggtcaaaaagaaggtgcaaagaagtgtggatgatcaatctgttctggttgcaacttatgaaggagagcacaatcatcctcacccttctcaaatggaggtaacaacaggctccaaccgttgtatgactcttggttcagtaccatgttcagcgtctcttagctcttccccaccaacagctacccttgactggacaaaatccaagtccagcagtgagtctaagaatactaagtccataaccgaatcaccagaangtccgcaggttatgttagagcagatggctacttgcttgaccaagatcctatttcagagcagcacttagtgctgccatctcaggaaaaatgttgcacaataaataaagtagaaatgagtgagtgtattcacctattcattagtgatcttgttagagcatagatctctatgaaatacacataggacattgctactattaattctcaatttattcaatcct

SEQ ID NO: 5744 - DNA, 776 bp, Glycine max
  misc_feature (619)..(620): n is a, c, g, or t
  misc_feature (632)..(632): n is a, c, g, or t
  misc_feature (707)..(711): n is a, c, g, or t
  Predicted polypeptide sequence is orthologous to G937
aaagctaaaccttaaaaaaaaactacaactgcctcttatcgttgaccctcttttttatgtatcatgtagtattattcttatgtagtggtaaaactcctcccatgtatacttttatctgcaaaattcatggtggagagtagtatcctatacatcaacttttcctggtttgttcatatgacttttccaactataactctcggatcttgcatcttcatcatcttctatgctgtcaccttcagtaggagatgtccctccccgggaccctgcagccaaatgaagaggactttgaggagaacctgaccctgaactgctaacttttgaagagtcattgtactgatcttgagacatccacaaacctccaagaaccacaactggctgattagaacttgcagcaggaactctccgcgtatgaagtcggtatttttgtaaatggctcttcacttcatcgttagttaggccatcaacctgcataagctctctaatttgctttggtgtagctgcttgagaacctccaagcttctgcaaggcattaacgaatcgtctgtgcaactcaggggaccagcacctcctctgtttcctagcagtctgctgaagcgaagtcgcacgcaaacccggctgnnccgtgggagganaagaagaaacagccctgttagaactgctccttgatccccttgaaccacacccttctttcacagaaggcgtcagannnnnaagcctattcctaacactctcttccttctcttctttggatgcagcccccagccccactgttgtca

SEQ ID NO: 5745 - DNA, 946 bp, Glycine max
  misc_feature (1)..(1): n is a, c, g, or t
  misc_feature (16)..(16): n is a, c, g, or t
  misc_feature (534)..(534): n is a, c, g, or t
  misc_feature (599)..(599): n is a, c, g, or t
  Predicted polypeptide sequence is orthologous to G938
naaggcaaggtaaggnatggtcgtgctgtattcgactactatagggaaagctggtacgcctgcaggtaccggtccggaattcccgggtcgacccactcgtccgcttcaagataagatgacagccaaggaaagtgcaacctggcttgcaataatcaatcaagaggaggccttggcgcgtgagctttacccggattattgccctccattagcagcctcttctggaggtagtggatctatggtaatcaatgattgcaatgagtatgatgttgaagggggtgacgatgagccaaactttgacgtcgaagatcgcaaacctgagaatcttcatgcaccgaatcttgggatggacagaatgatgggaagactgccttctttcccaatcaagggagaggctgttacaaatttggatttcattcggaagaggaagatctctggtgacttcaacatgataatggatcagaaaatttacacatgcgaacaacctcagtgcccttacagtgaaattcaccatggttttgctgacagaaattctanggacaaccatcgattgagttgtccttatagaggcagtgcttcaacagattatggaggttcatatnttcatgttaatgaggcaaagccggtcatattcccccaacagtcctttgttcaaccaaaacctactactactccgtctgttgtaactttgttccatctgtattgatctacacgacgtcgagtacagtagaatgcacgatatgatcactgacctatgtaatctatgatcaatgttcaagcacgacaatctagtgcagtaacatgttctgctaaaatcaaccttctcagcagcttcgcgcacatgccactcgtcgcatcatgattatatgaagaaactctgagagcgactgccacaaatgacaatttgcagggagcggaggtactgttgactttaggcacctggacatct

SEQ ID NO: 5746 - DNA, 934 bp, Glycine max
  misc_feature (1)..(1): n is a, c, g, or t
  misc_feature (12)..(12): n is a, c, g, or t
  misc_feature (51)..(51): n is a, c, g, or t
  misc_feature (665)..(665): n is a, c, g, or t
  misc_feature (693)..(693): n is a, c, g, or t
  misc_feature (712)..(712): n is a, c, g, or t
  misc_feature (738)..(738): n is a, c, g, or t
  misc_feature (774)..(774): n is a, c, g, or t
  misc_feature (804)..(804): n is a, c, g, or t
  misc_feature (931)..(931): n is a, c, g, or t
  misc_feature (933)..(934): n is a, c, g, or t
  Predicted polypeptide sequence is orthologous to G938
naaagagtgggnaagggggtcaacgcattatgctagcgcgcatttaccctnactaacggaacaaaagctggagctccaccgcggtggcggccgctctagaactagttgatcccccgggctgcaggaattcggcaccagtagggacaatcatcaattgaattgtgcatacagaaacagttctgcagattatggtggtggtcccaatttccatgctactgaggataagccagtcatattcccccagtcctttgttcaacccaacactacaacacagtctgcaagtttggttgcaccttcatttgatctaactggtcttggagttccggaggatggacagaaaatgattagtgaccttatgacaatctatgatacgaatgttgtaggaaacaagaacttaagttcctccaactgtgtagctgtagaaaatcataacctttctcaggccagcttacaacaacaagaaagttatttccctggtcaaggaatggtgttggaagggaacttctttgcacgagaggaaggtcaatttgaccggttcaaggccaccatgaacatgaacactcataccccttttgataccaaccatagcaacaataataatatccatttgatgtttaattccccttgtgatttgtcatcctttgatttcaaggaggatatacaangaggagtaggaatggatgctcttcacanacagcaagatgtttcaatntggtaccagtgaaaatgacaagaagngatactcgtgtatcacgggcttctatcgtgtcattnaaaggggacatgtgaaagcccttgactcanaaggcagctcatgcatcgtgctcccatgtaatcagttagactttagaattgtatgctttgcacgtctgggctggtgtatatattatggtttataaattatggtgtcccataatgtacccttttatgntnn

SEQ ID NO: 5747 - DNA, 945 bp, Glycine max
  Predicted polypeptide sequence is orthologous to G938
tgcgagttgacggctgatgtgatcacgccaagcgcgcaattaaccctcactaaagggaacaaaagctggagctccaccgcggtggcggccgctctagaactagtgtatcccccgggctgcaggcagttattaagcacatgtctcctgatattgcaaagattcgcaagcttgtgaggcagtccaaatgtcttcaagataagatgacagcaaaggaaagtgcaacctggcttgcaatcatcaatcaagaggaggccttagcaagagagctataccctgattatatccccccattagcctcagctggaggtagtggatctttggtgatcaatgatagcaatgagtatgatgttgaagggggtgaggatgaacctaactttgacgtggaagactgcaaacatgagaatcttcacacatccaatcttgggatggaaagagtgagggtaactctgccagttcaacagccctctttttcaataaagggagagactgttacaaatttggatttcattcggaagaggaaggtttctaatgacttcaacatgatggatctgaaaatttacacatgtgaacaccctcagtgcccttacagtcaagttcgccttggtttccctgaccgaatatcaagggacaaccatcagttgatttgtgcttatagaggtacttcagattattggggtccaagatttcctgttaatgagataaagccagtcgtacaccccccgtcctttgttcacccacatctactgctcagcctgttagatgttccacctgttatgatctagctgaactgagattagataatgccagaaatgatactgacttatgactactatgacacaatgtcgaggccacagaagacagtcctgtatacttactgagaaattcgacttgctacatgcatgcgagcacagacacttcattcggcaggatcatgcgagcacattt

SEQ ID NO: 5748 - DNA, 799 bp, Glycine max
  misc_feature (627)..(627): n is a, c, g, or t
  Predicted polypeptide sequence is orthologous to G938
agtgacagctttttgggtgattccgccaagcgcgcaattaaccctcactaaagggaacaaaagctggagctccaccgcggtggcggccgctctagatctagtggatcccccgggctgcaggaattcggcacgaggctgtgatccccctcagaggcggtttccgttggagaagggcgtttgtccaccatggtggcctactgggaatgaagagtggtggccccaaataggtttgccgaaagatcaaggtcctcctccttacaagaaacctcatgacttgaagaaggcatggaaaggtgggtgttctgactgcagttatcaagcacatgtctcctgatatcgccaaaatttgcaagctcgtgaggcagtccaaatgccttcaagataagatgacagccaaggaaagtgcaacctggcttgcaatcatcaatcaagaggaggacttggcacgcgagctttaccctgattattgcccctcattaactacttctggaggaagtggatctatggtcatcaatgattgcaatgaatacgatgttgaagggggtgatgatgagccaaactttgatgtggaagaccggaaacctgagaatcttcatgcatctaatctttggatggacagaatgaggngaagactgccagttcacagcctactttccaatcaagggagagggttttacaaattgtgattcattcgcagaagaagatctcttgtgactcttacatgatactgcatcagaagatttacacttgtgaaccatctgatagctctttacagtaaaacttgtccattgttttgctg

SEQ ID NO: 5749 - DNA, 746 bp, Glycine max
  misc_feature (1)..(1): n is a, c, g, or t
  misc_feature (433)..(433): n is a, c, g, or t
  misc_feature (619)..(619): n is a, c, g, or t
  misc_feature (739)..(739): n is a, c, g, or t
  Predicted polypeptide sequence is orthologous to G962
nagcgcagtcgttcagtatgactgccagcgctcagttaaccctcactaaagggaacaaaagctggagctccaccgcggtggcggccgctctagaactagtggatcccccgggctgcaggaattcggcacgagcttttttttttttttttaatctacatactatccatctctctaccttatctctccattttctcttatcaatattaaaagactaaaacacacacacacacacacaaaataaacaaataccccatggtactctgcttctgcttgaacccctgactttgtctgtagtccagtccactttctcttcactttctaagttccactactgactccaccaaaacccctcaacacacccttcttctcatgttgaatgatcaaacaccttccacaagccatggcacagagcaacaccacattgacagtgcanaaaacgaaccacaaatcagagaaatctacgccttaactccccccccaagaagagaaccaaactttgaaacacacacacacagccacagccacctctcatcttctgtgtccatagaaggtggttccacccaaaatttcagcatgaatagaaaatgcagtactcttattctagcaagctcaaccatcnaccacaacatcaccaccccaagtcaaataagcttggacatgatgatacatagcgattaaagaaagttttatagcaacaacactgacaataacaataactacaacaacgttgggaagattnaagaaat

SEQ ID NO: 5750 - DNA, 777 bp, Glycine max
  misc_feature (704)..(704): n is a, c, g, or t
  Predicted polypeptide sequence is orthologous to G963
gaataataaacagttgcttcttattagaaaatttatgagcccatacacaaaacaaacttccatatacacagatcatgactagaaggatatataaagattttttttttactgcctacggggcttcacaattaatttcttacactattgaaggttttgagcaacttgtaatctaactaattaggaagcttcactggtagcaggagagggaggaccagtcacagtgccattctccattgtgaaatcaatgacaatgggtgtctcatccatagcttcttcctcactgctgctgctgctagaggtctccccttcagacctttttgccttctttccctttcttccttccttcttcgtcttgaatatgcgatacacagccatagctgacaccatggaaggatgcgatttcgagacgaggcgaaattcatgcatcacccaattcgatttggcaaaaccattgcccttggcttcccagaaagccaaaacgttctttcttgcaacaacctgttctttagagagctcaaaatcttgagctttctctattgttctccattgaccgttcccggcttctcacttgttgaggttttcgaacacacgggtcctcaaatcatggaagaaaaacctctgccaattcaaattcttactaccacctcctggcagctcccaaggcactgtttggtaaacatcacagtcttgaatgaagtcattangggatggttgggccatgatcctcttcctgagatagtaaccagcaagaatttcatcacttggatcgacagcaac

SEQ ID NO: 5751 - DNA, 818 bp, Medicago truncatula
  Predicted polypeptide sequence is orthologous to G1006, G22, G28
ggtagagagagaactagtctcattgcttccacaaacggtagactttagatccaaaataccactactctttcctccaaaacatggcttcaaccaccaaagactcagatttggaatatttggaacacattcaacaataccttctttttgatgattctagcatgctgaaatctcatcaaccttttccaagccctaaaagtgacaatgatttagacacaactgtagaggcgcgtgaagtaagcatgcctcctgtatggaagcggtacaagggagtgaggcgtaggccatgggggaagttcgcagctgagataagagatccaaaaaagaatggtgctagagtttggcttggaacgtatgtgactgaggaggaagcagctttggcttacgacaaagctgcttttaagatgcgaggccgaaaggccaagcttaattttccccacctcattggctctgatgtgtctacatctgagccagagaggggaggtggttttgaaaagggaatcacccgagccttcttcttcttcatcggagggaagttgtgagtcagtgtaccagggttgaagaggaggaggggcatggttgacctacttaacaaattagccaagaatagaagccaagtagccaccgggtggttggcgttgaaaaggcctcacaagcaaatgattttgagcagtgggtgaatgagttgaatgattgcactctaatctagagctcatagtgtaggtgcatttattttattttttcttctaatttgggcagtttcctaatatttttttcatcacccttttgatattaatcaaaggcgtgatgttaagcaaaac

SEQ ID NO: 5752 - DNA, 759 bp, Medicago truncatula
  Predicted polypeptide sequence is orthologous to G1033
tatatctctctccccccccccccccaaaccctagtttccaaccccattccacctttcgttttcatcatgaaaggagccaagtccaagggtgaatcgaagaaagccgatgctaagcttgccgttaataagaagggcgccgccgctactaagggcggaaggaaaccagccaagggaaaggaaccaaaggaccctaacaagcctaagagacctccaagtgctttcttcgttttcatggaggattttaggaagcagttcaagaaggataaccctgacaacaaagctgtgtccgctgtgggcaaagctgctggagcaaaatggaagtcattgtctgaagctgagaaagcaccatatgcagcaaaagcagagaaaaggaaggcagaatatgagaaaaccatgaaggcatataacaagaaacaggctgaaggtccagctgctgttgaggaagaagaatctgggaaatcagaatctgaagtgcatgatgagaatgaggatgatgatgaggatggcagtgaagaggaggaggatgacgagtagaaacttggatgatgataacatttatgtaggatgtgctgatgatttgatcatcttgtgtagatgatcttttcgtttcttgataaacatgtcttacttctaggaatattttgctgctcccttggtaaatgttttgtcttttcaaaacgtgaatagctaaaatatgagggagctagcccttatctgtacttttaaatccactattttagttaagaggtgtttatcttt

SEQ ID NO: 5753 - DNA, 684 bp, Medicago truncatula
  misc_feature (608)..(608): n is a, c, g, or t
  misc_feature (623)..(623): n is a, c, g, or t
  misc_feature (674)..(674): n is a, c, g, or t
  Predicted polypeptide sequence is orthologous to G1033
cctttgtctctttgattctctgcttgctgtgtcttcggttcttctgcttcgcttgttgaagatcctctcttcaacctttcatccattttaagatcatcttgatactagaacgaagacgatgacaaagggcaagggaacagcaaagacttcaagggatgctttgaaaccagttgatgatcgaaaagtaggaaagagaaaggctgctgctaaacctgagaaggtgccaaagactaagaaggagaagaaggccaagaaagatcccaacaaaccaaaaagacctcccagcgctttcttcgtcttccttgaggatttcagaaagactttcaaggcagagaaccctaatgtgaaggctgtatcagctgttggaaaggctggaggagagaaatggaaatccttgactaaggcggaaaaagctccatatgaagccaaggctgcaaaaaggaaagttgagtatgaaaagcttatgaatgcttataataacaagccaagttcagcggacgatgacgaggaggaatcagacaaggacaattctgaagttaataatgaagatgaagcaagtggagaggatgaccaccaagatgacgaggaagaggatgacgaggacgaanatgacgatgaagacnacgagtgagatttgtgtgcataacttgaaatatgatgtttcattggtggangggaggtttt

SEQ ID NO: 5754 - DNA, 657 bp, Medicago truncatula
  Predicted polypeptide sequence is orthologous to G1033
aagttcaatcaccgtttcaccatgccgaaagctgtttccgacgccaaacctgctgataaccggttgaagcgcaagggcgcaggtactggaaccaagcagtcgaagaaagctaaggatcctaacaagcctaagaggcctccaagtgctttcttcgttttcatgtctgagttcagagagaggttcaagaaggagaatccaagcaacaagtccgttgctgtggttgggaaagccggtggaaaggaatggaaagctctgtctgatgctgtgagaattttgcttctgtttcaccgaaggaaattaatctaattctcttagttttgattttaaagtcgtttttgtgatttgtgtattttaggataaggctccattcattgctaaggctgataaattgaaggaggagtatgagaaaacaatgcgtgcttacaatatgggaattgtaattacttttatcacttttctgtgactttgatttttccgtgttctgattttacttggatttatatctcgtgtttgctgatttgagctaattttggtgcattagactgagaagaatgcttcggaggaagaaggatctgagaagtccaagtctgaagtgaatgatgatgatgaggatggtgatgatgaggaggatgaagagtaaggttggtggtgctgaag

SEQ ID NO: 5755 - DNA, 802 bp, Medicago truncatula
  Predicted polypeptide sequence is orthologous to G1048
gattccattcaactcattccattcatcatcttcttcgtaatttttgggtaccatggacactttcgaaccccaaatcgatttcgaatctctcttcgcagaatacgaagtcgccgattttttgcaggaggatgatatcaatccttctgtttccgtcgcagacactccctcgcctctttcagagattgagaatcttctcatgtctgatgccgagggaattgcgtcctcatcatcggattctgactatcataagcttctccaagatattctcgtcgaccctatccctctatcggatgatcaaggtttcgttctttctgatgaagccagggttgatccagtaactcctcaagaggttcctcctgaacccgtttcaaaaaagcaaattaggcagatgaggaacagggacgctgctgtgaaatcaagagagaggaagaaggtgtatgtgaaaaaccttgagacaaagagtaggtattttgaaggggaatgcagaagattggagcatttgcttcagtgctgctatgctgagaaccatgctttgcggctttgtttgcaatcgcgtggtggctttggtgctcccatgaccatgcaggagtctgctgtcctcttgttggaatccctgctgctgggttccctgctatggttcctgggcatcatgtgccaactcagtctaccccttccactgtcgctaacaacagtgttacctccaagagaaaacatggatcacaaaggtctaagaaggggtggctctaaaagggccaaacagtaataatatctctgattattttctgacttcgatcgtttgtaa

SEQ ID NO: 5756 - DNA, 759 bp, Medicago truncatula
  Predicted polypeptide sequence is orthologous to G1076
attctgaagaacaggaatcaaatcgtgccagtgttggtggtggtgcaccgttctcatcgaacgaagaagatgatcgcagccaaggtttagagcttggttcagcagccggaccaggagatgtggtaggccgccgtccacgcggcagaccgccgggatcgaaaaacaaggccaaaccaccggtgatcatcactcgagagagtgccaacactctcagagctcatattcttgaagttgccggcggttcagatgtttttgaatgcgtatctacctatgctcgccgccgtcaacgtgggatctgtgttctcagcggcagtggcactgtgacaaatgtcagtatccggcaaccagcggcggctggtggtgttgttacgctacatggaagatttgagatattatccttgtctggatcttttctgccaccaccagctcctcccggagcaactagcttaacgatttatcttgctggaggacaaggacaggtggtgggaggtagcgtggttggtgagcttatcgcggccgggccggtgattgtgattgcagcttcttttactaatgttgcttatgagaaattgccgttggaagaggagcagcttcagatgcaggctgaggctggaggaggttctcaaggctccggtggtggcggtgggcggcataatataacaatccattttctgatccatcttctggtttaccggttttcaatttgccattgaatatgcagaatggtcatcagctaccctgtgatggtttgggcgggaa

SEQ ID NO: 5757 - DNA, 796 bp, Medicago truncatula
  Predicted polypeptide sequence is orthologous to G1076
aatctaattaacaactccaacaacaaaagccaaatgttttacaaattgttcctagaaattaattaacttagtccttacaacataacctaaccatggaaattaaattaagaaaacgagacttgaatagaaaatcagtacttcttcacaaatgatttcaaaggaaaataaaaccatggaattcaactcacctttgtgctccaattaagctcaataagattgtcttccaccagagtttccagcccaaccatccactggtaattgaggcatatttagaggcaaattaaagaacgggagcccggatgatggatcgggaaaagagttattgacaccatcaccgccaccgccaccaccacctgcagatgattgcccttgttgcatctgaagagattcatcttcatccaacggtaacctctcatacgctacattcgtaaaagatgaagcgatgacaataaccggtccagaagcaaccaaaggaccaacaacatttcctcccacaacttgaccttggcctccaccaaggaacacactcaaacttgtagctcctggaggagctggtggtggtagaaacgatccggacaaagaaagtatttcaaaccttccatgtaaagtcactacagatcctgcggcagctggctgtcgcaaggtcacgttagtgactgttccactcccactaaggacacagatccctctttgacgctttcttgcattagtagccacagagtcaaacacatcacaaccactacttactttcaggatgtgagccctaagtgtgtttgcactctctcttgtgatgatc

SEQ ID NO: 5758 - DNA, 652 bp, Medicago truncatula
  misc_feature (480)..(480): n is a, c, g, or t
  misc_feature (632)..(632): n is a, c, g, or t
  Predicted polypeptide sequence is orthologous to G1078
gtagaatgatgtacatgtggagatcaatgcatcagtaccatgaagttcaaagcaacatagtgcagcaagtccgcggtctcgtgaatagatcaggaggtgagtcaacttctgaactgcacaggcaggcaactcgtgaccttgaatcggctgtctcggcttggcactccagtttttgccgcctcataaaatttcaacgggacttcattctctccctacacggctggtttaagcttagccttatgccagtcgataatgataacgtcaacaggatggaacactccgacgcgtacatgttttttgatgattggaagcttgcacttgaccgcgttcccgacacagttgcatcagaagccatcaagagctttatcaacgttgtccatgtcatatcttccaagcaagctgaagagctcaagataaagaagcgaaccgaaaatgcttccaaggaactcgagagaaaggcttcgtccgtacggaatttanaaagaaagttttacagctcgtattctatggtagggattggcattcctgacactggacctgataacggacaagggttggatgcaccccatccacttgctgagaaaaagatggaactagcaacctgccaaagacgtgttgaaaatgaaatgacnaagcattcaaaagctgtaaa

SEQ ID NO: 5759 - DNA, 727 bp, Medicago truncatula
  Predicted polypeptide sequence is orthologous to G1089
ggaaggatgattttgactcagatgagcatgaaactcatgctaccatcttggacaagttgctagcttgggaaaagaaactttatgatgaagttaaggctggtgaactaatgaaatttgattaccaaagaaaagtcgcttcactaaacaggctgaaaaaaagaggtaataactctgaagcattggagaaagccaaagcagctgtcagtcaattgcatacaagatatattgtagatatgcaatcattggattcgacagtctcagagattaaccgattacgtgatgaacaattgtatccaagacttgttaagcttgttgaagagatggccgctatgtggaaaaaaatgttatctgaacacgagaagcaatcggagactgtgacattgctgagatcgttggacccttcccaatctcctaagcagacaagtgaacaccatcatgagcgaacttatcagctattggttgttgttcaacagtggcatttacaatttgagatgctagtcaacaatcaaaagggatacataaagtccctaagtaattggttaaaattaaatcttatccctattgagagcagtttaaaggagaaagtttcttcacctccaagagttagaagtccgcctgtacaaggtcttctccatgcatggcatgaccgtctagagaaaattcccgatgaccttgctaggacagctataggaaactttgctgctgtgatagatactattttcaatca

SEQ ID NO: 5760 - DNA, 643 bp, Medicago truncatula
  misc_feature (556)..(556): n is a, c, g, or t
  Predicted polypeptide sequence is orthologous to G1133, G1137
cagaaacagtttttggtcgttgatcaaacgggtgatcaaacaactgttatttatagttcaagatttgggagccctgttgagtgtcttggttcctgggattcgaaattgaatggttgtagcaatttaaatgggaatgatgaaccctccttaaggagagatgtgaatcatgtgattgaagttggaccaacttttgattataaagttgatgaaaatgataatcaaggaactgagattgaaagtgagatgcacgaagatacagaggaaatcaatgcattgctttactcagacagtgatggttattctactgaggatgatgaagttaccagcacagggcattcacccagtacaatgaccactcatgtcaaccaacaacctttcagaattggaggaaccgcagaagaagttgctagctcctcccctggtaaaacaaagaaacgtaagctattcaatatggcttatagtgatgttgatgtgcagtttatggacactgcaagctctctaaaacgaaacagaccctttgatctcaaccgcggtgttgatgatgatgacgacgcanaatcaaggtgctcgggtagcaattacggcagagggtcacctgaaattggttccttaacaggccataagaagatgagaaaggaaaaga

SEQ ID NO: 5761 - DNA, 807 bp, Medicago truncatula
  Predicted polypeptide sequence is orthologous to G1136
gcgtttcggtgaaagtaaaaaaagttcttatatcaccggaaatggaactttcttttctggtcagtcacagttcgtcgctggtgaagaaaacagaaaaagaaagtctcctatatccagaagcagcattgacgatggaatgctttcgtttacttccggtgtagtcttgccgtcttcaaatatgaaatcaagcagcagaggcggaggtggagattctgatcattcagatctagatgtttctgctgtgaaggaaggtgagagcagcagagttgtagagccagggaagcgacctaagaaaagaggtcgaaaaccagctaatggaagagaagaaccattgaatcatgtagaagcagagagacaaagaagagaaaagcttaaccaaaaattctatgctctacgtgctgtggttccaaatgtttctaagatggacaaagcatcgctgctaggcgatgctatatcttatataaacgaattgaaatcgaagctacaagggctggaatcgtcaaaaggtgaattggagaaacaattaggtgcaacaaagaaggaattagaacttgttgcaagcaaaaatcaaagtcaaaatccaattccattagataaagaaaaggagaaaacaacaagctcaacaagctcttctaagttaattgacttggatattgatgtgaagattatgggttgggatgctatgattaggattcaatgcagcaagaagaatcaccctgcggcgaagttgatggcggcgttgaaagaattagaccttgatgtgaatcatgctagtgtgtctgttgtgaatgatttgatgattcaaca

SEQ ID NO: 5762 - DNA, 768 bp, Medicago truncatula
  Predicted polypeptide sequence is orthologous to G1136
cattgcatttctctgaagcaacgacaactcttaagtaatggggaccttatccaccttaaggccaccggtgcggccatcacaaccaccacaatcagccaccggattcaaccaagacactctccaacaacgtcttcaagctttaattgaaggcgtaaaagaaatctggacctacgctatcttctggcaaccttcttatgactattcaggttcttcgttactcggttggggtgacggatactataaaggcgaagaagacaaaacaaaagtgaagaaatcaatagttacttcacctgctgaacaagaacaccgaagaaaagttctcagagaactttattcattaatctccggtaatccagttacggaagaatctcctgttgatgaagaagttactgatatggagtggttctttttagtttccatgactcagtcttttgttaacgacggtggacttcctggacaagcttatttcaactcaactccggtgtggctggttggcggtgagaatcttgtcctctcgcactgcgagagggcgagacaaggtcaagaacacggtttagagacgctggtgtgtgtaccgtcagcgaacggcgttttagagcttggatcgaccgaattgatttatcaaaacaatgatttcatggataaagtgaagatgttattggatttcaataatgattttgattttggatcttcttcgcatagttctttctacatagctcatcaaggtgagaaatgtactgggccataggctatatgttgtatgataac

SEQ ID NO: 5763 - DNA, 794 bp, Medicago truncatula
  Predicted polypeptide sequence is orthologous to G1136
taataatattcagaattttcaccaagttacccatttatgagaatgatacatacacatatatacacacacaggcacgcatgcacaatcttacagataaaaaaatacacttagtttttacttactgcatcaaagctaactctatctatatatgacagtaagaaaactgactctagcaaattctagttctagttcccaataaccatataacttcccaaattaaattacctcaaaactcgtactaagctaccaaaaacaaagaaactaccagtttacagagatagctaccaggaatccataaaatatcccatgccccaaaattttggaggaatgagaaattcacagatataacattcccaattaatgtctcattattacagcaaatttgcagactttattgaacatccccgactttagaggacaatgccgctcgaagctgctcctgagtgtaaaaacgactccccattttcacggttgcttgttgtatcatcaaatcatttaccacagacacactggcatggtgcacttctaggtcaagctccattaacgctgccattaacctcgctgcagggtggtttttcttactgcattggacccttatcattgcatcccaacctataatcttcacgtcgatatctaaatcgattagagcttgattcgaagagggtttattcggtattggctggtgttgttgctgctggtgtggtggctgatgagactggttttcgttgattttctgaattcattcctcatcccatcaagttgctttttctatcccatcttatcagaatcagttt

SEQ ID NO: 5764 - DNA, 653 bp, Medicago truncatula
  misc_feature (464)..(464): n is a, c, g, or t
  misc_feature (550)..(550): n is a, c, g, or t
  misc_feature (620)..(620): n is a, c, g, or t
  misc_feature (623)..(623): n is a, c, g, or t
  misc_feature (633)..(633): n is a, c, g, or t
  misc_feature (642)..(642): n is a, c, g, or t
  misc_feature (646)..(646): n is a, c, g, or t
  misc_feature (648)..(649): n is a, c, g, or t
  Predicted polypeptide sequence is orthologous to G1140
gcacgagctttcctttcttgaaaattcagccacacacaccattcattctattctaatcagagaaagattaatggcgaggcagaagataaagataaagaaaatagacaatgcaacagcaagacaagtaacgttttcgaagagaagaagagggatcttcaagaaagctgaggagctttcgattttgtgtgatgctgaggttggtcttgttattttctcaacaactgggaaactatatgaatatgccagttccaatatgaaggacataattacaaggtatggtcagcagtcccaccacatcaccaaattggataaacctctgcaagtgcaggtagaaaaaaacatgccagctgaattgaataaggaagttgctgatagaacccaacaactaagggggatgaagagtgaggattttgaagggttaaacttagaggggttgcagcaattggagaaaagtcttgaatcangactcaagcgtgtgattgagatgaaggaaaagaagattcttaatgaaatcaaggcacttcgaatgaaggaaatcatgttggaagangagaacaagcatttaaagcaaaagatggctatgttaagtatgggaaaaagtccaatctttggggactcanatnttaccatgcnagaaatgtntcancnnaatc

SEQ ID NO: 5765 - DNA, 350 bp, Medicago truncatula
  Predicted polypeptide sequence is orthologous to G1140
ggtgatgaatctgagaatgagaatgtggttaatgaaggtcaatcctcagaatctgtcaccaacgtttacaattccattggtcctccccaagattatgagagttcggatacatcgctcaagttgggactaccatatgccggctgaaggaatgtttgtgtgcgagggattaaccttagaggcttgagattaacaaggattatatgattggctaaatttcccaaatgattgcgattttaagagtaaatatgtacgtatagtaattgagcaacatgacttcatggggtactctatattatctcatttcgaaattgttaacgtgaaatagattaaaaaaaaaaaaaaaaaaaaaa

SEQ ID NO: 5766 - DNA, 813 bp, Medicago truncatula
  Predicted polypeptide sequence is orthologous to G1140
aacaaacaaaagctccaaaacctaagtttcttttctttatcattccaaataccaacgcctttccctcaaaaggaaagtaaattccacaaagtacaattcacccttccaaaccctcaccacccatcacacaatttcaatattcattttctccaaaaacaaataaatccaccatttgttcactagttgatttcttacagaacctagaaattcctaaacaaaactaaaattagctaaaaatctgcatcatatttcttacagaagcacttttatttgcttttgctttaaacagaaaaaaaaaccataaatagtcaacttacacatctttcatttccttcttgtgcttttgtctcatctttttttagaggataaattaaggtaaagaagggatatggctcgtgagaagattcaaataaagaagattgaaaactcaacggcgagacaagtgactttttcaaagagaagaagaggattaatcaaaaaggctgaagaactttcagttttgtgtgatgctgatgttgctctcatcattttctcttctactgggaaactctttgaatactccaacttaagcatgagggaaatacttgaaagacatcatttgcactcaaagaatctggcaaagcttgaagaaccgtcgctagagttgcagctagttgaaaacagcaactgttctagattgagcaaggaagttgctcagaagagccatcaactaagggcagatgaggggagaggatctccaagggtttgagtctggaagagttacaacaattggagaagtctcttgaaattggattgggccgtgtaattgaaacc

SEQ ID NO: 5767 - DNA, 892 bp, Medicago truncatula
  Predicted polypeptide sequence is orthologous to G1146
cctaaagacaaagagcttgacctgctcattgttatattgcctgataataatggctctctctatggtgaccttaaaaggatatgtgagactgacttgggggttgtttcccagtgctgtttaactaaacatgtctttaagatgagcaagcagtaccttgcaaatgttgctttgaaaatcaatgtgaaggttgggggtaggaatacagtgcttgttgatgcactttctcgacgcattccacttgttagtgacaggcctacaatcatttttggtgctgatgttactcatccacaccctggagaggattcaagcccatcaatagcagctgttgttgcttctcaagattggcccgaaattaccaagtatgctggtttggtttgtgcccaagcacatcgccaagagctcattcaagatcttttcaaacaatggcaagatccagtcagggggacattgaccggtggaatgatcaaggagcttcttatatctttccgtagagctactggacaaaagccccagcgcatcatcttttacagagatggagtgagcgagggacaattttaccaggtgctgttgtttgagcttgatgcgatccggaaggcttgtgcatcccttgaacccaactatcagcctcctgtgacttttgttgtggttcaaaaacgtcatcatactaggctctttgctagtaaccaccaagacaagagctctgttgatcggagtggcaatatattgcctggtactgttgtggattctaagatctgccatcccacagaatttgacttttatctttgcagccatgctggaattcagggcacaagccgtcccgctcactatcatgtgctgtgggatgagaataattttagtgctgatggtcttcaaagtttaactaataacctgt

SEQ ID NO: 5768 - DNA, 794 bp, Medicago truncatula
  Predicted polypeptide sequence is orthologous to G1146
gactgtgttaactactttcctagctagatataagcataaggttataggcaaaaactaaacgtgaaaaactggttattttctgaaacttcttgtcactatagtcacctttgattggtgaatatatataatctatatatctatctattcctgcaagaactcagaaaaaattcaacatgcctttgaggcaaatgaaagagagttcagaacaacaccttgtgatcaaacctcatcagcaaaactctatgagtcaagctaagaaagttactaaagctgttcagaatggtaaaggtccaccattagtgtcacaagaacaacagaaccaaacttcaccacctcaagtaaagagtggtggaagaagaaggagtagaaatggtagaaaatctgatcaagttgatgttttgatgagaccaagttgtaggccttgtactgttgtgaagagcaatgaaaatggccatgttgttgaaaatggaaacacagtctctagtgatgtagaaatgagttttcctacttcaagtaaatctttgagttttgctcaaagaccaggttatggacaagctggtacaaaatgcattgttaaagccaaccacttctttgcagaattaccagacaaggacttgaaccaatatgatgtaactattacaccggaagtgtcttcgaaagccgtaaacaggtctatcatagcagaacttgtgaggctgtataaagaatctgaccttgggatgaggcttccagcatatgatggcaggaaaagtcttttacacagcaggagttcttcccttttcttggagagagtt

SEQ ID NO: 5769 - DNA, 701 bp, Medicago truncatula
  Predicted polypeptide sequence is orthologous to G1198, G1806, G558
atgaatcaagggtctgcttttaattttggagagctagaagaggcaattgttcttcaaggaatcaagataagaaatgatgaaggaaaagcatctgctttatttacaagcaaaccagcagctacacttgaaatgtttccttcatggccaattagattccaacaaacaccaagagttgtagcttctctcacttctccatctctgaccattccttatggaggttcaaaatcaggaggagaaagtactgattcaggatcaacagagctacaatttgaaacaaattctccaataagtgtaaaagcatcttcttcagatcatcataatcatgcttttcaacaggagacagcaactgatgatggattaagaacaggcacatcaacacagaatcaatcaaaagccaaatcacctcaacaaaagaaaaaaggagctgtttccacatcagaaaagacacttgatccaaagacactgagacgtttggcacaaaacagagaagctgcaaagaaaagccgtctgaggaaaaaggcttatgtacagcagctggagtcaagtagattaaggctatccagtctcgaacaagaccttcaaagagcacgctcccagggactattcttgggttgtggtggtggcaatataaagccctggagctgcaatgtttgacatggagtatgcaagatggctagaagaagatcaacgacacatggcgg

SEQ ID NO: 5770 - DNA, 611 bp, Medicago truncatula
  Predicted polypeptide sequence is orthologous to G1198, G1806, G558
ggcacgaggatggcttggtggttttcggtcgtctgaacttctcaagcttctggtaaatcaactggaacctctcactgagcagcagttgatgggtattaccaacttgcaacaatcctcccaacaagcagaagatgcattgtctcagggtatggaagcattacaacagtcccttgcagagacgttgtccactggtgcaccttcctcgtctggttcctcagggaatgtggcaaattacatgggtcaaatggctatggccatgggtaaacttggaacactcgagggcttcattcgacaggctgacaatctgcgccagcagacactacaacaaatgcaccggatattgacaacacgacaatcggctcgtgcactccttgccatccatgattacttttcgcggctgcgcgctctcagctctctctggttggctcgtccaagagattaatgattgtagtgaatagtctgtcaaattaattaattatctcatatcaaccaccatcaatactttggtcatgataagttttgctcttagcaagtgttcttggtgttgtacttgtagtctttgtaaggctgatactagtgtttcctagagttcacatagtctaggaatggga

SEQ ID NO: 5771 - DNA, 655 bp, Medicago truncatula
  Predicted polypeptide sequence is orthologous to G1198, G1806, G558
tcagataagccacttgatgcaaagacattgagaacgtttagcacaaaacagggaggctgcaaggaaaagtcgtctaaggaaaaaggcttatgtgcaacaacttgagtcaagtagattaaagcttacacaattggaacaagaccttcaaagagcacgctctcagggtatgttcatggattggagtggtggtgttggaggcaatataagctctggaggtgcaatgtttgacatggaatatggaagatggttagaagaagacaaccgtttattaacggagttaagaaacggattgcaagcggcgttaacagataatgaaatgagagtaatggtggatggatatttgtgtcattatgatcaaatatttagactcaaaggtgtcactgctaaatcagacgtgtttcatcttatcaatggcatgtggacttctcaagctgaacgttgcttcctttggattggtggttttagaccttctgaaattatcatgatgttgatccaacaattggagccactagctgagcagcagataatggggatgtatggactgaggcattcttctcagcaagcagaggaagctctctcacaaggacttgaccagttgcaacagtctcttgttgacaccattgctgggagaccccttgttgatggtgttcaacaa

SEQ ID NO: 5772 - DNA, 660 bp, Medicago truncatula
  Predicted polypeptide sequence is orthologous to G1198, G1806, G558
gacaggacattcaactcatcatgtcccttatggaattcatcataggattaataataataatccttcatcaagcttaatgaatgaagaatctggttttgattttggggagctagaagaagcaattgttttgcaaggagttaagaatggaaatgatgaaacaaaagcatcttttttcacagccagacctgctgctacactggaaatgttcccttcttggccaatgagattccatcaaacctcaacagtaggaggtggtaacaaatcaggaggtgaaagcagtgattcagcactatcaagcaaaaatgagaacccttttgagccagaatcacccttaagtagtaaaaaagcatcttctttttcatcagatcataataataatatggatcagcagaatcttcagctacaacaacagaagatgataatatccaatgatgcttctgctgctataagaacagcctcttcatcacagaatcaaatatcagcagcagccaaagaaaagaaaaaaggagctggttcaacatcagataagccacttgatgcaaagacattgagacgtttagcacaaaacagggaggctgcaaggaaaagtcgtctaaggaaaaaggcttatgtgcaacaacttgagtcaagtagattaaagcttacacaattggaacaaga

SEQ ID NO: 5773 - DNA, 800 bp, Medicago truncatula
  Predicted polypeptide sequence is orthologous to G1198, G1806, G558
tctgttgtttcttctttctgggcctagttgtggatttaaggtttgtggaagaaagataagataagaaaatggttattgatgggcagtagaggtagaactgctgaggacactaataaggttgttaacgggatgccaagctacgcacctccatctaattccatgggcatggagggaactaatattcatccttctcgaatttctgattttggagcccttgaacaatctctaggatttcgtgttgaggatgccatgaatcttagcagaaatccagtgtttaatcaaatgaaagcaaatagccaagctttaggtgctgatattcaatttggtgctttaagtaagtccattgcaaactcggatataaacctctctgctgcaattgctgggtctcagacattgcaattacaaaaagacgcgatgccaaatctggcttcaacatctggtggccatcgtgagaattggggagagtccaacatggctgagggaagcgctgatacttcaacagatgatacagaagacaagaatcaaatgcctgaaaggggggaatccagtgaaagatcaaaagataaatcggatcaaaagacgttaagacggctggctcaaaatcgtgaagctgccaggaaaagccgactgaggaaaaaggcatatgtgcaacaattagagagcagcaggctgaaactgaccccactagagcaagagctacagcgagcacgcccagcagggatatttattttcagtactggagagcagaccatttcatgagtggaatgggtgcatggcatttgatgcaaaatatgcacgat

SEQ ID NO: 5774 - DNA, 702 bp, Medicago truncatula
  Predicted polypeptide sequence is orthologous to G1198, G1806, G558
tagataaattatatacaaatatttgtcaagagacatatcaactgactggtcagtgatgtcttttcaatacagcacaagaaaaaacgaatatatacatacaacagtgtgcaaccacaaaccattaagcaggaaaagaaaccaagagagaggaaaccaccctcaaataagcttgatttctgaaatacaatgaacaactgtaacctaaaatacaaatactatttctacattttcccccttcaactctatctatcatacacctatataatcaaattattgagactatttttcaaagcatataaaagcttaatgaaaaatgttgtaccacaccagcagtatgtggaggagaatagaaaaatcacagtatctaatgtttacaagcaccacaactaggcttcttcttcacaacagaaattcatttcccaaaagataccagcttcatgcagaaagaacatatatatagctttgaaacagtttactcccttggtcgtgcaagccatagagaactcagagctcgcagccgggagaaataatcgcttattgcgagaagagctcgagctgattgtctggttgttaatatacgaagcatttgttgcaacgtttgctgcctcaggttatcagcctggcgaagaatccctcaagagtaccgagctttcccatggccatagccatttgtcccatgtaattcgccacatttccagaagc

SEQ ID NO: 5775 - DNA, 642 bp, Medicago truncatula
  Predicted polypeptide sequence is orthologous to G1249
gcacgaggaagaagagaaaacgctgtcgtttgaaccagagtttccgaagagtagagtgaagaagataatcactctggacaaagacgtgaagagggtgagttcagaagctttgttcttggtgtcacggtctacggagcttttttttacagttacttgctgaaaagtctgcggaagttgctattgagaagaagcgcaagacggtgaagcttgaacatatgagaatcgcggtgaagagaaaccgtccaataagtgattttctactcgattcgcttccggtgccgtctgaaactgtgaaatctgataaaccagcggcggttgtggatcggcctaaatccgtttcggttggtactcgccgcatcgatcagatcttccgaaagtctggaggcgacgttgaagctcaagcgcaagcgcaagcaccagcgccggaacctgaacctgaaccagaaccagaacccatggaggaggcataggttgttttcatttgttctctctgtaaatgagatttgctgattacgttaatgacgtattggcgtaactatgcgattctaatttgtaagcaactcgttaatcatatgttatctttggttttacatagaaattgaggtattcaattatgatctaaaaaaaaaaaaaaaaactcga

SEQ ID NO: 5776 - DNA, 791 bp, Medicago truncatula
  Predicted polypeptide sequence is orthologous to G1272
taaaaaatctgagggtgaagactcatccatcccttcaagagtggaaaatatgcggactcagcgaagtcccatgcaaagagcttacttttactttgaagaaaagggatggtgatggtactgatgagatgactgttctggattattttactaatgtccggaagatagatctgcgctactctgctgatcttccatgtattaatgttggcaggcccaaacggccaacatatttccccattgagctgtgtgaattggtatcactccaacgatatacaaaagctctttccacacttcaaagggcttcactggtggagaagtccagacagaagccacaagagagaatgagaattttgtcggatgcacttaaaactagcaactacggggctgaacctctgcttcaaagttgtggaatttctataagcacaggcttcactcaagtggagggacgtgttttgcctgctccaaagttgaagttcggcaatggtgaagatttcactccgagaaatggaagatggaatttcaacaacaagaaatttgtgcagccaacaaagaagatagaaaaatgggctgtggcaaacttttctgcacgatgtgatgtacgaggacttgtgagggatataattagaattggaaatatgaaaggaattatgattgaccaaccattcgatgtgtttgaagaaaatcctcagtttagacgtgctccaccaatggtgagggtagagaaaatgtttgaggacattcagtccaaacttccaggggctcctcaattccttctttgtttgcttcctgatcgg

SEQ ID NO: 5777 - DNA, 830 bp, Medicago truncatula
  Predicted polypeptide sequence is orthologous to G1272
ttcacctgggcaaactgaaattccctcaattgctgcggtcgtaagctcaaggcaatggcccttgatatctaaatatagggcatgcgtccgtactcagggtgctaaggttgaaatgattgacaatctgttcaagccagtgtcagatacggaggatgaaggaataataagggagcttttgattgatttttataatagttctgggaacagaaaaccagacaatatcataattttcagggatggtgtcagcgagtctcagttcaaccaagttttgaacattgaactgagccaaatcattgaggcctgcaaatttcttgatgaaaagtggaaccccaaatttctggttattgttgcccagaagaatcatcacacaaagttcttccagcctggatctccggataatgtgcctcctggtactgttgtggacaacaaaatctgtcatccccggaattatgatttctacatgtgtgctcatgctggaatgattggtaccagtaggccaactcattatcatgtccttttggatgagattggcttttctccagatgatcttcaagagcttgtgcactctctctcctatgtttatcagcggagcactactgccatctctgttgttgctccaatctgctatgcccatttggctgcttctcaagtgggacagttcatgaagtttgaagacaagtctgaaacttcatctagccatgggtggtagccggtcgtgatatcaatgccttctccatcccacagttgcccaaattgatggatagtgtctgcaaactctatgtcctttgtttgagtatgggagtaatgattcaaaacttgtatttactttg

SEQ ID NO: 5778 - DNA, 696 bp, Medicago truncatula
  Predicted polypeptide sequence is orthologous to G1272
accgatcaaagacctacaaagttgaaatcagctttgcctcaaagatccctctgcaggccattcgccaatgccttaaaagggcatgaaactgagaattatcaagaaagcgattagggttcttgacattatcttgaggcaacatgctgccaaacagggctgtctgcttgtccgccaaaactttttccacaatgatccgaaaaatttcacagatgtaggaggtggtgttcttggatgcagagggctgcattctagcttcaggaccacacaaagtgggctgtctttgaatatagacgtgtcaacaaccatgattgtccatcctgggcctgtggttgatttcttgattgcaaaccagaatgtgagagatcctttcagtcttgactggaataaggctaaaaggactctaaagaatttgaggatcactactagcccaaccaaccaagagtacaaaattactggtttaagtgaaatgccatgcaaggaccagctgtttactctgaaaaagaggggtgctgttcctggagaagatgataccgaggagatcactgtttatgattattttgtcaaccgcagaaaaatttctctacagtactcagctgatctgccatgtattaatgtgggaaagccaaagcgacctacatttgtcccagttgagctttgctcattggtatcccttcaacgatataccaaagccctgtc

SEQ ID NO: 5779 - DNA, 435 bp, Medicago truncatula
  Predicted polypeptide sequence is orthologous to G1273
ggggggaaatccatatcccagaagttactatagatgtactagtatcaactgtaacgttcgcaagcatgtggagagatcaatagatgatccaaaatcatttgtgactacatatgaaggaaagcacaaccatgagatgccactcaagaacacaacaaatatgacatctgaaaaagattcaacgacttctcttaagtaaagataaaccatattgacactacattttcatttattagttaacaataacagtatagttattatgactaaatgctttggatcctcttatagatggtgacaatttggaatgtagtaactacagagactgggttatttactttctgttgcaacatttgatgacagcagtctgtctgtcttggaatttggtgttggtttgtaacttcgtatactattctgataacactgccactattgtccttc

SEQ ID NO: 5780 - DNA, 515 bp, Medicago truncatula
  Predicted polypeptide sequence is orthologous to G1274, G1275
cgcgggacttgctaggtagctagtcccccgtaaataatggcacttttgcattatttgtgtgacactgtagctatgtgtgtgtgtctgaaagagagagattctgtgcactgggactgttgatcttatcaggaactactacaagtgttcaggtgaaagatgtggtgttaagaaaagggtggaaagggatagggaagattcaagctatgtgttaacaagctatgaaggtgttcacaatcacgaaagcccctgcaattcatactgcaccccagtgtctttggtgtattccaatgaatggccacagcagaacccttctgcaacctcttcttccaattaatgctaagttaatcatatagtataagtatatgtgtgtgtgtgtatatatatatatatagctagctgctcttaataaaaggctaggaaggtttgatcgagttggtaagttgtattggctatcttcctgttatctaatcatagttattttctgctaataaaaaaaaaaaaaaaaaaaaaaaagt

SEQ ID NO: 5781 - DNA, 369 bp, Medicago truncatula
  Predicted polypeptide sequence is orthologous to G1335
agcgcagctttgaaaagagggttttagggtttgtgaaaaattcaattcaattcatcatgagtgggtcaaaattaacctgggaaggtgaaatggttcaatgatcagaaggggtttggattcatcacccctgatgatggtagtgaggagttgtttgttcaccaatctcagatccagactgatggattccgttctcttgctgaaggtgaatctgttgagtatcagattgagtctgataacgatggaagatccaaggctgttagtgtgactggtcctgatggtgcttctgttcagggatcgagacgcggtggtggcggcggtggtggttatgagcgtggtggaggtggttatggtggaggcggtggtggttat

SEQ ID NO: 5782 - DNA, 679 bp, Medicago truncatula
  Predicted polypeptide sequence is orthologous to G1341
tctattagaagtcatgtaactttatttgccctcatttttttgaagtctccaaactaagaatgctaaaacaataaagatggagcatgagaagaaggtggaattggtaaggaagttagagatgagaagggctgattatgtgaagacagaaaaggcaaagaaagaagtggagaaattagaatcacaaatgatggttgcttctcaaaccattgatagtacatcggctgaaatcgttaaattaagggagatagagctctaccctcaactcattgagcttgttaaagggttgatgtgcatgtggagaagcatgtatgagtgtcatcaagttcagaagcacatagttcagcaactggaatacctcaacaccataccatcaaataaccctacatctgaaattcataggcaatcaacacttcagctggagcttgaagtacagcaatggcaccaatccttctgcaacctcttcaaggcccacagggactatattgaatctctcagtggttggctaaggctcagcctttaccaatttagccgaaaccctcttagtagaacaactgaggagtcgaagatattcaccctctgcgaacaatggcaccttgccgttgagcatataccagacaaagtagcgtctgaaggaataaaaagcttgttgacggttattcatgcgattgtagttcaacag

SEQ ID NO: 5783 - DNA, 837 bp, Medicago truncatula
  Predicted polypeptide sequence is orthologous to G1364, G481, G482, G485
atacaaacataatattcagggttccgacgatatgtccgaaactccggcgagtcctggcggcggcagccacgaaagcggcgaacacagtcctcgttccaacatccgtgaacaagaccgtttccttcctatcgccaacatcagccgcatcatgaaaaaagctcttcctgctaatggtaaaatcgctaaagatgctaaggaaaccgttcaggaatgcgtctccgagttcatcagcttcatcaccagcgaggcctctgataagtgtcagagagagaagaggaagacgattaacggtgatgatttgctttgggcgatggctactttagggtttgaggattatattgatcctcttaagatttaccttacaagatacagagagatggagggtgatactaagggctctgccaagggtggagacacatctggcaagaaagacgttcaacaaggttctaatcctcagcttgttcatcaaggttctttctcacaaggtgtttcctacacaaattctcagggtcaacatatgatggttcctatgcaaggtccagagtaggtaataagccaattgatcttctcacagtggttgcggtgttttcagttcggtgctggtagagctttactaaatgccgtcggcataattgaatgtatttcatgtaatgttaatactggcataagacacattggttcttgtgtcctgattttttttctctctaaaattatggtttgtatataatgtgtggagtaaaattatttatttcaaagttacatttggtagtgctggacccatggtagtcttgattccttctggcggctttggcaaggcttttagaattaggtagctga

SEQ ID NO: 5784 - DNA, 577 bp, Medicago truncatula
  Predicted polypeptide sequence is orthologous to G1364, G481, G482, G485
gggttttagttttagggtttatgcgccatggcagatgcaccgaaccaatgcgaagaaagccacgagagtggtggtgaacagagtccacgtggctcttcttctgcttcacgtgaacaagatcgttttttgcctatagctaacattagcagaatcatgaaaaaagctttaccttcaaatgggaaaattgctaaggatgctaaagatacgatgcaagaatgtgtttctgaattcatcagctttattaccagcgaggcaagtgagaaatgccagaaagagaagagaaagaccattaatggagatgatttgttatgggctatggctactttaggatttgaagattatatagaaccacttaaggtgtacctagcaaggtacagagagttagagggtgacagtaaaggatctgttagaaacagtgatggatctggtagacgagatcaagttggcggtcctccaggtcaaaatgctcagtttgttcatcagggttctttgagctatattgattcccaggtgcatccacaacatctggttatgccttcaatgcaaaatcatgaatagattagatgcttctcctcac

SEQ ID NO: 5785 - DNA, 718 bp, Medicago truncatula
  misc_feature (652)..(654): n is a, c, g, or t
  misc_feature (674)..(676): n is a, c, g, or t
  misc_feature (680)..(687): n is a, c, g, or t
  misc_feature (705)..(707): n is a, c, g, or t
  misc_feature (709)..(714): n is a, c, g, or t
  Predicted polypeptide sequence is orthologous to G1364, G481, G482, G485
cccgggcctgcagggaaactcctaccattcccgttcccaattccccttcgccggcgccaccaccatcaccaccgccgacaccactctcctccctcacacaccaccacaaatccttcagtacaacgttcttcaatttcacgcagaaacttagtcaactaaattgtatcctctctgaacacgcaactgccgagactaatcctttgttctggtagacactactcaagagtaaaatcacatcaacacttcaattccaggattctggtgagttttttccgaatacagttattaaattttgcaggaacccgagtcaacgcaatccgagttgaatccgtgactcgccggcggtgaactttgattcgagttttacgtcagaaagttcacgatggcggactctgacaacgactccggcggaccacacggcggaggatcaaacgctcacggaagcgagatgtcaccacgagaacaagaccgatttcttccaatagcaaacgtaagcaggatcatgaaaaaagcactaccagcgaacgcgaagatctcaaaagacgcaaaggaaacagttcaagagtgtgtttcagagttcatcagcttcatcaccggcgaagcctccgataagtgtcaacgtgagaagcggaagacgatcaacggcgatgannngctttgggcgatgacgacgnnnggannnnnnnngtatgttgagcccgtgannngnnnnnncacg

SEQ ID NO: 5786 - DNA, 676 bp, Medicago truncatula
  Predicted polypeptide sequence is orthologous to G137, G145
gtcctagcatgctcaagacgcttgttaggtaccaaaaatgcagctatggtgcagtagaagttaacaaacctgccaaagagcttgagagcagttaccgtgagtacttgaagctgaaagcaagatttgaatctcttcaaaggactcaaagaaaccttcttggtgaagacttaggtccattaggtaccaaagatcttgagcagcttgaacgccaacttgattcatctctcaagcaagtcaggtccaccaagacccaattcatgctggaccaattagctgatcttcaaaataaggagcatatgttggtagaagcaaacagatctttgtctatgaagctggaagaaatcaatatcaattcaagaaaccagtataggcaaacatgggaagctggtgatcaaagtatggcatatggtaatcaaaatgctcactcacaaagcttctttcagcctttggagtgcaatccaacattgcagatagggactgattacaggtacagtcctccagtagcatcagatcagctaactgcaacaactcaagctcaacaagttaatggatttattcctggatggatgctttgagctaagctcattatttctctatttgcataaaagcaaaagacaaaaaaatgccttttggttttgacattgttgtaaatgctgcatgtgcttctttctggtta

SEQ ID NO: 5787 - DNA, 646 bp, Medicago truncatula
  Predicted polypeptide sequence is orthologous to G1382
aaatctaatgagagagagagagagattcatacaatgtttcaagtcaaccaagtcccactctctcaccatctctgacaaacaaaacaacatgaaaaaatgaccattatacccctatctctattctaactttcgataacaccgccgtcacaatggaagtaaccaccactaactccggcgaaggaacacccactgatccgaatcgaaatgggtcggttcaaaattcgatggcaagatacaagttgatgtcgccggcgaagcttccgatctcaaggtcgccgtgcatcacaatacctgccgggtatagtcctacgtcgttgttggagtctccggttcttctttcaaacatgaaggttgagccttcaccgactacagggtcccttcttcaagctttaaactgttctatggcttctgctacatttcctgtaacttctgcatgcttcaataccagcactgttaatggcagaaaatcaagtttctttgagtttaaaccacaagatagaaatatggttcctgcaaacttcaacaaccatgtaagcgaaaaatctactcaaatggaaggttcaggaaacggtcaatcatttccgatcctctccattaaatgaaaatgagatagaagatcaatctaatgaattaagcctatcatcat

SEQ ID NO: 5788 - DNA, 742 bp, Medicago truncatula
  Predicted polypeptide sequence is orthologous to G1389
gttaagtgttggtccctcacttctctctacctcttccttcatcatctcattgttctttcttcttctcccttgtgtaaccaccaccaccggtcaactcctaccaacatctaacctcttccggcaacatttagcaaaaatacttgttcaaaaaaaaaaacatttagcaaaaataactacatattcatcatcctcttgatctcatctatctttctatcaaagccaactattaagaggagttaattttaaaaatgggtcattttcttaaaagcgttttccggctatgaccaccacaaactttccggccaccaccaccaccaaaaaatgtgcagtttcaccactgattctttgtaaggttgttggtgttaaatttatgcctttttgaattcttctcaaatctttttcctactacaaacttgtgaaattcaaaggaattagatagttgtggagttgacagcacacctttgattatttctgttttggaaacaagcttgttgctggtttggaaaatttagaaaattcagattatgcggctgagccgcctgttcagatggtggtggagggtttttgttgattaaaatgaaattttcttaggatcaaacaattgataataataagatgttttcaagatttttttggggaagaacacatgaagatgaagtggtatgtgtcttctttcttttgcagatttggattttgagaaagaacaaatagacatgaatacatgattttccagattttgcac

SEQ ID NO: 5789 - DNA, 849 bp, Medicago truncatula
  Predicted polypeptide sequence is orthologous to G140, G146
actacataagctttgcaaaatatggagctaccaaatgaaggtggagaaggatcttctcaaaagaaaatgggaagaggaaaaattgaaatcaagaggattgaaaacactaccaataggcaagtcactttttgcaaacgacgcaatggattgttgaagaaagcttatgaattatccgttctttgtgatgccgaagttgctcttgttgtcttctccactcgcggtcgtttgtatgagtatgccaacaacagtgttagagcaactattgaaaggtacaaaaaagcatgtgctgcttccactaacgcagaatctgtatctgaagctaatacccagttttaccagcaagaatcatccaaattgagaagacagattcgagatattcagaatctaaatagacacatccttggtgaagctctaggatctctaagtctcaaagaactgaagaatcttgagggtagattggagaaaggtttaagcagagttagatctagaaagcatgagactttgtttgctgatgtggagttcatgcaaaagcgggaaattgagctgcaaaaccataacaattatctacgggctaagatagcggaacatgagagagctcaacaacagcaacataatttgatgccagatcaaacaatgtgtgatcagtccttaccttcatcaccagcatatgaccgaaatttcttttcggtaaatctttctggatcagatcagcagcagtatttcgcgtcagaccaaactgcgcctccacttgtgtgatcatatatatgctggaaaaaggcatggacgttgtgcaacagtcctgaaacccgttataatctacctgaatagtgcatgagtgtgtctatatag

SEQ ID NO: 5790 - DNA, 841 bp, Medicago truncatula
  Predicted polypeptide sequence is orthologous to G1419, G43
atactcatggctaattttgaagaagcttcagctctaaaacgcatcaaaatgcatcttcttggtgaattttctccacttccatctcctatttcaacaccttgctttgattttgattttgattttgaatttcaaacaatcccaaacatatctcaatctgaatcaaactcttccacttctgattcatcaatctctttggatcattatttaactaacctccttgaaacagatacacaaattcctctgtttgaatttgacacaaaacctcaattaatggaacatgagagccctaaagctctaacatcatctcatcatgttaatcaacctcaacgaacagtagagaagaagcctaaactgagccgaaaaccatcgctggaaatcgctctaccgaagaagactgagtggatccaattcggtaaacctgatccaaaaccggaggtggttgttcagaaaccggaagttgctgagaaacaacactacagaggtgttagacaaagaccatggggaaaattcgccgcggagatccgtgacccgaacaaaagaggttcaagagtttggcttggaacctttgaaactgctatcgaagcagctaaagcctacgattcagctgctttcaggctgcgtggctccaaagcgattctcaactttccacttgaagtcaacgcagtcgcagcatcggcggaaaccaccgtggaaggcaataagaaacggtgccgtgaagaagaagaagaagaagaggaagaggtggtagaagtaaaaccggtggtgaaaaaggaaaaaataacggaatatgatatgaactgttttaaagagatgccgttaacgccgtctttttggactggtt

SEQ ID NO: 5791 - DNA, 773 bp, Medicago truncatula
  Predicted polypeptide sequence is orthologous to G1419, G43
caagtaacaaatacaaatactcatggctaactttgaagaagtttcagctcttaaacgtatcaaattccatcttctcggtgaattttctccacttccatctcctatttcaacaccttgctttgattttgattttgattttgaatttcaaaccaaccaaacagcatctcaatcagaatccaattcctccacttcaatctctatgaatcaatatttcactaacctccttgaaacagatgcacaaattccactgtttgaatttgacacaaaacctcaaatgatggaacatgagagccctaaagctctaacatcatctcatccttttagccaatctcaacgaaccacagagaagaagcctaaactggctcgaaaaccctcgctagaaatcgctctaccgaagaaaactgaatggatccaattcagtaaaccggatccaaaaccggaggcggttgtccagaagcctgaagcagttaagaaacagcactacagaggagttagacaaagaccatggggaaagttcgccgccgagatccgtgacccgaacaaacgaggttcaagagtttggcttggaacttttgaaactgctattgaagctgctaaagcctacgattcagccgctttcaggatgcgcggatccaaagcgattctcaactttccacttgaagtcaacgcagccgcggcgacggagaccgcagtcacagcggtggaaaccaccggtgacggcaataagaaacggtgccgtgaagaagagaaagagaggtggtagaagtaaaacc

SEQ ID NO: 5792 - DNA, 678 bp, Medicago truncatula
  Predicted polypeptide sequence is orthologous to G1419, G43
taacaaactaaaaattaattttaaatacattcaactaataattctaattaaaacagttcttgctaatattattttaacattttaattgattatgagtgcttaaccaacaaagaaaaaagaattactagttactaaaacaaacttgtacagcatcaccagcacctatgaacttgaacttgaacatcttgtaccttcaatttcactttctcttctccttttcctaccacaactatttggcttaggatcacaaacaccagcttccaaaggaaaattcaatatagctttctgacccctcattctgaaagcagcagaatcataagcttttgcagcatcaatttcacagtcaaatgtacctaaccaaaccctacttcctttccttgatggatcccttatctcagctgcaaatttcccccatggccttctccttacacctctatatcttcttgtctcatcaacacattcttcttctttcttaaccttctttgatgacaccatagtagttgctattgctacttcatctttgatttcctttgaaggggttgtttcctttgaagatgaagtgtgagtgaagaattccatgtcagctattaaatcatagttttcaaggaaagtgaagaaagtgctgtttttctgaatatatgaagagaaatccaattctggtaaagggtttttcagttt

SEQ ID NO: 5793 - DNA, 707 bp, Medicago truncatula
  Predicted polypeptide sequence is orthologous to G1421, G1750, G440
caacctccgtcgtcacgcgccgccacagcaatttccgcggggtaagacaacggccttggggaaaatgggctgcggagatccgtgacccgatccgaagaaaacgtctatggctgggaactttttctacggcggaggaagccgccgctgagtacgacagagtggcagtgatgttgcatggttcaaacgcggttacaaactacccaataactcaggtggaggttaaaacggagatcgaaaaggattttgaagtgacgccgccggtgagcagcggaaacagcgacagaggtggttactccgacgctttgtcgtcgccaacgtctgtattaccctacgactgtgattcgacgccgtttgacggtttccgttacgtagacgtggacgcttttgggtttcacatcgacgcgccgttaagtttaccagaagttaacgttccgctgacatgtcatcagaagttggaaaaagaagagaagtttgaagagtttgatcttgacgagtttatgacgtggccgtattgaaaaatcttgagggcttatttgtctttttgagaaaagaaaagggactgtttggtaattatgctgttttgttgctggttgtgtaattccgaagatgccctcagttgaagttttgttgtgcttattggaagagtgtagagtttcgtgccgaaaaagaaactatatttgtgtgtatttaatttggaaataaattta

SEQ ID NO: 5794 - DNA, 810 bp, Medicago truncatula
  Predicted polypeptide sequence is orthologous to G1421, G1750, G440
taacttaggacaaaaatatcttcatagtgttggagaaagataatcttatcttacttactctagtgctctacactcttggtcacaagggtaatttaggaattccatcaagtacaaacagaacacgacaaaaacctcaatattaacgacaaagaccaatatacccttagggtttaacttggccatgtcaagaactcgtccaagtcaaactcaccaaactcttctttttctttctcgaacggaacaaagttaacatccgttaaatttaacggcgcgtcaatatcaaagccaaacgcatccacagctccgtaacgtaaaccgtcaaacggcgtttcgccgtcgcagaaaggtagaacggatgtcggagaagcaaaaccgtcgccggagaaaatctcaggcgaacctttaacgcttttcttgtcggaggcatcgtttggaaagttgacggcggcgacttttggaccatagatcttcgcagcggcggcgtcgtaaacagcggcggcttccttctctgtgttgaaagttccgagccagagacgttttctttgaaacgggtcacggatctctgatatccaccgacccgaaggtcttttgcgaacaccacggaatatgctccggcggttagaaccgccggagttttttgtgggtcgttttctgggtttatttaaatgggtcgggttaatggagcaagatgaagaagaaggtgaagttgcttgagaatcagtgagagaaaggaattgcatggtgatgttagtgatttccttcttcactcttcgtggggtttcatcgtcgccggaggatctgaaatcggtg

SEQ ID NO: 5795 - DNA, 547 bp, Medicago truncatula
  Predicted polypeptide sequence is orthologous to G1451
acaccttcttaccacaggctggagcgtatttgttagtgcaaaaagactagtagctggagattctgtgcttttcatttggaatgaaaagaatcagcttcttttgggaatacgtcgtgccagtaggccacaaactgttatgccatcatcagttctttcaagtgatagcatgcacattggacttcttgcagctgcagcacatgctgcagcaactaatagctgctttacagtgttctttaatccaagggctagtccatccgagttcgtcataccactctcaaaatatatcaaagctgtgtaccatacacgcgtttctgtcggtatgcgtttcaggatgctttttgagactgaagaatcaagtgtccgcaggtacatgggtactataactagcataagtgacatggatcctgttcggtggccaaattctcattggaggtctgttaaggttggttgggatgaatcaacagctggggaaagacagccacgggtatcgttatgggaaattgagcctttaactacatttccaatgtatccatcactatttcccctt

SEQ ID NO: 5796 - DNA, 680 bp, Medicago truncatula
  misc_feature (541)..(541): n is a, c, g, or t
  Predicted polypeptide sequence is orthologous to G1451
ttcggcacgaggcgacaaactacttttgcaagaccttgactgctagtgacacaagcactcacgggggattctctgttcctcgccgggcggctgaaaaagtgtttcctcctttggatttctcccaacagcctcctgctcaagagttaatagcaagggacttgcatggtaacgaatggaaattcagacatatcttccgaggccagcccaaaagacatctacttacaactggatggagtgtttttgtgagtgctaaaagacttgttgctggtgattctgtgctgtttatctggaatgaaaagaaccaattgcttcttggtattcgccgtgctagccgaccacaaactgtgatgccttcctcagtattgtcaagtgatagtatgcacttgggacttcttgctgcagcagctcatgcggctgcaaccaatagccgtttcactattttctataacccacgtgcgtgtccatccgaatttgtcatacccttggcaaagtatgttaaagctgtgtatcatactcgagtttcagttggtatgcgtttcangatgctctttgaaacagaggagtctagtgtgcgacgatacatgggtacaataactggcatttgtgacctaaattctgtccggtggcctaactcacattggcgctcggtaaaggttggttgggatgaatccactgccgga

SEQ ID NO: 5797 - DNA, 815 bp, Medicago truncatula
  misc_feature (200)..(200): n is a, c, g, or t
  misc_feature (778)..(778): n is a, c, g, or t
  misc_feature (815)..(815): n is a, c, g, or t
  Predicted polypeptide sequence is orthologous to G1451
tgattacgccagctcgaaattaaccctcactaaagggaacaaaagctggagctccaccgcggtggcggccgctctagaactagtggatcccccgggctgcaggaattcggcacgaggctccaggactgccttcattccatgcaggtttgaaggatgatgattttggcatgaattctcccctattgtggcttcgagatgcntgatagagggcttcagactcttaattttcaagggatgggtgttaatccttggatgcaggcaaggcttgatccgtccatgatgaatatgcaaccagatatgtaccaggctatggctgctgctgcacttcaggatatgaggaccttagatccttctaaacagcatcctgcttccttgcttcaatttcagcagccgcagaatttctccaatggtaatgctgctttaatgcagaatcagatgttgcagcaatctcaacctcatcaggcttttccaaagaatcaagaaagtcagcatccatctcaatctcaggcccaaacacaacaattccagcagcttcttcagcatcagcactcattcactaatcaaaattatcatatgcaacagcagcagcagcaacagcagcagcaacagcagcaacaacagcagcaacatcagcagcagcaacaacaacaatcacaacagcaacaacaagttgtagatcatcaacagatgtcaaatgccgtctccacaatgtctcagtttgtttccgcacctccatctcaatcaacccagcccatgcaagccattttcttcaattggncatcaacaaaacttttcggactcaaatgggaacccan

SEQ ID NO: 5798 - DNA, 673 bp, Medicago truncatula
  misc_feature (567)..(567): n is a, c, g, or t
  misc_feature (586)..(586): n is a, c, g, or t
  misc_feature (602)..(602): n is a, c, g, or t
  misc_feature (620)..(620): n is a, c, g, or t
  misc_feature (673)..(673): n is a, c, g, or t
  Predicted polypeptide sequence is orthologous to G1451
gctgaaatgaagctttcttcagctgggtttagtcctccacctcaagaaggagaaaagcgggttctagattcagaactttggcatgcttgtgctggtcctcttgtttgtttgccagctgatggaagccgtgtggtttactttccacaaggtcacagtgaacaggttgctgtatctaccaacagggaagttgatacttatattccaaatccaagcttacctccccaacttatttgtcaacttcataatctgactatgcatgcagatacggagacagatgaagtgtatgcacaaatgaccttgcaacctctaaatcctgaagagcaaaaggaagcatatcttcctgcagagttgggaacggcaaataaacagccaacaaactacttttgcaaaattttgacagccagtgatacaagcactcacggaggtttctctgttcctcgccgggcagctgaaaaagtttttcctccattggactttacacaacaacctcctgctcaagagttgattgcaagggatttgcatggtaatgactggaaattcaaacatatcttccgtggccagccgaanaggcatttgcttacaacangttggagtgtctttgngagtgctaaaagacttgntgctggtgattcagtgctgtttatatggaatgaaaaaatcagttgcttcttgn

SEQ ID NO: 5799 - DNA, 646 bp, Medicago truncatula
  misc_feature (481)..(481): n is a, c, g, or t
  misc_feature (535)..(535): n is a, c, g, or t
  misc_feature (592)..(592): n is a, c, g, or t
  Predicted polypeptide sequence is orthologous to G1451
gtttacaagtcagggtccttcggaagatcgttggatatcaccaaattctccaactaccccgagctacgcagcgagccttgctcgtatgtttgggcttgaaggtgagttggaggaccctgtaagatcaggctggcagcttgtatttgttgatcaagagaatgatgttcttctcctcggtgatggtccatggccggaatttgtaaatagtgtatggtgcatcaagatactttcccctcaggaagtgcagcaaatggggaccaatggtctagagcttctgaactcagctccaacccagaggctctctaatggtatctgtgatgactacactggccgtgaggactcaagaaatttaagcaccgggctaacaactgtggggtctttagactactgaatgttgtgacaacaaatactgtgaatttcttctcttgtattattattactcttctcaaaccctctgtaaagggtgggaagcggttcctanttgtagtttatagcttactcagatataagcctttctttttccagtttttaccgnctaaaacaattattgagctaaacacttagctatatggcatcttctcattgtagtttngtacactatattggtaaccttttggaactctatgtttgaagttacctctatttt

SEQ ID NO: 5800 - DNA, 566 bp, Medicago truncatula
  Predicted polypeptide sequence is orthologous to G1451
cataaatccaatgactttatagtatgctctcaatatatacaacctatctgtttttaatggctcatgactaaagaaatggtacgaccataaattaaatgaccaaaactatcactgtctgagtgtagccataaattatgagccaagtacttgcaattgcatgctagtaacctacaaacataagtttaatgttgaaatgatatgccagaatataaaataaatagaatccccaaaacatgactggtgttgtgtcaatcttggggaagctgtatcagaaaatgagctaactcatgaaattccctccaccaatgtttgtagctccctgtgatgaaacttgtccctgagaaaccatttgtgagcgccccccaggaccttgaacataggtttgacccattccagcaccaaccatttgttgctgctgaggaagctgttgatgttgcagttgctgtaactgcggaagctgttgctgctgttgctgcagctgagaaagctgctgctgttgaagttgagggagttgctgctgctgttgctggagttgtggaatctgctgttgaatctgggaaagctgc

SEQ ID NO: 5801 - DNA, 829 bp, Medicago truncatula
  Predicted polypeptide sequence is orthologous to G1451
attgtatataattgtagctagcacaatgacaagataccatatagttacagtattagtttatgaatagtcctagcatgaaaaacatgtaaataaaaataaaaggctatattatataagataaactacatttagataacactttccataaaaaaatgcagactattagcagtcacatcttttagtagtctagagatcccacggttgttatcccgctgcttagatttcttgaatcttgacggctcacatagtcatcacaaatgctatttgagagcctttgaattggaaccgagttcaaaagcccgaggccagtgttgcccatttgctgcacttcctcaggcgaaagtatcttgatgcaccatacactattcacaaattccggccaagggccatcaccgaggagaagaacatcattctctcggtcaacgaatacaagctgccagcctgatctcacagggtcctccaactcgccttccagtccgaacattcgggcgagctcactacgcagctcattgtagctgctgaatttagtgatatccaacgatcttccgaaggaccctgatttataaaccttcacaaaggtcttgttcagtgggttgtttccttgctccccgttttcctgggtatgcaagaaaccagattcaccaatactaggcgttactccatgattcaacgaagaatcagcgcctgcggtgttcatgtaactagaagattgatggtaggacatggttgaggaaatcatggtgtttgcactgatccccttaaagtcgacatcccattatgcagtagaagagatgagggatctataatgacaccgaaataaagattactt

SEQ ID NO: 5802 - DNA, 684 bp, Medicago truncatula
  Predicted polypeptide sequence is orthologous to G1480
gtcatcttcacttgacgttggagtggtgccagacggaaacacagtgtcagagatatcatacaatttcggatcggaatcgatggtttcagggggtgtgaatagtagtaaccaaggggtgcaaggagcaacacaattatgtggaatggatcgtgaagcgagggttatgaggtacagagagaaaaggaagaaccgaaaattcgagaagactattcgttacgcttcacgaaaagcttatgcagaaacccggcctagaattaaaggccggttcgctaaacgaaccgaaattgactcggatgtggaccgtctctataaccctgctgatcctctctcagttccttcatctatgctaatggactgtccatacggcgtcgttcccacgttttagtaaacaaggataacagaggagtatgattctcctatactatggtttcaatgtgttagaataattagtgatgatgattctgtgggaaccgttgattattttgtttttattgctaattaaaagttcagataagttgagtccctcagatacatcaatgatcagagacaaagatatttacccgtcgcgcactaacgaggtctttatcactggacttcttaccaactggatcaactgttttaataatgttgattattattattaggatgaaaaagtggtgaattggttagatttggcgccggtgt

SEQ ID NO: 5803 - DNA, 784 bp, Medicago truncatula
  misc_feature (5)..(5): n is a, c, g, or t
  misc_feature (214)..(214): n is a, c, g, or t
  misc_feature (226)..(226): n is a, c, g, or t
  misc_feature (510)..(510): n is a, c, g, or t
  misc_feature (538)..(538): n is a, c, g, or t
  misc_feature (540)..(540): n is a, c, g, or t
  misc_feature (555)..(555): n is a, c, g, or t
  misc_feature (614)..(614): n is a, c, g, or t
  misc_feature (622)..(622): n is a, c, g, or t
  misc_feature (668)..(669): n is a, c, g, or t
  misc_feature (671)..(671): n is a, c, g, or t
  misc_feature (692)..(692): n is a, c, g, or t
  misc_feature (715)..(715): n is a, c, g, or t
  misc_feature (727)..(727): n is a, c, g, or t
  misc_feature (731)..(732): n is a, c, g, or t
  misc_feature (757)..(757): n is a, c, g, or t
  misc_feature (770)..(770): n is a, c, g, or t
  misc_feature (782)..(782): n is a, c, g, or t
  Predicted polypeptide sequence is orthologous to G1480
tgatncgccagctcgaaattaaccctcactaaagggaacaaaagctggagctccaccgcggtggcggccgctctagaactagtggatcccccgggctgcaggaattcggcacgaggacagtcgcagattagtcagagtgtttcatcttcctcgatggacgttggagttgttcctgacgcgaacaccgtgccggagatatcaaactgtggttacngggacggtggcnggtggatcgtgaagctagggttatgaggtacagggagaagaggaagaatcgaagattcgagaagacaattcgttatgcttctcgtaaagcttatgcggaaactaggcctaggattaaagggaggtttgcgaaacgcactgatgcagttgattccatttctggatacggcgtcgttcccacttgttgatttattttttgctcttgttgattttgttgcttcctatcttcccgctgcattttctttcatgatgtatataactttttgcttgtttaattatgtaatntaaagttgcaaactgaccttgcttgccnanaaaaaaaaaaaaaanaaaaaaaactcgaggtcgacggtatcgataagcttgatatcgaattcggcacgaggaancctcatanactttctagattgattttgttatcacctgctggctttcatcatganntncaacatggtcttttctgtggnggaacgtgtaatattttttctanctcctgttttgnctcnnattttccccgccttctacataccantccgattttttcntatgcttgatanca

SEQ ID NO: 5804 - DNA, 742 bp, Medicago truncatula
  Predicted polypeptide sequence is orthologous to G1480
agtctcgtaaaactaactaaactgtaaaacgtacatatacataacatcgtattacattacattttaatattaattcataaggttaatgaaaattcaaaatactcgagaaagacttgaaagcattcattcaaacacggaccgacctttctaatcgacgtgtcagatccggtgaacttcaacaggaaggaacgacgccgtattcatcctctgcaattaaattcatatttaaatctgatcgtttcgcaaaccttcctttaattctaggtctagtttctgcataagcttttctcgaagcgtagcgaatagtcttctcgaatcttctattctttctcttctctctgtacctcataaccctagcttctctttccaccgccgtcatcggaaccgccaccgtcatcggcgccgtctccgtcgccgttgtttggtaactgcagtacgatatctccgtcatcacgtttccgtccggcacaactccaacatccatcgacggtgaagatacggtgtgattgaaattgtaagtgaaaggttttgagttggagaaatcgatgttgatatctgagtagtgttcatgttcgtgttcggtggcggttttgctatgagactgcaccggaacgacgccatctgcggtggtgccgggactgttttgctctggcaagtctgttttagtgttgacagtgacgaaatcatcgatttcggggtacgagtagtgagagtaattgagatcagggaatttaggggtttg

SEQ ID NO: 5805 - DNA, 336 bp, Medicago truncatula
  Predicted polypeptide sequence is orthologous to G1488
attccaactcacatcgaaaggtgcaagagctccgacgccagaaggagatgatgagggcccaacaacaccaattgttgcaactacaacatcatcacagcattatgtttgaaggaccatccaacggtgatgattacttgattcatcaacacgtgggacccgatttcacgcacctcatctagtacggtgctttggtagagaattaaacctccaacgcagctttgaatattaattttgtagctacaattaattttacttatatctctcctaccatttttagtttatgacaggttaattaataatgttttttcatttttcaagaaaaaaaaaaaaaaaaaa

SEQ ID NO: 5806 - DNA, 696 bp, Medicago truncatula
  Predicted polypeptide sequence is orthologous to G1494, G789
caaggagcttctctgtcaagcttccagctactttctacatcagcaagtcagaaacaaaggagaaaagaaactaaaatctattttgctcagtttaggtactagtttggttcagttcggttcagttagcgatgaacaacaccattcctgattggaattttgggattgatagttttgtcaccaatcaaaagaagcaacctatgggactggaccatgaacttgtggagcttctatggcagaatggtcaagtagtattgaatagccaaacaaataagaaacaacttgtgaataactcaagacaagttcataagaatcttcaatcaacaactttaagcaacttgattcaagatgatgaaactgtttcatggatccaacaataccctattgaggatccacttgaacaagaattatgttcaaatcttttatctgaacttccaccttgtaatgtcgagtctttcaattcgcaaccgacgaatacaaaaccgccttttgttcaggaatttcctatgtcggctccgaggtttcatcaccttgttcccgattcatcgcaaagaaacaatgatttgtgtggatccagcaaggttgtaaacttttctcacttttcaagacatcccaatgttactttagcatctactaacggcgatgcaaatttaagagacaaaattacgggtaatctgtcacaatgtgatgttagagagt

SEQ ID NO: 5807 - DNA, 724 bp, Medicago truncatula
  Predicted polypeptide sequence is orthologous to G1494, G789
tagatcaacttaaaatttaggtcggacctaattgcctctatttataaacatttttttaaatcatatctcatttaatctgagattttcaacagatccaaaaaataagtcacttgtatataaatcaagtgaactatattatctacatacatatatttatagttgagctggcagacatatttttgttgctggttcttctaggaattcctctaaactaattaacccattttgccactcacagcatcattaatgtttgctgttccactcattggtccactgctattgcttggtggaatcattgtttgactattttgtacagcttggggaccatatctgtacatattcattggctgagaagcattttgcataagatgatagcccatgtaacgagcatattgctccgaaagagcaggattttgcatctgattttggtagttgaaggcacctaaaacaggattttggcacgttaatgtctgatttggcgtctgtgacgaagaaacggacagatccagaggcattctcggtaattgcattggattttgaagtggaggaaacgaaggcgtagtcattcccatacccatttgtgacatatagtgctgatatcccggtagcatcattggtgtcatgccagatcccatccacattacctgaaagtgtaactgaagtgatttcaagtattcaattgccctctctaacaatgatggcttgtccgtcttactactgttga

SEQ ID NO: 5808 - DNA, 611 bp, Medicago truncatula
  Predicted polypeptide sequence is orthologous to G154, G1797
tttagacacaaccctttattcctcctatcccttccttggttcattttttcttttatttttccaatttggtgcaaatctgcttccttttgttgctgcaaagaaaaggaaaaaaaatggtgagaggaaagacacaaatgaagcgtatagagaacgcaacaagtagacaagtaacattctcaaagagaagaaatggtttgttgaagaaggcctttgaactgtcagtgttatgtgatgctgaggttgctcttattgttttctcaccaagagggaggctttatgaatttgctagctctagcattctagaaacaattgaacgataccgcagtcataccaggattaataatactccaacaacatctgaatcagttgaaaatactcagcaattgaaggaagaagcagaaaacatgatgaagaagattgaccttcttgagacttcaaaacggaaactcttaggagaaggtttagggtcttgttccattgatgaactacaaaagataggaacaacagtgtggagaaaaagcataaacaaaattcgagtcaaaaagactaagggtttttcagggagcaaattgatcagtctaaaagaaaaggaaaaagccctagttgctgaa

SEQ ID NO: 5809 - DNA, 744 bp, Medicago truncatula
  misc_feature (603)..(604): n is a, c, g, or t
  misc_feature (606)..(606): n is a, c, g, or t
  misc_feature (660)..(662): n is a, c, g, or t
  misc_feature (680)..(685): n is a, c, g, or t
  misc_feature (703)..(704): n is a, c, g, or t
  misc_feature (706)..(706): n is a, c, g, or t
  misc_feature (712)..(716): n is a, c, g, or t
  misc_feature (718)..(718): n is a, c, g, or t
  misc_feature (724)..(724): n is a, c, g, or t
  misc_feature (726)..(729): n is a, c, g, or t
  misc_feature (740)..(741): n is a, c, g, or t
  Predicted polypeptide sequence is orthologous to G154, G1797
cccgggctgcgggaacctgtattggcttctttgagggttgagataacaaaagattccattcttttcttccactaaatatttgtcagttcagatcttaccctcaaagagagttcataatggtgagaggaaaaactcaaatgaaacgcatcgaaaatgagtcaaacagacaagtaactttctcaaagagaagaaatggactgcttaaaaaggcctttgaactttcagtgctttgtgatgctgaagtcgcactcatcgtcttctctaccacagggaaactctatgagttttctagttcaagtataagcaagacagtggaacgctatcaagggaaagtcaaggaactggttctcagcaccaaaggaatccaagaaaatacacagcatctaaaggaatgtgatatcgacacaacaaagaagttggaacacctagaactttccaaaaggaagctgttgggagaagaattgggttcatgtgcttttgacgaattacaacagattgaaaatcaacttgaacgtagcttaagcaaaataagggcaagaaagaatcaattgctcaaggagcaaattgaaaagctaaaagacaaggaaaggttacttcttgaannantaaacgcttatgcaagcagtgtggaattggacaaatgattgtttaataaacaannngaagtgtgcatgacgagnnnnnngagacagaattgttcatnngncgaccnnnnnangaatgntnnnngagctgaaccnngca

SEQ ID NO: 5810 - DNA, 682 bp, Medicago truncatula
  Predicted polypeptide sequence is orthologous to G1635
tccctcttctgtttttcttcaaccattgaggaagttgtaaaagtttgttaacttgtctgtgaacaaaattttgttctgtttacagagaagcaaagattttcatcactggattctgattctatggagattttgggtcaaaaagaaggaatgcattctgttatacatgttcaaaaactacttgatcaattttcatgtggaaatgaccatgccttgaaggcaaggaagccatatactatcacaaaacagagagaaaagtggacagatgaagaacataagaagttccttgaagctttaaaattatacggccgagcctggcgaaaaatcgaagatcaatcgagacactgatgggaatgatacaacaatggtggagacaattgaaattccacctccaagaccaaaacggaagccgattcatccttacccacgtaaactagttgaaatcccaaagaatgaaatctccaacttggaacagccactgaggtctaattcgcttgtgtcgttagattttggtcaagaaaacaactctccaaagtcagtattatctgcagttgcttcagaaacccttggtttctctgattcagataccccctgccggaagtttgtccccggtctcatccattagtgctgttcatacccagtagatttcccactttcttgagtccaaatcatcatcatctgagga

SEQ ID NO: 5811 - DNA, 689 bp, Medicago truncatula
  misc_feature (619)..(619): n is a, c, g, or t
  misc_feature (641)..(641): n is a, c, g, or t
  misc_feature (649)..(649): n is a, c, g, or t
  misc_feature (673)..(673): n is a, c, g, or t
  misc_feature (683)..(683): n is a, c, g, or t
  Predicted polypeptide sequence is orthologous to G1635
attttcttctttctctcttattcaccctcttccctcttctgtttttcttcaaccattgaggaagttgtaaaagtttgttaacttgtctgtgaagaaaattttgttctgtttacagagaagcaaagattttcatcactggattctgattctatggagattttgggtcaaaaagaaggaatgcattctgttatacatgttcaaaaactacttgatcaattttcatgtggaaatgaccatgccttgaaggcaaggaagccatatactatcacaaaacagagagaaaagtggacagatgaagaacataagaagttccttgaagctttaaaattatacggccgagcctggcgaaaaatcgaagaacatgttggcacaaagactgctgtgcagattcgaagtcatgctcagaagtttttttctaagatcaatcgagacactgatgggaatgatacaacaatggtggagacaattgaaattccacctccaagaccaaaacggaagccgattcatccttacccacgtaaactagttgaaatcccaaagaatgaaatctccaacttggaacagccactgaggtctaattcgcttgtgtcgttagattttggtcaagaaaacaactctncaaagtcagtattatctgcagntgcttcanaaacccttgggttctctgattcanatacccctgncggaag

SEQ ID NO: 5812 - DNA, 569 bp, Medicago truncatula
  Predicted polypeptide sequence is orthologous to G1638
ggcacgagggggagattggagaaacatctctaggaatttcgtgaccacaaggacaccaactcaagtcgcaagtcatgctcagaagtatttcattaggcagctttcaggagggaaggataagaggagatccagtatccatgatatcacagtggtcaatctccaagaaacgaaatcgccttcatcagaaagtaacaatctttcttcgccggatcatttggtcaaggttccaaatcaaccgcaaaataataatttgtccggcatggtcaagcaggaatttgactggaaattaccagatgaaggcatgtcatttgttttcaattcaactaaaggaaacatgtttgtggcaccgtcgtgcgggatttcttcacatgaatcgaaatcaccggggcgtaatgtactccgaagcactcatcatggataccagttttcaccttttgatactattttgcaaatgcaatccatgcagcatcaatgaactgaggaggacttaagttagtccatagtaattagaatctatgaagagattagttcgtgttgtttctgatattaaaattcgggcaatagtttgt

SEQ ID NO: 5813 - DNA, 646 bp, Medicago truncatula
  misc_feature (586)..(586): n is a, c, g, or t
  misc_feature (623)..(623): n is a, c, g, or t
  Predicted polypeptide sequence is orthologous to G1638
gtctcacttcaaatattcaacctttctttaagagggtggtgtataatattcttggattcatccatcaaaatcaatagtctcaaaattcattattttcacactcacactaaaatttttagcgcataatgattttcataaagattctgtatgatactaaaaggtatgactttgatagattctcaactttatcttaataatcacacaagtaaaagattcttgtttctgttttctatgtgacatgttgatcaaagttgtataatttcctcttttttgtggttttttatgtgtgtttaaaaccaaaccttttgtagtagtatttgtgatttaaggtatggatttggaaaccctttattctccttattttatgttggatacaaattggcttgttgaagagagttaccaaacagaatggagtagagaagataacaagaaatttgaaagtgctcttgctatatatgataaggatacgccagatagatggcttaaggttgctgagatgattcctggtaagactgtgtttgatgtgattaagcagtatagggaattggtagaagatgtgagtgaaattgaggccggaaatgttccnatcctggctatcttgcttcttctttcacctttgaagntgttgaaaaacaaaacttgatgg

SEQ ID NO: 5814 - DNA, 700 bp, Medicago truncatula
  Predicted polypeptide sequence is orthologous to G1638
ttcacttcttctttcacaaccaccacttatgcttattttcatctcaaacttcacaactttttcactttctcaattaccctcttgactctttttgttccattaaaattcttcaactcatttttatataaatttacactttttatgcatttttaaactgacccagttgcttaatttcactcaaaaaccctcatgttctaaaacttgatgtgggttttgtaaaaaaatcacttttttattttttttctttctcttttggtgatttttttcttgtcttttagatctgattagttttgtaaaagttcttattaataaattctggattttttccttggattttggaaaaaagcactttttttagattccttagttatttgggtagctgaaataagcagcagatagattccacccaaatgctgtttgataatatgcttctttggccataagaacttccacttttgtagcttatctctctctctttgaagctcttttttagagagaaagagatcaagagttagtttatatgattatatgattttatctagaacaatgaatagaggagtttgaagttctatcaccagcttcctatatccaaaattccaattgggttgtttcaagaaaacaatggttcaaaatggacttcagaagagaataagctctttgagaatgctctagcttattatgataaggatactcctgatag

SEQ ID NO: 5815 - DNA, 799 bp, Medicago truncatula
  Predicted polypeptide sequence is orthologous to G1646, G715
agcagatgatgatcaaatatgtttcacatattgcatagaaggatcattgttcgattttaaattttgtacatacgtagttaaatcatgttgttgatcatcaagttaaaaggttcttgatggcatcccatacaaatttagttaacaaaatcatttctaaattgcaagcaataaaaaaattccaagaaacattgcagaagtccagcatctttttaagtcttgacagtccatcggcagcagcgcggtcactcagctctggccatcgccattgtgctgaccactgccaacaccgccaccaccagcataagaaccatcatccgcgcccgtctgccaaacagactgccaagcctgagaaggcggctgaacataaacaccggtagcgggatcaacagccggacgaccaatcatcattccagcaggttgtcccataggaggataataataaggaacaccactagcagcagcaccaacaatagcagcagcaccttcatctttaatctcatctctcggaacaatatcaaccaaaaaatcaaaaatatcagtcctagtaatagcagcagcaatatcatttttctgaagagttcgtcgtttattctcttcagcatgaagccaagaacgaatggtgagttcaagaatgaaaagctcacaagctttagcaaagagaattggtgcttctgcagaaatcatgcgaacgtcttcatcagctttcatgattttcttaatgcgtgctaatggaaagtgatggtttttgaagtcattgacgtgttcgatttcttgacgttggtaagacaaaacatttgaa

SEQ ID NO: 5816 - DNA, 659 bp, Medicago truncatula
  misc_feature (609)..(609): n is a, c, g, or t
  misc_feature (635)..(635): n is a, c, g, or t
  misc_feature (650)..(650): n is a, c, g, or t
  Predicted polypeptide sequence is orthologous to G1752
cacaattagttgtttcactataaaaggaaaaaaaccatatatagaattagaaagtgccaagtgataaaaagaatttattgagtattgtgtccaaaaatggattttgattctcttctcttccaaaaccaaaatcaaaaccttatgtacttccctaataatttctcttgggaactagaagaagattttgttaacttctttagtgatgtcaacaactactcaaactcttctggatcattatcatcaacggaatcaaactcttctggatccgtactaagcaatgaaccactagaagtttcatcaaataccacttataaacaagtgatcaaagagacacaaacatcatcaccacctccaccgccgccgattaaggaaagtaagaaaagagcatttagaggagtaagaactaggccatggggaaaatttgccgcggagataagagattcaacaagaaaaggtgttagagtgtggattggaacattcgacacggccgaagcagctgctttagcttatgatcaagcagctttttcaacaagaggttcattggcagtgttgaattttcctgaagaagtagtgagagaatcacttaaagaaatggctagtaattctaancctttggatgaaggcacttcacctgnattggcactcaaaanaaacatagc

SEQ ID NO: 5817 - DNA, 426 bp, Medicago truncatula
  Predicted polypeptide sequence is orthologous to G1767
tttggtaataatcctatccataataaacatttacatcatccaccatggacatatgtacatcctaccaccttacccaaaccaatttaccctgccagtaccaacattccaaaaaagcatcctcaccaccctccaaaagaagataacactcatttctaaagtatgaaatgagagttttgaactatatatatgtactgaataggtggtcctagttaccaagctgtttgttttctatagtaatatgtactctcctacttggcaaatgtgtgtgtgtgtgtgtttgtgtgtgtatgtgtcatgaataaaaattacttgacaagaaacaatgctatgtacgtactgcaaattttaaatatttttatttgtgacactagattataataaataaatattatgattgtgtgagattgataggtttgattgatttat

SEQ ID NO: 5818 - DNA, 758 bp, Medicago truncatula
  misc_feature (1)..(1): n is a, c, g, or t
  misc_feature (513)..(513): n is a, c, g, or t
  misc_feature (538)..(538): n is a, c, g, or t
  misc_feature (558)..(559): n is a, c, g, or t
  misc_feature (561)..(561): n is a, c, g, or t
  misc_feature (563)..(563): n is a, c, g, or t
  misc_feature (581)..(581): n is a, c, g, or t
  misc_feature (606)..(607): n is a, c, g, or t
  misc_feature (610)..(610): n is a, c, g, or t
  misc_feature (621)..(621): n is a, c, g, or t
  misc_feature (624)..(624): n is a, c, g, or t
  misc_feature (627)..(627): n is a, c, g, or t
  misc_feature (633)..(633): n is a, c, g, or t
  misc_feature (635)..(635): n is a, c, g, or t
  misc_feature (637)..(637): n is a, c, g, or t
  misc_feature (639)..(639): n is a, c, g, or t
  misc_feature (641)..(641): n is a, c, g, or t
  misc_feature (644)..(644): n is a, c, g, or t
  misc_feature (653)..(653): n is a, c, g, or t
  misc_feature (658)..(658): n is a, c, g, or t
  misc_feature (660)..(660): n is a, c, g, or t
  misc_feature (670)..(670): n is a, c, g, or t
  misc_feature (673)..(673): n is a, c, g, or t
  misc_feature (679)..(679): n is a, c, g, or t
  misc_feature (682)..(682): n is a, c, g, or t
  misc_feature (693)..(693): n is a, c, g, or t
  misc_feature (695)..(695): n is a, c, g, or t
  misc_feature (700)..(702): n is a, c, g, or t
  misc_feature (704)..(705): n is a, c, g, or t
  misc_feature (708)..(709): n is a, c, g, or t
  misc_feature (711)..(711): n is a, c, g, or t
  misc_feature (713)..(713): n is a, c, g, or t
  misc_feature (717)..(717): n is a, c, g, or t
  misc_feature (720)..(722): n is a, c, g, or t
  misc_feature (724)..(724): n is a, c, g, or t
  misc_feature (726)..(726): n is a, c, g, or t
  misc_feature (728)..(729): n is a, c, g, or t
  misc_feature (731)..(731): n is a, c, g, or t
  misc_feature (733)..(733): n is a, c, g, or t
  misc_feature (738)..(738): n is a, c, g, or t
  misc_feature (741)..(743): n is a, c, g, or t
  misc_feature (750)..(750): n is a, c, g, or t
  misc_feature (752)..(753): n is a, c, g, or t
  misc_feature (757)..(758): n is a, c, g, or t
  Predicted polypeptide sequence is orthologous to G1850
nttgattcaccagctcgaaatttccctcctaaagggaacaaaagctggagctccaccgcggtggcggccgctctagaactagtggatcccccgggctgcaggaattcggcacgaggcctattttcgtatggggaattatgtttattgtgacccaaattaatttcttagatgtggcttaagctaatggattctgatcgtcttagaaagccttcagaaaatttagttcattctcgtttcttcctttctggtttctattgttgggattgggaattcttgactgctcttcttctctttagttgttcttcctagacctagacaaattttttacttttaagttatttttttaacatcagatcatagagaagagattttattttttggtttgagaaaattattattagtagtagtgattagaaaaatatattagttgaaggattgatcggagaaaaatgtcgcagcggtcggcgcctgcgccgtttttgttgaagacgtatcagatggtggatgatttancgacggatgatgtgatatcatggantgagagtggtgaaagtttgnngngnggaaacatgcctgatttntgcagggatttgctcctaaatattnnaancacaacaattnctntanctttgntncntnanctnatacttatngattncnaaagctggtnccnacaatnggnaatttcaaacnanaattnnnannaanncncnaacnccnnntnantnntntnaaacnccnnnaaacctntnnattnn

SEQ ID NO: 5819 - DNA, 715 bp, Medicago truncatula
  Predicted polypeptide sequence is orthologous to G1850
agacacaccaccttgtggatgaaatcgccaccgacgatgtgatttcgtggaatgatacctggaacttccttcatcgtttggaatccaaccattttcgctagggatttgcttcctaaatattttaagcacaacaatttctctagcttcgttcgccaactcaatacttatggatttaaaaaagttgtacctgatcggtgggaattttcgaatgaatctttccgaagaggtgaggaacggcttctcggtgatattcagcgacggaaaatcgtttcagcatcactggcggcagcttccaatgccggtgtgaccgcgacaaaaacggttccgacagcaaagcctatcgcgtcgccgtcaatttcaggagaggagcaggttatttcttcgaattcctcgccgtcgatttctacggcggcgcttttagacgagaatgagagattgaaaaaggagaacatgcagttagcgaaggaaatggaggacatgaaatcgctctacagcaatatattcaatcttctgtcgaattacgtgaattctcaaacggaaggcggtgcggaaggaaaagagtcttgctcaacggcgtcgccggtgaagacgcttcgtttgttaccggagaagcggtgcaacggcgaaaatgcccagcgtggaagatagaaaccccgaagctgtttggaatagcgattgatgccaagcgagagagagaaggaccgtgtatttgaga

SEQ ID NO: 5820 - DNA, 759 bp, Medicago truncatula
  Predicted polypeptide sequence is orthologous to G1850
tttcgtcgaattcatctccgattgcagtgaacaatggtgctacggtgcagcgtagcacaagttgcaccactgcaccggagttagttgaagagaatgaaagactgaaaaaagagaatatgcaactgagtaatgagttgagtcagttgaaaggtctttgtaataatatacttgctatgatgagtaattataattctggtttcagtagacagttagaatcttctacaagtgctgcgacggcgcgaggcgtggttgtaacagaagggaaaattttggatcttttgcctttaaggaatgtttctttagctgaggaaaatgtggtggttaatttgggtggtgctgccggtggtttgccgtgtgagacgatgagtttgatggaacctgaggttcaagcatctcaggttcctaagctatttggggtttcaattgggcttaaacgatgtaggaccgagaatgaggttgaaccggagagagaggaacgggaacaacatcaacaaatgcaagtgcagatgcaaacacaatcctcgcaggagactgatcgaggatcagatgtgaaatctgaaccacgcgatggtgactcggatgatcaagagcgtcgttggaaattgatgaaatagtggcaaaggccgtgtttggaatttggattatgtccggactcctaaatttgaaacatgacacacatgtttgaacatggctaacagacactagcagttggtgtcattggacaagggcatggtttgaaattgaaattcatggttggtg

SEQ ID NO: 5821 - DNA, 470 bp, Medicago truncatula
  misc_feature (16)..(16): n is a, c, g, or t
  misc_feature (66)..(66): n is a, c, g, or t
  misc_feature (421)..(421): n is a, c, g, or t
  misc_feature (433)..(435): n is a, c, g, or t
  misc_feature (441)..(441): n is a, c, g, or t
  misc_feature (443)..(443): n is a, c, g, or t
  misc_feature (445)..(445): n is a, c, g, or t
  misc_feature (447)..(448): n is a, c, g, or t
  misc_feature (451)..(452): n is a, c, g, or t
  misc_feature (458)..(458): n is a, c, g, or t
  misc_feature (464)..(464): n is a, c, g, or t
  Predicted polypeptide sequence is orthologous to G189
cctcgtgccgaattcngcacgagggtagaaagagctttggatgatccatctatgttggtagttacnttatgaaggcgaccacaatcactccctctctatggttgaagctaataatctcatcttagaatcctcttgaactgaattgaattgaataatcttcatttctcatctcaaatatactcactctttctcatgccattaactcaaggccagcacaactttttcatctcaaaggagattgattactaagggtggtgttcctttttcttgtacaatattggattcctttaacttttcttgttctcttcacaaactccaacaatgtgaacccatcgagattagtattatttattttcaaagaaaaaagtggagatggtggatttggtaaaaagaatagaaagaattgagtggggttttagtnaaaaaaaaaaannnaaaaanananannaannaaaaanaaaaanaaaaaa

SEQ ID NO: 5822 - DNA, 856 bp, Medicago truncatula
  Predicted polypeptide sequence is orthologous to G19
gtgatacatcaagcaatactcatcatcatcaaagaatgtgtggtggtgctatcatcgctgacttcattcctcgccgtgacggccgccgtctcaccgcctcggagctctggcctaactcatttggccaacagattgactcctcaaacttcggtttttctcatactgctgctgatcaacaaccacccagcactctcaaaagatcacagcctcccaaagttaatgaacgagttgagaagccactgaaaaaacagaggaagaatctctatagaggaattcgacagcgtccatggggaaaatgggctgcagagattcgtgatccaagaaaaggagttcgtgtttggcttggtacattcaacactgctgaagaagctgctagagcttacgacaaagaagctcgaaaaatccgtggcaaaaaagctaaggttaattttcctaacgaagatgatgaatataccattcatgctactcgtcgctacaataataatcctccaccgattcgaccacagaagcttcctctatatcatcaacaacactatcagaagaatctgaacttggaatttggttatgatctgaaccaaactgacacaattcatgctatcaatactggttctggtggtgatgagaattctttatttgggtctggttcagtttcagagggttggtttttctgtgatggagttcaatgggtggttccaatcagaatgaattcggttattttgggtgggtgttgtgaatgaacatgaaaaagagaaagagaaagtggtagaacaagaacacatgttgttgaacaaagctgagctgaattagcaaaaatgaggtacaagaattgtctgatgaattgttggcatacgaggat

SEQ ID NO: 5823 - DNA, 624 bp, Medicago truncatula
  Predicted polypeptide sequence is orthologous to G190
ccggcgcatggcggggatctcagtccacaaatgggtatgaggacttcattcctgcccctcaaatgcaaaatttggccagtcctgatgtccaaagaggtatgcacaatcgacaaagctatcctgctcagggagcatggcctctgaatcagaagtttagcaacaatccctccttggcgtccggtaagccagcacatcctgcagaccaaatttatgatcctttttcacctacatctgctgcacctccacacctgaaaggtaatcctggaaaatgagggaattgaatatggctacagatacgaaatactgacaaatacgaaatgaggtgatactaatttcatagattagtaatgggcatgggtgtaagatcatgttatttctaagcagaaagtttggttgtctccctttgatgacttattgtattccttattaaaccgacctttcttttctgaatgcccattgttgatgattgattaggaattgagtttcattatagattttttttgaagaataatgttagatattttgctatattcaaacataactttgccagaatataatcatattttcactttatgtaaaccatgtaccattctttaggatatttcacagctgtcatgtttgaat

SEQ ID NO: 5824 - DNA, 350 bp, Medicago truncatula
  Predicted polypeptide sequence is orthologous to G194
ctgggtttcccttcaaagaatatgaatgctactttttctcaagacagaccactttgtaatccaagggttcaggacaatggccttcttcaagatgttgttccttcacatatgttcaaggaggagtagatcattcatcactgtacatcataccactgcttctgtctcatttcttatgttgattgatcactttttgtagctagttagatatatagataggagacttagatgaggagtactccattagtgatgatcatatatactggtaatcttttttgcacagataagaaagccttaattatcattggtatttaatatcagtttgatcaaaaaaaaaaaaaaaaaaaaaaaaa

SEQ ID NO: 5825 - DNA, 666 bp, Medicago truncatula
  Predicted polypeptide sequence is orthologous to G194
gcaccagcttttactacttactattaccacaagagcgtgttgtctacaaatgaaggatttggatttgtgcatttgagatatcatatggagaagaaagacatgggtctaagtgtgaagagtgaggatgttgttgattcctcctcatctttgctaaataatggttatcaattttcaagcgtgtttgatttctgtgaggttgaaaggagttcttctttagggtttatggagttacttggtggtcatgactatagtcctctccttgatgtaccacaactatcaaccatgtctactgttaaggcttcatctgacaccactggaaaagagtgttctgaggttttgaaccagcaacaacctgcaactcctaattcttgttcgatttcatcagcatctagtgaagcagtcaatgataataaaactcttgttgaccaagcagaagaagatgaagaagaagaaaagcaaaagacaaataaacagttgaaaacgaagaagacaaatctaaagagacagagagaaccaagatttgctttcatgacgaaaagcgaggttgatcatctggaagatggataccgatggagaaagtacggtcaaaaagctgtcaaaaatagcccttttccaaggagctactatcgttgcaccactgcttcatgtaatgtcaagaaacgtgtg

SEQ ID NO: 5826 - DNA, 655 bp, Medicago truncatula
  misc_feature (642)..(642): n is a, c, g, or t
  Predicted polypeptide sequence is orthologous to G194
cacatatagatcaaccaaccctaccttatctatctaaatatctctctcaaacattgatgatggagaaaaagggtttgaatatggaggattatgcgaatattggatctttccctagctactcatttccaagtgtttttgatttatcggaagaaaggagcttcatggagttactgggtgtgcagcagaacatgaacaactatagtgatagtttacttgatttgcctgtggttgtaaaggagccacctttggagagtgatgggaatggaaaagagtattcagaggttttgaatagtcaacaacaacctgctactcctaactcttcatctatttcatctgcttctagtgaagcaatcaatgatgaacacaataaaactgttgaccaaactaataatcaactcaacaaacagttgaaggctaagaagacaaatcagaagaaaccaagagaagctagaatcgctttcatgacgaaaagcgaggtggatcatctggaagatgggtacagatggagaaagtacggtcaaaaagctgttaaaaatagcccctttccaaggagctattatcgttgcaccagtgtttcatgtaatgtgaagaaacacgtggagaggtctttgagtgatccaaccattgtagtaacaacctacnaaggaaaacacac

SEQ ID NO: 5827 - DNA, 369 bp, Medicago truncatula
  Predicted polypeptide sequence is orthologous to G1950
ttataaggcatggagcagatgtggatgtggaggacaaggaagggtacacagtgcttggtcgaattactgatgacgagtttagatcaatattgattgatgctgccaagaccatgcttgaatgatacaaacacaagagaacgagaacaaggttttgcttaggagttaggacctgttttatgtgtatgaccattgagagcattcaatggcttgcattttcgccaaccaaccttgcatttctgtctcttttttttatagcattcttaactagtatttgaggttattttcaccaacatatacaactaacgtttatgatccctttgatttgagaatatcgtaaattttatatatatagaaaaaaaaaaaaaaaaa

SEQ ID NO: 5828 - DNA, 640 bp, Medicago truncatula
  Predicted polypeptide sequence is orthologous to G2011
aatcttccaccgccctttccctccctttttatattcatcaccaccacactccactctattcttcttctcatattctattcacacccccttcacctttctacctttctattcacacccgctcaaaaaaaccgttttttctgttattattcaacttaacatgaatccaaatgatgaaaaaaactctcccaaattttcttcttcatctttgatggaatatgaagcatcagctataggtggtggtggtagtggtagtagtgatgttcctgtgcctatggagtgtttgcagatgagcccagttccaccatttctttcaaaaacatttgatttggttgatgacccttcattgaatccaatcatatcatggagttccaatggtggtagctttgttgtttgggatcctttggagtttgcaagaattatcttgcctagacacttcaaacacaacaatttctccagttttgttcgtcagcttaatacttatgtgggtatttttggtttttgtattcttttgctacttttcacaataatcacaatgcctctaatggcccctatttatctttgtaatgtaactaactatttttctttttttttgttttgtaactaactatttaaattccctcttccccccttgtgtttgtta

SEQ ID NO: 5829 - DNA, 812 bp, Medicago truncatula
  Predicted polypeptide sequence is orthologous to G2059
gaaatctttacacaaaaggaattaccaacttgttttcaagaaatagcaacaacagaatccaagtatttggaggatacaattataagaagaggctcttactctctcacttcctcatcaacatcatcaccacaaaagcttttctggtgtacttcaaattctacttcaatgaaacaagaggtacctttaaccactttagttaatcaaatacctgcaaagttcaatgatcatcatgatgacatgaagaatatgaaagctataaaccaatccatttctgaattcaattctatttccaatcctaatgtcttagcctcagatataaaacatagttttgttcctctaaatcttttggaaactctcccggctttaaccgtagctccgatgtctgatgagcctgcagtatctttagcttcttctacttgcgctacaccgaaatctccaaacttgactttgtttttgcaggaaccatccatgctatactcatcaacttcaaatatcaaaagtagtgaaatcatgtcaacatcttcaaatcccacatatcctatgtctcaatttggcctaactcagcatcatcaacaaagtgcttatgaattttatgattcaaacaaaatggacaggaatatgataacaaatctacaatccaagtctttcaatgagaattgggttgagtgccacaaagactcaacctatgaagtatggtacaagagggaagctttttaaaggggtgaggcagagacattggggaaaatgggttgctgaaataggctaccaagaaacagactagggtctggttagggacatttgaaacagctgaa

SEQ ID NO: 5830 - DNA, 806 bp, Medicago truncatula
  Predicted polypeptide sequence is orthologous to G206
aactaaactagcttgtgagagcacaaataattcatctcaatttcaagatggttagggctccttgttgtgaaaagaaaggattgaagaaaggtccttggaccttagaggaagatgaaatcctcacatcatacatcaataaacatggacatagcaattggcgtgccctaccaaaacatgcaggtttattaagatgtggaaagagttgtagattgagatggattaactatttaaaacctgatattaagagaggaaattttacaaatgaagaagaggaaactatcatcaagatgcatgaatcactggggaacaggtggtcagccatagcagcaaaattacctggaagaacagacaatgaaataaaaaatgtatggcacactcacttgaagaaaagattattgaataccaataataaccaaccaaattcaaataccaaaaaaagagtgtcaaaacaaaaaatcaaaagatctgattccaattccagcactttaactacagcatcaaattgcactttttctagtgatttttcatcacaagaaaaaaatttggacaatagcatcatttgtgaagactcattggtgacaatgcctgaaattgatgaaagcttttggtcagagacagtaattgatgatgaaattagttccaccatgccatcaaattctatgacagtttcaaatgatttaccagatcaacaatgcatttttaataattccgtggaaaaattttcaaaacccttttgataatgatgatgatggcatggattttttgtatgatgtgttcatcaaatcaggagaatcaacagaattgcc

SEQ ID NO: 5831 - DNA, 797 bp, Medicago truncatula
  misc_feature (8)..(8): n is a, c, g, or t
  Predicted polypeptide sequence is orthologous to G206
ctgattcnccaagctcgaaatttccctcactaaagggaacaaaagctggagctccaccgcggtggcggccgctctagaactagtggatcccccgggctgcaggaattcggcacgaggacaagaccaactttgtagagacaaacacactcactcattgaatttgagttcaccttgtttctcaaaaaataattaagatggcaagaactccttcttgtgacaaaaaaagtggaatgagaaaagggacatggactgctgaagaagataggaaattaattgcttatgtcactagatatggttgctggaattggcgccaacttcccaagtttgcaggtctttcgaggtgtgggaagagttgtagattgaggtggttgaattatctaaggcctaatatcaaaagaggaaactttactcaagaagaagaggagttgattatcagaatgcataaaaatcttgggaatagatggtcaaccattgcggccgagttacctggaagaacagataatgaagtgaagaactattggcatacttccctaaagaagcgagttgaacacaaccaaatcacaaatattgaagaaaccaaatcgaaagacattgaatccacacaggatagggatatttcctttctacaagttacccctccagctagttcccaaaccctagatatcactggcccattttccccactttcttcatctagtgaattctcttctacagattattcagatcacagtaccacttatgtggatgatttttggttttctagatggatttatagactacgtgggtgaaaaatcttg

SEQ ID NO: 5832 - DNA, 671 bp, Medicago truncatula
  misc_feature (615)..(615): n is a, c, g, or t
  misc_feature (626)..(626): n is a, c, g, or t
  misc_feature (671)..(671): n is a, c, g, or t
  Predicted polypeptide sequence is orthologous to G206
gaccaatataactcacaatttgtagaaacaaaacacactcactctctcactgaatttgagttcacttgtttaacaaaaacttattgctcaaatggctagaactccttcttgtgacaaaattagtggaatgaggaaagggacttggactgctgaagaagataggaaattaattgcttatgttactagatatggtttctggaattggcgccaacttcccaagtttgcaggtctttcaaggtgtgggaagagttgtagattgaggtggctgaattatctaaggcctaatatcagaagagggaactttactaaagatgaagaggagttgattatcagaatgcataaaaagcttgggaataaatggtcaaccattgctgccgagttacctggaagaacagataatgaagtgaagaaccactggcacacttccctcaagaagagagctatagataacattgtcacaaatgaagaaactaaatccaccaaatcaaaagacataattgaatccacacaagggagagatatatcgaattaccaaattacccctccagatagttcccaaatctcaaacaacaatggccctttatccccattttcatcatctagtgaaatctcttncacctcttcanatgattttgggtttctggattcatttataaaagatgtggatatan

SEQ ID NO: 5833 - DNA, 651 bp, Medicago truncatula
  Predicted polypeptide sequence is orthologous to G206
taactctcatcttgtagagacaaacacactcactcattgagtttgagttcacttgtttctcaaaaaataattaagatggcaagaactccttcttgtgacaaaaaaagtggaatgaggaaaggaacatggactgctgaagaagataggaaattaattgcttatgtcaccagatacggttgctggaattggcgccaactaccaaagtttgcaggtctttcaaggtgtgggaagagttgtagattgaggtggctgaattatttaagacctaatatcaaaagaggaaacttcactcaagaagaagaggagttgattatccgaatgcataaaaagcttggcaatagatggtcaaccattgcggccgagttacctggaagaacagataatgaagtgaagaaccactggcacacttccctcaagaagagagctatagataacattgtcacaaatgaagaaaccaaatccacacaagggaagatgtgtatccaattaccaaattacccttccagctaactcccaaatctcagacaccaatggccctttatccccattttcatcatctagtgaattatcttccacatcttcagatcacaattccactgctttggatgattttgggtttctggattcatttatagaagatgtggatgaaag

SEQ ID NO: 5834 - DNA, 661 bp, Medicago truncatula
  Predicted polypeptide sequence is orthologous to G206
gttctctctaagattattatatatagatctaacggcactcatactaagaattggtaggagtaagacaagctattaccaaccagactctatagagaatatggtgagaaccccttattgtgacaaaaatggactaaggaaaggcacatggacacccgaggaagacaaaaagttgattgcttatgtaactaggtatggctgttggaattggcgacaattacctaaatttgcaggtcttgaaaggtgtgggaagagttgtagactaaggtggttgaactatctaaggccagatatcaaaagagggagctttagtcatgaagaagaagagactatcatcaaacttcatgaaaaattgggtaatagatggaccatgatttctgcaaatttaccagggagaacagataacgagataaagaactactggcacaccaccataaaaaagactcttgtaaagaataagtcaaacaccaaacgtggaacgaaaaaagccaaagactcaaattcaaaaaatcaccctacaatggaaaaacccaagaaacttggagaaatgttagagaacaacagtgatttcaatattacgagtccaccatcttcacaaccatctacaagtgcatcctcttgcatatcattaatggacactgcagctactactacaatatcatat

SEQ ID NO: 5835 - DNA, 403 bp, Medicago truncatula
  Predicted polypeptide sequence is orthologous to G206
aacttatataaagagaaatagaaatctcctaaatttccacttcctcatgatggttgacctgatttaatgaatacatcgtaccaaaattcaatttcttcactaatctgacttgaaccatgatggtccatattttctcctaaagtatcacaagaggttgcattgtaaaatcctgaccctacagtgtttggatccttgcttgagactaaaccataattggaaataactcttttttcaccgacactactataaccatcacttgcttgtgcctcatccaaagtatatgaataagaggtattgacattgtacacttcacttttttgcacctttttcttcaaatgtgtatgccaaaagttcttcacttcattatctgttcgtcctggtaatcttgctgcaattgcagacc

SEQ ID NO: 5836 - DNA, 798 bp, Medicago truncatula
  Predicted polypeptide sequence is orthologous to G206
agtacatcatttattggtattacaatcaaactctaaccttttctcctaattaaagaaaaaataaaaaaatgtctaagacttgttgtttttcacaatatacattgaaaataaaaatcaatgtttcccttgtaatccctctttacatagagatagattacatatcattaccttggagacaatgatcacatcacatatttttcttgtcacattcaaactgaaattaccacgttgcaatgaaactcatatcttcatatcacataaagataagaatttgaatctcgttgtcaatgtgagagaatctctttactgaatagcgtacactattagtatatgagccgagacctgctctgatagaccgtacccaattccaacttgtctaaacttttagttgtcaaaaaaaattggagttactatgtttttttgaactttctattaactcaaaactcaggcaattctatttgatctccagtcctaataaatatatcataccaaaaatccatgccatcatccatgttagaattataatcttcatgactttctggaagaatttcatcagggtattgaagtggcaacatttcatttgagattgttaatgaacttgatttcatatcagttgaagtttcatccaatgctgctgcttctgaccaaaaactctcatcaattacagccattgtttcttccatagactcaatgtcttcactttttatatccttttcttcaccactgtgacagatgaaaaatcactagaactagtagtgcatgcaaatgctgattctgatttgtggtatgtgctttgaa

SEQ ID NO: 5837 - DNA, 696 bp, Medicago truncatula
  misc_feature (471)..(471): n is a, c, g, or t
  misc_feature (612)..(612): n is a, c, g, or t
  misc_feature (652)..(652): n is a, c, g, or t
  misc_feature (674)..(674): n is a, c, g, or t
  misc_feature (683)..(683): n is a, c, g, or t
  Predicted polypeptide sequence is orthologous to G2071
gtaaagaccatacttctgctttaagtctttaaaagtggggtcaaaatgaacttcgcttgggatgcaatgagtgtgaagacacctggaagtgttaacctagcaagccagtcttcaatatactccctcacttttgatgagttacaaagcaccattggaggagttggaaaagattttggatcaatgaacatggatgaactcttgaaaaacatatggaatgttgaagagactcaagccttgacatctctaactggtggaggagtaggagaaggacctaacaacccaaatggtggtactttgcaaaaacaaggctcattgacattgccaaggacacttagtcagagaaaagttgatgaagtttggagggatttgatgaaagatagtggttcatctatgcctcaaagacaaccaacattaggtgaagtgactttggaggagtttttggtgagagctggtgttgtgaaagaagatacncctaatcatgctcaacaaatcgaaagaccgaataataatgaatggtttagtgacttttctaggtcaaacaataacaccaatctacttggctttcacaaccaaatggaaataatggggatatgagccacaacaataacttanttccgaaacacgttcctcttcctccttcctaatttaactngaatcactctcaacgggcgcanccacttttnccgaaacctcaac

SEQ ID NO: 5838 - DNA, 784 bp, Medicago truncatula
  Predicted polypeptide sequence is orthologous to G2085
ggtatggatgattccaactccgatgctgtttacggcaacggcagtgaaaatcctgaattcgcacttcaaagttttgatgaatctgatcagctggacgctgtcgtttcgtggtcaagtttatgtctttgattctgttacgcccgctaaggttcaatcggtgttgttactgttgggtggatgtgaacaacctaatgttggtgtgaatgcggtgcctcaacaaagtttgagggtggaatcaatggattttcctacaaaatatagtcaactgcatcgagaagcctcattacttaggttccggcagaagaggaaagaaagatgctttgataagaaagttagatatgaagtacgtcaagaagttgcactcaggatgcagcgaaagaagggtcaatttactacatctaagaaacaagatgggtccaatagttgtggtacagaccaggattctagccaggatgccagtccatcagaaatctcttgcacacattgtggcacaagctcaaaatcgaccccaatgatgcggcgagggccatctggtccaaggtcactttgcaatgcttgtgggcttttctgggcaaacagaggtgttttgagagacctttccaagagacatcaggagttatctactggtaccagttgagcagggttgatcaaagtaacagctcagactgtggaactgcaactatccctgcacacaacatcacccctattgagcaccatctactatttgctagtactatactgggtacttggtctgttgggatgcacagcctgtctattggatgca

SEQ ID NO: 5839 - DNA, 454 bp, Medicago truncatula
  Predicted polypeptide sequence is orthologous to G21
actctgtccttatacacaatagtctttgtcctcaaccaaccacttccttgtcttcctacattattgcctcaacctcttctaattcatcctcctccttagaagaagaagaagaagaagaagaagctactaacactaaatgcaaagaaaagaaaaagaagaaagtgggaatggtgaataaagtgaatgataggaagaataatccaacgtatagaggagtaagaatgcgtcaatggggcaaatgggtatcagagattagagagccaagaaaaaaatcaagaatttggctcggaacttttccaactcctgatatggctgctagagctcatgatgtggctgctcttactatcaaaggctcttcggcttacctcaattttcccgaattagctgccgtgctgccacgtgcagctagtgcctctcctaaagacatccaagttgcggctgctaaagcagccgc

SEQ ID NO: 5840 - DNA, 784 bp, Medicago truncatula
  Predicted polypeptide sequence is orthologous to G2107
catcatcaccggattctgaggtgcggttagcatcaagcaacccgaagaagagagcggggaggaagatatttaaggaaactcgtcaccctgtctatagaggtgtgaggaagaggaacttaaataaatgggtttgtgaaatgagggagccgaacacaaagaataggatttggctaggaacttttccaacagccgagatggcagcccgagcccacgatgttgccgcgatagcattgaggggccgctatgcctgtctcaattttgcagactcggtgtggcgccttcctattccagcaacttccgcgataaaagatattcaaaaggcagctacaaaagccgccgaagcttttagaccagacaatactttaatgaccagtgacattgacaccgttgtagctgttgtcgcaacacaggagctgaatatgtttcgtgttgaagtcgaagaagaggaagtgttgaatatgccagagttgtggaggaatatggcactaatgtcccctacacatagctttgggtatcatgatcagtatgaagatattcatatacaagactttcaagatgatgaggactttaaaaaaaggtctgttacgacgatctgggctgtgacttcaattggggtgcattcgctgcatttcaccgtcatatcaaggattgtgatgcgaaccttgcttttatgtgtctgaattctgtgttttcatcctggcaagggaagctacaagagaagaatgaaatgaattttagcagatgccagtaattaatatcctctgcaatttcctcatgtatttgg

SEQ ID NO: 5841 - DNA, 798 bp, Medicago truncatula
  Predicted polypeptide sequence is orthologous to G2107
tacttcataataacaaacacttatcttcagttccaactttcactatcaaattcttttcccactctcaccaacacaatcatatgtatccaactacaaactctgtctcttcctcttcctccgacatgtcgctgccgaattcagagggctctcattggatgtcaatttgcaacgaggagatgcgattagcggcaactaccccgaagaagcgtgcagggaggaagaagttcaaggaaactcgccacccagtctatagaggagtgaggaagaggaacttagataaatgggtttgtgaaatgagggagcctaacaagaagactaagatttggctagggacttttccaactgccgagatggcagcccgtgcccacgatgttgctgcaatggcattgaggggccgctacgcttgtctcaactttgcagactcagcgtggcggctccccaaacctgcaactactcaagcaaaggatatacaaaaggctgctacagaggccgccgaggctttcagaccagacaagactttattgactaatcacaatgacaatgacaatgacaatgacaaagagaatgacatggctgtagttgccactgccactgaggagcagagtatgatttgtatggaagagaaagaagaaggagtgatgaacatgcaagagatgtggagtaatatggcgctaatgtctcctacacatagcttgggggtattatgagtatcaatatattaatgaagactttcaagatgaggaagtatcactatggagtttttaaattttttgtaggaaaatggaattttttagtttg

SEQ ID NO: 5842 - DNA, 774 bp, Medicago truncatula
  Predicted polypeptide sequence is orthologous to G2107
cttatcttcagttccaactttcactatcaaattcttttcccactctcaccaacacaatcatatgtatccaactacaaactctgtctcttcctcttcctccgacatgtcgctgccgaattcagagggctctcattggatgtcaatttgcaacgaggagatgcgattagcggcaactaccccgaagaagcgtgcagggaggaagaagttcaaggaaactcgccacccagtctatagaggagtgaggaagaggaacttagataaatgggtttgtgaaatgagggagcctaacaagaagactaagatttggctagggacttttccaactgccgagatggcagcccgtgcccacgatgttgctgcaatggcattgaggggccgctacgcttgtctcaactttgcagactcagcgtggcggctccccaaacctgcaactactcaagcaaaggatatacaaaaggctgctacagaggccgccgaggctttcagaccagacaagactttattgactaatcacaatgacaatgacaatgacaatgacaaagagaatgacatggctgtagttgccactgccactgaggagcagagtatgatttgtatggaagagaaagaagaaggagtgatgaacatgcaagagatgtggagtaatatggcgctaatgtctcctacacatagcttggggtattatgagtatcaatatattaatgaagactttcaagatgaggaagtatcactatggagtttttaaattttttgtaggaaaatggaattttttag

SEQ ID NO: 5843 - DNA, 740 bp, Medicago truncatula
  Predicted polypeptide sequence is orthologous to G2107
gaaacctaagctactttactactagtactactacatacaccccacaaatgaaatcatcacttgatgagtctagttacgtagagaacaactcttcttcatcagaaatcttgttagcatcagaacaaccaaagaaacgtgcgggtcgacgaaaattcaaggagacaagacatccagtatacagaggagtacgaagaaggaacaacaacaacaacaagtgggtttgtgaagtgcgtgttcctaacgacaagtccacgaggatttggcttggaacatatccaacacctgagatggcagcacgtgcacacgacgttgccgcactggcacttcgcggtaaatcagcttgtcttaattttgctgactctgcgtggcggttagcgttgccggcgacgaacaatgcgaaggagattaggaaaatggcggcggaggctgctttggcatttgccgtagttgcggacagtaaggaacaaactatgattagtaattgtgatgttaataagtgttggtgttatgggaagttgataataaacctttgcagggactgtgtggtggaagttccagaggaggaaatgttgcatgattggtttaggagtatggctgatgagccattacgatctcctattactccatttataagacatgggcagggatcagtggaataatgttgatattgatcaggttgatgctgaggtctccttgtggaactttaccatctaatctatgagatgcattttgctttttgt

SEQ ID NO: 5844 - DNA, 783 bp, Medicago truncatula
  Predicted polypeptide sequence is orthologous to G2107
catcatcaccgggttctgaggtgcggttagcatcaagtaacccgaagaagcgagcagggaggaagatatttaaggaaactcgccacccggtctatagaggtgtgaggaagaggaacttaaataaatgggtttgtgaaatgagggagccgaacacaaagaataggatttggctgggaacttttccaacaccggagatggctgcccgagcccacgatgttgctgcaatggcattgaggggccgctatgcctgtctcaatttctcagactcggtgtggcgccttcctattccagcaacttccgcaataaaagatattcaaaaggcagctacaaaagcggccgaagcttttagaccagacaatactttaatgactaacaatattgacactatcgtagatgtcgtcgccacaaaggagctgaatatgttttgtgtggaagttgatgaacaggaggaaatgttgaatatgccagagttgtggaggaatatggcgttgatgtcacctacacatagctttgagtatcatgagtatgacgatattcatgtacaagattttcaagatgatgaggacttaaaaaaaaaaagtttgttaccactacctggactgtgactgcaactggggtgcattcgccgcatttcaccataatgtacaggatcgtgattgttgccgtgactgcgaaccccgcttttatattttctttgttttcttcctggcaaagaaagtttgaaaagaagaaagaaataaacttggatggtcatattctgaatttactacctaagcagaagcc

SEQ ID NO: 5845 - DNA, 655 bp, Medicago truncatula
  Predicted polypeptide sequence is orthologous to G2107
gacagtcaacattaaaaaaaaatatatatatgtcttctcttttgtgacatcttttctccacctacacaatagtatccgtactagtataaaaaaatcataagtacgaacactatcctattttttttttgttaagacactatcctagtacgaacttcctgcacaaacaatttattcctcaatttggtactagtaatgtactaatgtttagatatttatcttaaattaaattaaaatgagtaactccacaatgaaacttcagtttcatcaaattccacgtcagcaacaccacaatcacttccccagtaatgtgccggtgacattagcaccatgtttctcaaatactccggcaccgtatcctcttcctcctcccgttgctccatcaccgtctccgacaccgccactgtcgacgaaggctcactatccttcctctcttcactattctcaaacacactctccggcctgaaagcctccgctgcctcagccgccgccttttgaatatcccttgcttccgacgtagccggaaccggcaacttccaagcagaatcagcaaagttaagacaagcagaccttcctctcagtgcaatcgcagcgacatcatgcgcacgcgccgccatctccggtgtaggggatgtttcaagccaaattctggttttct

SEQ ID NO: 5846 - DNA, 814 bp, Medicago truncatula
  Predicted polypeptide sequence is orthologous to G2107
attgattagtgatttaaaaattcacataaaagctatgaaaagaaattccaatttatgctaccaattaaaaaggttgtagtatagacatttcctattctacaatccaaaaataaagttaaaccaaacaaagaaaatttagaagttccatagtgatacctcatcatcttgaaagtcttgaaaatgaaaatcttcatattgatcatgatactcaaagctatgtgtaggggacattagtgccatattcctccaaaactccggcatattcaacatttcctcttcttcttccacacaaaacatattcaactcctttgtggcgacaacagctacaacagtctcaatgttggtaatcattatagtattgtctggtctaaaagcttcggcggcttttgtagctgccttttgaatatcttttattgaggaagttgctggaataggaagccgccacaccgaatctgcaaaattgagacaggcgtagcgacccctcaatgccatcgcagcaacatcgtgggctcgggctgccatctcggctgttggaaaagttcctagccaaattctagtcttcgtgttgggttccctcatttcacaaacccatttatctaagttcctcttccttacacctctatacaccgggtggcgagtttccttgaatatcttcctccctgctctcttcttcgggttactagctgctaatcgtatctccgattccggtaatgagttatagtaggaagaagatgcttctgaagaaatggagtgtgaataggaagaagtttgtagtagtaaacatatgtatgtgttggcctcgtgccgaattctg

SEQ ID NO: 5847 - DNA, 715 bp, Medicago truncatula
  Predicted polypeptide sequence is orthologous to G2141
tccccatgttggagggtactactagtggagagccttctatgaaaggactaaactcgaagaaaaggaaaagaagtggacaggatgctgataatgataaacccaatggaactcaagaacctacaaaatgaaggtgcaaaggacaaccctgagaaccaacagaagtgtgaccaacaaccaacttcgacaattaaggcttctgggaagaatgccaaacagggctctcaaaattctgatccacctaaggaggaatacatacatgttagggctcgccggggtcaagcaacaaacagccatagccttgcagagagggtgaggagggaaaaaataagtgagaggatgaagtttcttcaagaacttgtgcctggatgcagcaaggtcactggtaaggcagtgatgctggatgaaatcatcaactatgtacagtcacttcaacgacaagttgagtttttgtctatgaaacttgcaacagttaatccacggctggatttcaatattgaaagccttcttgctaaagatgttcttcaccaacggcctggtccttcgtcccactaggatttcctctagagatgtcaatgaattttcctccattacatccatctcaaccagggatgattcagtcagtgattccaaacatggcaaacccgtccgatatccttcgaagaactattcatacacagttaacaccccgttgagtggaggattcaaggagccaaat

SEQ ID NO: 5848 - DNA, 663 bp, Medicago truncatula
  Predicted polypeptide sequence is orthologous to G2144
atttgagatatccaaaccaaacaaaaccgtagcgtaacaacgttgttttcttacttacttcaaatgccagagaagaaccaacacagaacaaaaataataagcacattataaaacacagacttcactctttttccactctctttctttccctccttcattctcccccaacaacttacacagttaactccggtttttgggttttcggagttttctcaaaccggttcatttcggtttggttcagttaaacgatggaacaaaccacgttcgagtcgattcaattcaatgaagaaattcaaggaatcatggctccggcgacggaaacagcgaactctttcaccgcacttcttgaacttccaccgacgcaggtcgttgagcttcttcactcgtcggagattaccggaaaaccaccgaaaccctatccactgacttgcaacaccggtaatttaactttcccttccaacgccgcgttggttgaacgcgccgctagattctccgttttcgccggagaaaattccacaaactcgccgaacttgccgcaggtgaaggatgagctaccggagactgaagaaggtggatgtgtctctgatccaacagtttgaaaacacgaatttcagagtgcgaagaggaaggaacggagagaagaaggtgaattgtcgtctaaaa

SEQ ID NO: 5849 - DNA, 672 bp, Medicago truncatula
  misc_feature (664)..(664): n is a, c, g, or t
  Predicted polypeptide sequence is orthologous to G2144
cagaacaacaaaaacaaaaacagattgaccgccatcacactcaactacaacattgaacaaaattttcaacactctcacacttcaaattaaacaaaatttcaattggatttttaatttcattttctttgctcaatggaacaagctacagtaggattaagtggatccattcacgacgattctgttcaatttgacgaagaaattcaaggaattatgattccggcgccggcaccggaaaacgcaagctcattcacagcactgttagagcttccacctacgctggcggttgagctacttcatttgcctgagcagaaaccctatcttccgaactcttctaacgggaatttaacttttcctactaacgccgcgttgattgaacgcgccgcgaaattctcagtgttcgccggagagaattcttcaccgggagattcgcggctgtttccggtggaaagtgtgaagaacgagcctcaagagactgattcgaatccttgctcgacgcaagagtgtgtttcggatccagctgagaataagaatcagagaaacgtgaagagaaaagagcgagagaagaagggtaaagcgtcgtcgtcgaagaagagcaaaagcatcgccgatgaaacttccggtgccggtgagaagcttccctatgttcatgttcgcgttcgacganggcaagct

SEQ ID NO: 5850 - DNA, 706 bp, Medicago truncatula
  misc_feature (426)..(426): n is a, c, g, or t
  misc_feature (626)..(626): n is a, c, g, or t
  misc_feature (648)..(648): n is a, c, g, or t
  misc_feature (673)..(673): n is a, c, g, or t
  misc_feature (694)..(694): n is a, c, g, or t
  Predicted polypeptide sequence is orthologous to G2157
gtcaaagaaaacagcacactactaaaaaaaaaacacaaacattatcatctcaaacattcactcaattccaccttcttcttaccctttttcacacaacatccaaaaaacatctcaagtttttcaagaaacatgtcgaatcgatggtggagtggaagacaaacggaggcgaacccggtcgaaggagagaaccgaaacggtccaacccggatcattttacgaagagagtcacgaagggcaagtaacggtagcgttaacggcaacgttaccggcggtaacgttactccaacgaggagtaacaccagcaataccggcaccggcaacagcaacggccatgttaacgacgaacttgagaacagcaatggccgttccggcgaccagaccgccagaagtggacgccggccacgtggacgtccgccggggtcgaanaacaagccaaaaccaccgctgatgatcacaaaagaaactccaaacgctcttagcagcgttatcttggaagtcgccaacggagccgacatcgcccatagcatttcatcctatgctaaccgtcgccaccgtggtggttcagttctcagcggcactgggttatgttaccaacgtgacactccggcaagataatgctccgggangaatgatatctcttcaagggangtgtcacattctgtcactcagcggngcttttttgcctccgccttcnccgcctgatgct

SEQ ID NO: 5851 - DNA, 681 bp, Medicago truncatula
  misc_feature (562)..(562): n is a, c, g, or t
  misc_feature (599)..(599): n is a, c, g, or t
  misc_feature (675)..(675): n is a, c, g, or t
  Predicted polypeptide sequence is orthologous to G217
gcaccagagaaagcaagacgttgcaaggaataaaattgcagagaggcaagatgccccagctgctattctgcatgccaacaagctgaatgacccagaaacagttagaaagagatcaaaactgatgcttccaccgcctcagatttccgatcaagaattggatgaaattgccaagttgggttatgccagtgaccttgtgggcagcgaggaactcaccgaaggtagcagtgctacccgtgctcttctccctaattatccacagacacccaaccaagccaagactcctttaagaactcctcagagaacaccagctagtaaaggagatgctatcatgatggaagctgaaaatttggccaggctgagggagtctcagacaccacttttaggaggagaaaacccggagttgcatccttcagatttctctggggtcactcctaagaaaaaggaaattcacactccaaacccgctgctgactccctctgcaaccccgggaagtgcaggccttactcccagaagtggtatgacaccggcaagggatggtttttcttttggcatgactccgaanggaactcctctcagggatgagctacatatcaatgaanatatggagatgcgtgatagtgctaagctcgagctacggagacaagctgatatgaaaaaaagtctgcgctctggttnagcagc

SEQ ID NO: 5852 - DNA, 664 bp, Medicago truncatula
  misc_feature (655)..(655): n is a, c, g, or t
  Predicted polypeptide sequence is orthologous to G2226
ggcacgaggacctcttcacaaattgttcttgttgacccacatcacaaatcctcaaatcctttatctgtaaactattaacaagatcaaaatagtttccattgataaattctgcttcaaaatacacattgcatcataaagtgtatcacaaatttgttcatcaaaatgggcctatcaagtcttccagcacaatctgaaggagtgttatgcatcattctagtaaacactgccatgtcaatatccatattcaaaggcattataaggactatcctgcacattgttggtatcattgcttcaccatcttcctctccttcccaagactacattcctcaaaacatacctgagtcatatgaaatccatctaagtccttcagatgatttcgttgaagagttcagaagcagaacaccaacacttaggtttgatagtgtgtgtaatagctgcaaagaacctgaacatgattgctcagtgtgtctcactcaatttgaacctgaatcagagataaactattgcatatcatgtggccatgtttttcataaagtgtgtttggagaagtggttggattattggaacattacatgtccactttgtaggagtcctttaattcctgaagatgatgcatcttgcttatggtaagagcaatgattgaagcatgcacaanatatctaat

SEQ ID NO: 5853 - DNA, 820 bp, Medicago truncatula
  Predicted polypeptide sequence is orthologous to G2239
ctccggcgtccccttcgccggattacaaaccaacgacaacacaaatgataactcatattacaaccgtgtaagcccttccatggctataataatcgtaatcctcgtagctgctctttttctcatgggtttcttctcaatctacatccgtcgatgcggcgactcaccttccaacagcatccgaaacatggcaggaggtttagccggacgttcaagacgggcggcgcgtggtctcgacgcttcggtgattgcgactttcccgatctttgaatactcgactgtgaagattcataaaatcggaaaaggcgcgttggaatgtgctgtttgtttgaacgagtttgaagagagtgaaacgctgcgtttgattccaaagtgtgatcatgtttttcatcctgagtgtattgatgaatggcttggttcacataccacttgtccggtttgcagagctaatttggttcctcaaccgggtgaatcggttcacggtatcccatcgattaataccgaaccacaagatattgaagctcaaaacgacgctgttgaatcggttcatgaacatcaaaacgcagacggttctgtaaaagtcgacccaaccgaaccagaagtgctgactgtaagccagacgctgaaccggaaccgtacgagaggttcacagtctggtcggccacgttggtttcaacggtctcattcaaccggtcattcattggttcaaccgggtgagaatactgaacggttcactttgaggctaccagttgaagtgaggaaacaaatactacagaacccggaattgcatagggctagaagcttagttgtgttgccaagagaa

SEQ ID NO: 5854 - DNA, 855 bp, Medicago truncatula
  Predicted polypeptide sequence is orthologous to G2239
tattcatcctctttggaatccttcttctctcaatcacaaaaacccaatcccaagctactaacgataaccccacaaatccaaatttcaaccaagaatttaacccttccttcgctataatcatagtcattttagtagctgctctttttctcatgggctttttctccatctacatccgtcgctgctccgattcaccttcctccaacaacctccttctccccatcaccaacggccgtagagcggtggcgcgtggactcgatccatcagtaatcgaaactttcccgattcttgaatactccgaagtcaagatccataagatcggaaaagatgttcttgagtgtgccgtttgtttaatggaattcgaagatactgaaacgctgcgtttgattccaaagtgtgatcatgtttttcaccctgagtgtattgacgagtggttatcttctcacacaacgtgtcccgtttgtcgcgcgaatctcgttccacaacctggtgactcagttcacggcgttcctgagtcacagcaacaagacgttgaagctcaaaacgacgcggttcaattaccgacggaatctgactcagtattacttgctccagaagtgatttcgttgaataaaacactgaaccggaaccgtacgcgtggatctcaatcaaaccggccgcgtcgttttccacggtctcactcgaccggacattctttaatccaaccgggtgaaaacacggaccggttcactttgaaactgcctaataaggttaggaaacagataatgagccggcaattgcaacgagcgagaagtttgattacgttaccaagagaaagtagctcaagacatggctaccgaaccggaggtgaaggaagta

SEQ ID NO: 5855 - DNA, 688 bp, Medicago truncatula
  Predicted polypeptide sequence is orthologous to G227, G242
ttttacgcctgaagaggatgatactataatcagagcccatgctcgatttggaaacaaatgggctacaatagccaggcttttatcgggccgaactgataacgctattaagaatcattggaactctactttgaaaaacgtaagtgttcttctattatgattgatgattctgaatctccaccgttgaaaagatctgttagtgctggtgctgctattcccgtttctactggtctttatattaacgccaattctcctggttctccttctggatccgatgtaagcgagtccagcgtacctattgtgaacactcatgtaaactctcatgtttaccgacccgtgccaacgagaaccgtcgcgcctctaccactcgtagaaacgacgtcgccttcgaattcgaatgatcctccaacttcgttatcactttcacttcccggtgttggtgttgattcttcttctgaagattcaaaccgtgtaactgagcctgtcaacactgcaccaccacctcctccgccaccaccgccaagcgcgatccctttgatgccggtaatgaccacggctgtacctgttccgatggcggttccgatgcaacaatcgggatcggtgatgccgtttagtttagtgcggagttgttgagtgtgatgcaggagatgattagaacagaggtgagagttacatggcgggattggagcac

SEQ ID NO: 5856 - DNA, 805 bp, Medicago truncatula
  Predicted polypeptide sequence is orthologous to G227, G242
aatggatcggatcaagtcctggagccccgaagaagacgaatccttaacaaaactcgttgatcgttacggtcctcgtaactggtcactcatcagccgtgctattcctggtcggagtggtaaatcttgcaggctgagatggtgtaatcagctttctccacaagttgagcatcgtgctttttctcctgaagaagataacatcattatcagagcccatgctcagttcggtaacaaatgggctactattgcccgtttgttatcgggccgaaccgataacgctatcaaaaaccactggaactctacgctgaaacggaagtgctcgtctttcatcggttccgatgatcgcgatttcaatcctcagccgcttaaacgctctgcttccgtcggtgctccggggagtccttctggttctgatttaagtgattctggtgttcaacaaactgtttttcgtcctgttccgattcgtttgcctgtggaaactacatcggagccggagccagtaacggtaccggaggcggttgaggaggatgacggtcctttaacttcgctgtcgctttctctaccaggtgtggatgctgctgcggcggtgctggttagtcctgctccgataaccgctgtaactgccgtaacggtttcagaagaagctggaattggagcgttaaatttgagtggtgaatttatggcggttatgcaagagatgataaagaatgaagtgaggagttatatggaagagagaaatggaatgtgttttcaaggagttgataggcttagaaatgtttctgctaagccaattgggattacagggttg

SEQ ID NO: 5857 - DNA, 690 bp, Medicago truncatula
  misc_feature (659)..(659): n is a, c, g, or t
  misc_feature (674)..(674): n is a, c, g, or t
  Predicted polypeptide sequence is orthologous to G227, G242
atcatatcaaacattcactattactatatactcaaataataacgctatggatttgaatatgaattttgaagctattaatagaagctcttcaacaacaacatcatcatcagactcatgttcctcagaaacaaaccaaaacaaactagacagaatcaaaggtccatggagtgcagaagaagacagaattttaacacgactggttgaacaacatggagcaagaaactggtcactcatcagccgctacataaaaggtcgttccggcaagtcatgtcgtctccggtggtgtaatcagctgagtcccaccgtggaacaccgtccattttcttcacaagaagatgaaacaatcatagcggcgcatgctcaatatggtaaccgttgggctaccattgcaaggcttttacctggtagaactgataatgctgtcaagaatcattggaactctacgcttaagcgtagagcgggttgtggtggttctgttacggttgctggaggtggcaacgaaggtggtcagtttacttttccgttggaagatgatccgttgaccgcgttgactcttgctcctccggggaatggtgtggaagatagggaggaaatggttggtgatcatcggtttccttcgccggaaaatgttccgactgagttttgggatgtgatgagangtgttattgcaaganaagttagggaatatgt

SEQ ID NO: 5858 - DNA, 669 bp, Medicago truncatula
  Predicted polypeptide sequence is orthologous to G2344, G929
attatggccggggggattggtggcagcagctccaactacaacacaaaacacaaacacaaacacacagacagaacacaacacagtaacacttctcttctcttctccactgccccaacacacaacaacacttcaaccttcttctatcattttcaattcacaacactaagatttggacagagtgcatgtgaatcaggaaaccatgacttcttccacacatgatcccacagataatgaggctgatggacagcagcagtcagaatcacagatgcagccaatatctgcaaacggaatttctcacgccagtattgataatgctcagattgttcagtatgcagcacctccacagcttggtacggggcatgccatggcaccaccacctgcttatccatatccggatccctactacagaagcatctttgctccctatgatgcacaaccttatccgccgcaaccctacggtggacatccaatggttcgttctaatatcttggtgttgattctttgtaatacggtggtttcttgtcaaagttattttcttatctctatatggttgaaccatattctgtgccaggccaatcttcagttaatgggaattcagcatgcaggagttcctttgccaactgatgcagttgaggagcctgtgtttgtcaatgcaaaacagtatcatgg

SEQ ID NO: 5859 - DNA, 623 bp, Medicago truncatula
  misc_feature (607)..(607): n is a, c, g, or t
  Predicted polypeptide sequence is orthologous to G2457
cttttttatatcacattgccttaccctatttattttctccttctctctttctaatataactcatcctttgggttccaaacaaaccccttcatcaagctctttctaccgtaattctctatatatattactatccacccttccctcagcttttatttactgttctcatatccaacctagcttataaatatacacaaaccaagtagaggtttggaaataaagagagagagagagacctttctcttcaactttggtatcccttgcaagatatttaattatcttatctatctatcttcatctccttcttcttcgtctctcttacatctttgtttttgtaaaagaatcttccttgtagagacatgtctagctgcagcatcgatgttgcacctgcagctgcagagcaactttgctacatcccttgcaacttttgcaatattgttcttgcggtgagtgttccatgcagtagcttgtttgacatagtgaccgttcgatgtggtcactgcacaaatctatggtcagtaaacatggccgccgcgtttcagtcactgtcatggcaagatgttcaggcacctagccactgcatgaatccagagtataggattcgaactanctccactcccaaatgc

SEQ ID NO: 5860 - DNA, 644 bp, Medicago truncatula
  misc_feature (605)..(605): n is a, c, g, or t
  misc_feature (642)..(642): n is a, c, g, or t
  Predicted polypeptide sequence is orthologous to G2510
cataaacccccacacacaacctcaatattcaacaccattaaaccacaacactcacaaaaatctcatcactcaattttcctttttctcatttctcatgtccatcacaaaggaatctgaatctcaatctcaagcagaagctcgacccggctcgataacaaaacgaagctcgagaaaaggtgactccgtatttcacggagtcaggaaacgtagctggggacgctacgtttctgagataaggctgccaggtcagaagactcgaatatggcttggatcattcgagtcagctgaaatggcagcccgtgcttatgactcagcagcttttttcttgaaaggaaattcagctagccttaattttcctgaagaagttgagtttctaccacgtcctctttcttcttctaggagagatattcaatctgctgcttctaaagcagctcatcaacgaagccaccaccatcaacaacaagaagaacaattacgtggagttacaccttcttcttcttcttcaacaagaatgaatgaaaataatattatcaataatagtgatgataatattattagtggaaataataatgttaatgatttttccattgagatgatggaatggnggaaagaaaaaaagtgtgtttcgaccacctcgttttngg

SEQ ID NO: 5861 - DNA, 664 bp, Medicago truncatula
  misc_feature (2)..(2): n is a, c, g, or t
  misc_feature (600)..(600): n is a, c, g, or t
  misc_feature (612)..(615): n is a, c, g, or t
  misc_feature (628)..(629): n is a, c, g, or t
  misc_feature (631)..(631): n is a, c, g, or t
  misc_feature (635)..(641): n is a, c, g, or t
  misc_feature (651)..(653): n is a, c, g, or t
  misc_feature (662)..(662): n is a, c, g, or t
  Predicted polypeptide sequence is orthologous to G2510
gncccattcattgaagatgatgtaaccgctgctgacagacagagaggtggaacacgccaccctgtctaccgcggtgtccgtaaacggcggtggggaaaatgggtatcacaaattcgtgaacccaagaagaaatctcgcatatggctaggatcattcccggtgccggagatggctgctaaagcatatgacgttgcagtgtattgcctgaaaggccaaaaagcgcaactcaactttcccgacgaggtggagaatctaccacttccggctacatgtacggccagagacattcatgctgcggcagctaaggcggcggcgagtatgatgaaggcttcgttggatgagaaaggttgcattgtgtctgatgaagatgatttttggggtgagattgaattgccggagctgatggagagtgattcgtcatggagttgctccggtgatatcatgacgtggccagaagttgaggttttggcgcagcaacatttcatgtcgtcgtgtctataaataaacgttggtctgtttcttgcatatctatcaatgtagtattatcttttatattgctatatatcatgatcatcaatgagttatatttatcatttgaanattaaaaactcnnnntctttctcccccnngnaagnnnnnnnaaaaaaaagnnnggggggggngg

SEQ ID NO: 5862 - DNA, 730 bp, Medicago truncatula
  Predicted polypeptide sequence is orthologous to G255, G664
gaacaaaacaaacacaaatttctcaatatcctattatcattcaaaatttcaaaagtgaaacaaacatacatagaaaatagaacaacaaaagttacttaactcaaatatgggaagatcaccttgttgtgaaaaagctcatacaaacaaaggagcttggacaaaagaagaagatgatagacttatatcatatattagggcacatggtgaaggttgttggagatctctccctaaagcagctggcttactccgatgtggtaaaagttgtcgtctccggtggattaactatctcaggccagaccttaaacgtggtaactttacagaagaagaagatgaactcatcatcaaactccatagtcttcttggtaacaaatggtctttgatagctggaagattaccaggaagaacagataatgagataaagaattattggaacactcatataagaagaaagcttttgaatagaggaattgaccctgctactcataggcctttaaacgaagtttctcattctcaatcacaatctcaaactcttcatcttcaaaatcaagaagctgttactatagctgtagcagcatctacatcaactcctacagctacaaaaaccctaccaacaactatatcttttgcatcatccattaaacaagaacaatatcatcatcatcatcatcatcaagaaatgaacacaaacatggttaaagggttggtgttagaacgttgtcctgatttgaat

SEQ ID NO: 5863 - DNA, 523 bp, Medicago truncatula
  Predicted polypeptide sequence is orthologous to G255, G664
gcacgagggtaaagtctaaaaatactcaagaacgatagtgtagcttacttgttaccgaggagagtgtggagttttatgatgagttgatcttcttgttgggtgaaatttccacgtttgaggtcggggcgtaggtagttgatccaccggagacggcaactcttaccgcaacggagaagaccagcggcttttgggagagagcgccagcatccctcaccgtgagcagccgctcatcttcttctttgctccatgctcctttgtttatgtgacctttctcacagcaaggggaccttcccatatcgatcaattctatctatatttgatgatcactcacttctttgcttcattgattcagagtgaatgaatataaaaaacatcgattgatgtatgtattgtatttatatatggtattggtgttggttggttcgtaattaataacgactctatagatgctaatattctagtgcagcagcataataatactatatagcaatatttattctaaaaaaaaaaaaaaaaaactcga

SEQ ID NO: 5864 - DNA, 803 bp, Medicago truncatula
  misc_feature (764)..(767): n is a, c, g, or t
  misc_feature (769)..(773): n is a, c, g, or t
  misc_feature (788)..(790): n is a, c, g, or t
  Predicted polypeptide sequence is orthologous to G2550
ccgggcctgcaggattcggcacgagccgaaagcacgtggaatggaaaagcaagaaacaatccgcaacattggattggataatcccaaagatagtgatggaaaatctattagtcagtctatgcaaataacttcagggggacctaatgatcctaattccaatccttcttgtgaaatatcctcagccgaaagacagaatttgttggataagaagacaaagcttttgtccatgttggatgaggtagacaagagatacagacagtactgccatcggatgcaaattgtggtgtcatctttggacatggttgctgggggtggagcagcagagccatatactacacttgcattgcgaacaatttcgcgtcagtttcgctgcttgcgcgatgctatcagcaaccaagttcaagtgattcaaaggaaccttggggaacaagaaggaatacctcgtctccggtacgtggaccaacagcttaggcaacaaaaggcacttcagcatcttggtgttatgcgacaagcttggagacctcagagaggacttcccgaaaactctgtttcaatacttcgtgcttggctctttgaacattttcttaatccgtaagtgttactttataataccccctagaccttcactcagttttgtattttcaattagttgcaatggcttcatatgtatgctactttcataatattttctatttatgtgtattttaataaaattcattttgaactttgatttcataaattggttgataccagttaccccaagnnnncnnnnnaaataatgctagctnnncaaactggtttga

SEQ ID NO: 5865 - DNA, 803 bp, Medicago truncatula
  Predicted polypeptide sequence is orthologous to G2574
tttcaataaaacaagatacagaataatacactaaaattcaattctctaattacatacataaatccaatcaaaaaaagaaagtatagaatttcctaagtaactacattaaaataaataatcaccaattaattggtgttgtcactattatcaccaccaggagatgtagaagcacttttagttgcagaaaatggcaaagaaggagacaacaacatcaaacttccattctgtgtattgttcaccggtgccgttttgttcaagaaacttgaagcacaaccatttactttagaacttgatgaaggcaatgaagtagaagaaacttgaaacatctcagcccatttcattttctgactcaaattttctcctgcactttgattttgattcccttgattggtggtgtttccgataagcgaagaaagtgctgcagctaaagctgattgaaaagttggatctgctgtgatagcttttgttgctgcagatatagtactatcttgtaaacctacatgttgtgaaatgtttgaactattgttgtttttttgcatgtaggtttggtatatactttccattgtgttttgtctaccaaagtttaaagtgcttaggttattattgttcctattattactatatggttgattttgagtagtagcatagttgaggaagctattccaatgcatgggatttgattcaggagaactaaagctaagagtggaagaagggtatcttgggtagttggttattggttgttgtagcttggattgaatctaaccaagggtgatgatgttgaagaatttgatgggtttgaagtg

SEQ ID NO: 5866 - DNA, 817 bp, Medicago truncatula
  Predicted polypeptide sequence is orthologous to G259
atatgatttccaatatttgattatgactttaattttcagaagctgtataaacttatgttttcaggcttctattgtaacatatttatttatatttctatttgcatgattgagacaacaaaatgcttgcgttttcactaatctcagctctagtccttttaatccttctttctccttgttgaacatccaatctcaccccaaacagcattggccttttatcattatctttagcttcctcttcttccatttttttggtatgaattgagaccaaatcaagtagttccttacacttccttttcatgcttgttagctcagaattcaacaccacattttccttcttgagtcgcttgttttcatccactagattagtgtaacctgaagttgatgaggttgatgacgatctttgatcttcatcagaatcttggttttgtaccgtttgttgttgcttgttgctccaggccttccttctccgaatctcggatagtaactctctttcacctttcttaaatctttcattgcaaaactcccatctacttgttgcaactttacgaaatccataagtattgagctgccgtacaaagctagagaagttgctatgcttgaagagtgttggaaggatatcacgagcaaactccgccggctgccacaccacaaacgccgttccttcatcgttccacgatatcacaccatcgggttatcggatcctcaaccaacatgtatgtcttcaacaagaaggggtgatggagtgcactttcttccacattccaataatcccttctcactaataaccactccttccatttttttctatttctatttc

SEQ ID NO: 5867 - DNA, 672 bp, Medicago truncatula
  Predicted polypeptide sequence is orthologous to G2604
atttcaaggaggaagcttttcctttgactctcactttatctggtttttgatttgatattctaccaatcttttgcttcaaaggagttgaaaaaatggatggaagtgctttgttctgtttgtagaatttggcacagaaaaataatacttttgacttagttcttttataatgccagttccacttgctccttatccaactccacctccagctcctgctccagctccagctccatatacaacacctccaacaaatggtgcacagagtcaacttgtgtgttctggctgtagaaaccttcttatgtatccagttggagcaacttctgtatgctgtgctgtttgcaatgctgtcacagcagtgccacctcctggcacagaaatggctcagttagtttgtggaggatgccatactttactcatgtacatccgcggagcaacaagtgttcaatgctcttgttgtcacacagtcaatctagctctggaagcaaatcaggtggcacatgtaaactgtggtaactgcaggatgctacttatgtatcaatatggagcaagatccgtgaaatgtgcagtttgcaattttgttacctcagttggggcctcagcaagcacgacagagccgcagaagttcagcacctaataaatcatatactattatagcaaggtcattacagactctac

SEQ ID NO: 5868 - DNA, 396 bp, Medicago truncatula
  Predicted polypeptide sequence is orthologous to G2604
taactgcaggatgctacttatgtatcaatatggagcaagatccgtgaaatgtgcagtttgcaattttgttacctcagttggggcctcagcaagcacgacagagccgcagaagttcagcacctaataaatcatatactattatagcaaggtcattacagactctacaaccttggtttttgctatttacatatcaatcttaaggaataataaagagtgcaaatcagattgaaaactttcttcacatgtatagagttatttttcccttgcgtgacggtgattgtattaagcgtttttgtttgaattggtgtatgaataagtcgataactatttgttataagattcttgattctgagtgctatgcaaaaaccacatcttttgataaaaaaaaaaaaaaaa

SEQ ID NO: 5869 - DNA, 829 bp, Medicago truncatula
  Predicted polypeptide sequence is orthologous to G261
gctactattatcttttctttctgattgcacttcctgtgcttccgatgcaccaggatcctcagtcaagaactgctcccagaatacatcattaaccccagttgctgcagtggtgattctcgcaggttgttcttttagtgcaacagcctcaagagcagcagaagctggttcaacgttcatgtcaatttcaggtgacttaggtcgaacttcaccgtctagttgctgagaagatatggacaaactatcagcacagcatgtagattcatctaaatccatgtttgaatgagtgtgaacgaaattgccgccaacttcatgtgcaagagtctcccaaaatgccacggatgcctcaagttgatccaatctctcggtgtttaacgtcaaagtagagttatcctctgcattttccctgggcaaagctacagaagtctccatagcatcttcaacactagcttcattattaaagcaaccacttctcgccggcaaccttcgttttctctccatggcttctgccagtggcaagagatttacagcaatcataggtttctgcagtgcttcagaaacagaggacaacatcttttgttgcttatgttccaatttttccaactgatctttcgaacaatgcatttgaatctcatacgtttcccaatcatgctggtatctgttcgtctccatgaggagttgttctctatcctgtttcagcttctctatttcatcaaccatactctgcctttcagactccgttagaggggcttgtgcttgaagattatgcagagaatgactatgaaccggcttccgtctatgaatattcttcataagatgtggttgccccctt

SEQ ID NO: 5870 - DNA, 659 bp, Medicago truncatula
  Predicted polypeptide sequence is orthologous to G2632
gtttttttttttccttcttgataggaaattacggacaagaacaaggaatgcagaatactgcatcatctgcagttattcgcgaagaatgcctcacacagactcctcagctggaacttgttggtcattcaattgtaagtctttgcctaagctttattgtttttttttcccccaattgctttcaagttgttaaaataaacatttttttgcaaacatcaaatcagtaattttattctggaacacaaatctttgctgattcgtgcatataatttcaatggaaaatatgttattatagagcttgtagttgcatgcatttggactggatgggactcctagtattcttccaattcttttgatgcaggcatgtgctacaaatccttatcaggatccatattatggtggcatgatggcagcttatcctcaccagccgttggtatgtgacattaatctgttaccttacctgcttaaagggatatcctccttttataggagtgcctcatgccagaatgcctttgccccttgagatggctcaagaacctgtttatgtgaatgccaaacaataccaaggaattctgaggcgaagacaagctcgtgctaaagcagagcttgaaaggaagctcataaaatctagaaagccatatcttcatgaatctagaacatca

SEQ ID NO: 5871 - DNA, 799 bp, Medicago truncatula
  Predicted polypeptide sequence is orthologous to G2632
tcataaaatctagaaagccatatcttcatgaatctagacatcagcatgctttgagaagggcaagaggcaccggaggacgatttgcaaagaaaactgatggtgaggcctcgggaaaggataatggctctggtccagtcttgtcgtcgcaatcaattagttcatctggttcagaacttttgccttcagactctgcggaaacctggaattctcccaacatgcgacaagatgcaagaggatcaaatgaaaatggtggtagctcctaccataataacaacaatggtatgcaatcttcaaggtatcagggtgaaagagtggaagaaggggactgttcagggcagctacgtgtaagcatctcctcgaacgaggcatcgcagaggcgtcttgctattcagtagaccccccttcctgcatgggagggatagatgctgaggttggttttgtatatcctagtgatatatttggtgaatgagtaccttaccttggttatcttcttggcaatatatatgccggcaaatcattcttggcttttgttcttgtgtttatggtgtgaatgatataatatgggggggagaagaatggtgattggggtatatgatttctgttgaagtctcaagcaatcaatcaatccttcaatcttatctcatttttgcattttgtacagagttttagtggtagtcaacttcagctgatatggatggtcaggtcaaaagactgaagaaaacaaactcttttatgtagtaccaaaactctcttgtttcatggggtttggtctgtaaacttacctgggtgggttgttaat

SEQ ID NO: 5872 - DNA, 485 bp, Medicago truncatula
  Predicted polypeptide sequence is orthologous to G264
taggataggtttaagttttttaggaccttcaacgctttattttaatattatcgcaaagagagggcccgtagccaaaattgatgatgtttttccaactgatgggcttactgtaagtcccggtagtccttttcaaaatgttggagaatttgaaatttattacacaaatgaatataatgcagaatatagtaatgaatctggaatgaaattacttggtaaacttaagtttgattggccaggcttggggtttaatagatctgttacctttaagttatcattttgcgaaatggaaattaccgcaactgcaacaaatgatttaaccggtcaaaattatctcacgtactttgagataaatacagaaaactaatatctattatacacaatatttttagttttataaattgtttctttaatttctttactatgacaagatttatatattaaaataaaagttctgtttttaaaaatccaaaaaaaaaaaaaaaaaa

SEQ ID NO: 5873 - DNA, 789 bp, Medicago truncatula
  misc_feature (75)..(75): n is a, c, g, or t
  misc_feature (166)..(166): n is a, c, g, or t
  misc_feature (178)..(178): n is a, c, g, or t
  misc_feature (203)..(203): n is a, c, g, or t
  misc_feature (260)..(260): n is a, c, g, or t
  misc_feature (283)..(283): n is a, c, g, or t
  misc_feature (295)..(295): n is a, c, g, or t
  misc_feature (304)..(304): n is a, c, g, or t
  misc_feature (317)..(317): n is a, c, g, or t
  misc_feature (329)..(329): n is a, c, g, or t
  misc_feature (355)..(355): n is a, c, g, or t
  misc_feature (367)..(367): n is a, c, g, or t
  misc_feature (424)..(424): n is a, c, g, or t
  misc_feature (439)..(439): n is a, c, g, or t
  misc_feature (448)..(448): n is a, c, g, or t
  misc_feature (475)..(475): n is a, c, g, or t
  misc_feature (482)..(482): n is a, c, g, or t
  misc_feature (495)..(495): n is a, c, g, or t
  misc_feature (520)..(521): n is a, c, g, or t
  misc_feature (531)..(531): n is a, c, g, or t
  misc_feature (535)..(535): n is a, c, g, or t
  misc_feature (537)..(537): n is a, c, g, or t
  misc_feature (571)..(571): n is a, c, g, or t
  misc_feature (578)..(578): n is a, c, g, or t
  misc_feature (586)..(586): n is a, c, g, or t
  misc_feature (607)..(607): n is a, c, g, or t
  misc_feature (613)..(613): n is a, c, g, or t
  misc_feature (618)..(618): n is a, c, g, or t
  misc_feature (620)..(620): n is a, c, g, or t
  misc_feature (627)..(627): n is a, c, g, or t
  misc_feature (634)..(634): n is a, c, g, or t
  misc_feature (637)..(637): n is a, c, g, or t
  misc_feature (642)..(642): n is a, c, g, or t
  misc_feature (655)..(655): n is a, c, g, or t
  misc_feature (671)..(671): n is a, c, g, or t
  misc_feature (674)..(675): n is a, c, g, or t
  misc_feature (688)..(688): n is a, c, g, or t
  misc_feature (703)..(703): n is a, c, g, or t
  misc_feature (710)..(710): n is a, c, g, or t
  misc_feature (717)..(717): n is a, c, g, or t
  misc_feature (721)..(721): n is a, c, g, or t
  misc_feature (723)..(723): n is a, c, g, or t
  misc_feature (737)..(737): n is a, c, g, or t
  misc_feature (740)..(740): n is a, c, g, or t
  misc_feature (752)..(752): n is a, c, g, or t
  misc_feature (756)..(756): n is a, c, g, or t
  misc_feature (765)..(766): n is a, c, g, or t
  misc_feature (777)..(777): n is a, c, g, or t
  misc_feature (781)..(782): n is a, c, g, or t
  misc_feature (785)..(785): n is a, c, g, or t
  misc_feature (787)..(787): n is a, c, g, or t
  misc_feature (789)..(789): n is a, c, g, or t
  Predicted polypeptide sequence is orthologous to G264
tgattacgccaagctcgaaattaaccctcactaaagggaacaaaagctggagctccaccgcggtggcggccgctntagaactagtggatcccccgggctgcaggaattcggcacgaggccccccctttttttttttttttttttttttttttttcactttcaagtntacaataccggngaaaaccattaaaagcttgaacgtntacaacactaccaaacaactaattcccaatgcatgtttcagtctaaaaagtcaaacntatttttacatgacagtagtaanacaaacatattnttgaacgtntacaatattcagngaatctcacatnccaatagtaagtgtcccaaaacagcntgctcaaagggngaaattatccatgttcttgatgttactggaaattccatgaactgaccgccctttttnttgctcactatttgnaattgctcnatagttggatattgcctcttcattgtntgaacancctggtctttcantaaggaaattttcccaaaacacatnnttcactccgngccnancagctgctttgacttggacgttacctgaagcctnctttggnggagctanattgatacccttattacccanattttnggttngnggaaacnccaattncanattcngggggggcccggnccccaattcgcccctnttnngagccggtattanaattaactggccgtngttttanaacgtcntggncngggaaaacccctgncgnttcccaacttantccnccttgaaannatccccctttncccnngcngngn

SEQ ID NO: 5874 - DNA, 811 bp, Medicago truncatula
  Predicted polypeptide sequence is orthologous to G264
aagttcaacatacctgtgaaaaccattcaaaacttgaatatataggagtatgtattcaaaactgcatagtcactttcaagtctacaataccggtgaaaaccattaaaagcttgaacgtctacaacactaccagacaactaattcgcaatgcatgtttcagtctaaaaagtcaaacatatttttacatgacagtagtaagacaaacatattcttgaacgtctacaatattcagtgaatctcacataccaatagtaagtgtcccaagacagcatgctcaaagggtgagattatccatgttcttgatgttactggagattccatgaactgaccgcccttcttcttgctcactatttggaattgctcgatagttggatattgcctcttcattgtctgaacagcctggtctttcagtaaggaaattttcccaaaacacatcattcactccgtgccgagcagctgctttgacttggacgttacctgaagcctcctttggtggagctagattgatagcctcattagccacatttcggtttgaggaaactccaatttcagattctttaccatcagcgttaactcttgactctgccaaattgccaatttcctgacagtttatttggggcgacctggccgagtatgaattcctattgaattccaatgtacaagatgccagagttaaatttagttggcaggatatatgactatcgcctttctcagtactcggctccagagagtgaagattgggcactcagtagttgtttgctcttgtgataacacgaatccatgttaaagtgaaagatgcccagtatctgca

SEQ ID NO: 5875 - DNA, 718 bp, Medicago truncatula
  Predicted polypeptide sequence is orthologous to G2655
tgattcgccagctcgaaattaaccctcctaaagggaacaaaagctggagctccaccgcggtggcggccgctctagaactagtggatcccccgggctgcaggaattcggcacgaggaacaacaacaacaacaacgtcacaatggaacaacacaattaccaagaacagaaacaatgggctgttgcagacattgaagttacaatggtagatagtcatgccaacatgaaaattctatccaagaaaaaaccaggacaacttatgaagattgttgttgggttacaaaatcttaggcttaccattcttcatcttaatgttaccacggtcgatgatatggttctttactcagttagtatcaaggtagaggaggggagtcagctgaatagtgtggatgaaattgcggctgctgtgaatcgactattaaggacggtccaacaagaactggcttatcaactaaattgaatgaatttaatttccttgcttaatttattttaaaatttgtctatcaaaccttctccatcgtttggatatataaatgtgactgtgtttattgggaatattagagggggtaaggtagcatgtgtagcactttaattatttgtcataattttttcttctgatagcagcagcatttgtggcaaacaacttcaatgcctagttgaaatgtgttaattaggctgttatgtacaaccaacagttatcttacaagtctatgtgaattac

SEQ ID NO: 5876 - DNA, 687 bp, Medicago truncatula
  Predicted polypeptide sequence is orthologous to G2655
gttaaaaagggtcacctttgttttctctttcgggtatctaatacttttgtttgggacttttatgttcataatttctttctaaaagtttttctccttcaactttttaccctctcttcaataattttagattagtcacaaattaataataataatggctcttgaaactgtggttttcccacaacaagatccattcacatatagttacaaagacaattacttcaactctttgaataatgactatgatcatcttcatgcggaagaacaagagaatgttctcctaggaatcatcaacaatgaacaacaaaatctccatgcaaactgggatcatcaatgggaatattcacactcttcctctcctgaaatctgcaccgttgatcaaactatcacagcacctccttcttccaccatggaggaagctacagtaacagcatcgtgtaggagaaagcgtccgtcgtatcaagagtgcaaagaacaaagaggagattgaaaatcaaaggatgactcatattactgttgaacgcaatcgaagaaaacaaatgaatgagtacttgaatgtgcttcgatctttgatgccttcttcttatgttcaaaggggtgaccaagcttctattattggaggagcaataaactttgtgaaggagttagagcaacatttacagtctatggggggccaaaagaaaacgaaag

SEQ ID NO: 5877 - DNA, 742 bp, Medicago truncatula
  Predicted polypeptide sequence is orthologous to G2655
aaaccaaaaaattccttcaatgagcccataatttatagagtaatagaagataaataaacattacaatagctaggcacatatcttgagagagagagagatagatttaatttataaggttaaaaaactaatgaatcttaattcaacattgcctcttgttgaatcctagtgaccgtctggtatacagctgaagctatatcatccaccgatcccaacttgcaatcatcttcaaccttaacactgagagagtaaagaacaatttcaccaatagtagtaacatttaaatgcaagattgtgagacgcatgttttgcaaaccagatacaattttcaagagctgctttggcctctttcttgatcttattttaagatttgcatggttttccaccattgtcacttctatgtcagcaatgcaagattgaatctcaccaactttttcaccaatagtagctacagaattagaattatcacacacactaccacttgttgaatactgtggaaatgtaaagaactcagaaaatggcatgttgtttgatccaccagcttcatcagatttcaccactctttctttcttagcaccaagaaaatgaaacttgtgctcaagctctttaacaaagttaatagctcctccaattatagaagcttgatcacccctttggatgtgagaatctggcattagagagcgaagaatagaaagatactcattcatctgctttcttctattacgctcaacagccatgtgagtca

SEQ ID NO: 5878 - DNA, 678 bp, Medicago truncatula
  misc_feature (532)..(532): n is a, c, g, or t
  misc_feature (622)..(622): n is a, c, g, or t
  misc_feature (673)..(673): n is a, c, g, or t
  Predicted polypeptide sequence is orthologous to G268
cttcttctctcctccttctccagaagatcaccaacaacaacaaccaccaccaccaccacctccacctcctcttcaaccaactccaaaacccttccgtataccacccttacccccacaagagagaattggtctaatagacgaaaatggtgtcatgacagacaatttcacagtcagcaacaacgatgacgatgaaacattgttaaattggagcttgaacattaccaacaacaatagtgatacgaattttgtggtggaggaggtgaagaaagtgaagaagtataagatttgtaaggatgtgagaatggtggattatataccttgtttggataattttgaagagattgccaagtttaatggaagtgaaagaggggagaaatatgaacgtcattgtccggaacaagagaagggtttgaattgtgttgttcctcggcctaagggttacaggaagccgattctttggcccaagagtagagatgagatttggttcagtaatgtaccccatacacgtctggttgaggacaaaggtggccanaattggatatcaagaaagaaggataaatttgtttttccaggaggtggaacacagttcatacatggagcagataaatacctggatcagatntccgagatggttcctgacattgcatttggttcaacacaagagttgctttanacatc

SEQ ID NO: 5879 - DNA, 626 bp, Medicago truncatula
  Predicted polypeptide sequence is orthologous to G268
ccgccgtcggattcggtggagaaattcgggatcgtgaacgagaatggaacaatgtcggaggagtttgaaattgggagcttcgatccagcgatggtggatgattgggttaacgaaacgcaagttgagaaggaaggttctgagagtgttacgaaatttgcgatcaagaaatttgggttgtgttcacgaggtatgagtgagtatataccttgtttggataatgtagaagcgattaagaagttgccatcgacggagaaaggtgagagatttgaacgacattgtcctgaagatggtaaaaagttgaattgtttggttcctgctcctaaagggtatcgtgccccaattccatggcccaaaagcagagatgaggtatggttcagtaatgttcctcatactcgtctagttgaagataaaggtggccaaaactggatttccagagacaaaagataagtttaaatttccaggaggcggtacacagttttatacacggcgcggatgaatacttggaccatatttctaagatgattcctgaaattacatttggtcggcatattacgagttgctctttgatgttaggctgtggtgtagctagttttggtgcgtacttactgcaacggaatgtcatcacc

SEQ ID NO: 5880 - DNA, 604 bp, Medicago truncatula
  Predicted polypeptide sequence is orthologous to G268
aaggcatgattggtgtttgccatttgatcatacccaagaacatatgatctgctacatgcagcaggtctcttctctgctgaaaaaaagaggaaaaaatgtaatatttcaaccatcatgctcgagatggatcggatgctaagaccaggtggttatgtgtatatacgtgatgctgtacgtgttgttagtgaacttgaagaaattgcgaaagcaatgggatgggtgactacccgggatgatgtaggagagggtccatatgcaagcttgaaaatattaaggtgtgagaaacgcttctgaagccaatgtaacatggtttaattggtaaggattcggctcatatcatacaagaatatgattttgaatgtgactggtctaccttggttatctcctgagactcaactcacctaaactatagttcaattgtatgaatagcgtagagattcatatactggttcacgcaaacagaaaatggtgatctctgtataattccagaaaggtgaagagttagttccatacttcgcaccaatgttgaatccctactaatgggttttctagaagaagttactttgtatctattgatagtttaatttttttacattgatatccc

SEQ ID NO: 5881 - DNA, 582 bp, Medicago truncatula
  Predicted polypeptide sequence is orthologous to G2699
tttttttttttgttcatggaaacaaaatacactgattaataaaaacaaaatctaaaaacaccataaagacataaacataacatctcatctacttatttactcttaaaaaatacaataaaaactaaccaaatattattaaaacccaaagactaaatagaaaaacaataactttattattcatagaatacaaaaagaggcaaaaatgttgaactagttaagcaggtaaccaagcagaagcaaaaacaacattatggcctttccaagtaagcacaatatgctcatcttctttcttcaatccccatccagcagcatgttcatcaagcatagctttcacctcaccaacacattcctcaccaaatccaatcccttgaaaattagcatttctcattctttgttcccatttgcttataggttcaactctctcaactctttgaacaccttcatgagctatcacattttcaatcttccaacaaatatctgcttcataccattgcctttgcttacttccacgcggtagaaatgtgtccacggtatcataaggtatccatagataattaaatgcggaccttaaatctactaacc

SEQ ID NO: 5882 - DNA, 656 bp, Medicago truncatula
  Predicted polypeptide sequence is orthologous to G274
aactattagggaaaatagtggcacatagagaggggtgtttttattcttgaatgcttcattctaaattgttaattaatttaacaccaaaactgatttgtaacataaacttggagcaagttatgtgaacccctcactctaccacagttgtgataatgaatcaaaccatatgaactctgtgactattgtttgtatatagaaaagtagtagcagcttaaggctaggagtgcaatttcttcaacttgtttttcactgattattgtgttgatgtggagtttccatcagtaacccaatactgtttgacagcaattagtactttctcgggaacaagaggaccatcttcatgatcaaccaatttcatattccatctcattcctccgattaacttctttaccttaattaacacatcgacttcgtcacggattatgacagcgccttctggtcgcaatatccgatccatctcgagaagaatgtcttctgtattgcatttatcctggtacaaactgaagaggccattagcatgaatgagatcatatgttcttggatatgtggaaaagccttcacaccaatcatgatagatgccaatcagtcctcgctcatatatcacaccgagcgtacttttttcagctatagtaggcacaacattcatgacccatgac

SEQ ID NO: 5883 - DNA, 804 bp, Medicago truncatula
  Predicted polypeptide sequence is orthologous to G274
ttttagtgtgatctactataccagacctgggatctctattctctcttttcaaggtttgatcgtttgaaagaggttagaaagaaaactgcggggttaatgggttctaaaaatgccttaccgggcaacagagcacgaaggcctttgtcaattttcgctgtgcttgctctgtgttgtttgttttatcttttgggaacatggcaaagcagtggttctggaaagggagacagccttgcattgaaggtaaataagatgcaggcgacaacagactgcaacattgtaccgaatttgaattttgaaccccaacacaaatatgtagaaattgttgagcaatccgaaccgaaagctaaaatgttcaaggcatgtgatgtaaaatatgctgattatacaccttgccaagagcaagaccgagcaatgacattccctagagaaaacatgatctatagggaaaggcattgtccacctcaagaggaaaaattgcgttgcctcattcctgctcctgaagggtacacgactccttttccatggcctaaaagccgcgattatgcctactatgctaatgttccttacaagcatctgacagtggagaaggctaatcaaaactgggtgaaatttgaagggaatgtgttcaaatttccaggtggaggaaccatgttccctcaaggagccgatgcatatattgatgagcttgcttcggttattccaatcaaagatggtactgtcagaacagcattggacactggttgcggggttgcgagctggggagcgtacttgctaaagagaaatgtgctagctatgtcatttgct

SEQ ID NO: 5884 - DNA, 674 bp, Medicago truncatula
  misc_feature (622)..(622): n is a, c, g, or t
  misc_feature (655)..(655): n is a, c, g, or t
  misc_feature (659)..(659): n is a, c, g, or t
  Predicted polypeptide sequence is orthologous to G274
ctgaacatgattgacgctattgaatcatagggttttagagtgagacttttcactgactcattcagcttctcttactcaaccaaacaccaaacaacaaaaacatcatcatagtttggttcctagatcttctcaaccattgcttcctccaacatcatatgatcggttctatatggctaaaccaagttcatctggtagtagaactagaagctttgtgcagatctttatagtagttggtctatgttgtttcttctacatattaggtgcatggcagagaactggttttggaaagggagatcttttacaattggaggttactaagaaaggtgctggttgtgatattgttccaaatttaagctttgattctcaccatggtggagaagttggcaaaattgatgaggttgattcaaaacctaaggtatttaagccttgcaaggctcgatatatcgattacacgccctgccatgatcaacggcgtgccatgaccttttctagacaaaatatgatttatcgagagaggcattgccctcgtgaagaagagaagttacattgtttgataccagcaccgaaagggtatgttactccatttccatggccaaagagccgtgattatgttccatatgcnaacgcaccctacaagagtcttacagttgagaangctnttcagaactggatcc

SEQ ID NO: 5885 - DNA, 795 bp, Medicago truncatula
  Predicted polypeptide sequence is orthologous to G274
acactccatgtcaagatcaacggcgtgctatgacgtttccgagagaaaacatgaactacagagagagacactgccctccagaggaagagaagttacattgtatgatcccagcaccaaaagggtatgtaacaccttttccatggcctaagagtagggattatgtcccttatgctaatgcaccttacaagagtctcacagttgagaaggctattcagaattggatccaatatgagggaaatgtgtttagattccctggtggtggaacccaatttcctcaaggtgctgataaatatattgatcaactcgcatctgttattcctatcaatgatgggacagtgaggacagcacttgacaccggttgtggggttgcaagttggggtgcatatctttggagcagaaatgttgttgccatgtcgtttgcaccgagggactctcacgaagcacaagtacaatttgctctagaaaggggtgtacctgctgttattggtgtttttggaaccataaagttgccatatccatcaagagccttcgacatggctcattgttctcgctgtttgattccatggggagcaaatgatggaatgtatatgatggaagttgatagagttctaaggcctggtggttattgggtgctttctggtcctccaatcaattggaaggtcaactacaaaccatggcagagaccaaaggaggaacttgaggaagaaaaagaaagattgaagaggttgctaagaaactttgctggggagaagaagtctgagaaagctgaaatgcaatttggcaaagatgacgaca

SEQ ID NO: 5886 - DNA, 819 bp, Medicago truncatula
  Predicted polypeptide sequence is orthologous to G2789
caatttcacaccaaccaccaaaccaatgaagaggaacaacaaagtggcaatgggagcttaagccgaggccaaaaaagagaacgaaacaacgaagacggcaacaacactcccaccggaggagaaggaaaagacgacggtggtagcggaagtgctggtggaggaagtggtggtgagatgggaagaagaccaagaggaagaccagcaggttcgaaaaacaaaccaaaaccacctatcatcatcacgagggacagcgcgaacgcactccgatcccacgtgatggaagttgcaaatggatgtgacatcatggaaagtgtgacggtctttgcgcgaaggaggcagcgtggtgtctgcatccttagcggaagtgggaccgtcacaaacgtgactctccgtcaaccagcatcgcctggtgcggtagtcacacttcatggaagatttgagatattatcattatctggctctttcctgccgccgcctgctccaccagcggcgtcaggattagccatatatctagctggtggacaaggacaggtcgtcggtggtagcgtggtgggaccgttgttagcttccggtccggttgttatcatggcagcttcctttggaaatgctgcttatgaaaggctacctttagaagatgaagaaacaccagtgaatgtgccaggaaatggagggttagggtcaccgggaaccatgggaagtcaacaacaacagcagcagaaccagcaacagcaacaacttgtagcagatcctaatgcttcatcactttttcatggagttccctcaaatcttctcaattcatgccaattaccagctgaaggt

SEQ ID NO: 5887 - DNA, 600 bp, Medicago truncatula
  Predicted polypeptide sequence is orthologous to G2791
gaggtagctcctcttgtggctgatatgtcctccgagggtgtcagtgactgcgtccaaacaaacggcaacggaggggtccacccacgaaaccctaaaacggcgtcgtcctccaacgaaagcctcaccatgacggagcatcaagtggccaagctaatggaagaagacatgggatctgccatgcaatacttacaaggcaaaggtctttgcctcatgcctatttctcttgctactgcaatctctactgccacgtgtcacaccaggaaccctttgatcaatgctgctaataataacatcaacggtagttccaaccctatcaccgcatctaacggtgatgggccatcttctcccggaatgtccgttaacagcatcgtcaaagatgctaactccgcttctaagtcgtagacgccgtctgtttcgttgactttttcactcaacagagacataaacaaaagagtagcatctaagatgaaaacacaaaatgaggtggagtttctcaagtctaggaaaataatgcgtgggacttttacgacgtcgtatttacctagactttggcagatgctaactttcgtattaatttcagccttaccatctttctattat

SEQ ID NO: 5888 - DNA, 682 bp, Medicago truncatula
  misc_feature (586)..(586): n is a, c, g, or t
  Predicted polypeptide sequence is orthologous to G280
cacaatctcatttctcttaaaattttctatctctcttagaatatttttctctcaatttttttagctcttttttcctcactattttcaagcttcaatggctactcaagaggttaataagcctctttcacttcctccataccctgagatgattatgaaggcactggaagcactgaatgaaccaaatggttcaaacaaatcatcaatttcaaactacatagaatcaatctatggagaattaccagaaggccattcaattgttcttgcaaatcaccttaaccagatgaaggataatggtgaccttgtttttgcaaagaacaactacatgaagcctgatccaaatgcaccaccaaagagaggacgtggaagaccaccaaagccaaaggatccattggctccaccaccagctgctgttctgtccccaccaaggccaagaggtcgtcctcctaaggaccctaatgcacctccaaagacccctaagcctgcttcaagtggaagaggaaggggtaggccaaagaaggttcaaaggactgagaatgtttcaaatccaagtggtggagatggtgatggtgctggtgctggtgctgangttgatgatgatgatgctgctccaagtgttgctgctgttgctgttccaactactagtggaaggggaaggggtaggcctcctaagttaagcctcaaa

SEQ ID NO: 5889 - DNA, 727 bp, Medicago truncatula
  Predicted polypeptide sequence is orthologous to G2802
gtgaaaatggattgattcggtgtccgaattgttgtatttcttgaggatttgtttcgatgtatgtgtgtattagtatagtagttggtgttttgtgcaattgcagcttgtttattgatgcgtgcttgcaaggttttaggtgttgtcgataaataatttgatcaagattgatgaatttgtgtcgttgttgttgttggcagtggcggtgttgatgatgataagtctttggttaaggttatcaagggttttaaataaaggtctgcgatctagacagccgacatgaccgagactgcaattgagaccatgtcagctgtcacatgtcacagtttgttgtaatatcgagcaaggattgcaatgcagctgcaatgtgaccatgactgcaattgagaccacatcagctgccatgattatttgtaatatcaagcaaggatcgtgatgtgactgcagttcaaaaccttggttatatcaagattcaaagctctctttgaattttatatggttggtgtttacttatttatttgatatataggatttgtgtgatgagctgaagctgacggtgttttcagctccttgaacatgatttttgttgttcaagagtgtgcttataggaataaatgggtttgagtgtgtatgtctgttgtagttcattcctgatgaaggctgaggactgtttctcatcaagggaatgtaaatatttagtggtattatgatatgatcccttgtagggatt

SEQ ID NO: 5890 - DNA, 547 bp, Medicago truncatula
  Predicted polypeptide sequence is orthologous to G2826
caatcatctgctctcatcaccgggacaagttatgatgcctactgctcctccgtcgtgggtttacatgccaccacgtgctgcaccacctccttttcatgtctcagtttcacatggttgtgcttttccatcgcaaaacaacagtaacaatggtaatagttatagtattataacgggtgcaagatctgctagtgcaggtgtgttaccgtgtgttagtggtgtagggaattcttcacccacattgtcaactatgggctcacaaatacagagcctggcccagtttgggaaacttgatgggccatctttgagtaggttctcaaaaggagatgtggggcccaactttgatgaaggatttggtttagatttgcatcttagcctagctccaccgtgatcgatcaacttagttcagctcgactcttgttcaggaaatccattcaaaatggactcgattcaaaaattcatgcagtaaagaatctcgatcgttgatttaaggttaaatgatctagattgtactattaaattgatctggtcgattgatttagatccaata

SEQ ID NO: 5891 - DNA, 798 bp, Medicago truncatula
  Predicted polypeptide sequence is orthologous to G2826, G2838, G362
gtatataattgccaatggctatataccataaaataaatacaccataattaagaattgtatatattaatgtctgaacaatcattggtcagtaggggcaaagtcatgacaagccaactcaaatgaatagtgaaattttttcttctaatttccttttccttgatgtttgagaattgttcataatcaaacaatatcaaggaaaacaatgaaactattactttggatcctataccaaactacgaccttttcaaagagcttcttattgtatttgactgcaaattaagacctagttgaagatctaaagctttactatgactttggtttgaagaaggcttatcatcgttggagaaagtaaacatgcaagtatcttgttgggaaggagaaacatgagaaggaagagaataccaactagagttagtatcatgaacattttttgacttgaaactaatttgagattcttcactcaaagagaattcagaattataagaagaagggtcataaaaccaatgagtatgatcagaaccatggtaagaaaaaccatgatgatttttttgaaaaggttgcaagtaatagtttatgctagctttcctagcttgaagttgcaatctttttttcttcaatctttctttcttgtgtgcattttgatggcctcctaatgcttgtgaatttggcaattctttgaaaacatattgacactcaaattttctctcatcttggtctttagatgaatttttttctggacattttatctcctcagatgaattgagttagaggaatcacacttcatctcctcatagactc

SEQ ID NO: 5892 - DNA, 1688 bp, Medicago truncatula
  Predicted polypeptide sequence is orthologous to G2887
cggcacgagaatcaattttctctctttcgatttcatagtaacacacttgttacgttattgtaatcgttttctgagttacgaggtttcgatcaattttttttccgactgaggttgtttgttcgctacgacaacaaacaacctcggtgttggattctgtaattttggtattgatttgatttgattcgatggctataccgaaattggttccggggtttcgattctctccaactggagttgaattgatcaaatatttcctcaaaaggaaagtgatggggaaaaaggttcttaacgatgtcattgctgaacttgacatatacaaatacgcaccttgggatctcccagatttatcttatctccaaaatggggatttagaatggtatttcttctgtcccattgagaagaagtatggaaatgggtcgaggatgaatcgagctacggaaatagggttttggaaagctactggtaaggatagagctgttcaacagaataatcaaactgtggggatgattaaaacactgatatttcatactggaaaagcacctcgtggggatcgtactgattgggttatgcacgagtataggcttgaagataaggacctagctgataaaggaattgttcaggattcctacgtaatctgtaaggtatttcaaaaggaaggtcctggtcccaggaatggtgcacaatatgggagaccatttaatgaggaagactggagtgatgatgaagtaggaacaccgtttgctgagccggctgcactagctcccactttgcctgtgacatctaatagttttgttctaaatgaccagaatctccatgctattggatataatggttcaatatccatgccatgtcaatccggattggtgccttctcccgatccagcaaattcatgtcaaacaggattaccgccttctcctgaccctgcaaattcatctcaaataggattgacgccttctccagatcctgtgaattcatgtcaaacaggatttatgtcgtctcccgacccttcaaattcatgtcaaacagggtatatgccgtatcctgattctgcaaatgaatgtcaaataggatttatgtctcccgaccctgcaaattcacatcaaacaggattggtgctgtctccccctgaccctgtaaattcacatctaacaggtttggtgccttctcccgaccctgtggataattcatatctagaaaatcaagctgttaatactgataacattttatcaatgcttgatatgttcaacgacaacgacatattgcctgaggaaaacattgctgaaggtgcactatcaaccgacttttttgaggtttgggagacctggattgcctgggacctgttggccagaatgctgactttagcacatacggtatggcttctacgggtgatgactacttggatttcatggagttgattgatctagactccgagatgttctggcagagtgctgctgaacctaagttggacccaaaataaagaattttcattggtccttttggcatgatattttctgacgactgagcgtcggacttaatactttggcactattgctgcagtgctggccagaaggtgattcggtcattggcacatagacacattgtttgaatttgtctgcctttatatatattttagtggttaataaataactgaagtaagtaatgtattattgtgaaaaaaaaaaaaaaaa

SEQ ID NO: 5893 - DNA, 821 bp, Medicago truncatula
  Predicted polypeptide sequence is orthologous to G2983
aaacataaacattatgaaggtgcatcaattacacgtggattttgggagcatgaaccttccctcacacttggttgcaagcgtttacgtcctcttgcacctaaaatttcttctaataacaccgataattctactactaacaccccttctctttcttttgatctcaagagtttcattagacccgaaactgctcccagaattagtctttcttcctctgatgataacaagaaagatccaccttcaccacaaagccaggttgaaacgcatattccaggagggacaagatggaatccaacacaagaacaaataggaatattggagatgttatacagaggtggaatgagaactccaaatgcacaacaaatagaacagattacagttcaacttagcaagtacggtaaaattgaagggaaaaatgtgttctattggttccaaaaccacaaagcacgcgagagacaaaagcagaaacgtaacagtcttggccttcctcatagtcctcgaactcccaccaccacacttgtgtctatgtcccccacctttagtactattacaactttggacaccccaaaaagggtgcaagtaatggaaagagatcaagaagatagcccattgaagaagagtaggagttggccatttgagtatttggaagagaaaaattggtcaatgtgcaaagtagaggaacataaaactctagagcttttcccattacacccagaaggcagatgaagggagtttgatctataacaatttttagctttttctttcccaaatgtgctttaatttgctttagtaatttcttctttcatttacattgggaaagaaga

SEQ ID NO: 5894 - DNA, 904 bp, Medicago truncatula
  Predicted polypeptide sequence is orthologous to G2989, G2990
ctgattcgccagctcgaaattaaccctcactaaagggaacaaaagctggagctccaccgcggtggcggccgctctataactagtggatcccccgggctgcaggaattcggcacgaggggaggtggaggtggtgaccgtggttatggtggtggaggtggcaggtgatcgctactctcgtggtggtggtgctgatagcgagtggaaactggagggattagaaaattaggtcttcagtttggtggtttatgattatgaatgttgtcatgttgaattagtttgatttagttggttgaatttagtgttttggctatgatatttgttctgttatggtttagttttgctttgtcgtgtttttggtgctgaatctggttttgtataaacgattgattgaaaaggataatgaaaaattggattcaacaaaataaaaaataaagatggaaaagagtacaaggggaggaaatctggagggggggcccggtacccatttgtccctatagggagtgtcgggttgtacaatgagcactgagcccgtggtgtgttgtacaatcgttggtgaactgtggaaaacccttgagtcgcgttgacccagaatttgagtactggggccttgtgtcatcaccctttaccccatttttatccagttataagacgatcgaatatgcgcgaaaaagctcccaaacccaagatgcacagcctctcctcatatagtagtgttgcaatcatctgccctctttagtgatatatactattattatatatgatactgttattatttgtccatatatacacatatcgtatactaacagtttttattgtatgctgtagatattacttttattttttcggttcgtcattgctttagtgcgtcatattgcgattgattatatcagttattatatattaa

SEQ ID NO: 5895 - DNA, 594 bp, Medicago truncatula
  Predicted polypeptide sequence is orthologous to G2996
cctttgaacaaaaaaaaagcacatagagaaaaagagtgaaagtgagagtgaatgttcctttgttttctttcttctttcagctcaaattattattcactacatcaaagcaaccattgataacctaacttcaaattttgctacaaaaatggattttgatgaagatcaagaagaggaacaagatgaagagttatgtatgggtggaggaaattacgactctttacctaactcatcaagagttgttaagatgcctggtggaactgaacctatcatggtgactcatccactcagaaacatcctcaacaacaacaacaacaacaacaacaacaacaatggaaacagcaacatagggtggtgttgttggaaatggtaaagcaaggtatagagagtgtctgaagaatcatgctgtaggtattgggggtcatgctcttgatggttgcggtgagtttatgccggcaggaagtgaaggaactttggagtcactaaaatgtgctgcttgtaactgccaccgtaacttccaccgaaaagagtcatcggcagatgttactgccggtgacccttttctgttgacacaccatcatcaccatccaccacctc

SEQ ID NO: 5896 - DNA, 718 bp, Medicago truncatula
  Predicted polypeptide sequence is orthologous to G2996
gataatgttatgtttgataattgttcttattgagattcaccttttttttcataaaattccatgttgatatggttggagcaattcccttgtcttcattgtattctccgactttatcattgtgaatcccttcaataaactcttcccactttcttaggccttcctttctaatcacttgatgggttactactattgtaaacccagggctaatgatactcatacttccaatgttgttctgttcttggctgtggcattgattcttctggttataccaaagctcttctcaagtgaaccagaggaagaagttgaagtagagagtggttcctcaccttttgtactaccaatactcgtattattgatggtgcttttggtatcatggttgggaagctcaagtaaaagggtttgtgccaagccacgatactgttactgcacgcatgcctgctactgttatcggtaggtagtgtgtccaagagcttggtggtggtggttggggtgtttgatgatgaacggtattgtgtttgtttgtcacccatcatcatctcaggctagtaaataagatattgcataggaatattggatgagcttcttgcattgcttcatatgataattaaaaagaatgttcaatgtttgtaatgaatcaacaaatagcatttgtaagtctgtaatgaacatgggatgagctttttggatttcacataaaaagtttcttatttatcagtgt

SEQ ID NO: 5897 - DNA, 638 bp, Medicago truncatula
  Predicted polypeptide sequence is orthologous to G3
ggcacgaggttgagacacaatatatatggtacagcaaagcgaatcaactaggaggatcatggaagaagaaagagattgttgttcaacaataataagaaacatagaaagcaacaacaaacctcaagagaaacacaacaaacaacaactagagaaaccatacagaggaataaggaagagaaagtggggtaagtgggtagcagaaataagagaaccaaataaaagatcaagaatatggttaggttcttacatcactccggtagctgctgctcgtgcctacgacaccgccgtattctatttaagaggtcctacggctcgtcttaatttccccgaattattgctcgaagacgacgaagaaaacaaggacggttctattcagcaaggtaacatgtctgctgatttaatacgcaaaaaagctaccaaagtcggtgctagagttgatgctcttcaagcggctcttcaagcttcttctcgttctgattccgatcaattcaacgctgatgtgaaacctgatttgaacaagtttccagaacctgaagattattaatgctttttcacttagaggtttaatattattgatatgatacttagtttctctctgtaatctttaatatccatcatctattaatcaacccaatatt

SEQ ID NO: 5898 - DNA, 671 bp, Medicago truncatula
  Predicted polypeptide sequence is orthologous to G3060
ccgccttcaaaacccctcttttcttttcttttcttttcttcctccgctagggttagggttttactcaatttcaagattcgatctcgatccatggatatgcgcaagagaggaagacccgaacatggattcaacaacaatgggggattcaagaaatccagacatgaaatggagtccttatcaactggtgtaggaagcaaatcgaagccatgtaccaagtttttcagcacttctggctgcccatttggtgagagctgccacttcttgcaccatgttcctggcggttataatgctgtttcccagatgatgaatctaacacctgcagcacctcctgcacccagaaatgttccagccccacgaaatgcacatgcacccaatgggtctgcaccatctgctgttaaaagccgcatatgcagcaagtttaatactgctgaaggctgcaaatttggtgacaaatgccatttcgcacacggagaatgggaacttggtaagcctgttgctccatcatttgatgatcaccgtcacaatgaccaccgtcacatgggaccccccaatgctggccgttttggcggtcatcggatggagcctcctcctgttccagctagctttggtgccaatgccactgccaagatcagtgttgaagcctccctggctggagctatcattggtaaggg

SEQ ID NO: 5899 - DNA, 528 bp, Medicago truncatula
  Predicted polypeptide sequence is orthologous to G3067
tgcatgctctcttggcataaatggttcttatagtttatgcactttagactattgtggtgtatgtcaaattttgaggcatggtttttctactaacaaggaatttcaaggtgcattaggagtttacacaagttccacaagtggaaaagcctttgattcaattatgctatctgatgagagagcatttacaagaaaggcagttataatgtgtagagtaatagctgggagagttcattgtccttttgaagaaattcaagaaaaaattgattcaggatttgattcatttgctgaaaagataagtgatcattcaaatattgaggaactatgtttgttgaatcctaaagctctgctcccttgctttgtggtaatctacaaacaaaaatagatggaaattaaaaggttcaactcaagctcaaggataagtagataaagtatgtaggataagctatgctccctctctttttagatttttcagtcttttcatatatttatataaaatatgtattcaaagtaaaaaaaaaaaaaaaaaaa

SEQ ID NO: 5900 - DNA, 702 bp, Medicago truncatula
  misc_feature (26)..(26): n is a, c, g, or t
  misc_feature (395)..(395): n is a, c, g, or t
  misc_feature (526)..(526): n is a, c, g, or t
  misc_feature (530)..(530): n is a, c, g, or t
  misc_feature (565)..(565): n is a, c, g, or t
  misc_feature (585)..(585): n is a, c, g, or t
  misc_feature (598)..(598): n is a, c, g, or t
  misc_feature (665)..(665): n is a, c, g, or t
  misc_feature (702)..(702): n is a, c, g, or t
  Predicted polypeptide sequence is orthologous to G3067
ggaaatctagtttgatgtataagganaaaaccaaaaagggtaatatgccaacagtgtggttttctttgaagaagtcacatacattgcaaatcagaaccatcagatgtacatgatccaaaaacaagaaagcatttaagcacaatcttaacaaaaaaaggaggaggaggaagatcaggttgttcaaggtcaatagcaaatctaaaagatgttatccatggaagcaaaagacatatacaaaagccaccaagttgcagtccaagatctataggaagcagtgagtttcttaatccaataactcatgaagttattttgagtaactcaaggtgtgagttaaaaatcactggttttcaagaagggattaacggtggtggtaataatgctagtggtggtagtantagtggtggttcttcaacttatgttggtactttaagacctggtacacctggtcctggaggacaccctacaatgcattactttaacccttcttttagaacttcttcaactcctacaaggaaatctccttttntttngtcagaagggtctaatggttttcatggtggtgggnggtgttcattcaagtaatangatgtcttttganacagattctaatggttcttcaactgttacttgtcacaaatgtggtgaacagtttaacaaatgggaanctgctgaagctcaccatctctccagcatgctggtaan

SEQ ID NO: 5901 - DNA, 731 bp, Medicago truncatula
  Predicted polypeptide sequence is orthologous to G3067
aaaattacaaatgtatgaatagggggttcatacaaattacaattaccatggacaagcacaagtgacttgacaaaaaagaatcaaaatccttcaaaagatgtaggccaaagaacctccatataaaagccaaaagtatagagcatgttctgaatcatggtaagttcgacgaaattacagggctaccgtgattttgttgaaactctaaagttctgccaaattcactgtgaatccaaacagcgtcaacactttgatcctgtttttgggctcatgatttgcaaattaccacaaaacaaggaagaagagctctaggattgagcaaataaagctcctcaatgtttgaataaagacctactttaccagccaatgaatcaaatccagtttgagatgccatttcttgaatgttttcaagtggcctatgaaccctaccagcaattaccctgcatactatcaatgcctttctaagtgaaggttcattatcaaaaatctctatagattcaaaagctcttccacttgtagatgttgtgaaaacacctatgccacctttcaattccttcttagcagaaaacccactcctaatgattctacaaacacaacattttttctgataaacaaagacttgaagagccattgagaccaagagaacagcaactgtggttccatagaactttaaaagtcattttcatcagctagacacctagggatgttcttctggagtttgcttgctttaattt

SEQ ID NO: 5902 - DNA, 578 bp, Medicago truncatula
  Predicted polypeptide sequence is orthologous to G3074
ctgtaaccaacgtgttactctttcaaacctttctcacacattgcgttgaacgaatctcagaaacgatgaagtgtgttttgcacctttggatctgaaaaatgggttcctttgatctcatcgcgttgaccttgggagcaattcttctcttcaaaacttgcgatttcaccttcttactctctttcttctacttcttctgatctctctcaactttttcgttaccatgaagaagaagctcgatacccgtttccctgctgctcggataaagaaaataatgcaagctgatgaagatgttggaaagatagcattggctgtgcctgttttagtttctaaagctctggagctatttctgcaagacctttgtgaccgcacttatgaaataactcttcaaagaggggcgaaaaccatgaattcattgcatttaaaacattgtgtacaaagctataatgtatttgactttctgaaggatgtagtcagcaaggttcctgactacggccatggtcatggccatactgatgctggtggtgctgatgatcagaccattcctaaaagaaggaaagctgcaggtgatgatggtaatg

SEQ ID NO: 5903 - DNA, 829 bp, Medicago truncatula
  Predicted polypeptide sequence is orthologous to G3074
cttacatcacaccattcaccccttcctttgctttcaaatttcccttcaaaattgttaccttcttcctgttcaatttcccaatttgatgccatgaagaagaagcttgatactcgtttccctgctgctcggataaagaagataatgcaagcagatgaggatgttggaaagatagcactggcagttcctgttttagtttcaaaagctctggaattatttttgcaagatctttgtgaccgaacttatgaaataactctacagagaggagcaaagaccatgaatgcattgcatttgaaacattgtgtacaaagctacaacgtctttgactttttgagagacattgtcagcagggttcctgactatagccatggacatggccattctgaggctggggctgatgatcgcgccgttccaaagagaaggaaagctgctggtgatgattgtaatgacagcgatgaagaggctaagcggagtaaaatgcttgagttgggccacactggcagtactggtaggggaagaggaaggggtagaggaagaggccgcggtcgaggggctcgaactgcagaaagagaaaccttacatcagcaggttgaatctgaaccttgcacttctattcagcaaactagcaaagacgtccccaatacaagtatggcaatagataatggttcagaaccaaaggagttatcgaaggaaaatattgcagctcatgaagaaagtacccaatctctccgaaacattgatctgaatgccaacttacatgaaaacgaggaaaaaaataatacaagcacggatatacctactcaggccccattgcctgaacctgctgcacaac

SEQ ID NO: 5904 - DNA, 768 bp, Medicago truncatula
  Predicted polypeptide sequence is orthologous to G3074
caagatgcttgagttgggcacactagccctactggcaggggaagaggccgaggtagaggaagaggacgaggtcgaggtcgaggacgagctattcaaagagagggacatcatcaggagactgagtctgagccttgtccttctgttcagcaagttagccaaaatactacagatacaaatgtggctatacttgatggcacagagtcaaacgagttaccaaagaataatgttgttgttcttcctgctgataactctgactcactccttaatattgatctgaatgccaatatgaacgaaaatgatgacaaaaaggctagcacagttgctaatctcacagtcactattcccgaagccgctaatcctgaagctgccaatccccctgtgtctgaacctcctccaccagacagcagtcatcatgaagaaattccgggctggtccctttctgaggtggacaagatggccattgattcgatgcagcttgcccagcttggtacacgaatggatgaagatgatgaagattatgacgaggaagggtaaattgtagtcttcaggagagggagattagattagctaaaagctcattataagtgtagaagaagtatatactagtgttatgattataagtattcactagccgtcataacatgtcttatgttgactgggaaaaaaagggttctgaatgtcccatttgtttaatatggtttatctatgttagcacatgttcgctgttgtatctgtcagttatgttagctttggtgactcttagggctg

SEQ ID NO: 5905 - DNA, 624 bp, Medicago truncatula
  Predicted polypeptide sequence is orthologous to G3075
gtaaatacactatggagatgtaaaacagtgcattactaagtactaaccatcatacatgtttccatttcagaatgtgtttaacaaaagaattgacttaggttcaccactttctgtgttttacatttcctaacctcctttattccctcttgagtttgtctctcttaatgcatcctcagctttcactttctcaggaacaaagtcggacagaaagtcatatcttttttgcttactaacaacacgtgatagatgattgtagctcaaagatttcttccgatcctgagcacaacaaccataagcatcttccgctaattgttcaagaaacttctccgcagcattgttaatagccaatatagcttcctgagaaacacgcaaatcgctaatttcaccctttaacatcgtcctaattcgattcataggaaacacatgcgttttcgcatcttcttcttcgtcatcatcctttgaatgtttcttttttcttccactttcttcctgttctttggaatttccatttgtgaaattgagcttcttcttattcttgttgttgttttctttggatttttcaatgtttttgttgtctttcctgattttgcttgtaggagttgagggttgtggttttttggtttt

SEQ ID NO: 5906 - DNA, 756 bp, Medicago truncatula
  Predicted polypeptide sequence is orthologous to G309
gtgctcatgcattttacaacttatcttctctcttagttttctcacacatcactttctttatttctttctcctcttttttcactctctcctagcttaaactcaattataaacacacacacttctttagatgctatcatacttcaactttgcttccacagactaacgcttataagttcaaaaactgtgttttaagttttgaattctatggaaatagtttcagattcttcttctccatcaaagacaaaagacatcgatggcctcctcgccaatgtcggctacaaagtccgatcatctgagctacatcaagtagctcagaatctcgaacgattagaaagtgcgatcgtgaactcatccagcgacatttctcaattcgcttcggatacggtccactatgatccctccgacattggcaattgggtggacaatctcctctccgaatttgaccacacggcctctttaccctacgatttctctcaacttccagatctctcagcaccgccgccacaacaccaccaccaccaatcttcttcgacagttaataatgtcgaagaagattctgcaataaaacttgtccacatgctgatgacctgtgcagattccgtgcaacgtggtaaatcttcattggctggctcgctaatcgaaggcatgcaagggtttgtggcaaacatgaacacaaactccggcatccgaaaagtcgcgggatacttcatcgacgctttgaaccgtcgcatcttcggtcaaaacatgttagccacc

SEQ ID NO: 5907 - DNA, 831 bp, Medicago truncatula
  Predicted polypeptide sequence is orthologous to G309
ctcccattcttctaaacttcaaaccataaactcaaaaaaccccattttgctatgacccaactcaaattctaaatcaaaatctattcacttcaccaatttaatcaacaaattatagaaagaaaaaaaaaatgaagagagaacaccaagaaagttttggtgggggtgtgattagcaacaacaacaaaacaaacaccaaccaccttaacagcagcaaaaacatcaactttggtgaatgttcatcaatgcaaaacacaaacacaaaacaaaacatgtggagagaagaaaaagaaaccaacggtggtggaatggacgagttgttagcagcattaggttacaaggttcgctcttccgacatggctgatgtagctcaaaagcttgaacagcttgagatggttatgggtagtgctcaagaagaaggtatcaatcatctttcttctgatactgttcactatgacccaaccgatctatattcatgggttcaaaccatgctcactgaactcaaccctgattcttctcaaatcaacgaccctttggcttctttgggttcttcttctgaaatcctcaacaacactttcaatgatgattctgagtatgatcttagcgctattcctggaatggcagcatacccacctcaagaagaaaacacagctgctaaacgaatgaagacttggtctgaaccagaatctgaaccggcggtagtgatgtcaccaccgccggcggtggaaaatacagaccggtggttcttgttgcacacaagaaactggtgttcgtcttgttcatactttaatggcttgtgcagaagcgattcagcaaaagaatctgaaacttgca

SEQ ID NO: 5908 - DNA, 693 bp, Medicago truncatula
  Predicted polypeptide sequence is orthologous to G309
catcatttaactcaaccagatgaattatttatcctccacctcaatttagaaccatggcatattacaaatatgagaaaattagcaatttgtgacaagcaaacccctcaaaaatctatctatggctacataataagaagaacaagtcagagatattgagcacgcaaaatgattaagggtacaaaaatactactaaaagaaggagaaatatacagtatgctaagtgagctacaatgcttgttttgttcatatttgctagttaaccaagttctccattcttcaacaatcaaaacgcagtgtttcagcatctaacaaaggcacagcttgccaagccgaagccgcaatcaaaggccggctatgccaacccaaagtcaagctaccttgattctcttccacgcaataaccctccgctgaaaacagagtcaacaacatactcgcttgcttaaaagcattcgaacccaaatgcaacggtctgaacccggctttaccaagccgctccttccacttaaccaacggttcatgtctctcaactcgagcaggtccttcgcagcacaccacgttgcatatctctctttgtaaatacatctcggccatagctttatctggttcaaccggacacgctttcagcgagtcaaaacggtcgagtataatgcatgcctccgtgaaccgttccataaccgttctcgtatggttcgc

SEQ ID NO: 5909 - DNA, 760 bp, Medicago truncatula
  Predicted polypeptide sequence is orthologous to G309
atccaaaaaaaggggttgtgtgcaatgtgcaaatatgcaaaaaggaacgagttgaatcagtgcgaaaccaccactgagttagcggcggcgagtttccaagctgaagttgcaatcaaaggcctagtgtgccaaccaagcataagacacccatcattctcttccaccttgtaaccatctccaccggcgaaaagcgctaacaacatactcgcttgtttgaacgcgttagatcccaaatgaaccggagagaatccagccgaattaaaccggttcctccactggttcagcgtctcatgacgttcaacccggtccgttccttcacacgccaccacgttgcagatttgcttccctagatatacttctgacatagctttatcttgcggttcaaccgatgaaccctccagcgagtcaaacaaagttgaataatagtgaagtgactcggtgaaccggtctagaaaagccggtccgttgtgatttgcttcttgttcaacaacggtgacaatctccggccgaatctgacgaataacagaaaacactttctccaacgcgccgggacgcgcgttgagtttatgaagctcaaaaacagagttaaccgcaacagattccgtttccggtgaccggagttcaagcatcgaagcatcaagatcagctaaactattagcaacaaaaccacgatactcaaactgaacatgaatcgtttgtgcaaattgagcaagcctccacccaacttgttgaagatgatctgagttatccgacgccggag

SEQ ID NO: 5910 - DNA, 692 bp, Medicago truncatula
  Predicted polypeptide sequence is orthologous to G3111
ctttcactcaaacatttcatcaaacactttccctcgctcgctaacatgactcgaccgctaagaattctcctttcaatggaaaccacacccaccaccgtagtggtggcaccgccaccggaagccgtagctatagaatcagatttcgttgtaattctcgcagctttactctgtgctttaatatgtgttgttggactcatcgccgtcgctcgttgtgcttggctccgacgagactccggcgccggaaactcacctcaacaagctttagccaacaaaggactcaagaaaaaagttctacaatcacttcccaaattctcttacgtcgatagcaaccctggaaaatggttagcaacaacagaatgcgcgatttgtctctcggatttcgccgccggcgatgagatccgtgttcttccacagtgtggacatggttttcacgtggcttgtattgatacatggcttgggtcacactcatcttgtccttcttgtaggcagattctggcggtgacgaggtgtcagaagtgtggtaggtttccggcgaacggaggtgaagctaccggagttacggttagtgaaccggagatgaaaagtagagaagatagcaatgtcggtgcaaatagtaatagtgggggtgttagtagttgtagtataactctgcactcacatcatagtggaacagtggttcttgccttaagaga

SEQ ID NO: 5911 - DNA, 705 bp, Medicago truncatula
  Predicted polypeptide sequence is orthologous to G3111
cattatggccgggaagcacaaagcacatcaaataacaataacaatacactaacttttcatttcattcacttcacatgactcgtcctttcagatttctcggcgagctcaactcgtcttcctccgattcacctgagtcatccaccgtcgttgattccgatttcgtcgtcatcctcgctgctcttctctgtgctctcatctgcgttctaggtcttgttgccgtcacccgctgcggttgtctccgccgcctacgtctctcctcaaccacaaacaacacttctccagctgcacctccagctgccgccaacaaaggcgtcaagaagaaggttctccgttctcttccaaagctcacagcaacagaggaatccgccgtgaaattctctgattgtgctatctgtttaagcgaattcaccgcaggagatgaaatccgagtgttgcctcagtgcggccatggctttcatgtgtcttgtattgatttatggctcagatctcattcatcatgtccttcctgccgtcagattctggtagtttctagatgcgataagtgcggcgggattcctcctcccgccacaactacgacggccggctccagctctacggcggcaccggcgccagattgtgaaggtagattaaagcaagcactgcagggtcgtcgttgagaaaagggaaatttaattatattgttattatataaagtttgtaaactgt

SEQ ID NO: 5912 - DNA, 662 bp, Medicago truncatula
  Predicted polypeptide sequence is orthologous to G328
tttgaacttccttaacactgtctgtccaaaactgacaaacaaaccattcatcactccctctctccacaaatgttggagcaagatttcctcaccaccacctcagccacagccactgtaaggtctgcgggaacgtgggcacgaacatgtgacacgtgccgctcggccccatgcgcggttttctgccgcgcagactcggcatatttatgtgccgcgtgtgatgcacgcatccacgcggcaaaccgtgtagcctcgaggcacgaacgcgtctgggtctgtgaggcctgcgagcgtgccccggcggcttttctttgtaaagctgatgctgcttctctttgctccacttgtgatgctgatatccactctgctaaccctcttgcaagccgccaccaacgtgtcccgattcttccaatttccggttacctatacggtcctccggccacccttttaggtgccgaagatgaaggcttcgtccgcggtggttgtgaggtggaggaagaggaggatgaaggtgttgatcatgatatggaagatgaaaatgaagcagcttcatggcttttgttgaatcctctaaagaacaacaataacaatagtaacaacaacattagcaatgatcataatcaagtggctaataatggatatttgtttagtggagaagttgatga

SEQ ID NO: 5913 - DNA, 707 bp, Medicago truncatula
  misc_feature (667)..(667): n is a, c, g, or t
  Predicted polypeptide sequence is orthologous to G328
ggattcagttacaatggtggttctattagtcaaagtgtttcagtttcatcaatggatgttggtgttgtaccagaatcaaccatgacctattcaagacctccaaaaggaacaattgacctattttcaggtccttctattcaaatgtcttcccatttctctccaatggatagagaagcaagagtcttaaggtacagagagaaaaagaagacaagaaaatttgagaaaacaattaggtatgcttcaaggaaagcctatgcagaaactcgaccgcgtataaaaggtcgattcgcgaagagaacagatgtagaagctgaagttgatcaaatgttttccacatcactaattacagaagttggatatggaattgttccctctttctgaaatgatacaaaacaaaatggtcaggggacaaagtgcacatttgaattgacggtgagtttgacataatcacctcgtatcaccgtcaattttgtataagctacatttttggagcttcaacaaaattactgtaattttgtcaaacagaccgtgctttcaaatatacactaaggagaaggttgagaaacatgaccaacagaaaattgcaaccatgttttactattaccaagtctttctactaatactgtatttttgatataatattattatttgcagttgcactaattanatatatgctttattatcttgttggtggcttttgatgcgac

SEQ ID NO: 5914 - DNA, 876 bp, Medicago truncatula
  Predicted polypeptide sequence is orthologous to G351
ctcatctcaaaaatttcaatacctatctctttctatcaatggctctagaagcacttaactcacccacttctactacccctaaattcaccttcgatgaaccaaatcttccatggactaaacgtaaacgttctaaacgttcacgttcatgcactgaagaagaatatctcgctctttgtctcatcatgcttgctcgtggccacaccaaccgccacgatttcaatcctttgaatccaccaccaacaaccattgacaacaacaacaacaacaccaaactcagttacaaatgttctgtttgtaataaagagttttcttcttatcaagcgctcggtggacacaaagcaagtcaccggaaaaactccgtcggtggcggtggtgatgatcatccatcaacttcctcagctgctaccacaagctcagccaacacaaacggtggtggtgttagatctcatgagtgttcgatttgtcataggtcgtttccgacaggacaagctttgggtggacacaaacgttgtcactatgaaggtgttgttggtggtggtgcttctgctgtaactgtctctgaaggtatgggatccacacatagtcatcaacgtgatttcgatctgaatatcccggcttttccggagtttgctaataaggttggagaagatgaagttgaaagtcctcatcctgttatgatgaagaagaaagctcgtgttttcgtggtgcccaagattgaaattccgaattttcagtgatgaattatttgagatgtagatttacttttagtgaaagattagtagacaagtttattttatttcttatttggaaaatttttaggattatatgattttgtataaagtttgggttgggggattcaaaaaaaaaaaaaaaaaa

SEQ ID NO: 5915 - DNA, 827 bp, Medicago truncatula
  Predicted polypeptide sequence is orthologous to G351
taatcacttactctctcaaaatctccttttgcttctactttcacttgcgtaacgctaactaagtcttcttgagtgttcttttttcatcatctatggctatggaagcacttaactcaccaaccaccgctactcctttcacaccctttgaggaaccaaatctgagttatcttgaaacaccgtggacgaaaggtaaacgttcaaagcgttctcgtatggatcaatcttcatgcactgaagaagagtatctcgctctttgtctcatcatgcttgctcgcagcggaaacaacaacgacaacaagactgaatcggtgccggtgccggcgccgctaaccaccgttaaactcagtcacaaatgctcagtctgcaacaaagctttttcatcttatcaagccctaggtggacacaaagccagtcaccggaaagctgttatgtccgcaaccaccgttgaagatcagaccaccaccacttcatctgccgtgactaccagctctgcatccaacggtaagaacaagactcatgagtgttccatctgtcacaaatcctttcctactggacaggctttgggaggacacaagcgttgtcactacgaaggcagcgttggtgccggtgccggaagtagcgctgtaactgccgcctctgaaggagttggatcgtctcacagtcaccaccgtgattttgatcttaacctaccggcttttccggacttttcaaagaagtttttcgtggatgacgagggttctagtcctttacctgctgcaagaagccctgtcttttcagcttgaaatccttctcattactgatcaatatagatccatgttatggtatta

SEQ ID NO: 5916 - DNA, 770 bp, Medicago truncatula
  Predicted polypeptide sequence is orthologous to G351
gaaacgatcaaaacgaccgcgtattggtattggtaacccacccactgaagaagaatatcttgctctctgtctcatcatgctctcacaaagcaacaaccaaattcaatcatcaccgttgaagctcaatcacaagtgcagtgtttgcaacaaagcttttccatcttatcaagcacttggtggtcacaaagccagccaccgcaaatcttcatcggaaaaccaatccacaaccgtcaacgagaccatctctgtttccgtctcaaccagtaagatgcatgagtgttccatttgtcacaagagttttcctaccggtcaagctcttggtggacacaaacgatgccactatgaaggagtcatcaacaacaaccataatcataataacagtaacagcagtggaattacagtctccgacgccggcgccgcgtcctcctccatcagccaccgtggatttgacctcaatttaccagcgcctctcactgaattctggtctccggttggattcggcggtggagattccaagaagaacaaggttaatgttaatctcgccggaatcaatgaacaagaggtagaaagtccgttgccggtaacagccaaaaggccacgtttattttctggtgaagacaatgatgaaacggtgtagtttactgatacaccgttatttgatggattgaatttgtttgcttattagttcattgaatatgaagaatcgcacatattcttctagctagctaggtttcttcatttcttggttttattttaaattggattagggt

SEQ ID NO: 5917 - DNA, 769 bp, Medicago truncatula
  Predicted polypeptide sequence is orthologous to G363
atgaacctattgatcattttatgactgtccatgaagggatttgaactcggtactgaagttacatagtcaagctcttaccacttgatcgaaccgacacctcataaaaatggtttacccctgtttgcatcatctctcaaatcttatagcttcagtgtaagatcaggagatgcagatgcttgaggtggaggaggtgccattggaacaaaactagaatttgaagtttgaggatatcctatattaacaactcctccttgatccacctgtctaaaacttccgggccaaaagctacctacatcatcatcttcaacgtaaactagcgatccaaaatggtttctatcaaatttcgcagcagctctcatatctggagctctcattgatgatgatggttgcatatgtctttgatgcattgcagaatgagcttcaacaccgagggaccgaaaaggcgaaccatgaagaggtagagaagcaaggcttgtatacctttcggtgaacattcccattcgcattgcacgtttagccatcgtcctctcccttttgtgagcgttctgatgaccacctaatgcttgcgagctatagaacttcctcttgcagtaattacaagagaatatccttggagttaccgatggcgaagcatgaacttcagcagctcctacttcgctactagcatcacttgaacccattaactcggcttcactcgaactgaaattgagtgtcaagtcaagggtcataggatctagatcttggggtgcttctgactgattttcaggtt

SEQ ID NO: 5918 - DNA, 834 bp, Medicago truncatula
  Predicted polypeptide sequence is orthologous to G363
agagtaattacaaacatgatttatatatatagtagacatacatagatgctctaaatttgtcttcctagagctcttatagaacaagaaaaatagagtaaaatatcaaagcatagatttgtaataatagcattaaccctttcaaagtttcaatgttaattcaggtgctgaattctcaatgtcaaccaatggtttcacattcacctcactaaaacacatatttgaactctgatgagtattactacctcccttagtaacctgatggaaactaccttgccacatcagttctgtctcatcgtcctccaagaatatcggatgaccgatagatccttgtttgaatcttacattgctttttatctcaggactaggccttattgttggcggcgaaaaaccatggtgtagtgaagagtgtgtctttatacctaatgccctgaaagaaccattgagaggcagagatgcaagacatgcatacctctcagtgaatagtccaattcgcatagctcgctttgctaatgttctttctctcttgtgtgcattttgatgaccaccaagtgcctgagagctgtaaaatttgcgccgacagtaattgcaagagaaaactctttggatggtaagttcattgctgctctcactggtgcttgagaatgagattcctgttgaatctcgaacaaccaagtcattgttgttgaaattgagtgttaagtccagtgagatggaatctgaattggaaaggctgttactataggaacccttgtagagtttcaatttggtgggtgggatatagtggaagcaacatggctacctacatcagattcatattcttctgtggcctctact

SEQ ID NO: 5919 - DNA, 769 bp, Medicago truncatula
  Predicted polypeptide sequence is orthologous to G385
tctacaaacgagtgtgatttctttgattaaataagttaattctcaaaagaagggcttcttacaaacggtgaaacagtacaggattatgcctacccctacccgagcatatctgttccaacataaatcgtcaccatgttggaagggaggcagaatgcctctatgaagtttgacagggatttgagctataaccctacacagtctgagttagacttagaattagcaatgataatgtccctgtcttcacaagaggcagccacatatgctgctcaagcatttgctgaagtggaagcccttctagaggaagctgaagaggcaacagaggagaggaggctgatccaaacacttgaagggaggaatagtgtgataaagcttgctgatagaatggtcaaaatgttttgtgaatgcttaacaatgcctggtcaagtggaattgaaccatttaactcttgatagcattggtggggtttagagtctctcttcgcgataccaccgacaatgatacaagccagccaaatggcactgttgtaactgctgctaccactctttggctccctctgcctgctcagaaagtttttgaattgctcaaagatcctacaaaacgatcacagtgggatggtctttcttgtggaaatccatgcatgaaatcgcacacatttcaaatggaccctatcatggaaactgcattttcattattaagtcattcatccctactcagaggcaaatggttattctgcaggaaagtttcacatctccggtggggtcatatatta

SEQ ID NO: 5920 - DNA, 768 bp, Medicago truncatula
  Predicted polypeptide sequence is orthologous to G385
ttggtgcaaaacgttggattgcaaccctagatcgacaatgtgaaagacttgctagtgccatggcaacaaacattcccacggtcgatgttggcgtgataacaaaccaagatgggagaaagagtatgttgaaactagctgaaagaatgtgtataagcttttgtgctggagtgagtgcctcaacagcacacacgtggacaacactttcgggtacaggagctgatgatgtaagggtcatgacccgtaagagtgtagatgacccaggaagaccagctggcattgttctaagtgctgcaacttctttttggcttccagtgccaccaaaaagagtttttgaatttcttagagatgaaaactcaagaagtgagtgggatatcctttccaatggtggagttgtccaagaaatggcacatattgctaatggaagagatactggaaattgtgtttctctacttcgagtgaatagtgcaaattcaagccaaagcaacatgttgatattgcaagagagttgtacggatacaacagggtcatttgtgatatatgcacctgtagacatagttgcaatgaatgtggttctaaatggaggggatccagattatgtagcacttcttccatctggatttgctatactaccagatgggacaaccacaaatggaggaaaggtgttggtgaaactggacatgggtggtggatctctattgactgttgcatttcaaatattggtcgattccgttccaacggcaaaactttctcttggatctgttgctacgg

SEQ ID NO: 5921 - DNA, 827 bp, Medicago truncatula
  Predicted polypeptide sequence is orthologous to G4
caattggggtataacaaagtttcaaccttttttcaagagagagaaaaaagatgtgtggtggagctattatctccgacttcattccagctgcggcggcggtgggtggttcccgccgtgtcacagcggatatcctctggccgaatttgaggaggaaaccaagttcaaggaaaccttttttgcttgacgatgatttcgaggctgggttcagagagtttaaggatgattctgattttgatgaagacgaggatgaagatgatgatgaagggttgttggtcggtgtcaaaggtttcacctttgcttccaataagaacaacaaatcttctaagtcctttgttcgtggatcaagtgctgcaaaatctgttgctttgaattcaaaccagcaagctgaaaaggattcgaagagaaagagaaagaatcagtataggggtatccgtcaacgtccatggggaaaatgggcagctgagatccgtgacccaaggaaaggagtccgtgtctggctcggaactttcaacactgctgaagaagctgcaagagcttatgatgctgaagctaggagaatccgtggcaataaagccaaggtgaatttccctgaagaggctccggttgcttcctcaaaacgtctcaagaaaaatcctgaagatgcagccctgttgaatgataatctaaactctttcaagccgaacggaaaccaaatgttcaatttcagtgaaaatatggagaactactattctccctatggatcaggtggaacagaaaacattggttaacaaccaatatgctggacatcggagcttcttccggaaacggagtgcagcttacatctgctg

SEQ ID NO: 5922 - DNA, 804 bp, Medicago truncatula
  Predicted polypeptide sequence is orthologous to G4
gtggtggtgcaattattctccgacttcatctcaactgcggcggtggtgggtggttcccgccgtgtcaccgccgacatgttgtggcccaatttgaggaaatccagttccagaaaaccgtttttccttgacaatgacttcgaagctgagttcagagagtttaaggatgattctgatttggatgatgatgatgaagggttgttggtcggtgccaaatgttttacctttggttcaactaacaacaaatcttccaactcctttgttcgtggatcaagtgctgcaaaagttgttgcatcgaaatcaaacgagcaaggtgaaaaggaattgaagagaaagaggaagaatcagtataggggtatccgccaacgtccatggggaaaatgggcagctgagatccgtgacccgagaaaaggagttcgtgtttggctcggaactttcaacactgctgaagaagctgcaagagcctacgatgctgaagctaggagaatccgtggcaagaaagccaaggtgaatttccctgaagaggctccaaatgcttcctcaaaacgtctcaagacaaattctgagacacagctgttggacaaaaatctgaactctttcaagtgtgaaaatatagagaactactattccccagtgaatcaggtggaacagagaccattggttaacgcccaatgtgctaatgtcggaccctttgctggaaacggtgttcagcttgcatcttctgatgttactgcatatttcagttcggagtattcgagcaattcatttgattatcctgatctatgttggggtgaaacaagggcccga

SEQ ID NO: 5923 - DNA, 942 bp, Medicago truncatula
  Predicted polypeptide sequence is orthologous to G409
tctcacacacacacacacactcatcacaaaacctcgccggaaaactccctttccggccaccagcgttctccttcctccggtaaacccttcagttcaaaactgaatcccttcaaagaccaccggaatcggtggtttttatcttacagtgcatgatgggatcttgcatatgtccgttagaaactccagcaaggttgctttggacaacaagtttcttccgtcataagttaatgatcttttaatccacaaaccatcatagaaatatttctataaaaaaaaataccaagtttggaatttgaaagaaaaaatatatatatatatcattttttgtttctgattctgaaagattaatagtattaagagaacaaatttagcacaacctttaacgtgaagttttgaagtttgaagttgaaaaaatggagtctggtcgtctttactttgattcttctgcttgtcgtgggaataacatgaacatgctgtttcttggaaatgctgatcttggttttcgaggaaggtcaatgatgagcatggaggaaggctcaaagaggagacctttctttagctcacctgatgaactgtatgatgaggagtactacgaggagcagtcaccggagaagaagcgccgcctcacttccgagcaggtccatatgttggagaagagctttgaggaagagaacaaacttgagccagagaggaaaacccagttggccaagaaactaggattgcaacctaggcaggtggctgtatggtttcagaaccgtagggctagatggaagacaaaacaacttgaaagagattatgatgttcttaagtcttcctatgattccctactttcaacatatgattccattaataaggagaatgagaaactcaaatctgaggtatttaactacatatgtactgtataatcaaatatgtgcatttatagtagttatgattaaaatc

SEQ ID NO: 5924 - DNA, 852 bp, Medicago truncatula
  Predicted polypeptide sequence is orthologous to G409
tcgtgcaggtggaagactattcagcttgagaaggattatgattctcttaatgatggttatgagtctcttaagacagagtatgacaaccttctcaaagagaaagataggttacaatctgaggtggcaagcctaactgaaaaggtacttgaaagagagaaacaagagggaaaattcaaacaaggtgaaagtgaaacaaaggaattcttgaaggaaccaacaattaataagcctttggttgattcagtttctgagggtgaaggatccaaattgtcaattgttgaggcttctaataataataataataataacaaacttgaagatattagttcagcaaggagtgacatattggattgtgaaagtccacgctacactgatggagtgttagagacatgtgattcttcctatgtatttgaacctgaatatcaatcggacctatcacaagatgaagaagatcacaatttattgcctccttacatctttacaaaacttgaagatgtgaattactccgacccgccacataattcaacaagttatggatttcaagaggaagatcatcatcaagctctttggccttggtcttattagatatgatatgatatgatgcatttatctttctttctttgtaatatgcatgtatcttttcattgtgtttattagtatttaccctttttgtgcaaagtgagtgagtactgtactaagttgtgtgcgtaataaagttagagcaatggcaagttgaaaacatttcatttcatacccgaaatgggtgtggctcttgtaagatagaaatggcggcttttataccccattttgttgcattgtaaattaatgaacttttggatctaatcaacattt

SEQ ID NO: 5925 - DNA, 735 bp, Medicago truncatula
  Predicted polypeptide sequence is orthologous to G409
gtttacttctctctctttcacaaaacaaaatatttctaactctcaactctccccaaccccctctctaccctcttctctctgaccttctgcccatctttgaaaactcacaagtaaacactcaaccttctctgccctccaattaattacttctgacacccccctttaatatttctcccagtaatgggtatgatctctcctcactcccacaattcccacattatagtaatcctcaacacctgcttctttcgtcataaattctagatcaaattcaaccctttgaaaatcaacatattttttttttacttcttatggggtatgtatgattgtgaccctttaatctaaaactctcttgtaaggctccacacataccaacctacccaaaagttctttccctataaggctgttcttatggcaggtggcaagctttttggtggttctaatatgtcacttttgcttcaaaatgaaagactcccttgtacttctgaagtccttgaatctctttgggttcacacccctgcttcttttcaaggttcaaattcagtggttaattttgagaatggtggtggtagcaacagagtggtaacagatagacccttctttcaacaacttgagaaagaagagaattgtggtgatgaagattatgaagcatgctaccatcaacaaggaaagaaaaggaggctttcaagtgaacaagttcaatttcttgaaaagagttttgaggtagaaacaagcttg

SEQ ID NO: 5926 - DNA, 776 bp, Medicago truncatula
  Predicted polypeptide sequence is orthologous to G450
caaatcacactgaatgcttagagagagaaagaaaaatttagagagagaaaaaacttgataatggaagttgttgcagggatgaaaaaggaggaaaagatggtgtttgatgaaactgaactgaggttaggacttggattgccagggaaaacaacagaagtagtaaggaagagaggtttttctgaaactgagagtgaaagtgaaacaaacactgtggatttgaagcttaatctttctactaaggaaggagcaacagatccacaatttaagccaaaggagaaggctcttctgctctctgattctggtgccaagcctcctgctaaggcacaagtggtagggtggccaccagtgcggtcattccgtaagaacatgtttgctgcccaaaagagcaatgaaggatcagaagaaagtgaaaagaagaatagcaataataatccaataagctttgtgaaagttagcatggatggagcaccttacctccgtaaagtagacctcaagatgtacaagagttacccagagctctctgatgccttggccaaaatgtttaactcctttaccacaggaaattgtgaatcccaaggcattaaggatttcatgaatgagagtaataagttgatggatctattgaacagctccgactatgtcccaacttatgaaagacaagatggcgactggatgcttgtcggtgatgtaccatgggagatgtttattgattcatgccagcgtctacgtatcatgaaaggaaagggaagccattggactcgcaccaagagccatgg

SEQ ID NO: 5927 - DNA, 640 bp, Medicago truncatula
  misc_feature (616)..(616): n is a, c, g, or t
  Predicted polypeptide sequence is orthologous to G450
tgaattgttagagagagaaaaagtgttatatataattaagagagtgaaaaactcatcatggaagttgttggtatgaagaaggagaatatgggatttgaggaaactgagttgagacttggaattggatttcttggaaataatggatcagccacagctactgaaggagttgtaaggaagagaggattttctgagactgaaactgatgatgatacaactactatggatttgatgcttaatctttcctctaaggaagctactgctgaggtagatccaagtgatataaccaccaagactttgcaaaaggagaagacccttttgcctgcagatcctgccaagcctcctgcaaaggctcaagtggtgggttggccacctgtccggtcgtaccggaagaacatgttagcaatgcaaaagagtgaaagttgagaagaacagcagttccaatttcaatgcaattacatttgttgaaagttagtatggatggagctccttaccttcgtaaggttgacttgaagatgttcacaagttactcccagctttctgattccttaggcaaaatttcagctccttcaccattggcaactgttgaatctcaaggaatgaagatttcctgaatganattaatttgatggatctttttaaa

SEQ ID NO: 5928 - DNA, 525 bp, Medicago truncatula
  Predicted polypeptide sequence is orthologous to G450
aactgtgaatctcaaggaatgaaggatttcatgaatgagagtaagttgatggatcttttaaacaattctgattatgttccaacctatgaagacaaggatggtgactggatgcttgtcggtgacgtcccatgggagatgtttgttgaatcatgcaaacgtttgcgtatcatgaaaggaaaggaggctattggtatagcaccaagagctatggaaaaatgcaagaacaggagctagacttgctggtcgcacttgttcgccacctgctccatcttttgtcatattttggtacctgcaggatgttcagtatagttaatttgtgtaatgttatatggtttttattttttgataaaattgttatatggtttgttatacatatataatgtttgaaacaaaatacaatgagagtcttaagtgctgattactttaaacagaaacaataaacgactcccaaattatgttgttagatttggctttcttatatattatctatgatttcctatttaaaaaaaaaaaaaaaaaaaaaaa

SEQ ID NO: 5929 - DNA, 836 bp, Medicago truncatula
  misc_feature (380)..(380): n is a, c, g, or t
  misc_feature (489)..(489): n is a, c, g, or t
  misc_feature (564)..(564): n is a, c, g, or t
  misc_feature (583)..(583): n is a, c, g, or t
  misc_feature (594)..(594): n is a, c, g, or t
  misc_feature (630)..(630): n is a, c, g, or t
  misc_feature (632)..(632): n is a, c, g, or t
  misc_feature (646)..(646): n is a, c, g, or t
  misc_feature (652)..(652): n is a, c, g, or t
  misc_feature (657)..(657): n is a, c, g, or t
  misc_feature (676)..(676): n is a, c, g, or t
  misc_feature (682)..(682): n is a, c, g, or t
  misc_feature (691)..(692): n is a, c, g, or t
  misc_feature (696)..(696): n is a, c, g, or t
  misc_feature (699)..(699): n is a, c, g, or t
  misc_feature (707)..(707): n is a, c, g, or t
  misc_feature (738)..(738): n is a, c, g, or t
  misc_feature (747)..(747): n is a, c, g, or t
  misc_feature (751)..(751): n is a, c, g, or t
  misc_feature (756)..(757): n is a, c, g, or t
  misc_feature (759)..(759): n is a, c, g, or t
  misc_feature (765)..(767): n is a, c, g, or t
  misc_feature (769)..(770): n is a, c, g, or t
  misc_feature (786)..(786): n is a, c, g, or t
  misc_feature (788)..(789): n is a, c, g, or t
  misc_feature (803)..(803): n is a, c, g, or t
  misc_feature (817)..(819): n is a, c, g, or t
  misc_feature (822)..(822): n is a, c, g, or t
  misc_feature (832)..(832): n is a, c, g, or t
  misc_feature (835)..(835): n is a, c, g, or t
  Predicted polypeptide sequence is orthologous to G450
tgattaccgccaagcctcgaaattaaccctcactaaagggaacaaaagctggagctccaccgcggtggcggccgctctagaactagtggatcccccgggctgcaggtcgagtttttttttttttttttttggaagcaatcacataataataataattaaacaaggcaaacctacaatagtatataggtggttaagtttattgcttcttgtcgattacaaatacttaaaattaaagtttgaatctatatacgaacaaaacaaaaacagtgaagacacatccaaactaacactccaatccacaggtagtgcttcatatatcttttcatataggtccactttggtacgggacttcgatataggaggatatgatatgtatttanaccaaattcagcttcggtttttgcatttctccattgctcttggtgcaagtccaatagcttctgatcctttcattatgcgaagacgcttgcatgatccaacaaacatctnccatgggacatctcccacgagcattcagtcgccatccttatcttcataggttggcacatactcagagctgttaanaagatccatcaacttgcgncccttcccaanagttgcgcaaccctgaatggcgaatggcaaattgtnancgttaatattttgntaaaantcgcntttaaatttttgttaaaancaactnattttttanncaantangccgaaancggcaaaatccccttataaatttaaaagaanaaaccgaanatanggtcnnantgttcnnncnnctttggaaccaagaancnnctattaaaaaaacncggactccaaccgnnnaangggcgaaaanccnt

SEQ ID NO: 5930 - DNA, 923 bp, Medicago truncatula
  Predicted polypeptide sequence is orthologous to G451
tatattttctaattgaattagagggttttgccttagcaagatggaattcaaggcaactgagcttagattgggattaccagggacagatgaaaaggatatgaaaacaatacatggtagtgttgttaagaataacaaaagacaattacctcaaacttctgaagaatctgtttcaatttctaaggtttcaaatgatgaccagcatgtggagagttcttctgctgcccctcctgccaaggcaaagatagtagggtggccaccaattaggtcttacaggaaaaacactttgcaagaggctgaagttggtgggatatatgtgaaagttagcatggatggagctccttaccttagaaagattgacttgaggatctatggaggttatccagaacttctcaaagctctagaaaccatgttcaaattgaccataggtgagtattctgaaagagagggttataagggatctgaatatgcaccaacctatgaagacaaggatggtgactggatgctagttggagatgttccatgggacatgtttgtgacttcctgcaaaagactaagaatcatgaaaggcacagaagctagaggtttgggttgtggtgtatgagaaacaactgaatttttcctatgactatatgcaagaaaaagagttttggtgtttaggaaagtcaatctttcaattgctggagctaatggattttgaatcttgatttggaagggagatggaagatactttctacataaactttgtcaacatgtttttttggttattttagcatcttgaagtgatgctatatgctatattgtttgttatttccactgaacattttcaataacattttcagaaatttgcatcaaagcaactttgtatacttatagagaattagaattagaagagtcatgggttgttttgtatcaatatataaaat

SEQ ID NO: 5931 - DNA, 647 bp, Medicago truncatula
  Predicted polypeptide sequence is orthologous to G451
tacaacacttggtatactacactgtattaatcttgcatcaatacaagaaaaaactcggattaacaatataatacatattagcacccttctctatctctttcatttgatagcaaatctgtatgagatggctcatttgaaacatagaaaaaaaaatcagtagaaataattaacagcatagaatagcatctcttcctagatgctaaagtaaccagaaattaatcaatgttgaggaaactaagaaactgcactgtatcttacatttcccttccttagagcacaacttcagatagatatgtatgctgatagcagcatagcatacactacagtgattcaaaaatccatttgtgtagttcttccgataacacaagcagaaaggttctttgttttttcccttcacaccaaaacacttgacttttcatactaactttgctgtttttggttgattctcaaacacctctagcttctgttcctttcatgattcttagtctgttgcaagaagtcacaaacatctcccatggaacatgtccaactaacatccaatcaccatctgtatcttcatatgtaggttcatattcagatccttgataaccttctttctcagaataattacctatggttaacttgaacatgctttccaaagctttgag

SEQ ID NO: 5932 - DNA, 678 bp, Medicago truncatula
  misc_feature (527)..(527): n is a, c, g, or t
  misc_feature (581)..(581): n is a, c, g, or t
  misc_feature (626)..(626): n is a, c, g, or t
  misc_feature (630)..(630): n is a, c, g, or t
  misc_feature (637)..(637): n is a, c, g, or t
  misc_feature (650)..(650): n is a, c, g, or t
  misc_feature (652)..(652): n is a, c, g, or t
  misc_feature (656)..(656): n is a, c, g, or t
  Predicted polypeptide sequence is orthologous to G451
catctattctctttcacatcccaaaagaatttaacagatttcagaattgatctgtagagttttggatttggatttgaaggtgaatttattaaggtagcatcaaagaaaaaaaatattaccaagaaaaatggggagctatattgaaacagagttgattattaatcacaaggacacagaattaaggttgggattgcctggaagtgatgatgaacaatcatgcaatggtggttctattgttagaagcaacaagagatctttttcacctgaaacaagtgttgaagaagagtccatttctaagagctctggtgattctaattccacaaccacaagtgatcgtgatcatgaccaagactctgtccaacctacaaaggtacaagttgttgggtggccaccaattagatcttttaggaagaatagtttacaacaaaataaagtggaagatggaaatggaatgtatgtgaaagtgagcatggctggtgcaccttacttgaggaaaatagatctcaaagtttacaagagttactcanaacttcttaaggttttggaaaatatgttcaagtgtacatttggtgaatattcanaaagagaagggtacaatggatctgaatatgctcctacttatgaanacanggatggngattggatgctantngganatgtcccatggaacatgttata

SEQ ID NO: 5933 - DNA, 836 bp, Medicago truncatula
  misc_feature (100)..(100): n is a, c, g, or t
  misc_feature (237)..(237): n is a, c, g, or t
  Predicted polypeptide sequence is orthologous to G489, G714
ctgcaggccattatggcgggatcatcacgtacgagaacattccgaaacgtgcttctgtggcgttcgacaaacttgaacactctcgtgcaatcatctctcngcaagcatcacccactcaacaaaagaatggatcatcaaggtcatggccaaaacccaaatatgggtgttgttggtagtggacaaatggcccatatggtctaatccataccagccaaaccctatgactgggtcacctgngatggttgttccctctgttgggactattcaacctggtggtcaaccagatggaactcagctgggacaacatcagcttgcttatcagcacattcatcagcagcaacagcagcagcagcaacaacaactccagaccttttggggaaatcagtatcaagaaatcgagaaggtaactgatttcaaaaaccacagccttcccttggcaaggatcaagaagattatgaaggctgatgaggatgtgaagatgatatcagctgaggcgcctgttgtatttgcaagggcgtgtgaaatgttcatattggagttaaccttgcgttcttggaatcacactgaagagaacaaaaggcgaacccttcaaaagaatgacattgcagcagcaatcacaggaactgatatctttgatttcttggttgacattgtgcctcgggaggacttgaaagatgaagtgcttgcatcgataccaagaggaccaatgcctgttggagggcctgctgatggaattccttattgctatatgccacctcaaaatgcacagcaagctggaaatcctggtctcatgatgcataatccaaacatgtatgctccacagtctcatccgtaca

SEQ ID NO: 5934 - DNA, 784 bp, Medicago truncatula
  Predicted polypeptide sequence is orthologous to G489, G714
tagaagtctgcaagtacataatatatatcatccgaagaccataaggtttaaacccatattacattttacccagcttaattaaacataaagataagttattactggcatattatctacataatagtctgcaatgcaagtaaaccatctcagctacagtttctgatcgcaccaatggaacagtttcacccccacccccattgcagttccctgcaatcttaacatccacatctcagcatctagtgatctggagatggtggtcgctgttccggaggctgtggccacatttgtggtgccatgtagggatggggctgctgagcatacatgtttgggtccatcacaggcttgcccattatgacaccagcagttccaacttgggaggcatgctgaggtggcatgtagcagtaaggaagagcatcagcaggcccagcaacaggcattgttcctcttggaattgaagccagcacttcatctttcaggtcctcacgaggcacaatgtcaaccaggaaatcaaagatatcagtcctagtgattgcagcagcaatatcattcttctgaagtgtcctccttttgttctcctcagtgtggttccatgagcgcagggttaactccaatatgaacatctcacaggcccttgcaaatatgacaggtgcttcagctgatatcattctaacatcctcatcagccttcatgatcttcttgatccttgccagaagaaggctgtggttcttgaaatcagtaaccttttcgatttcctggtactggtttgaccagaaggattgcagct

SEQ ID NO: 5935 - DNA, 666 bp, Medicago truncatula
  Predicted polypeptide sequence is orthologous to G519
gcacgaggcaaacattaaaaatttagaaagaaaaacacgttttgttttcttcatcaattgttctttctttgttttatcattattatgggagttccagagagagatcctctttcacagttgagtttaccacctggtttcagattcttccccactgatgaggagcttcttgttcaatatctatgtcggaaagttgcaggacatcatttttctttgccaattattgctgaaattgatttgtataaatttgatccttgggttcttccaggcaaggcgaattttggtgagaaagaatggtatttcttcagtccaagggacaggaaatatccaaatggttctacaccaaacagagttgctggttctggttattggaaagccacaggaacagacaaaattatcacaactgaaggtagaaaagtgtggcataaaaaaagcacttgttttctacattggcgaagcaccaaaaggaacaaaaactaattggattatgcatgagtatcgtcttcttgacgcttggcgaaaacacaatcttggtagctcaaaacttgatgattgggttttgtgtcgaatatacaagaaaaactcaagctcacaaaaggaaattccaacattttcaagcaaagaatgctgcaatgcttcttcgccttcatcgtcgtcccaagtggatga

SEQ ID NO: 5936 - DNA, 809 bp, Medicago truncatula
  Predicted polypeptide sequence is orthologous to G519
acaactttcaactcagaactagcagagcaaagaacatcatcaacaacaattatcttcttcaataacatagtcaacgtttcaacctttcagtcaaactagtattaacacaaagaacaagaacacaagaatgcaaggtgaattagaattaccacctggtttcagatttcaccctactgatgaagaattggtgaatcactacttgtgtcgcaaatgtgctggtcaatctatttctgttcccgttgtcaaagaagttgatttgtataagtttgatccatggcagcttccagaaatgggttaccatagcgagaaagaatggtattttttctctccaagggacagaaagtatccgaacggttcgaggccaaatcgagctgctggaagtggttattggaaagctactggagctgataaaccaattgggaaattgaagccgatggggattaaaaaggcgctagtattctatgccggtaaagcccccaaaggagttaaaactaattggattatgcacgaatatcgtcttgccaacgttgatagatcagccggaaagaaaaacaacttgaggcttgatgattgggtgttgtgtagaatttacaacaagaaaggcaagattgagaaattcaatactagtaacacgccaaaggttcaaaattattatgaacatgaagaagtagaagaacatgagatgaagccagaaattcaaaagttggggaattaccaactgtacatggacacttcagattcagttccaaagctgcacacggactctagcagctccggtgggcacgtggtttcaccggatgtcacgtgcg

SEQ ID NO: 5937 - DNA, 827 bp, Medicago truncatula
  Predicted polypeptide sequence is orthologous to G519
tgcaccgtaggttcttcttagtattcttcatttcataaactagggagaaccatacatacaatatagattgattaaattcaaaaatcatcaaatcttattagcaagcaaattcagtttagcaattatagctgaaaaaacaatggcatccgagcttcaattgccaccgggcttcagattccatccaacggatgaggagctcgtgatgcactatctctgccgcaaatgcacgtcgcagcctatcgccgttccgatcatcgccgaaattgatctatataaatatgatccttgggacctcccaggtatggctacttatggagaaaaggagtggtactttttctcgccacgagacagaaaatacccaaacggttcaaggccgaaccgggcggctgggtctggatattggaaggcaactggggcggataaaccaataggtcatcctaaaccggttgggatcaaaaaagcgttggtgttttacgcgggtaaagcacctaaaggtgataaaaccaattggatcatgcacgagtatcgtttagctgatgtagatcgctccattcgaaaaaagaacagcttaaggttggatgattgggtgctttgccgtatttacaacaagaagggtacaattgagaaacaaccaagcaacagtgttgtcaaccgaaaaactgaacattctgaaattgaagacaggaagccggagattgtgacacgtggggggcggtcttccgccacatccaccgccgcaaactacggctggaattagggattacatgtattttgatacatcagattcgattcctaagctgcacaccgattcgagctgttcggaacag

SEQ ID NO: 5938 - DNA, 787 bp, Medicago truncatula
  Predicted polypeptide sequence is orthologous to G519
cgacgcgaatgcaaggagcattagagttaccacctggcttcagatttcaccctactgatgatgagcttgtgaatcactacttgtgtagaaagtgtgcttcccttccaattgctgttcctattatcaaagaaattgatttgtataagtttgatccatggcatcttccagaaatggctctttacggtgagaaagagtggtattttttctctccaagggatcgaaaatatccaaacggttcacggccgaaccgggctgcgggaaccggatattggaaggcgaccggagctgataagccgattggaaagcctaaggcacttggtataaagaaagcactcgttttctatgctggcaaagctcccaaaggaattaaaaccaattggatcatgcatgagtatcgtcttgctaatgttgatagatccgcttcaaaaaataaccacaatttaagactcgatgattgggtgttgtgtcgaatttacaacaagaaagggaagattgagaaatacaatgacacaaaaccaccaatgttttctcaatttgagaatgagacaaagcctcatatcaagatgaacatgaacggccaggatgatcaattgtacactgacacatcagattcggtgccactgtttcataccgactcaagcggttctgaccacgtggtttcaccggatgtcacgtgcgataataaggaagttcaaagtgagcccaagtggaatgaatttgttctgggctcagacccagtttcagcctttgattttcagttgaatcttatggatgatgctgaagatga

SEQ ID NO: 5939 - DNA, 843 bp, Medicago truncatula
  Predicted polypeptide sequence is orthologous to G525
cttttatatataattcttctctgtttcatcactaaaacctttgatttgaggttttgaacaaggttttagaggttgacccttttggttaccttgatcaagatggaaaacgtttcagtcttatcaaataaggaagatgagaagatggatttgcctcctggatttcgatttcacccaactgatgaagagcttataagtcattacctctacaaaaaggttattgattcaaatttctctgcaagagccattggtgatgtagacctcaacaagtctgaaccttgggatttaccatttaaagcaaaaatgggagaaaaagaatggtactttttctgtgtgagagacagaaaatatccaactgggttgaggacaaacagagcaacagaagcaggttattggaaagcaactgggaaagataaagaaattttcaaagggaaatcgttggttggtatgaagaaaactcttgttttctacaaaggaagagcacctaaaggagaaaaaagtaattgggtcatgcatgaatatcgacttgagggtaaattctctgttcacaatcttccaaaagctgcaaagaatgaatgggtgatttgtagggtttttcagaagagttcagctgggaaaaaaacacatatttctggtataatgaggttggattcacttggtaatgaatttggttgttctgttttaccaccacttactgattcgtcgaattcaattgggaaaatcaaacaattgaatgattcagcttacgtgtcctgcttctccaactcaattgatgttcaaagaaaccaaggaggggatcttgattcattcaacaactcaatttatggtatttcttcacataatcaa

SEQ ID NO: 5940 - DNA, 832 bp, Medicago truncatula
  Predicted polypeptide sequence is orthologous to G562
taaccttaattccttctccaaaattcaatcttgtttgctttaaattctgttaggtgtttgcaatgggaaatagcgatgaagagaaatctaccaagactgaaaaaccttcttcacctgtaacagtggatcagaccaaccagacgaatgttcatgtctatcctgattgggcagccatgcaggcatattatggaccaagagttgccatgccaccttactacaactcacctgtggcttctggtcacactcctcacccatatatgtgggggccaccacagcctatgatgccaccttatggacatccttatgcagcaatgtatccacatggaggggtttatactcaccctgcagttcctattggtccacatccacatagtcaaggaatttcatcttcacctgctactggaactcctttaagcatagagacacctcccaaatcatctggaaatactgatcagggtctgatgaagaaattgaaagggtttgatggacttgcaatgtcaataggcaatggccatgctgagagtgctgagcctggagctgaaagcaggcaatcacagaggttcgttgatgttctatttatacatgaagttttccaagagcatacatacatcctatttatctttctctctgttgataagattggtccatttgtttgttattgtggataaccaagtaactttatgatgatatgaacagtgtgaatactgagggttcgagtgatggaagtgacggaaacacttcagggatggagaagggaaaacaaatacacaaggtagtcaaatttccaaagaaattgcagcttctgataagatgatggcagtagcccctgctg

SEQ ID NO: 5941 - DNA, 806 bp, Medicago truncatula
  Predicted polypeptide sequence is orthologous to G562
tatcagataccattataaggtgcacaccaatcattaatacacacaccataatatattatgcgacagtttcaacatccctctctaaactaaaatatctaattttcttgattatacaaactttagtagtcatccatatttgtcaaatctaaatagaatatagttctctttcctaagtaactgatgatgaacaatgaattagttctggttttgatggatttagatactaaaattcagctgatccatcccctcagaaaaactgttagcagtagttttgggtttgtaatatgccaaaactacatgatcatggttttttgtatcaaccagcagccacagcatcagctctaggacttgcatccaatagttggtgcaacttcgcaccagaatttggtttgttgtcacaataaccattctcatcctccacagttctatcattagaacccgaattgttattaactcttgataataagttttctgtacttacaggtgtggtcctctggctgtcaatgttggtcaaaattatctctttcggttgtcccagtttagcaattttaaatttttcctttaatgcagcattttccatcctcagtctttcagaattctcagcaagtcggtttatttctgatctaagtgacgcactctcagcattcaaggattcaacttttcgtgccagttcttcagcctcagcctgcttccttagtctgggacttctagcagattctcgaattgattgtttcctcctctcacgcttcagttcacgctcattctgtatcaagcctcgggaggcatacagcagaagttgtggggta

SEQ ID NO: 5942 - DNA, 677 bp, Medicago truncatula
  misc_feature (570)..(570): n is a, c, g, or t
  misc_feature (639)..(639): n is a, c, g, or t
  Predicted polypeptide sequence is orthologous to G591, G793
aagaacaaaaagctgaaaaagcttacaccaccactctcttctctttctcttctctccttcttctttctcactcacttgttttagtttattgatttcttccataatcaatcttctaattaagctacaaaacaaaacaagacattcttgggaagcatacccttaaattctattccattttcaggtcctagggtttcacacacaccacgtaaggaaaacatctctccttgtttcctgctttttgtgttttccattttcacacttgacaatagaacaaatgctgcagtattgaaaaaggttacactaccactacacaaaactaataacctagctgaaaaaagaaaagaatcttagacatggctggtaattgttcagaaggattaggtgatgatttctttgagcagatcttagcagtgcctgagaacggagttggatatggaggagtgttgcaattagggtccacacctcatggtggttctttgagaggaggaggaggaggaataatgccattagggttgaatttggagcaaaatcatcatgggtttctcaggcagcatcaagatggaacacggnttgttgataacgttgttgatgttgaaggaaatattaccaataacacaacaacaaccatcatcatcttcntctacatgatatcaataatcattaccaccacaacattt

SEQ ID NO: 5943 - DNA, 679 bp, Medicago truncatula
  Predicted polypeptide sequence is orthologous to G591, G793
ggctgaactcaaacaccattttcaactagtcactcagaaactaatgacaacaacaaactgagtagaaaataagcagagagaaaacaacaactacaaattttcttttcttttcagttatggcgaatcatccttccgatacacccgccgacgatttccttgaacaaattctcggtctcccgaatttcacctccgccgacggaaccgacgcttctccgatgatgctgcaacttaactccggcgacgcggcctctcaccttggcgccggaggggggtttcatgcaccggtttatcatttgggtttgagcttggaccagggtaaaggaggagggtttttgaagcctgatgaagcttccgggagtgggaagcgtttccgggaggatcttgttgatacaagacctaagaatacttttcatggacaacccatgcctactacagttcctgctgctccacaaccaccagcaatgcgtcctagagtgcgggcaagaagaggacaggctacagatccccatagcatcgctgaaaggttgcgcagagaaagaatagctgaaagaatcagggctttgcaagaacttgttcctagtgtcaacaagactgatcgagctgccatgctagatgaaattgtggattatgtcaaattcttaaggcttcaagtgaagggtttgagcatgagtagattggg

SEQ ID NO: 5944 - DNA, 607 bp, Medicago truncatula
  Predicted polypeptide sequence is orthologous to G598
accatttccattcactaacaacctcaaaacacacacactatcactataccatgcttgaatgaaatctcttcactttgttgtttcataacaaactttccctccgtactattgagattgtacacatgttgaataataatctaaatacttccaccagccatatatcagaggaaaaccaagaagatgaacaaataacagaaataagagaaatccatgccttaacaccacctcgtcttccacctcctccaccaccaaccaaccgcggcagccatagccaccgttcatcatctctatccatggctagcacagatagtgaaaacttcacaactataagcagagaattcaatgctctagttctagcaggatcaactgttgaccacaacaacataagtcctcatgaacatgaaacagctaacaacaacaataacaataacagcaacaatttgaggaggattagagaagatgatcatatgatggaagaaaccaatcctttggcgattgtggtagataacagcccttttgatcctattccatctcctactagcagaagaaatatggctagtggaagttcacgtgcaagtggtcaaggtggtagtgaagaacatgtgtc

SEQ ID NO: 5945 - DNA, 457 bp, Medicago truncatula
  Predicted polypeptide sequence is orthologous to G635
gatgaaagactaagaattgcattagacggcatcattgtagttagcatggaagtatgtcgcgctcaaagtttagacagttcggttgaaaaccccttaaaaggaaagataagaattaccacaagatgcctatggcttgacaaagggaagctgttggacgcactccataaagctgctcatgcttctctttcaagctgccctgtaaactgcccactggctcacatggaaaagactgtgtctgagatgttgaggaaaatggtgaggaagtatagtggcaaacgacctgaagttattgccgtcgctatagaaaatcctggagctgttcttgctactgagataaacacgaagttatctggaaaatcctatgtaggtgggatatcaacatttagaaatgtggtgcataaagaaaatcaatccaccaaaatgcaaatgagaggagatcaaaaaaaaaaaaaaaaaa

SEQ ID NO: 5946 - DNA, 683 bp, Medicago truncatula
  Predicted polypeptide sequence is orthologous to G653
agaaaatgcaatgaaaattacatcatgaaattggaaagatacattttgcaagtcaatctctcatgtcagtactgaatgtgcactggataaataaatcacacaagatttgcacaccacacatgtataagtaaacatcagaaaaatgacaagtaatgatggaacaattatgaaggaaaaagaaaaccacacatacaacaaacacttgcttgaaagatcaaaataccctcttctttcaaaacagaacaaaggcaattagaaggcaccaacattcaagattctggaacggaggctgctgcacgtttgattgatgcagacttgataagatgattgtagctccctttctccttaaaaagctgagagaaatggtgcttgcaatacaaaatgccctcaagggctgcataatttgatggagttataggacaaccaccgtgtgaacacttgaaacatgatttgtgataggcctggctttctactgtcaccttctccaatggataagcagttttgccacatgtagcacacttttcttgggtcccagaaaacatgcccgcagctttgctaggggtccttgtcagcacaggggttgtaccgtcagctacctttgcagctgttcaaaataatactatagccggttaaagagggcactgactgaaaaattttacaaaatagctttattatccctgatg

SEQ ID NO: 5947 - DNA, 705 bp, Medicago truncatula
  misc_feature (568)..(568): n is a, c, g, or t
  misc_feature (668)..(668): n is a, c, g, or t
  misc_feature (691)..(691): n is a, c, g, or t
  misc_feature (703)..(703): n is a, c, g, or t
  Predicted polypeptide sequence is orthologous to G666
ccaagacagggttgtcaagatgcagcaaaagttgcagacttagatggactaattacctaaggccaggaatcaaacggggtaaccttcactgaacaagaggagaagatgattatccatcttcaagatcttttaggaaatagatgggctgcaatagcatcataccttccacaaagaacagataatgacataaaaaactattggaatactcatttgaaaaagaagctaaagaaatcacaaacaggtaataatgctgaatgcattaattttgaagaagaaaaattttcagcatctcaaagaattccaagaggtcaatgggaaagaagacttcaaacagatattcaaatggccaaaaaagcacttaatgaagcactttcaccacaaaaattatctcctaacttttctacttcaaaccctacaaatagtaacctcattttcttccactaaagaaccaggtcaatcgttttgctatgcttcaagtgcagataacatagcgcgtttattaaagggttggatgaaaaatccgattaaatcatcggtaagtactaattcagttggtgacacaaaattnccttcaacaaactttgattctgcttctagtagtggaacaaaggggtgaaatattggtctgaacatttgaatctttgtttggttttgaccctttaaagtcnttggagtcatcgaattctgaatnttctcatcaggnct

SEQ ID NO: 5948 - DNA, 822 bp, Medicago truncatula
  Predicted polypeptide sequence is orthologous to G666
attttggtatttccattcaagaactggacctggaaattggagatcagttcccaccactacaggtttgatgagatgcagtaaaagttgcagacttagatggactaattatcttagacctggtatcaaaagaggtaatttcaatgaccatgaagaaaaaatgataatccaccttcaagcgcttttaggaaatagatgggctgccatagcttcctatcttccagaaagaacagacaatgacatcaaaaactattggaatacacatttgaggaaaaagcttaagaagattaatcaaacaggtgatgaaaatgaagtagaagaaaactctattcctcaagtaaaaggtcaatgggagagaagacttcaaacagatatccatatggcaaaacaagctttgtgtgaggcactttctcttgacaagccaacacctattttagctgaaaatcaaacatccccttatgcatcaaacaccgaaaacatagctagattactcgaaaagtggatgaaaaaacccgaaaattcagtcgagacaacaaattcaggaaactccattatggtagtaacaggatccggttctagggaaggaggacagaatactatagcatgcaaacaaaaagatcaagcatttgattctttggtgagttttaattcattaaattctgattgttctcaatctgtgtcggtcgaagaaaaaatttcttggcaatggattcatgcttttttcaatatcaaagtaagccaaaccaggaaactcaagaccctctcatgtttatggagaaattggccttttgatgatgaggctgctcagtggcatgaagatctaat

SEQ ID NO: 5949 - DNA, 684 bp, Medicago truncatula
  Predicted polypeptide sequence is orthologous to G707
aattatgataaaattgtgtcatattccactattcctttcattgatgttttttcaactaggggaaacaaacaagagtcaatacccgaaccacgatccttgccttgtgttaaggaacctaaccctaaaaagatagatatccttaccaccatgcaaggaacctttttctttttccatgagtggttcgttcttgactcaaacacaccccaaatcccaccaattacatttttacccttttctttcatccattaccaaaacaacaacaacaaaaacaatagcaatagtagtagatatagaaaaacaaaaaatttaagaaaaaccacttaagtcacgtgactcagctttcacattgaagtgctgctttgattttctgaacagtgcatgaaatgagattgttcactgtttcaactgactccacggtgagttttgctgtaggaagactattcacaaggatttgaaacgccaccgttaaaagggacccacttacacgcgcctcgccacctccatttgcggtcgcatcgccattctctagtccacgtgacccaggaccatcagggacgatggcaaagccggagggtagtaatgcaacataagctgaatcgccaccattcatgacaacatgcatagctggaatatcgaccggcgcatagacaacaagcgaccccgcttcggcaatacatgtttctt

SEQ ID NO: 5950 - DNA, 722 bp, Medicago truncatula
  Predicted polypeptide sequence is orthologous to G720
ggggccattctggttatcccgtgtggcagcctacagaaagttggcattggaaaccatttccggggatgcatccagatgcatggggctgcccggtgttacctccacctcaacctccttgctattcctactctcaggatatacctgcagtgagtaacgctaatgcaatggactacacatttagcatgatgctacatagttcctttgacgattatccggcagaggaggttattgacaatgttgtgaaggaggcaataagtaagccatggctacctttgccaataggcctcaaacctccttccacggatagtgtgttggctgagctttcaagacaaggcatttccagcatccctccaagctacaatggttctattccctattgacatttacaaccaaaaactggttctgatggtgacaaacttctatacaaaaagggtccactagatcatgaccccattgttatttttttagtttctcaaatttatcaagttccaagtagtaaattgaccgggaataggagaatggggaccattttgttaagtcatattaggttcccccctcccacatcacaccaccaacaaccacttcatacaataccttgatgcaacaaccaagtagaagtcatgcagcactgacacttgacgtgtccggtgtccgacaccaacatatgtgtccaatgtcaacgtgtttgtgtcagcatcgtgtatgatgtttgtggttgtcta

SEQ ID NO: 5951 - DNA, 613 bp, Medicago truncatula
  Predicted polypeptide sequence is orthologous to G720
gaataaacaagccatggctacctttacctataggcctcaaacctccttcaatggatagtgtgttggatgaactttccaaacaaggcattccttttagcaagaagagcaagggctctagaccatgctgacttgtccatgactcaaatgggtcccaccaaacagtgctagttactgttgatggtggtggacagacaaacttgctggcagacatgcatgggccaatgccatatggactgttgtaataatcttgtatctctcaattttaccctcttaggctccaaccaaccagaatggtagattagattaagttgggaccagttatttttcccctgtggtccctaccataacacagacaccttatgtagcttctgggaaatgacatacaatgatgcatgcaacaaatggacatgacatacatggatgatgatggatgatatctattgcaacttgctaaaaccaaaaaaataaataaataattggtagctgaaaaatggccacacatttgttgaattgaatgaagctattgtgcaaaaatgttgcatgtggttgaaaataagttcagatacaaaatattgatggagattgtgaccatcaattgaagtttgtacctatc

SEQ ID NO: 5952 - DNA, 716 bp, Medicago truncatula
  misc_feature (698)..(698): n is a, c, g, or t
  Predicted polypeptide sequence is orthologous to G720
ggaagattacttgatgatggggattgccaagagcagactaattgctccacggaaaaagaaagtggggaacatgatggagaatctaaatctgtcgaaattacatgtgaaaatttgaatgctgaaagtattactcaacaaacgaaatctgaagctactttggttcagaaggaagaggaggaatttgccgacgcttctaagtgtgagagtgttgtttcaccacagttaccaaatgtgaaggttctaaacaacagtgaaagtaatacaacgtctgcaaacaaagtagttgttcgtagtcataaatgtgaaataaaagctaatcggaagaagatgaaagtagactggacgccggagctgcacaaaaaatttgtgaaggcagtggagcaactaggcattgatcacgctattccttctcgaatattggatctaatgaaagtggagggattgacaaggcataatgtggcaagccatcttcagaaatttagaatgcataagagacatatcttgccgaagcaagaagatcggaaatggctaaatccaagggatccaactcaaaggaactattgtcttcaaagaccaattatgcccggtcctccatcatattattctaaccatacccttcctcctctagctcctttatatcccatgtggggacaatctggaactcaaccgctggcatgcaggtttggggccattctggntatcccgggtggcaacct

SEQ ID NO: 5953 - DNA, 772 bp, Medicago truncatula
  Predicted polypeptide sequence is orthologous to G720
agaagattttgccaagggttccaagggtgagggtggtgcttcattgaatccacttaataaaaattttctcggcgacgctggtggcaatacatctctgaataaaacaagggtttttaacgatccgtgtgagaataaagctaatcggaagaagatgaaagtagactggacagctgagctgcacaaaaaatttgtgaaggcagtggaacaactaggtattgatcaagccattccttctcgtatattggagttaatgaaagtcgacggtttgacaaggcataatgtggcaagccatcttcagaaatatagaatgcacaagagacagatcatccacacggacgaagatcgaaaatggccaaatcgaagagatcctgcaaaggaactattgtatgcaaagaccgattatggcttatccaccatatcattctaatcacacctttcctccagctcctgcatatcccatgtggggccaacatggaagtcaaacagctggtgtaccgatttggagtcctccgggttatcctctatggcagcctacagaaagttggcattggaagccatatccgccaggggtgcatgtggatgcatggggtaacccaatgttgcgcccacctcaaactcactgtattccatacactcaaaatatggctgggatgcacaatgctaaagcagtggattatagttatccggcagaagaagtggtggacaaggctgtgaagggaggcataaacagccatggctacctttacctataggccctcaacctcttcaatgg

SEQ ID NO: 5954 - DNA, 841 bp, Medicago truncatula
  Predicted polypeptide sequence is orthologous to G732
aaaacttataatataataataatctaatataaaatgaaagcaattgacaatttgacattacaactaaacaaaaatataaaaatactagagacaagacaagcaggggttgttacatgttacaatcaactagctagcacacagaagcaaccaaaagccgttgatacataatttgtcatcaaaattattcaccaatcaatacattaacatatgatccgaagaagccatgattggttgttgattaacaggaaaagtgttccatgtgtccgagaatccacaatcattgaacaattgatctgtctcctgaaagagtgagttacttgattcaatgtaatgaataatatcattaagtgattgcaacctgtggctaagttcagccatttgaaccctaagaatagcattttcagattccacgttcagatacatctgagtagttactccaacgtttgtgcttatttgaatattctcttttttcagctgttcaatttggttgcttagatcttccatatgttgttgtttcttcatccttgatcttcgtgctgattctctgttggattgcattctcttcctcttcttttgatctgttatgttcacctgcacgtgattatgatctccctctgatccagagttttgaagagagcttgtgccagatgaataagttccaccagaagaagccatatcaattgcagttcccgatgtgtttgttaaaaactaaaaaactttgatgtgatcgtgggtatagtactatttttctaactatgtagtttaaattgatatgttgatagaattaatgaactaatttgtattgaaagaaagatatagattatttataattcctgagaaa

SEQ ID NO: 5955 - DNA, 854 bp, Medicago truncatula
  Predicted polypeptide sequence is orthologous to G748
ttaagaagaaaaaaatgattgaaactaaggaccctgaaattaagctctttgggaagaagattctttttcctggggaaggtgaagctcttatgattgatggtgaggaaaatgtttcgcccgcggcggctatggatgtagaagaagaaagagatagtgagtctgagaatgaagatgatgaagaagaaacggagaaggatcctgaagcagataaagatactgaggaaaagaaagaagctgatcctccaccagatgcagcagagatcaagaacaacaacaattcagcagcaacattaccggagggtaacccaaaaacaccttccatagatgaagaaacttcaaaatccgaaaacgaacaaagtgaaacaacagcaaacaacaacgatactcaagagaaaacactaaagaaaccagacaaattactcctgtgtccacgctgcaacagcgcggacacaaagttctgttactacaataattacaacgtcaatcagccgcgctatttctgcaaggcgtgtcaaagatattggactgcaggtggaaccatgagaaatgttccggtgggtgcaggaagaagaaaaaataagaacaactcttcgtcgcattatcgccacatcaccatctctgaggctcttgatgcagcaagaattatttctcctaatggaactcatcatcttcaaaatttgaaaaccaatggtagagttctcaactttgggttggatcatccacatatctatgattcaatgtcaaatgatctcaatcctgcagagaaaaaggttcttaacgacactcgaaataatggtgatcgttttttcagtgcgtcttctgttacagtttcaaaatccatggaggaaagtggt

SEQ ID NO: 5956 - DNA, 760 bp, Medicago truncatula
  Predicted polypeptide sequence is orthologous to G748
ttttcggtctcatatatatatattttctatatgtacatcaagatatttacccaacatattatcaaatctgcaacagaaacacctgttcagttaggcaggctcaagatagcagctactgaggctaaacagctaaagtacaacactgttgtcctaggactcttgcatggaggttggtcaactatacttccttttgagcataataaagatcaagaacttgtcagcagaataaggttgcattgatatagctacaattctcatagcagtgtaatctgatgtatttcaatgcaattcacaactaggtttcctcatgaaaggtacgagaccgcgataaagccgcagggttggcatacatcagcggtgacgttccaaccgagtgattcatgtcctttcccttggactgaaatccattgaacatgcctcctccattgagagaattggccttgtcattattgatcccaagctttgaccataatgaactctttgcagcttcacttgggtcatcaaatctaagtgtctttgggatcaaaacgctgctttcggtactattgtgttcagtttcaggcttttcttttggtgagttgactgaggtaatgatgtttccatcccttgagtgtttccccaaagtcggtacagaactatgagcagagtcactttcattaacagaagcacttcctggtgagatgcatggtatattccatggaggtggcatacaaccccaatatgcaggtggagttacgggagtatagatgctaatggatag

SEQ ID NO: 5957 - DNA, 703 bp, Medicago truncatula
  Predicted polypeptide sequence is orthologous to G748
cttaaagagtgccccggagacactcgttaacaagaccccttcctttatcataagaaaataataaagtaaggagctcaagagtgaagagaacaagcttatatttacatgtacatcaactcaaacagaacaagcttagcacataaaataaaaacacctatttatagtgttacacaaaaagagacaaaattagttcccctttcttgtgctgagactaccaaccaaatgcacattggtgagaaagatggtcactgtctcaagagaagaagtgactaacctcaattctcaaacacaatacaaaaaggattatttcttatttaagagttctcatggaaattaagcgatctagctaaagctgcagggttagccatcaacattggagaggtttgaacatggtttttaccatctttctttgattgaaaagccttagtcataccacctctactcaaaccttcattcttaattccaagtgtttcccaaattgaactctttgcagcttcggttggatcatcaattcgcaatgttttaggaaccaaaacacacccatttctttgttttggtgattcttctgtttgcaaactgtcttgtttagcattttcgtcgttggtgttgtcatcgtccctcgagtgtttcccgagcgttggagatttcggactagatcttggagttgtcgcgggagtatgaggcggaaaccaaggaacattcc

SEQ ID NO: 5958 - DNA, 676 bp, Medicago truncatula
  misc_feature (550)..(550): n is a, c, g, or t
  misc_feature (675)..(675): n is a, c, g, or t
  Predicted polypeptide sequence is orthologous to G783
tttctctctcctctgccctaattctaatttcaaattaaattaaaatctctttcattttcatttctcgattccaaatcaaacttcttcatccttcaaccttgattcatacttcaatcaacatattctaattccattccttctgattattcttccacgaaccaggaaaattgttgctgaagaattgaagacagggatagctggttttgttcatatgggatcggagagtgttgctcctatgattgagccatcaaataacaggtctgatcctggtacaatgaagcaagggaaagtccctaagagaattcacaaggccgaaagggagaaaatgaagcgtgaacatttgaacgaactcttccttgatcttgccaatgctcttgatctcagtgagccgaacaatggaaaggcttcaatattgatcgaagcttctagactgctaaaagacttgctctgtcagatccagtccctcaagaaagagaatgtctctttattgtctgaatctcattatgtgaccatggagaaaaatgagctaaaggaggagaatagtagcctnaaaactcaaattgagaagcttcaaggcgagatacaggcaagaatagctcaatctaaacctgacttgaatgcgcctcctcaattagagcttgagtcaccagagcagacaactttttcaggacagant

SEQ ID NO: 5959 - DNA, 812 bp, Medicago truncatula
  Predicted polypeptide sequence is orthologous to G8
ttatgttcttacataatgtcttgaatttattacacttaaattatcaaagctcattaggattctaaccaatacgtttctctctttccggaaatcagggcttatgacaaagcagctctaaaatgcaatggaagagaggctgtgactaacttcgagccaagtacatatgaaaatgagatgaaaccgggagctattaatgaaggtggcagtcacaatcttgaccttaatttgggcatggcgactccaggacatgaacccaaagaaaacaaaggatattgtcaatttcagaccgtcccttcttacaacatgcatcctggaaggaatttaaagatggagactaatgttaattcagttattggtgacccgtctttgaaaaagctggttgtaactgaacagcgtcctcccatgtggaatgccacgttttctagtttctttcccaatcagcaggaaagggcagagagaattggcattgatccttcaaaaggacaccccaactgggggtggcaagggcataatcaaggcactgtttccccagtaccacaattctcttctgcagcatcatcaggattctccatttcagctacctttccaccaaatgcaatctttcaaacacaaccaatcaactcaattccccagtcactctgtttcactcctggtagcaatgcatcatctcaatactattaccaggttaagtcctcacaggcaccaccatagcctatattctgtatttgtaataataatacaagatatatgaatggcatgacgcaacaagcttttgcgttaaaactcaattgtataattcagttaggatttga

SEQ ID NO: 5960 - DNA, 800 bp, Medicago truncatula
  Predicted polypeptide sequence is orthologous to G896
ctaaaaattggcatgaaaaacaccatgttgaatatcagttgtcagcacaatagggataatcctattgctaagtacactaagacaaaacaagagctggttagcctggaattgcagtctattacatctgctaatcctggattaaaggatggtgatgatggcgaacacaaggacaaaacattgataaacaacctacctggtaacctttcaggaaatgggaatggatcgattttcattagcatctacaaccacaattacagcatgcaatatcctcctactacgtacgaaatacctgtccattcctattatcctccacttaggcctccttctgcatttggtaacaagagggctgtgttatttggaatcagttatgctaacacagcgacagcgaagaagcttaaaggttctgtgaataatgctcggtgcatgaaacattttctgattgacaagttgggatttcctggaaattccatttgcatgctcacagatgattcagaagagaaaaacacaattccatcaaaaagtaacatgcggatggccatgaggtggttggttgagggctgcaaacctggggattcattggtgttttacttctgtggtcatgcatcaagggttaaagaccgtaacgtggatgaggttgatgggtatgatgaagcaatatgccctgtcgattatgagcaggaggggatgatactcgatgatgaatcaatgctacaattgttaggcctctacctcatggtgcaaactacatgcccttgttgatgcatccttagcgggacaatcttgacatacatttgtatgca

SEQ ID NO: 5961 - DNA, 717 bp, Medicago truncatula
  Predicted polypeptide sequence is orthologous to G896
catcaagccattcctctttgttgttgtctacaactacaatcggtaacaaacgcgcggttctatgtggagttacttacagaagaagacggtacatgctcaagggaaccgttaatgatgttgttaacatgaaaaaactactgactaataattttgcattcccaatagaatccatacgcgtcctcacagaagaacagaaagatctaaatttcctaccaactaagaggaatataatggaatccttaaagtggctggtgaaggactgcaagttcggagactcattagtgttctacttctccggacatggtacgcaacaaccggcaatagacaaagatgatgaacttgacgggtttgatgaaactatttgccctgttgatttcattagagaaggaatgatcactgacgacgaaatcaattctaccattgttcggccactcaaggaaggtgtcaaacttcatgctattattgatgcttgtcatagtggaacaactcttgatctcattgataattggaaatggatgaataacattccccctagcatagaccctgtcactaaacgtacaaatggtggagtggccatttgcttcagtgcttgtgaagattgtcagatggctgccgatactgcagcttttggaggaaaagagatgaacggtgttatgacctatcttttaacaaaaaatatccgagaacatttctgaatacatatgtccggtttgctag

SEQ ID NO: 5962 - DNA, 556 bp, Medicago truncatula
  Predicted polypeptide sequence is orthologous to G896
gcacgagtcgagttttttttttttttttttataaatcaacgaaaaaatagatgataatgttattcattttttgaacacatgacgtaattcatgagatataagagaaaacattcataaattgcagaggtgtatttttaggatgaaattccagagctagctcagttttcaacttttcattagacactctttcaaagttacaaatcaatatttttccctccttttttttggcacaatgaagtagtagtagtattacagaacttccccaatttgaatgcaaatctctcctataaaccttcatttcctttcccaaatagacattatattttattttctacaaacaggaccaacgtcaattattcctcgtattcattttatttttcaacgcgacttccagttatgttcacattgcaataggctttgaataaatatcaaatttctcagaacatgacagttgtggctcatgagcatactgctgccgattgtccatgacatactgttgattattcgggccatattcttctctagccccacgaatcgtagaacgcatggcattaaa

SEQ ID NO: 5963 - DNA, 523 bp, Medicago truncatula
  Predicted polypeptide sequence is orthologous to G896
cagatacatctgcactatcaaaaattacatcaactggagccatgacgttttgcttcatccaagctgtagagcgctctggtccaggggccacatatggcaccattcttacttcaatgcgaagtgccataaaaaatgctggtagcggtggtagtgggggcggcgatgtggtaacatctcttgtttccatgcttttgaccggaggtagtcttaccactggtgggctaagacaggaaccgcagttaacagcttgcgaagcattcgacgtgtatagaaaacctttctcattatgatagtattctttatacttcaatttgttttccttggtgctgcccttgtacatgaatttatttggttatcgtgtattgattactatgataggttaaaattataagtaggtgaggttctaatttattcggttatcgccaaggacgtctgggtgacttcatgtctggattttagaatgcatttgctcgtaataatgagtagttgtcggtatgatccttctaaaaaaaaaaaaaaaaaa

SEQ ID NO: 5964 - DNA, 668 bp, Medicago truncatula
  misc_feature (533)..(533): n is a, c, g, or t
  Predicted polypeptide sequence is orthologous to G896
attatggccggggacccaacaactcaatcccttctcctcaattcatcattcactccgtcaacaaaattccaattctacccttcaacgatgtacagcaacatcctcgttaactgctccaactgccacacccctctccaactccctcccggcgccgcatcaatccgctgcgcactttgtcaagccatcactctcgtcgccgacccacgcgctctccctcctcaacccgcatcctcccctcacgcgcctccgcctccttccccttacaatcatgccccgcctggtcctttacctaacgttcacggccgtaaaaaggccgtgatcgtcggaatctcgtataaattctctcgtcatgaacttaagggttgcatcaatgacgctaaatgcatgcgttatcttcttatcaataaatacaattttcctgattcttccattattatgctcactgaagaagaagaccctcatggccccaaatttccaaataagcacaacatcaggatggcaatgttttggcttgcacaaggatgtcaacctgnagactcccttgtttttcattattctggtcatggatcccagcaaaggaactataatggtgaagaagctgatggttttgatgaaactatatgtcctctggattttgaaacacagggtatgatagttgatgatgagat

SEQ ID NO: 5965 - DNA, 778 bp, Medicago truncatula
  Predicted polypeptide sequence is orthologous to G921
actgaaccacatgtgcaacaattatattgctttgcaaaagcatttgagtcaattcagtcaaacaaattttgaaaatgaattagtatcaccaatatcgcggaagagaaaggccgagagcgttgaaaattgtttcaatcggtttggctatgccattgctgagagcagcaccattactactgaggaggagacattcaaacacaacaacataatctcgccaaaagtttccaaggttcttgtgcaaacagatgcatccaataccggcttatatgtgaaggatggatatcagtggagaaaatatggtcagaaagtcactagagataacccctctcctagggcttacttcaagtgttcctttgctcctggctgccctgtgaagaagaaggtgcaaagaagtgtagaagaccaaaatgtattagtgaccacatacgaaggagagcacaaccatgcacatcaccaacctgaaatgtcactcactagttcaaaccaaagtgaaacaacccctacatataatttagttccagcatcctcgtcctcaccaattaattggcgtacagctcaagcttcaaagcttgacttggtccagccaagacaattggtagttgatgattcccataagtcatctatccagcagttattagttcagcaaatggctacttctttgacaagagatcctaatttcgcagcagcacttgccactgccatttctggaagaataataattctggatgtggaaaacccgaagtaaattcacacttgcatgattttgttatctgtatgg

SEQ ID NO: 5966 - DNA, 786 bp, Medicago truncatula
  Predicted polypeptide sequence is orthologous to G921
gcttcatcttcatcttcaacaagaaagtcatacttatttactttcaatttgaatttatttgacatatggatttttcatcatcatggattaacacttccttggatctcaacattaatccacgcactagggttcatcaacaagctgctcctgtaagtttcaagaaatatgaggtggaaaacaattttttctcattagggatgatgagtatatcttctgcaaaagaagaggtaagttagtttggttactttattaatcagttcattatgaatactagatatatgaagtttttgttttttactaattaaagttgcatgaatattgagaaacaatttgatggaatatatgagaaagaatcctgatcataaggagaaaagaaaatctgatgaaataagcagcagtaacaatctaatgggaggaggagttactggaaacaactctgagagcagttcaagtgatgaagatcaatcatgcaagaaaccaaggcaaatagtagaaacttgcattaaggctaaagtttcaagagtttatttcaagacagaatcatctgattcaagccttgtaagaatattcattcctcttcattaatttgcaaagccaacaatataagtgatttttgtttgacattttttgtgttaattaattttcagattgtgaaagatggatatcagtggagaaaatatggacaaaaggtgacaagggataatccatctccaagagcatacttcaaatgctcatttgctccaagctgcacagtgaagaagaaagtgcaaagaagtgttgatgatc

SEQ ID NO: 5967 - DNA, 773 bp, Medicago truncatula
  Predicted polypeptide sequence is orthologous to G921
gattgagttttgcttctacaactcttttgtctttgagcttgaacaatatttttggatttatttggttaacatggattgttcatcatatatcaacacttctttggatctcaacattattccctatagagctcatgaagaagttccaaagaaggaggtggaaagcaactttttctccttggggatgaccaacttttctgtgaaaaatgagtctattgatgaattggaggaggaactaaaaagggtaaccttagaaaacaagaaattggtggaaatgctctcagtggtttgtgagaattacaacactttgagaagtcatttgatggaatatatgaagagaaatcctgagaaagaagttagcacatcatcaaagaaaaggaaatctgaaagcagcaataataacaatagtaatttgattggaattaacaatggaaattccgagagtagctctaccgatgaagaatcgtgcaagaaaccaagggaagaagaaaatattaaagccaaaatttcaagagcttatgttaggactgaagtttctgatacaggccttattgtgaaggatggataccattggaggaaatatggacaaaaagtgaccagagataacccttgtgcaagagcttatttcaaatgctcttttgctccaagctgccctgtcaaaaagaaggtgcaaagaagtgtggatgatcaatctatgcttgttgctacttatgaaggggagcacaatcatcctcaacctcctcaaattgagtcaacatcacgttctggtcggtagc

SEQ ID NO: 5968 - DNA, 781 bp, Medicago truncatula
  Predicted polypeptide sequence is orthologous to G927
tatgatctgtgcaaaatatccgtatatggatcaattttacgggctcttctcgacttatggacctcaaatctcggggcgaattatgcttccgcttagcatgacatctgacgacggaccaacatacgtgaatgctaagcaataccatggaatcatcagacgcaggcattctcgtgccaaagctgtgcttcagaataaattgataaagcgtaacaagccatatatgcacgaatcgcgtcatctacatgcaatgcgtagaccaagaggatgcggtggtcgtttcttgaacacaaaagtttctgctaatggaaacggtaaaagcgggagtgaagagaacggaaacattggtggcctacagctgcagtccagtggttctcagagttccgaagtcttacaatctgaggttggaactttaaattcgtcgaaggagacaaacggaggcagtccaaatgtctcggggtcagaggtgactagcatgtatacacagggagttcttgatagctttactgtcaatcatatcggatctactgtccactctttgggagacatgatcgatactggacacggtatcgtcatgccaacaaaatggtttgcagcagctggcagacagctgctggaaccataagtttcgattcagaaaggaaacaagtgggtttggtacaatgtgaaatattttgcaccaaactcatcctttccgagaccagatgaagaagctatgtttcagtttgttgtgtttactacgacaaatttagtttcggaagactacttttccatctggtgctca

SEQ ID NO: 5969 - DNA, 851 bp, Medicago truncatula
  Predicted polypeptide sequence is orthologous to G938
gaaaaagatgtctagagctcaagatggaatattgaattacatgctgaaaatgatggaggtttgtaaggcacaaggctttgtttatgggataattcccgagaagggaaaaccggtgaccggagcatctgacaatcttcgtgaatggtggaaggataaggttcggtttgataggaatggtccagctgccatatccaagtatcaagcagataacgcaatcccaggaaagaatgatggatgcaattccattggtccaactccacacaccttgcaagaattacaggacacaaccttgggttctctcttatcagcacttatgcagcactgcgatcctcctcagaggcgtttcccattggagaagggcaatcctccaccatggtggccagccgggactgaagactggtggccccagatcggtttgcctaaagatcaaggccctccaccatacaagaaaccccatgacttgaaaaaagcatggaaagtcggtgttctaactgctgttatcaagcatatgtctcctgatatagccaagattcgcaagctcgtgaggcagtccaaatgccttcaagataaagtgacagccaaggaaagcgcaacctggcttgccatcatcaatcaagaggaatccttggctcgagaactttttccagattattgccccccgttatcctctggtggaggtactggttctatggtcatcaacgattgcagtgagtatgatgttgatggggctgacggcgagtcaaactttgatgtggaggaccgaaaacccgagaatcttcatccatccaatcttgggatggatagaatgaggggaagctttccagttcagcaaccttctcatcaaatcaagg

SEQ ID NO: 5970 - DNA, 710 bp, Medicago truncatula
  Predicted polypeptide sequence is orthologous to G938
atctgaagacggcctggaaggttggagttctgactgctgtcatcaagcacatgtcacccgacattgccaaaattcgcaagcttgtaaggcaatccaaatgccttcaagacaaaatgacggctaaggaaagtgcaacctggcttgcaatcgtcaatcaagaggaggccttagcgcgggagctttatcctgattatatccccccatttgtcccagctggacctttcggcatcaatgaaggcaatgagtatgatgtcgatgggggagaagaggagccgaattttgatgtggaggaacggaaacctgagaatcttctccatcaatccaacatcgggttgatggagaggatgagaggtgtaagactgccatttcagcagactttcgcaatgaaggaagaggctgtgaccaacttggatttcgtgaggaagcggaagatctctggcgagtttaacatgatggatccgaaaattttcacttgccaacactctacatgtccttatagccaagctcacatcggttttccagacagggcttctagggacactcatcaattgagttgtccatatagaggctcttcttcatcagattttggtggtccaagttttcatgctaatgaggtaaaaccagtcatatatcctcctcaatcattcgttcaaccgaaacctatgatggctcagtctgttaatatggttccaccttccattgacataact

SEQ ID NO: 5971 - DNA, 654 bp, Medicago truncatula
  Predicted polypeptide sequence is orthologous to G938
cctcgtgccgcctttttgggttcctttcatttttttctttcaattcttattcttcaccaataacaaaaaaaaaaacgcaggttacccttatcgaatcgaatcccaaagttcgtttttttcgtaccaattttcattcatgggtgaactcgttgaaattggagctgaaattggctcagatttagatgtcgacgatattagatatcacaatattccagagaaagatgtcagtgatgaagagattgaggcagaagatttggagaggcggatgtggaaggatcgtatcaaactcaaaaggctcaaggaaaaacaaaagcttgaagcgcagaaagccctagagaagcaaaagccgaggcagtcatctgatcaagctcgcaggaagaaaatgtcgagggcacaagatgggattcttaagtacatgctgaagctcatggaagtctgcaaagctcgtggatttgtgtatggaatcattcctgagaagggaaaaccagttagtggttcatctgataacattagagcttggtggaaagaaaaggtgaagtttgataggaatggtcctgcagccatagcaaagtatgaagcagagtgtcttgctatgagcgaggctgaaaataaccgaaatgggaactccccagagcacgctccaagacctgcaga

SEQ ID NO: 5972 - DNA, 657 bp, Medicago truncatula
  misc_feature (528)..(528): n is a, c, g, or t
  misc_feature (570)..(570): n is a, c, g, or t
  misc_feature (631)..(631): n is a, c, g, or t
  Predicted polypeptide sequence is orthologous to G962
aaataaataaataaataaatagattttgaaagtataaaagaggagagagcaaaggggtgtgttgttgttgttgttagttagttagagagagtggatggcaatagcagcagcaacatcatcacctaacatgagcagcatgagcttgagtcacgaagatggaacttctaacgataatattaacaaaggagctacagctacagttacagtagtagatgatgatgatgatgctgatgatgatcacgagcatgacgtggttatgccagggtttcgtttccatccaactgaagaagaacttgtagagttctaccttcgccgtaaggtcgagggaaaacgtttcaacgttgagcttattacttttctcgatctttatcgctatgacccttgggaacttcctgctttggcagcaatcggagagaaggagtggtacttttatgtgcctcgagataggaagtatcgaaacggtgatcgtccaaatcgtgtaacaacttctggttattggaaggcaacaggagcggataggatgattcnaactgaaaacttccgttcaatttggactcaagaaacccctanttttctattctggaaaagctcctaaaggcatccgaaccagttggattatgaatgagtatanattaccccaacatgaacccgaacgat

SEQ ID NO: 5973 - DNA, 802 bp, Medicago truncatula
  Predicted polypeptide sequence is orthologous to G976
attcattctatcgtgtatgcttagttcctacctacaacaacaacataaacatttcacttctttcgtcatggatggcaccaacaacaacacttcatcggtgccaccaccaatacaacctcctgatgcatcatcagcaccaacaactccttcatcttctccggcgactaccggagtcgcaggaagataccgtggaacccgttgtaggagtggtaaatgggtatcagagatacgtgagccacgtaaaacaaaacgcatttggttaggaacataccctactgctgaaatggcagctgctgcttatgatgttgcagctcttgctttaaaaggacctgatactactcttaactttcccaattcaatactatcttaccctattcctgcttcattgtcttcaactgatattcgtgctgctgctgaagctgctgcacaaaccagaatcatgagaccagcacaacaagatcaacaacaacaaaacccttcagcttttagttttgaggggtcttcttcaagtagtggaatattgcaacaacaacaaggtcatcatcatgaatatattgatgaagatgagttgttgaatatgccaagtttgttagatgatatggctagaggaatgcaggttagtccaccaaggatgagttcattctctaattgttcttcagatgattcacctcgcaattctgatggacgagataatctttggagttacaatttttgaagacagaatcattcattttctctctttgaatttgtttgattttggttatttacaagtgtttgtacgggtagatcttgattcaccctc

SEQ ID NO: 5974 - DNA, 844 bp, Medicago truncatula
  Predicted polypeptide sequence is orthologous to G993
taatacatacactcttcttcatacttacttcattctccttcaacaacaaaaatacaaagttagttataaaaatatatatatatatttcaattcaaactttgctagttattaacagaataacagaaaaaatggaattaggaggaagttccacagatgaaactgtcacaagcaatgactctctttcggcgaacttatctacaccgccgccaacgctgaactcactaagccgcgttggcagtgctgctagctccgtcgtggatccagaaatctacggcgtctccggtgaggcggagtctcgtaaacttccatcgtcgaaatacaaaggcgtggtgccacagcctaacggacgttggggagcacagatttacgagaaacaccagcgtgtgtggcttggtacgttcaatgaagaagacgaagcagccagagcctatgacatagccgccttgagattccgtggaaaagatgctgttacaaattctaaaagtctcactggcgttggtaacgacgccgacgaaggtgaaactgagtttctgaattcacattctaagtcggagattgttgatatgcttcggaaacacacctacgatgacgagcttaagcaaagcatgcgtgacatgagcggtggaagacagcggcgtaacggagaattgaatggtgcggtttcacgtggcgcgtgtgatgctaaagcgcgtgagcagttgtttgagaaaacggttacgccgagtgacgtgggggaaagtgaatcggttggtgataccgaaacagcatgcggagaagcattttccgttgaatgcagttgctgttgccgtcgcatgcgaccgaatctcgacggctgctgcggcgg

SEQ ID NO: 5975 - DNA, 548 bp, Medicago truncatula
  Predicted polypeptide sequence is orthologous to G993
gtcaaagttacgttctaacaaaaggatggagccggttcgttaaggagaagaatctgaaagccggtgatacggtttgttttcaacggtctactggaccggagaagcagctgtttattgattggaaagcaaggaagaatgttaatgaggttgggttgtttgttccggttggaccggttgttgagccggttcagatggttcggttatttggggttaatattttgaaacaactccctggatccgatgttaatagtaatggtaatgttattgctgggttctgcaatggaaagaggaaggagttgaatatgtttacttttgactcttgcaagaagcctaagattattggagctttgtaacattacgttaactttatattttttgttttttgagtttttgtgactgataatatgaaagaaatggatctcaaacaaagaaatgagagatccatggagatggtactgtagttgcaagttgcaaagagtaaattgtatattacttaattagaagaagaaaaaggaagacggtgaaagtaggtgtaacaaaactgtaca

SEQ ID NO: 5976 - DNA, 862 bp, Hordeum vulgare
  Predicted polypeptide sequence is orthologous to G1006
taaacagagagctcgctcgctctccgtgaatgatgtcgaggaagaggaggaagaagaagaagaagtgtggagcacgctgctgctacgtacctggtcaggctctcggcagcgtgaatttgtagaagcatgcttgccgtgccttcttccgggtgcaccggaggctggcatgtgagcagggctgcttcagtgatgcagaagaaaaaaggcaagtcttatcggcaagggaaggctacgcctttcttccaggtctccctctctccatctaaatctgtgtttggaggagggggctacggttagtccttgtggtcattatcctgagttgcttgttctgtatggtgttcattgaatttttcagctacataataatggtcagttgtgtgagtcaatgggagtgttcatgtgtcagttcatctgtgtgtctgctgtgagtaagttaatgaaaagatgtgtgtcggctgggaagtcattagaaaaatatagaatgtgtgaattttactaagctccatcgagttaggcgatatggtcagtgaagttggaaatgtaagatccttatagctgtatgttgcattatagggcagaaggaagattgtccatgagggatgatcaaatgagtatgatatattgaacgttgtcggaggatgggcgaatgaattacgatttgaggattttggtcgattgatgttagaagtatgtatgacggactatagatgagtgatgacttgagaaagatctgtggatggtcgatttatgtaggcttggtaggactgcgaatattccattggatgatataattcattgatggatcgtataattgttcgattgcacgattgatcgactattattgattgactaaaggaatccg

SEQ ID NO: 5977 - DNA, 877 bp, Hordeum vulgare
  misc_feature (776)..(778): n is a, c, g, or t
  misc_feature (788)..(790): n is a, c, g, or t
  misc_feature (800)..(800): n is a, c, g, or t
  misc_feature (807)..(807): n is a, c, g, or t
  misc_feature (835)..(835): n is a, c, g, or t
  Predicted polypeptide sequence is orthologous to G1033
ggccggcggcaggatgaaggccaaggcgggatcccgcgccggcggctccaggctcgcggtgaagaagagcaaggccgacaaggaccccaacaagcccaagcgacccccgagcgccttcttcgtcttcatggataccttcaggaaggagtacagggagaagcaccccgacgtcaagctggcctccgtgattggcaaggccggtggtgagaagtggaagtctctgagtgacgctgagaaggctccctacaatgccaaggccgagaagctcaaggccgagtacaccaagaagatcaacgcctacaacaacccacaggcaggagaggcgtccggcgactctgacaagtccaagtccgaggtgaacgacgaggacgacggcagcgagggcgacgcgtgaagcggcagcagggggagggtggtctctggaacgtcgccgtttgatgcttctctgtttgccagtgtcaccgatcgatgatggatgtttgctgttagtttagctccttggtagtccctccctctctttcaggctctcctgctgctgctggtggtagtaatggtggctctagtcccatgtaggcattgtcctggatccgagtggcgaaattgctatagcccagtcgtctttctgtaggggcctgtgctcggaccggcatcttctgttgcgtcggttttatgctagtttagcctctgtcgaatgtacctagtggcgtgccccgtggcttttttaaagaatctcatatatattgggggtgaaaaagaaagaaaatggtctccgtttnnnaaaaaaatcnnncaaaaacacntttcccncattttctcacactttaaaaaaaaaaanaaccttgggggggggccggggccccaaatccccctaaatgag

SEQ ID NO: 5978 - DNA, 1030 bp, Hordeum vulgare
  Predicted polypeptide sequence is orthologous to G1033
ggacgcaaattactgtcgtagttctccataaagggaacaaaagctggagctccaccgcggtggcggccgctctagaactagtggatcccccgggctgcattaattcggcacgagcaagctcaagggcgagtacaacaaggccattgctgcctacaacaagggcgagagcactgctgctgccccaaagaaggccgctgccaaggaggtagaggaggaagatgaggaggaatccgacaagtccaagtcggagatcaatgacgacgatgacgatgagggtagcgatgaggacgaggatgacgacgagtgaagaagaagcatctttgctccggcggacaaggcgggagctgctgcgcgaggcccctgagctgtgggtggtggttgtcataaggagcctatccatctccactagaattatcccaagtttcacttcacaccgtcatgttgttttacctttttcatgtcgtccgtccatccgtcctgctataacggatagcgctccctgttggcgcccccgccggcggggtgctccttgcggtgttagggcgtatgtcctccgccgcgggtgtgcccctgcctgtacctacctagatggtcactctttccgtccattgtcatcggctaacattgtgataatatcagtttgggtaatgttaaaaaaaaaaaaaaaaaaaactcgagggggggcccggaacccaattcgccctaaagggagcccataaccccccttcactgcccccgttttaaaaatactatctcaccacagcccccttagacccaacttatcctttaccccactgaccactccgcgtgacctccccactatcaacatcgctcgtaacgcggctcccatacactctatcaccccaacactcaacccccctctctcgttagtaccgcaccaacgcttataatgacccctatccctatctctagaactctactgcgcaccatacactcctggttatagacagttgcaccctagatcttagcgatgactactagaacactgcaatacagctcaactctctct

SEQ ID NO: 5979 - DNA, 1367 bp, Hordeum vulgare
  misc_feature (6)..(6): n is a, c, g, or t
  misc_feature (30)..(30): n is a, c, g, or t
  misc_feature (426)..(426): n is a, c, g, or t
  misc_feature (784)..(785): n is a, c, g, or t
  misc_feature (790)..(790): n is a, c, g, or t
  misc_feature (798)..(800): n is a, c, g, or t
  misc_feature (804)..(854): n is a, c, g, or t
  misc_feature (929)..(929): n is a, c, g, or t
  misc_feature (937)..(937): n is a, c, g, or t
  misc_feature (985)..(993): n is a, c, g, or t
  misc_feature (996)..(997): n is a, c, g, or t
  misc_feature (1000)..(1000): n is a, c, g, or t
  Predicted polypeptide sequence is orthologous to G1033
cgggcntccgggaaatatctgaccctcctnctaaaggcacacaggctgaagctccaccgcggaggcggccgctctagaactagtggatcccccgggctgcaggaattcggcacgagcaggctcaaggccgccgttggttccagcaagaggaagaaggccgccgctgccgctggcaagcccaagcgcccgccctccgccttcttcgtcttcatgtctgacttcaggcagcagtacaacgcggagaaccccaacaacaagaatgtcgccaacgtgagcaaggctgcaggtgagaagtggagatctatgtctgatgaggacaaagcaccttatgtggagaaggctggacagaagaagcaggactatgagaagaccaaagccagcttcgagaacaaggagagtgtgagctccaagaaggccaagactcangatgatgaggaggctgagggctccaaatctgaggtcgaagacgagggtagcgatgaggataatgaagacgacgatgagtaaatagtgtatccaagcacgaggtagcaaattgggagttgggtccccgcgtagtgtactagtttgctatcctgctatcttcagtgttagatgatgaaatttggaagtagatgtgcctttgtgtgttaagggggcccctcttagacttgtggactcatggtttgagaagttgcttagtagtgtattagcagagagagagccgagaatgccactagctgtctcttgctaaccacttgtgtaagaacttgttttcattcgctaatctgatgactgcccaaannaaaanaaaaaaannnaaannnnnnnnnnnnnnnnnnnnnnnnnnnnnnnnnnnnnnnnnnnnnnnnnnnaaaaaaggggggggcgcgcgcgcccccccccccccactaggaggagaaaaccccccccccggcggcgggcggtanaaaaaaangggggggggaaacaaccccccccccccacaaatatggggcgggggagnnnnnnnnncgnncgnagcccccgggccacgaccccgtctcagaagcgctacgcgtcgagctgggcatcgacgggacgatggcagtgatgtggcggccatccctacgatgtaccctcaatccccgctccccgcgactggacaaagctggcatggcatgaggccgataacgatcctgtttcggtgagtagacgcgctcagtagctggagcatgcagacggcgacggcgatgtcgtgccgctgacgcgcagggctgcgacgtcagtgttctcgtctaacgagactgccccgagacgacgtcccgtatggctagagctatcgcaggccgagaagccgttgtacgcgataccgccgccttactgcaccacgaggcttgactgctcgg

SEQ ID NO: 5980 - DNA, 926 bp, Hordeum vulgare
  Predicted polypeptide sequence is orthologous to G1033
agttccgcgccgaagccctaaccctccccagagccctagccgctcgccgccccgccccgccaccatgaggtccaaggccaacggcgacgccgcgttcaaggcctccggcaagagcaagacggccaccggcggcgtcaccaagccgaagcgcgccccgacccccttcttcgtcttcctggctgagttcaggccgcagtacatggagaagcaccccgaggcaaagggcgtcgctgccgttaccaaggcggccggggagaagtggcgcagcatgtcggatgaggagaaggcaaagtatggtgggaagaaggcagatgcaccagcgagcaaggctgtgaagaagaaggagagcaccacctccaagaaggccaagaccgatgctgatgaggaggaagaaggttctgacaagtccaagtctgacgttgaggatgatgctgaggacgacgaggagtaaatagtggatgagggaacagcagtggtgcaaatcaacgcgtgctgcttaaggcttaactgccatgtcaatgtccttatgatgtaatgttatgtgaggagaatgttaaatgcgtactcctggtctgcggcatgctgggagagtctttgtttgactagtagcgaaaataagcctaaaacccttgactgcctatctttcggggacctccgcacctgtgggaaaccgcacttatgccttgtttttatctactggggctggagactaaccccctggtgggctgctgttatttgttggcgaaaaaaaaaaaaaaaaaataaaactggggggggggcccgggcccaatcccccttagggaaggagttatattacatgggcgcgtgtttacaggcggggatggaaaaacggggctcaccccttaacgcctgtgcgatacccttctcagtgggtataagagaagccacaccgggccttctaaagg

SEQ ID NO: 5981 - DNA, 710 bp, Hordeum vulgare
  misc_feature (563)..(563): n is a, c, g, or t
  Predicted polypeptide sequence is orthologous to G1062
gccgctgacggcgggggcgggagggcagaaaggggggttcttggcgcccccgctgtcggcgttcggcgacggcatggggtgggacgacgaggacgagctggatcagcagagcatggacgcctcctccttgggggtctccgcctcgctggagaatgcggcggtcggcgcgccggggggaggtggcggcggcggcaacgggaagggcaagaagaaggggatgccggccaagaacctgatggcggagcggcggcgcaggaagaagctcaacgaccgcctctacatgctgcgctccgtggtgcccaagatcagcaagatggacagggcttcaatcctcggtgacgcaattgactacctgaaggagctcctgcagaggatcagcgatcttcactccgagctcgagtctgctccaagctctgctgcactcggtggaccatcgacggccaataccttcctgccgtcgacgcccactctgcagccgttccccggccgcatcaaggaggagcggtgcccgccggccccgttccctagccccagcggccagcaggcgacggttgaggtgaggnatgagggaggggcaggcggtgaacatccacatgttctgcgcgcgcaggccgggcatcctgctgtccaccatgagggcgctggacagcctcggcctcgacatcgagcaggccgtcatcaggctgcttcgacggctttccccatggacg

SEQ ID NO: 5982 - DNA, 832 bp, Hordeum vulgare
  Predicted polypeptide sequence is orthologous to G1140
gaccgcgaccgcaaccctcccgccgcatcggcgagtgagccgcgctcggtgctcccagccagcctgcctgcctgcctgcccgggcgacgcgcgctacctcggcgtgggtggtggcggggggagagagcgcgcgggggcggggagatcgatcggtcggtgaccgggacctaggaggagggaggaccggaggagacgcgatggcgcgggagcggagggagataaagcggatagagagcgcggcggcgcggcatgtcaccttctccaagcgccgccggggcctcttcaagaaggccgaagagctctccgtcctctgcgacgccgacgtcgcgctcatcgtcttctcctacaccggcaagctcttccaggtcgccagctccaggatgaatgagatcatcgacaagtacagcacgcattctaagaacctggggaaaacagaccagcctactcttgccttgaacttaaaacatagcaaatttgccaatttgaacgatcagcttgcagaagctagtcttcgacttagatgagaggcgaggagcttgagggataaagtgttgatgaacttccacagttggagaaaaaatctaaaacttgtctggacaaagggccttaaaacaaagaatcaacaattcttggaaccaattaaatgacctacacccaaagagtttacagtttggaggaggaatatttgaaacttgggaacccggttggcccaggttcctaaggtggggagggtttggggggtgtgttaccaaagatggtttttgtttaaatagggaaagatgttggtgtatggtggtgaatgattttgcagtggtgtgagcgcgaaggaagg

SEQ ID NO: 5983 - DNA, 1086 bp, Hordeum vulgare
  Predicted polypeptide sequence is orthologous to G1140
ccaccccccgaccgacgccgcccgccgcagatctattgcaacacctcagccactgtggggagaggagaggaggggaggggaggagaggatggcggggaagagggagaggattgcgatacggaggatcgagaatctggcggccaggcaggtcaccttctccaagcgccggaggggcctcttcaagaaggccgaggagctctccatcctctgcgacgccgaggtcggcctcgccgtcttctccgccaccggcaagctcttccagttcgccagctccagcatgaaccagatcattgatcggtataactctcattccaagatacttaagaaagtagacgagccatctcagctggatttgcatgaggacagtaattgtgcaagactaagggacgagcttgcagaagcaagcctctggctccagcagatgagaggggaggaactccagagcctgaacgtccagcagcttcaggctctagagaagagcctcgagtccgggctcagctccgttctgaaaaccaagagccagaagatcatggaccagatcagcgagctagaaaaaaagagggtgcaactgatagaggagaacgcaaggctaaaggagcaactgcaggcgtccaagatggagatgcaggtcgccgctgatccactggtggtggtgtacgatgaagggcagtcatctgagtctgtcaccaacacgtcgtatccacgccctcccctcgacaccgaggacagctccgacacatctctcaggctcggattatcactcttcaactcgaagtgattggctggaaattacccgaagcgaagtgacgcttggtcacgaccaactcctgaatcgaaccacgcgctgcattgaataaacagtttgagcgcactggatgatgtgtgtaatctaaaagaagactggcttctgttatactccctccgtctcaaaataactgtctcaactttgtattagctctagtacaaagttgtactaagcttaagacacttattttaggaccgagggaatatatagcatagtgtggtacaataagagaacaggttcttgtgatattacctgctactgttttttccaaaaaaaaaacg

SEQ ID NO: 5984 - DNA, 914 bp, Hordeum vulgare
  Predicted polypeptide sequence is orthologous to G1146
gttacacaccctcatcctggagaagattccagtccttccattgctgctgtggttgcttcccaagactggcctgaggtcactaagtatgcaggattagttagcgcccaagcccataggcaagaattgatacaggatctttttaaagtatggcaagatccccaaagaggaactgtgactggtggcatgatcaaggagcttctcatttctttcaagagggcaaccggacagaaaccccagagaatcatattttacagggatggtgtcagcgagggccagttctatcaagttcttcggtatgaacttgatgccattagaaaggcatgtgcgtccttggagcccaattaccagcccccagttacttttgtagttgtccagaagcggcatcacaccaagctttttgctaataaccacaatgatcaacgtactggtgatagaagcggaaacatactgcctggcactggtggtggttcaaagatttggcatccgaacgagtttgatttctacttgtgtagccacgcttgcattaaggaacaaagccttctgcgtattattactactatgggatgagaacaattactgggggtggattgacactttaaaaacaacttgtgctaacgatgctaggggccccccgctttgtaaatttggcccccaccatttatgccaattgggaagcctcggcgtggttttattgggccggaacccggatgggggcctggaaatggtgcccgggcccccaaaggggaggataaacaggggtgggagagtgcgttggaggcgctcgccctcagggaacaggagaggtttgtgttcgttaagggcggcggtcgggcaattttgcaacgatatttataggtatgggtgggtttctcggtggggggggagaacacgcgacactacgcggacgaaatatt

SEQ ID NO: 5985 - DNA, 970 bp, Hordeum vulgare
  Predicted polypeptide sequence is orthologous to G1146
gttacttttgtggttgtccagaagcgtcaccacactaggctttttgctaacaatcacaatgatcagcgtactgtcgatagaagcgggaacatactgcctggcaccgttgttgattcgaagatctgccatccgacagaattcgatttctacttgtgtagccatgctggcattcagggaacaagccggcctgcccactatcatgttctctgggacgagaacaaatttactgctgatgagttgcaaactctcacaaacaacctgtgctacacgtatgctcgatgcacccgctctgtatcgattgttcctcctgcatactatgcccatctggcagccttccgggctcggttctacatggagccggacacctccgacagcgggtccgtggcgagcggtgcacgtggcggtcctccacagggcggtccacgcagcagcaccaggttttgggaacgttgctgtcaggcctctccccgccctcaaggaaaacgtcaagcgcgtcatgttttactgctaagatcctcgcagttaccgtgaggtaacttgaagcacctgtgagtcggattggggatgctgttcaacaccattgtgggaacctaaacccaagttatcttgctgtactcttgttcaacacccattctaaatacctgcaccgggatgggtgactagtgtgggcggtgcacaaaccttttaaagcttttcaacttgattggggcgtcatttagtctgttgcgttgcgcccgtgctgctgccagaaagctttgctttcatgggctgtgccgagtgagaaatctggcctagtcctatttttgtatcccctggtgtttaaaaattatttttgacccattggtgaaggaatcacttggctagcatgagccctttgtttccttgcttggacgcatccaacggaaaatttgtggggcgatgatgtatattggatggtatactcaaaaggaaacatgaactttaagtaaac

SEQ ID NO: 5986 - DNA, 673 bp, Hordeum vulgare
  Predicted polypeptide sequence is orthologous to G1146
acctggaatctcaagaaaagcattactggcttctcttgagaagttcaatgggtcccattgattgctatttgttaagtgaccatcaggaggtatccaacccagagcaggtggcacaagacaatttggatcatgcatccgcagctggaggttttgatgctccacgaccggtggatggtcatcaaagtcaagctcccgaaaagggagagggggacacaatcggcaaggacacatcgaacccatccaatacacatgaactgatgtctggcattctgagaatcataccgccagatactgatattgatgctgattactggctcgcttctgacgttgacgctactgaaacatgggccacttagacttggtccgcctcttacgtggcgaaatagcaatgattccacacaatgcacattctgatgaaggagatggagcctggatcaataggcccaccttcaacggagtcttccattgggtaatcttaaaagaatatgtgagacagatcttggattggtctctcaatgctgtttgacgaaacatatttttaagatgagcccgcagtatcttgcatatgtcgcccttataatcaatgtcaaggtgttttctcacttgcatgagcttgatcttcgttatcttctaagccggcaaactggagctctaaatcgcataattgacagag

SEQ ID NO: 5987 - DNA, 558 bp, Hordeum vulgare
  misc_feature (7)..(7): n is a, c, g, or t
  Predicted polypeptide sequence is orthologous to G1146
gagaagncaacagcaatcaactgcttatgtatcttataaaagcaagaaaaatactgatgagaatacagcaagtaacaaaaggcagagcttcagaaactgctgcagaaacaaacttacacacacgcaaaaataacgaacttgcaaacttacacttgacacctcttcaccgtgtgcattcgtcgggatagagccaggtgatcttaataaagcaacaacaaaagaagaaaaatagcgcaagccgtcgcttgaatgctcagattttcaagctccagacccttaaaagtattcgagattcaacgtttacaacataacaaagtacacaaatagatggtacttaagcaaacataggtcagcatagtacggcgcacgacatagccactggcagattattactactctcttcacataattacaaggacaagaagctgacacgccgacttaaggagcatattaagattgcccttcacgggcttcagcagtagaacatgacgttcttcacactgtccttcattgctggaaggggcttaacagctgcaccgccagggggccgagtaccac

SEQ ID NO: 5988 - DNA, 652 bp, Hordeum vulgare
  Predicted polypeptide sequence is orthologous to G1146
ccttaaaaattcttattgtttgcataatggtgtaaaacagtacagctcgcaggcactaataataccgtcaccgaaaccaccacaaccttaacagtaaaccatggcacgcttgacatcttggcaaggagaggccggacagcagcatatccaaaagccctggcgctgcatgccgcaagcaacggacccgctatccgaggtatctgtctccgtgtaaaatcgagcccaaaaggctgccagatgtgcataatacgctggaggaacgatcgatacagagcggatgcgcctagcattcgttacgtgtagcacgagttgtttttgggagtttgcaactcatcagcggtaaatttgttctcgttccacagaacaagataatgaagcaggctggcttgttccctgaatgccagcattggtacatatgtagcaatcaaattccatcagatggtaaatcttcgaatcaataacagtgcaaagaacaggcaggcagcatatttccggcttctatcaatagtatgtttcctgccaatggtggtgaaagccggcaagaacctccaagatcggcacgaggaagaggtgaagaatcgcaggcatggagaagaaagcatcatcagcgagaaacagggcaagcagcatcagcctgaattgtaagcgtaca

SEQ ID NO: 5989 - DNA, 614 bp, Hordeum vulgare
  Predicted polypeptide sequence is orthologous to G1146
gtggggaaacatatacagggtcgtagcattacatggaatcgtcaggcactgcaaatctggacagatgtttgaatgcgcaggccaataatctggtcaagacaaacagagcaatgccattcgaaaatctgtagggggcagagaggaattgaaatattcaggttgctcagaaaacatggcagcactgacagtctgatacatatagatacacttacgtgatgactgacgatattgcttttctaccacaacgaaaggattgccagatcaacaggtaattcggttggcatcatggcgaagagaggcgttgcccctaaactcagcagtaaaacatgacacgtttcacgttttccttgaggtcaggcagaggcttaacagcaacattccctgcagctctactgccgccgcgtgcgccagtagggccacggcctgtcgtggcaccactcgcgaccgagccaccgtcggaggtatccagttccatgtagaaccgagctcgaaaagccgcgaggtgagcatagtatgccggaggcacaatcgatacagaacgggtgcaccttgcgtaggtgtagcacaggttgttcgtgagagtctgcaaaccatccgcggtaaaattgttctca

SEQ ID NO: 5990 - DNA, 661 bp, Hordeum vulgare
  Predicted polypeptide sequence is orthologous to G1146
actgaattacctattggaaatgaaactgctcgctatggacactcctatccgttttcccactaggctcctacacaaatattgagaattgtagaattaacttgactcttagtaggccaaacagcctcaaagtttcggatggctatacatttgcgtgtgcataaaatatttcggaacgcaaagtctacaatacagaaatggtatttcgtctataatgacttgacacagctaattctgtaactaacaccgaaggttatggtttaatgattctcattctcatgcaatgagcttagatgtagtacatggaatccctcatactcggcggaataacaatgtcctcgatcgtttggttggtgccgccactcatcacactctgggcctcacttgggtcgaaaacttcagataagtagcagcgtacccttgtgcagagtaaatcagcatagtaagcaggaggacaaagactgacggcttttgttgctcgtccaaacagatgactcatattgtttgtcaattcctcaagggcatcagcgtgatttttgtgaccacccttaaccttattggaccggaaaatttcgtctattatcacatagtaatgacaggcacgtgctgttccctgaagacatgcatgggcttgtaggtaaaagtcccagtttcgagtctctgt

SEQ ID NO: 5991 - DNA, 700 bp, Hordeum vulgare
  Predicted polypeptide sequence is orthologous to G1146
agttgttagacataataattttattggcacatacaaaaagcggttcatacatatggaggcgcagaccatgtccaacaccacgcgacactggtgcattctccggcaggtgcacgcgcttccacttgggcagtagttacttctcgctgatgcccatcaccgttacgggttaccgctactacttgtcttgctccttggcgtctcctgctactgatcttcgaagccttgtgctaccgtcggagaagagtgaaccagccagccatgtccatgtgaccacacacaattttatgtttcctgtgagagcttaaattgcatattccacttgccaacttttggccagaatactttctccttgccttggtcaccaaatttcagcataggagggggtagcacacgacccttaattattgttagtctgttctcaaaagtcacaccgaattcctttgcatatggatcctcattgtatgggttcacaatattttcttatccgacgatcttcttcaccacctccttgcctttgatcaggaagaaggtgggcatggccttcacccccagcttggaagacgcgtccaggacatcgtcgacgtcgacgaagaggaagagcatgtcggggtgggtctgggcgagctcctcgaacttgtagcgctcctcgcgtcatgaatccgctcacggatgcatcttcttgagcccttccctccgctgc

SEQ ID NO: 5992 - DNA, 555 bp, Hordeum vulgare
  Predicted polypeptide sequence is orthologous to G1150
gccggccgacgcactactacatgctgaagaacgcgcacggcttcgagcgcgtggacctgcagaagctggtgtaccgcatgtgtttcgtgttcgcgcgctgcaccaagccggtgtcgctgacggcgcccatcaagtacgccgacatcgcggcctaccgtggcagggactactacgacagcaggatggcgtccctgcagtaccaccaggtccccgcgggtcctcccctgttcagggatatgcccgaggtgcacgaggctctcaaagacagcatgttcttcatctgatggcgcctgcttttcagcgtggtaagccccaatccaaccctgcgttctgcttcttgtctgcgccttcttgctgtgtatggtgaaggcctttggcgcttctgttaaggtacatgtttgctgtgttcagtactacaatgctcgtcaaattgactctttacagctttgctgtgttctgtacatgctcgccaaattggctcttacagctttgctgtcttgtgtacatgctcgccgaattggcttgttacaaacttgttctgcacaaaaaaaaaaa

SEQ ID NO: 5993 - DNA, 898 bp, Hordeum vulgare
  misc_feature (797)..(797): n is a, c, g, or t
  Predicted polypeptide sequence is orthologous to G1198, G1806, G558
gccgcagtcgcgtactggtcgctgggctcatcgtgccggccaggagcggcggccgcggtagctcggggagcttgcagcagcggtggccgcaaaaggatcggcgacggcggcaccctactaccccgtagcctccgatagaggcccctcttcctgttcgagctttgtcacaacaaaggaatctctctgggagttacattgagcactaggaataatctgcaatggcagaggccagtcctagaacagaaacgtcagatgatactgatgaaaatcttatgcttgaaccagggaatgctgctcttgctgttgcttctgactctagtgacagatccagagacagaaacggagatcaaaagacaatgcgtcggcttgctcaaaatcgcgaggctgcaaggaaaagtcgtttgaggaaaaaggcatatgttcaacaattggagaatagcaggctaaagcttacccagctagagcaggagttgcaacgagctcgtcaacaagtttgcttttattgcttgtcactgtcttgagttctggttacaagacttcatttgaagtttgcttactgaaatttccttcacagggcatttttatatctagttcagcagaccagtcccattccatgagtggaaatggggcattggcttttgacacggagtacgcacggtggttggaagaacacaatcgacaagttaatgagctgagagctgcagttaatgctcatgcaggcgatactgagctgcgcagtgttgttgagaagatcatgtcacactatgatgagatttttaagcaaaaagaaatgcggncaaagcagatgtctttcatgtgttatcaggcatgtggaagacaccacctgagaggtgtttcctatggcttgaggtttccgaccttctgaccttttaaagcg

SEQ ID NO: 5994 - DNA, 851 bp, Hordeum vulgare
  misc_feature (159)..(159): n is a, c, g, or t
  misc_feature (368)..(368): n is a, c, g, or t
  misc_feature (422)..(422): n is a, c, g, or t
  Predicted polypeptide sequence is orthologous to G1198, G1806, G558
gcgcgggcggggggggggggaccaaatcagcgacaccgccggtcggagctcgtatcctcggaggaggaggaagaggtggcctccgggtagaagccgcgcggattcggtgcgggggctctgaggcacccctcccccccatccatcccgggcgggggcccnaggggggggggggcgaccatggccgcggcccgccggcgccacgccgagccccgctccggacgaccgcgccgaccgtacgccgccatacggttgtagtaaatcctaggcagctactaatctggattcttggagagaaaaattccggcaacgacccatctcccgcagcacaggctgggctcaccactttgctgttacgaaggggggagcanagtgatttgctgtctcattgtgattgtggtccgctgagtgatggcagatgctanctcaaggactgacaactcaactgtggtagacaacgacggcgagatctataggttagaacaaggagcaagtgggggggcaatcatggcttctaattcttccgataggtctgacagggccgacaaacccttgggaccaaaggacattgggtggtcttgcgtcaaatccgtgaggctgcaaggagaagtccactaaggaagaagtcttatggtgcaccgctagaaagcccggagctggagcttgcgcaaattgaagcgggagctccaaaaagcttccccacgagggaattttcaatttttagcctccggagaccaaacgcctgcctatgggtgggaacgcgggccatgactttccgaccataaaacccttagagggtgggggagccgaaccagcgattcagtgggggggggagtggagttgaggtgatgcga

SEQ ID NO: 5995 - DNA, 700 bp, Hordeum vulgare
  Predicted polypeptide sequence is orthologous to G1198, G1806, G558
cttatttttaacacaaattgaagtactgtttcaataatgaattctgggcttccttcatttgttcccactccaggatacattaaaccatttgactcaagaaaaatctgatgacagttctacgcgttctgacaagttctcccatttctggagcttcctttgtttcccagctctctgtttctcacatatctgctacattacatccaaaaaaatttcttcccagttgtttcgattatgctcctactttgaaggttagttccaaaatacatttgaatcagaaggcagaatattggctttcagatggatgtgctgcaatgcttagctctccgcaattgccttcatctgtcatcagtatctctcgagggcgagaagcccagagggagcttagggcacggaggcggttgtggtactcgccaatagccaggaaacatcgagctgcctgcctaactgtcagaatcctgtgcatctgatgaagagtctgctgcctcaagttatcagcctgtatgacaaaaccttccaggttggccagcttgccaagagcaactgccatgtcacccatgaagctccccatgttggtatcatcgctaagagacccgctgcctgccacagtgactgccaatgactgatggagctgctccaggccctgggtgagagcttcttctgcctgctgcaatgactgctcaaggctgcagatgccaaccat

SEQ ID NO: 5996 - DNA, 1070 bp, Hordeum vulgare
  misc_feature (657)..(657): n is a, c, g, or t
  misc_feature (678)..(679): n is a, c, g, or t
  misc_feature (693)..(694): n is a, c, g, or t
  misc_feature (741)..(741): n is a, c, g, or t
  misc_feature (798)..(798): n is a, c, g, or t
  misc_feature (870)..(870): n is a, c, g, or t
  misc_feature (913)..(913): n is a, c, g, or t
  misc_feature (972)..(972): n is a, c, g, or t
  misc_feature (1040)..(1040): n is a, c, g, or t
  Predicted polypeptide sequence is orthologous to G1272
gtgaagtctaaacttcctggggctcccaagtttctgttgtgtgtccttgccgagaggaagaactctgatgtttatggtccatggaagcgaaaatgccttgctgactttgggattgtcactcaatgtgtggccccaacaagggtcaatgaccaatatctgacaaatgttttgctgaagatcaatgcaaaacttggtggaatgaactcactgctacaaattgaaatgtccccaagtatacctcttgtatcaaaggtcccaactctcatcttgggaatggatgtgtcccatggatcccctggacagtctgatataccatccattgcagcagttgttggttctcgagaatggccccttgtctcgaaatatagggcttcagtgcgctcgcagtcaccaaagctagaaatgatagattcattgttcaagccacaaggaactgaagatgatggccttgttcgggagtgtctcattgacttctacaccagttctggaaagagaaaaccagatcagaatatcatcttcagggatggtgttagcgagagccagtttaatcaggtgctgaacatcgaattagatcaaattattgaggcctgcaaagtcttggatgaaaattggaaccccaagttcacactgattgttgctcagaagaataccacacanagtttttcatgcctggatctnnctgacatgtccctnnctgcactgttgttgataatgctgtctgccatccaggaaatatgactnttacatgtgcgctcatgctggaaatgatggggacacagggccacacattaccatatnctgcatgatgagaatacacttgccgccgatgacttgcaggatcttgggcattccctctcttatgtgtaccanaggagccaacagccatatcaggtggtgtctcaatctgttatgnactttgcagctgttcagggggcgcatttcataaagtttgagtagattccccgaccttgntcgaacaggttgttggacacactttcttgccacggccgggcagagctgctctctcttgagaacccganacatgtttttgtagcattacactgccgtta

SEQ ID NO: 5997 - DNA, 1009 bp, Hordeum vulgare
  misc_feature (869)..(869): n is a, c, g, or t
  Predicted polypeptide sequence is orthologous to G1272
atcttcagggatggagtcagcgaaagccagtttacccaggtgataaacatcgagcttgagcagatcatcgaggcatgcaagtgccttgacgacaagtgggagcccaagttcacagtcattgttgctcagaagaaccatcacaccagatttttccagacaaattcgccagaaaatgttcctcctggtacggtggtggataaacaagtgtgccatcccaagaactttgacttctacatgtgtgcgcatgctgggatgattggcacgtcgaggccaacgcattaccatgttctgcatgatgagattggcttcagcgcggacgagctccaggagtttgtccactcgctttcttatgtgtaccagaggagcacgacggcgatttcagtagctgctccaatagcgtacgcgcatctggcggcggcgcaagtgggcaccttcatgaagtttgaggacatgtcggacacttcgtcgagccagggagggggccacacgtcggtgggcagcgcctcggtgccggagctgcctcggctgcatgagaaagtgaagagctccatgttcttctgctgatgggctcggcttgtgtcgacttgatagatgctgaacttcgtcaccgggtggtctgattaaaaactatttatctatctatcaatctatctaatctaaggttgtagggtgcacttggaactttacttggtgggtgcccgtaaaatgaacaataaatcggtagtgcgttggttgcgcttctggagccaacggaaatgggccatgctttcgtcctgtgggggggttgtagacaacaacaaaccaactacttaccttttggaaactgggagggtggtgggcgaataagaaataattggggagaaaggcantgattgtgacacagttgtgtgaggtgaggggctcttttgatgtacgaacaatagaacgacgtccgcgatgatgaggaggtagtagaagcggggggcgagagcgaggtgagaggtgagtgtcgcccattacagagtgggag

SEQ ID NO: 5998 - DNA, 849 bp, Hordeum vulgare
  misc_feature (675)..(675): n is a, c, g, or t
  misc_feature (765)..(765): n is a, c, g, or t
  misc_feature (831)..(831): n is a, c, g, or t
  Predicted polypeptide sequence is orthologous to G1274, G1275
ggcggcaccagtgctctaccaacagcaggcgcaggcggtgggcgacgcctgcttcttctcctccatgtcctcctacttctccaacgaggcaatcagctcctcctgctccagcccagcctccagcttctccgccgcgctgggcgccacgccgcccgctgcgccggcgatcagccccgaccccgcgtcgcagttcgacatctccgagtacctctacggcgacggcccgttagccgcgccgctggcgcccgttggcgctgctgttgcaagctcggcgactgcggtgcctgcgaggagcgcggccgagtcggcggcggcggtggagaggccgcggacggagcgcatcgcgttccgcacgaggacggagatcgagatcctcgacgacggctacaagtggcgcaagtacggcaagaagtccgtcaagaacagcccaaacccaaggaactactaccggtgctcgacggaagggtgcagcgtgaagaagcgggtggagcgggaccgggacgacccggcgtacgtggtgaccacgtacgagggcacgcacagccacgccagccccagcaccgtctactacgccagccaggacgccgcctccggcccgcttcttcgtcgccggcacgcacccgccgccaggctccctcaactgagtagactagccaccaacgacggagccacgtngagatcaagcacgtacggggccttccatttttgggcaaagctaagccaagcttcgggccttcggtgcccgtaaccaacccaacaaagttngtaagttaaacttaagtggccactaactgggtttcaagggttccgggttttcccgaacttgtaagnggtttggggtaacttggc

SEQ ID NO: 5999 - DNA, 760 bp, Hordeum vulgare
  Predicted polypeptide sequence is orthologous to G1274, G1275
cggcacgaggtgtggacttgccgcaatgtcctcgtactcgtccctcatctctgtgagccccggcgagcagatcggtgggtatgcggaccaaggtgacgacgacgacatggcggccgccgctaactacctatcatcattctgctttgattttggcgacgagtattccgtagggaaggcagcaacagcctcctaccccttgcacggacagcagcagcaggcgccgaccaaagccgacagccaccacagcggccaagcagcaagtattaccagttcacagagattcgacaatatcaacacgagcttgacgagcagcgacgcgaggagcaaaggcagtaagatcgcgttcaagacgaggtcggaggtggaggtgctggatgacgggtaccgctggaggaagtacggcaagaaaatggtcaagaacagcccaaacccaaggaactactaccgttgctcaagcgagggatgccgcgttaagaagcgagtggagcgggatcgcgacgacgagcgcttcgtcatcaccacctacgacggcgtccacaaccaccttgcgccactgccgccgcagggatgcgccggatactcgctatcgctagcgcagacgcgcgtggacgaggggtcatcaccgctacccatggaagggcgccgttgctttcttgacgccatgaagatgcacgctgccgggagcctcgctggctcctcacccgtgcccgcaccgcgcacactagagcgtcataactgataattgataatatgtccagga

SEQ ID NO: 6000 - DNA, 717 bp, Hordeum vulgare
  misc_feature (593)..(593): n is a, c, g, or t
  Predicted polypeptide sequence is orthologous to G1309, G237
agccgaagccgaagcctaagccaccggtgctgcgtcccgtaaacctccctgaggtttcgtgcggcgtccgtcgttcgcctgcaagcaagcaagcaagcaatggggtgtaaggcgtgcgagaagcccaggccgagctaccggaaggggctgtggtcgccggaggaggaccagaagctccgcgattacattctccggcacggccacggctgctggagcgcgcttcccgctaaagccgggctccagcggaacggcaagagctgcaagctgcggtggatcaactacctgcggccggggctgaagcacggcatgttctctccggaggaggaggagacggtgatgagcctccacgccgtcctcggcaacaagtggtcgaggatcgcacggcatttgccggggaggaccgacaacgaggtcaagaactactggaactcctacctcaagaagagggtcgagggcggcaagggagcgcccaactcgcccacgccggcggcggcgagctccgccgcggactcagacgggtctctagagccccgagccccagggggagggttatttagttacgggtggcatggaaacggggcccaagcgcgggnccattggaaacctgcccgcccaggtgttcaattcggggagcccggcccggcaccggaagtcccgtccgttccgggcccggaactttcggagagcttgccccttggaccccgtgggaacccggat

SEQ ID NO: 6001 - DNA, 2263 bp, Hordeum vulgare
  Predicted polypeptide sequence is orthologous to G1313
ccccctccctctccctcctccctcaaaactctctctccctccctgaaaattctccgcatactggtgcccaagtggtgccggcatcccgctgagggcagagagagagagagagaaagagatcctcctcccctgtccccactcccctgatccgccgccgagccgggacgaggaggaggaggagctgcagctcagctccgccccagctcagcccccggagcccgagctgatcgacccgccggcagcgagattcggccagggcacgatcgacggagagatgtaccgggtgaagagcgagagcgactgcgagatgatgcaccaggaggaccagatggactcgccggtgggcgacgacggcagcagcggcggagggtcgcctcacaggggcggcgggccgcctctgaagaaggggccctggacgtccgcggaggacgccatcctggtggactacgtgaagaagcacggcgaggggaactggaacgcggtgcagaagaacaccgggctgttccggtgcggcaagagctgccgcctccggtgggcgaaccacctcaggcccaacctcaagaagggggccttcacccccgaggaggagaggctcatcatccagctccactccaagatgggcaacaagtgggctcggatggccgctcatttgccagggcgtactgataatgaaataaagaattactggaacactcgaataaagagatgtcagcgagccggtttgccaatatatcctgctagtgtatgcaatcaatcttcaaatgaagatcagcagggctccagcgatttcaactgcggcgagaatctttccagtgacctcctgaatggaaatggtctttatctgccagattttacctgtgacaatttcattgctaattcagaggctctatcttatgcaccacagctttcagctgtttcaataagcagtttgcttggccagagctttgcatccaaaaactgcggcttcatggatcaagtaaaccaagcagggatgctaaaacagtctgaccctttactccctggattgagcgacaccatcaatggcgcgctctcctcggtcgatcaattctcaaatgactctgagaagctcaagcaggctcttggttttgactatctccacgaagccaactctagcagcaagattattgcaccatttgggggtgcgcttactggcagccatgcctttttaaatggcaccttctctacttctaggaccatcaatggtcctttgaagatggagctcccttcactccaagataccgaatctgatccgaatagctggctcaagtataccgtggctcctgcgatgcagcctacggagttggttgatccgtacctgcagtccccgacagcaactccgtcagtgaaatcggagtgtgcttcgccgaggaacagcggcctcttggaagagctgcttcatgaagctcagggactaagatctgggaagaatcagcagctctccgtgagaagttcaagttcctctgtcagcacgccgtgtgataccacggtggttagcccggagtttgatctctgtcaggaatattgggaagaacgtctgaatgaatatgccccattcagtggcaattcactcactggatccaccgctcctatgagtgctgcgtcgcctgatgtttttcagctctccaaaatttctcctgcacaaagcccttcactgggatctggagagcaggcaatggagcctgcatatgagcccggggcaggggacacttcgtctcatcctgaaaacttgaggccagacgcgttcttctccgggaacacggcggactcgtccgtcttcaacaacgccatagccatgctcctgggcaacgacatgaacacggagtgcaagcctgttttcggcgacggtatcatgtttgatacttcggtgtggagcaacttgcctcatgcttgtcaaatgtcggaggaattcaaatgagttcctcaccgaacctccagcggagtcgaaggagattcttggtatccctcaccctgattgttttgaggaaaaattcagagaaagcctcatcgattgtatacgctgctgcgtgcgtacgcggctgctaccagatgcgctctccgttcaactaagccccttttccccaataaagttggcggagataagccggttatctattttttgtttgtttgtttcgaactagagaacccttttttgtcatctctgtggcatttatttgaacaatgtaagatcagttactgcttaaaaaaaaaaaaaaaaaaaaaaaaaaaaaaaaaaaaaaaaaaa

SEQ ID NO: 6002 - DNA, 288 bp, Hordeum vulgare
  Predicted polypeptide sequence is orthologous to G1313
gtctcccggggtgcaaaccacagggagtgaaatttccgcttttcgcagagctcaagaaaggaagtctgaagagtgtcgtgtgaacatgattaagttctgagcgactgactggttgactgcttccaaatctgatgcatgttaccacaagatttgaagcttggatggtgggaagtgacctgtcctgctttgtaaattgcactaataggtagatttcgaccggctatgtttttatacttgtagtcggtcggtgtgtgggaagttgggatgagaatgaacaaaaaaaaaaaa

SEQ ID NO: 6003 - DNA, 537 bp, Hordeum vulgare
  Predicted polypeptide sequence is orthologous to G1335
acgggggaggaggaggcggcggcacctgctacaactgcggcgagccgggccacatcgcccgtgactgccccaccagcagcggcttcggcgggggcggcggcggcggccgcttcggcggcggaggaggcggcggcggcggcgaccgctcctgctacaactgtggcgagcccggccacatctcccgcgagtgcaccaagtgaggggatctctgcccctcccgctctatagacgtcgcctaaatacctctcgtcttagttttgccgatcgatcgcagccgcctcgcagcttattttaccttggctccctttccccccctttccgttcttagggggaagctcggtccaaaagtaaattcagtcagtcagtcccgtgggaagggtaatttttgcctatgaatggtcccggtacccggtacccgttactctcagttgaaggtttaagggtctggatgaagggattattggcggcgaattttgggtgtgtggggattaataagaatgaaggaaattgcaaaaaaaaaaaaaaaaaaaaatctgg

SEQ ID NO: 6004 - DNA, 1387 bp, Hordeum vulgare
  misc_feature (984)..(984): n is a, c, g, or t
  misc_feature (997)..(997): n is a, c, g, or t
  misc_feature (1097)..(1097): n is a, c, g, or t
  misc_feature (1168)..(1168): n is a, c, g, or t
  misc_feature (1170)..(1175): n is a, c, g, or t
  misc_feature (1177)..(1177): n is a, c, g, or t
  misc_feature (1183)..(1183): n is a, c, g, or t
  misc_feature (1212)..(1212): n is a, c, g, or t
  misc_feature (1266)..(1266): n is a, c, g, or t
  misc_feature (1306)..(1306): n is a, c, g, or t
  misc_feature (1337)..(1337): n is a, c, g, or t
  Predicted polypeptide sequence is orthologous to G1335
ttcctgctacggttttagtccttcgttttcggcggcgcaagatgggggagagagtgaagggaaccgtgaagtggttcaacgtcaccggggggttcggcttcatctccccggaggacggcagcgacgacctcttcgtccaccagtccgccatcaaggccgacggctaccgcagcctcaacgagaacgacgtcgtcgagttcgatgtcatcaccggcgacgacgggcgcaccaaggcctccgacgtcaccgcaccaggaggaggcgctctagccggtggctcccgccctgtcgacggcggtggtgaccgcgggggccgcggcgggggcggctactgcggtggcggctacggtggtggcggtggcggctacagcggcggtggtggcggctacggcggtggaggtggcggctacggcagcggtggcagtggcggccgctacagaggaagaggcggcggccgtgagtgctacaagtgcggcgaggagggccacatctccacggactgcccccaaggcggcggtggtggtggtcggcatcggcctctgaagttgtaccttcacagtggcggtagacgatcttcactattgttacttatacttacctacaccgatcatctacactttatcgtccttcaccacgtcactagctacgttcgttctccaaccatccttctctctccactctacgcccttaacatcatccatcatcgctcgatacaactatccttcgctatatgattcaacttacgcactcagtcatcgattcgtcccttactctcataacacaaatccacacatcgcatcggatcgctcgtatccatctcaccatccgatcacatcgtcttctattccatctactccatcatcacatcatcgcactcatattctccatactcatatctactctgcacgtatccctcactgtgcacatgcgaccgtatacagtactcgatcttttgacaatcttactccacttcgcatcgctctnacactcgacatantactgcgtcacataactctgcatacgctctctctactctcactcgacactcgattgcatacagacacgacatctattcgctctcgcactctcatcgcatnccttatcacatcgtaactcgctcgtttctcgactttgttacttaccgtaatcttcaacgtgctatcatcangnnnnnnanatatgnattcgcaatccgtctcccaaccactaatngacactctacctgtactccgaactccatcctacatcgataccgcgaacatatangtgtctacatctggtctctactctaatctgacatctatangaacatccttatcggatacataactgcatcngtaatctgcatcgatgatacgaactcgcattcgcatctctagtacactcg

SEQ ID NO: 6005 - DNA, 585 bp, Hordeum vulgare
  misc_feature (29)..(29): n is a, c, g, or t
  misc_feature (47)..(47): n is a, c, g, or t
  misc_feature (511)..(511): n is a, c, g, or t
  Predicted polypeptide sequence is orthologous to G1335
gggactgcttcaacggcggcgccggcggnggaggaggcggctactgnggaggaggaggcggcggcacctgctacaactgcggcgagccgggccacatcgcccgtgactgccccaccagcagcggcttcagcgggggcggcgggggcggccgcttctgcggcggatgaggccgcggcggcggcgaccgctcctgctacaactgtggcgagcccggccacatctgccgcgagtgcaccaagtgaggggatctctgcccctcccgctctatagacgtcgcctaaatacctctcgtcttagttttgccgatcgatcgcagccgcctcgcagcttattttaccttgctcccttctccccccttccgtgcttaggggaagctcgtccgaaagttaagtcagtcagtcagtccgtgtggatggttaattttgctatgaaatggtccggtacccgtacccgtactctcaattgatggttaaagtcgtgatgatggattattgtcgggggaaacaaaccncctaacatttacaatttgggtaaaaccaggcggcccccacctgttagggggccccggggggggcgcccgcccct

SEQ ID NO: 6006 - DNA, 1048 bp, Hordeum vulgare
  misc_feature (981)..(981): n is a, c, g, or t
  misc_feature (983)..(983): n is a, c, g, or t
  misc_feature (985)..(986): n is a, c, g, or t
  misc_feature (995)..(995): n is a, c, g, or t
  misc_feature (998)..(998): n is a, c, g, or t
  misc_feature (1000)..(1001): n is a, c, g, or t
  Predicted polypeptide sequence is orthologous to G1364, G481, G482, G485
cctctcccacgcgctcctcgatctccttgctgcactgcacctgcagtcctgcacgtacataatagtgccccaaagattgattctcagtttctcgtacaagtgtccttccagttaagttcatgcctccgccgcgtcgatgcttgatcggagtggtttgacgtcaccacttgcttcttgatttgagctgagacagatcatatatatcgaggcgccagcgccatgccggactcggacaacgactccagtgggccgagcaacgcgggcggggagctgtcgtcgccgcgggagcaggaccgcttcctgcccatcgccaacgtcagccggatcatgaagaaggcgctcccggccaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctttggcaataacccccctcggtttgagaacttctcacccgttaatactacttccccaattccccaaatcaaggcaaaggcggttcttcacaacaccacaccgataacaagccgcgaccttcccaaatccaggacacattcccggggtccccgatcggagggagcccctccccccgcggaggttaataataggcttcccaggcaccccagtgggaagaaaaaagtttaaattgacaagcggtcccgaccctaggtacgtgggctaaatataaggggggggacctcctgttgttccaaaaaaaaatttgttcaggggagacacacccccggcggcgaaaataatccctgagtattgtggtgttcaaaaaaaagaaaaaagagggcggcggcgccggcctacggaatagatgtaccggcggatacggcacggcggcgaggacccgcgttttcggccggttgggtattcgaacagcggagtacaggtgcgttgcgcgcgcatgngnanngcggggggnggntnntcatactatagttcgggggcacccgggagtgtgcggctcagggcgac

SEQ ID NO: 6007 - DNA, 674 bp, Hordeum vulgare
  misc_feature (206)..(206): n is a, c, g, or t
  Predicted polypeptide sequence is orthologous to G1364, G481, G482, G485
aaacgaatcgcacccgcctgcgccgccttctcttctccagcgtcggatctccccccactcgccgccctcaccgcacctccattccccgcctccaccaccttccctccacgcgcacgcgctcgtctatataaggaggagggccggatgtcggacgcgccggcgagccccccgggcggcgggaacgggggaggagggggaggggtggncagcgacgacggcggcggcggcggatacggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggccagcgacaagtgccagagggagaagcgcaagaccatcaacggcgacgacctgctctgggcgatggccacgctcgggtttgaggagtacatcgagcccctcaggtttatctgcagaagtacagagagacggagggtgatagtaagctagctgggaagtctggcgacgtctctggtaaaaaggatgccactggtcctcatggaggagcaagtgcgccagggatgggccaacaagtagcatacaatccaggaatggtttatatgcaacctcaataccataatggggcg

SEQ ID NO: 6008 - DNA, 693 bp, Hordeum vulgare
  misc_feature (650)..(650): n is a, c, g, or t
  Predicted polypeptide sequence is orthologous to G1364, G481, G482, G485
gtgccacatggagcaccgcaagaccgtcaacgcggaagacatcgtgtgggccctgaaccgcctcggcttcgacgactacgtcctgcccctcagcgtcttcctgcaccgcatgcgcgagggcgaggcggggacaggtggtgccggtgcaggcgacaaccgcgccgccacgagggcgcctccccgcgcgccgccgcccgctctccacgccgtgccgttgcaggtactgcagcgtcccatgtacgcgcccccgtctccggtgcaggttcagaatcacatgcagaggccagtgtacgcgcccccggctccagtgcaggttcagaatctggtgcagcggccagtgtacgcgcccccggctccggtgcaggttcagaatctggtgcagcgccccatgtccatgtacgcttccccggctcctgttcaggttcagatgcagctgggcatctacgggccccgggctccggtgcgcgggtaccccgtcacgatgtcccccgtgcggtccgtcgtcgcgccgcacgtcggcgagcagtgccatgcgttcggcggagaacccgtcgtggcccagcaatactacgggtacgggtacggggaaggagcgtacgggcgctgtactagcaacaacggaggaacctgtgccgacgaggaaagtcgtncaaacgcgttcccgtgccccgggttgccaacgatgagccggaa

SEQ ID NO: 6009 - DNA, 917 bp, Hordeum vulgare
  misc_feature (742)..(742): n is a, c, g, or t
  misc_feature (917)..(917): n is a, c, g, or t
  Predicted polypeptide sequence is orthologous to G137, G145
gagaactagatcaaccgccaggtcaccttcgccaagcgccgcaacggcctgctcaagaaggcctacgagctctccgtgctctgcgatgccgaggtcgccctcatcatcttctccaaccgcggcaagctctacgagttctgcagcggccagagcatgcccaaaacacttgagagataccaaaaatgcagttatggtgggccagatacagcaatacaaaataaggagaatgagttagtgcagagcagtcgaaacgagtacctcaaactgaaagcacgagtggagaatttgcagagaactcaacgaaatttgcttggcgaagatctcgggtcacttggcatcaaagatcttgagcagctcgaaaagcaacttgattcatccttgaggcacataagatccacaaggacacagcatatgcttgaccagctcactgatctccagaggaaggaacaaatgctgtctgaagcaaataagtgccttcgaagaaaactggaggagagcagccagcagatgcagggccaaatgtgggagcagcatgccgccaacttgctcggctacgaccatctgcgacagtccccgcaccagcagcaagcgcaacaccacggcggcaacgggctctttcaccccctggaccctaccactgagcctacacttcagatagggtatactcaagagcagattaacaacgcgggcgtgggggggtccctcatgccgactggctgccctgagatcgatgatcaagcangcaataaagtgcagacgggcttgaccttcggcgttggatctctcctacgtatttccgggcgacgggagcatagacgcgtccgacgctatagtcggtgggggttggccctggtgaaactttggaaccggttgtaatctgctgcaaaggcgccgtctccctccgtatagcgggttgn

SEQ ID NO: 6010 - DNA, 984 bp, Hordeum vulgare
  Predicted polypeptide sequence is orthologous to G137, G145
cgactttacgcagccagcagagagtagagagagagaaagaaagaggggaggaggaggaagaaggaagatgggtcgtgggaaggtggagatgaggcggatcgagaacaagataagccggcaggtgaccttcgccaagcgccggaacgggctgctcaagaaggcctacgagctctcgctgctctgcgacgccgaggtcgccctcatcatcttctccggccgcggccgcctcttcgagttctcaagctcctcatgcatgtacaaaactcttgagaggtaccgcacctgcaactccaactcacaggaagcaacacctcaggtagaaaatgagattaattaccaggaatatttaaagctgaagacaagagttgaatttcttcaaagttcacaaagaaatattctcggtgaggatctgggcccacttagcatgaaggagcttgaccagatagagaaccaaatagatgcatccctccagcatatcaggtcaaaaaagaatcaagtattactcgatcagctatttgaactgaaaagtaaggagcaagaattgcaggatgaaaacaaagacttgaggaagaagctgcaagacaccaccaccaccagctgcggagagaatgcggtccatatgtcctggcaagacggtgggcagagtagctccagaaggcatgccactgagccttacccgggagtactccaacacccggagcatgatacctccatgcaaattgggtatcctcaggcctacatggaccagctgaacaacagagatcacatggcttcacagcgccctggtggacatcctggatcgtctgcaggttggatatgattaactgatgtggagctgcgtcccgtcaccgtgtactgtagctattgtatttggacttgagtgacaattgctatgttcttttgtgtgtgtaccggagttgtggtggtgagcaccacatgtatctactgaaattacgtgtatgctaagctgcgttgtacgctgcg

SEQ ID NO: 6011 - DNA, 1140 bp, Hordeum vulgare
  Predicted polypeptide sequence is orthologous to G137, G145
cgggagggtggagctgcctgctcctcccccacccccttatcttcctctcccttcttgctaggagtagtacgcttggtggtggtggtggtgcatgtgtatggttgctgcagcatagctagggacagggaaggtggaggaagcagcagaggcgtcggccatggggagggggagggtggagctgaagcggatcgagaacaagatcaaccgccaggtcaccttcgccaagcgcaggaacggcctgctcaagaaggcctacgagctctccgtgctatgcgacgctgaggtcgcgctcatcgtcttctccaaccgcggcaagctctacgagttctgcagcacccagagcatgacaaagacactggacaagtatcaaaaatgcagttatgcaggacctgaaactactgtgcaaaacagagaaaatgagcaactgaaaaacagccgcaatgagtacctgaaactaaagacacgggttgataatttacagcgaacacaaaggaatttgcttggtgaagatcttgattcattaggcataaaagagcttgagagccttgagaagcaactcgattcgtccttgaagcacattagaacaacaaggacacaacatatggttgaccaattgacagaactccagagaagggaacaaatgttttcggaggcaaataaatgtcttcgaataaaattggaggagagcaaccaggttcatgggcagcagctctgggagcacaacaacaacgtactgagctatgaacgtcagccggaagtgcagccgcagatgcacggcggcaatggattcttccacccccttgatgctgctggtgaacccactcttcacatagggtaccctcctgagtccctgaatagctcatgcatgactactttcatgcccccgtggttgccttgattgaaaacagctagcgaagaaagtgtgaaaaataagtatatacgtggcacctggccggccgcatatatgcatgtataccacttcgagtgatggactattccagtcaagattctcagttattttgcgtgcaactttcgtgtgatgaaaattccagaaccctgtatttgatgctcaacgttattgtgttattgcgtgtaaaagatcatacattatattactactagagcggctatgtatgcgcg

SEQ ID NO: 6012 - DNA, 2354 bp, Hordeum vulgare
  Predicted polypeptide sequence is orthologous to G1382
agatcatgcatcgttgagccgcttggtgggcgagacggctcgatgggctccccgagcgggcacgcgggctcgatgaagtactccccgtgcttcacttctgcgccacggtgatctccttgggtcgggtccaagccgaaacctagctccggggacctcccctcgcccgccgggagctcgcccgagaagccctaccccgcggatcgacgcgtcgcggcgctcgccggcgcgggcgcgaggtacaaggccatgtcccccgcgcggctgccgatctcgcgcgagtcctgcctcaccatccccgccggcttcagcccctcagcgctcctcgactcccccgtgctcctcaccaacttcaaggttgaaccttcaccaacaactggtagtctgggcatggctgcgattctgcacaagagcgctcatccagacatgctgccttcgccacgggataaatctgttcgtaatgcccatgaagataggggttctagggattttgaattcaagcctcatctgaattcgtcttctcaatcactggctcctgctatgagtgatctaaaaaaacatgagcattctatgcaaaatcagagtatgaatcccagctcatcatctagcaatatggtgaatgaaaacagacctccctgttcacgtgagtcgagtcttacagtgaatgtaagtgctcagaaccaacctgttggaatggttggtttgactgacagcatgcctgctgaagttggtacatctgagccgcagcagatgaatagctctgacaatgccatgcaagagccgcagtctgaaaatgttgctgacaagtcggcagatgatggctacaactggcggaaatacgggcagaagcatgtcaagggaagtgaaaaccctagaagttactacaagtgcacacatcctaattgtgaagtaaaaaagctattggagcgtgcagttgatggtctgatcacggaagttgtctataagggacgccacaatcatcctaagccccagcccaataggaggttagctggtggtgcagttccttcaaaccagggtgaagaacgatatgacggcgcttcagctgctgatgataaatcttccaatgctcttagcaaccttgctaatccggtacattcgcctggtatggttgagcctgttccagcttcagttagtgatgatgacatcgatgctggaggtggaagaccctaccctggggatgatgctactgaggaggaggatttagagtcgaaacgcaggaaaatggagtctgctggtattgatgctgctctgatgggtaaacctaaccgtgagccccgtgtcgtcgttcaaactgtaagtgaggttgacatcttggatgatggctatcgttggcggaaatatggacagaaagttgtcaaaggaaaccccaatccacggagttactacaaatgcacaagcacaggatgccctgtgaggaagcatgttgagagagcatcacacgatcctaaatcagtgataacaacgtatgaaggaaaacataaccatgaagtccctgctgcgaggaatgcaacccatgagatgtccgcgcctcccatgaagaacgtcgtgcatcagattaacagcaatatgcccagcagcattggtggcatgatgagggcatgtgaagccaggaactacaccaaccaatattctcaggcggctgaaaccgacactgtcagtcttgatcttggtgttggaatcagcccaaaccacagcgacgcgacaaaccaaatgcagtcttcaggtcctgaccagatgcagtatcaaatgcaaaccatgggttcgatgtacggcaacatgagacatccatcatcaatggcagcgccagcggtacaaggaaactctgctgcccgcatgtatggttcgagagaagagaaaggtaacgaagggtttactttcagagccacaccgatggaccattcagctaacctatgctatagcagtgctgggaacttggtcatgggtccatgagagggaatgagagtgtctgcaaatgctcatagctccatgaatcatatattaccaacaatgctttgtaatgacaatctcttcagcaagattctcaattgtctcaattgtgtatcggttacaagtcagttcagccggaggcaagtatgctagtataagctatacgtgggggcactgcagcaaatacgcatgtgtctttttaagtgcggaaaaggcccttgctgtatgtagcatcgcagccctacattcgttgtacagcgaacctaatatgattaattaattagattatgagaatttggtttcgtgaactgtctaatcttctgtactggaatattgatagaaatatagattatggtaattttctttaaaaaaaaaaaaaaaaaaaaaaa

SEQ ID NO: 6013 - DNA, 1068 bp, Hordeum vulgare
  Predicted polypeptide sequence is orthologous to G140, G146
acgagaagctggctacaccatccacaggcctaatggtgaaggagtccgtgtccccgggcttgggatcggcgggtgctgctgctgagaagatggggagagggaggatcgagatcaagcgcatcgagaacacgacgaaccggcagctcaccttctgcaagcgccgcaacggactcctgaagaaggcgtacgagctctcggtgctctgcgacgctgaggtcgcgctcgtcgtcttttccagccgcgggcgcctctatgagtactccaacaacagcgtcaaggcaaccattgagagatacaagaaggcaactagtgacacctccagcgctggtacagtcgcagagatcaatgcccagcactaccagcaggaatctgcaaagctgaggcaacagataaccaccttgcagaactccaacaggactctaataggcgataccatggctaccatgagccacagagacctaaagcagctggagggaaggctggacaaaggcctaggaaagattagagcaagaaagaatgaattactaagcgctgaaattgagtacatgcagagaagggaaatggagctgcagaataacaacttctacttgagggaaaaagtcgctgagactgagagggggcaacagcagacgttgaacatgatgggggcggcttccacatctaatgagtacgaccaaaatatgatacaatgtgatccgagaaccttcctgcagttcaacatcatgcagcagcctcagtactacacccagcaggaggatagaaaaaccctcaactcagttgagaggtgatggatgcatccatgcatagctgtgtctctcatttacttcaagtgagattgaagctatatccgtgcactataactagaacttccttgaatgcatgtgtgtatttctatacacccccaatcaattttatcccataattaaggcttggccacaccaatgcaatgtatccatatgtattgcgatgaaacgacttaactctttcagtgcaacgcacgtacttcttcgcatatatctatgtaggagtacctttttctaaatgcaatactactggtggcgatttcat

SEQ ID NO: 6014 - DNA, 1163 bp, Hordeum vulgare
  Predicted polypeptide sequence is orthologous to G140, G146
tagagagatcctccttccgtagcatccatgatgagcatgatggccgatttgagctgcggagcttccggtgtgaccgtgaatgatcatcagctgacggctccggctccggaggagtcggcggtggcggggagcgagaagatggggaggggccggatcgagatcaagcgcatcgagaacaccaccaaccggcaggtcaccttctgcaagcgccgcaacggcctcctcaagaaggcgtacgagctctcggtgctctgtgacgccgaggtcgccctcgtcgtcttctccagccgcgggcgcctctacgaatactcaaacaacagtgtgaaagccaccattgagaggtacaaaaaggccaacagtgacacatccaactctggcacggttgcagaagtcaatgcccagtactaccagcaggagtcctccaagctgcgccagcagatcagtagcttgcaaaactcaaacagtaggtcactggtgagagattctgtcagcaccatgaccctgagggatcttaagcagcttgaaggcaggctggagaaaggcatagccaagataagagctagaaagaatgagctgatgtatgctgaagttgagtatatgcagaagagggaaatggagctacataacgataacatttacctgaggagcaaggtgtctgagaatgagaggggtcagcagccgatgaacatgatggcgtcggggtcgacgagcagcgaatacgatcacatggtcgcgccgtatgattccagaaacttcctgcaggttaacatgcagcagcagcagcattactcccaacagctgcagccaactgcccttcagctcggccagcagtacttcaactagttttgctccacaccctgcagtccacgcacgctagataatactgtcgcgtgcatgtgtgcttgcaatgtcgttgctcgttctccggtggtataacagtagtaaccggaatttgtggatcagatgcatgtgggactcgtaatatatatgtatgtatttgctcatgagcaactagctaggtgctgctagtcgatcaccacacaagtggtcgatttcggcgtgcaccatcgcgttgcatatcttccccaatgtattaattaattaccagcatttcgaattgtgtaccgaaaatcaatggaccagggattgacgaagggctaact

SEQ ID NO: 6015 - DNA, 485 bp, Hordeum vulgare
  Predicted polypeptide sequence is orthologous to G1451
cgtgatctgccagctgcacgacgtcacaatgcatgccgatgtggagaccgacgaagtgtacgcgcagatgacgctgcagccgctgaacccacaagagcagaacgacgcctacctgccggccgagatggggatcatgagcaagcagccgaccaactacttctgcaagacgctgacggccagcgacaccagcacgcacggcggcttctccgtgccccgccgtgccgccgagcgcgtcttcccccctctggatttcacgcagcagcctcctgctcaggagctaattgcgcgggatattcatgacgtcgagtggaagttcagacacatcttccgaggccagccaaaacgacacttgctaacaactggctggagtgtctttgttagcgccaaaagactcgttgctggagactcagtgctattcatatggaatgagaaaaaccagctttggctgggaatcaggcgtgccaaccggacacagactgtgatcg

SEQ ID NO: 6016 - DNA, 1464 bp, Hordeum vulgare
  Predicted polypeptide sequence is orthologous to G148
aggtggcgtgggggacgcagcattggatcgccctcattccgtcccgtgcttccagttagggtaaacccgtggtaactgccccaaagttaccctcctgtaaagttgagagagagggcgcgcgacagggatgtgtcaagcgagatcgacgcaagaaaccagcaccgagctacagtaactgtaccccccctgcctgcttgctcccctttttttcccttgcctccactaatatcccgcgccccattatatgctggggcatcatcgcttcccagcccaagccctatgtgttagtaggtggcaccgccggaggaagagcgcagagctagcttgctgatcggtagagctttgcttccttgcttgcttgggaggaggaggaggaggaggagatcatggggaggggaagggtcgaactgaagcgcatcgagaacaagatcaaccggcaggtcaccttctccaagcgccgcaacggcctcctcaagaaggcctacgagctctccgtgctctgcgacgccgaggtggcgctcatcatcttctccagccgcggcaagctctacgagttcggcagcgccggcacaacaaaaacattggagaggtaccaacactgctgctataatgctcaagattccaatggtgcactatctgaaactcagagctggtaccaggaaatgtcaaagctaaaggcaaaatttgaagctttgcagcgaactcagagacacttgcttggggaggaccttggaccgctaagcgtgaaagaactgcagcagctggagaaacagctagaatgttcactgtcacaggccagacagcgaaagacgcaacttatgatggagcaggtggaggaacttcgcaggaaggagcgtcagctgggagacatcaacaggcaactcaagcacaagctcgacgctgaaggcagcaacagcaacaactacaggaccatgcagcagatcacctgggctgccggcaccgtcgtcgatgaaggcgccgccgcatatcacatgcagcagcagcagcagcagcagcagcagcaccctaatcattccgctgcgatggactgtgaacccactctgcaaattgggtaccctcatcatcagttcgcggctcctgatcaggtagccaataatattccacggagcagcgcccccggaggggagaacaacttcatgctggggtgggttctttgagctatctggctgctctagcagcagctggttagcttgggtgtccaccagccaagaaaccaataaaatgcgcgtgctgctccgatgctctacacgagaagtaccctgcgtggcgcgttcccatttctttatttttactcgttgttcgtgtgtaagaagtaagaaccgatgcaggaactacttctatattttcagtgtttgaactacatggatcttgcaaaagacttgcaagctctaagctgtccattcatgcatgctcagttatctagtacaaccataatttctggac

SEQ ID NO: 6017 - DNA, 524 bp, Hordeum vulgare
  Predicted polypeptide sequence is orthologous to G1480
tttttttttttttttttttgctcacaagaattcgacatgattctttattcatattagcacttgaaactaacaagagaccgaggaaatacattaatcgcctagtagttcaccaatggggatgatcgaagaacccgcgtcatcagttaaaaatgtcgatggcgggtttttaccatgaatgaatattgactgcaacgacggcacgacaggatcacgggcacggcaggaagaccatggcgccgataggatggcagtatggcatctgcactttgctggatttcgtctcaagctgggcagacgccattgccacggtcaagtaccttcacccttctagaactagaagcttggcacgactccatgggaagcaacgtgaaaccctacgctgttgtcggagaaggagagccagaatttggcggcctcggcggcgctcgtgttgccgtcgtccgtcgccgccgcggcagggcgtttgacgaagcggcccttgaccctcggccgcgcctcggcgtacgccttgcggggaggcgtag

SEQ ID NO: 6018 - DNA, 1230 bp, Hordeum vulgare
  Predicted polypeptide sequence is orthologous to G1480
ccgagcgaaaaagcttggctgagagtcgcctgctcactgcagccaatcacggcggtggcgctggtgctagctgcgcttgtcgaactgtgagcgcgtgccatggagggggaggagaagccggtggtcggcggagcctactggggcgtgggcgcgagggcgtgcgattcgtgcgccaccgaggcggccaggctcttctgccgcgccgacgccgcgttcctctgcgccggctgcgacgcgcgcgcgcacggctccgggtcgcgccacgcccgggtctggctctgcgaggtctgcgagcacgcgcccgcggccgtcacctgcaaggccgacgccgccgtgctctgcgcgtcctgcgacgccgacatccacgccgccaacccgctcgcgcgccggcacgagcgcgtccccgtcgcgcccttcttcggcgcggccgccgacgcgcacaagcccttcccgtcgtcgggagcccaggccggcgcggcggcctctgccgaggacgacgggagcaacgacgccgaggcggcctcgtggctgctccccgagcccgatcacaaggatggcgccaacggtgctaccgcggacgtcttcttcgcggattccgaccattacctcgacctcgacttcgcgcggtcaatggacgacatcaaggccatcagcgtgcagctcaacggccagcccgagatcgacctcaatggcggcaacaaaggcttctactccgaccactccatgaaccacagcttatcgtcgtctgaggcggcggtggttcccgacgcggcggcggcgccggtggtgagcaggggaagggagcgggaggcgcggctgatgcggtacagggagaagcgcaagagccggcggttcgagaagaccatccggtacgcgtcccgcaaggcgtacgcggagacgcggccgcgcgtcaagggccggttcgccaagcgcacgggaacggcggacgccgacgccctggaggagcacgaggagatgtactcctcggcggcggccgccgtcgccgcgctcatggcgcccggccccgaccacgactacggcgtggacggcgtggtgccgaccttggtgtaattttgttgcatgcatgcacgcacgcaaagcctcgtctagcatttgatcactcaattgtatatgcatgattacgcgggagcgatccagacttccaatccaaccccccctccttaatttttgcccgatccctgtatttttcacctgtagcatatcatcatc

SEQ ID NO: 6019 - DNA, 1056 bp, Hordeum vulgare
  misc_feature (487)..(487): n is a, c, g, or t
  misc_feature (739)..(739): n is a, c, g, or t
  Predicted polypeptide sequence is orthologous to G1480
cggcacgaggtcgttcggcggctcggtggacggggagaagcaggacgccgtggtgaacctgaacgacgctctggaggccggccccgacgggaaggagaacgtgaagctggacttcctgttcgcggacatgatggaccctttcttcggctccgagctcccgcgcttcccgcacgctgacagcgttgtccccagcggtggcgcggtggaactggacttcggtggcgttgccgccgccgcagccgtcgtttccaacccgtcctacagctcctacacggcggcgtcgatcggtggaagcggctcctcgtcggaggtcggcttggtgccggacgcgatctgtggccgaggcggcggcatcatcgagctggacttcgcacagtccaaggccgcgtatctgccgtacacccccacgcctagccacagtactgtctcctcggtggatgttgggcctgtgccggagcggagcgaaagcgccgtcgcggcggcgacnccggcgatgggggaggggagggaggcgcgtttgatgcggtaccgcgagaagcgcaagaaccggcggtttgagaagaccatccggtacgcgtcccggaaagcctacgccgagagccggccgcgcgtcaaggggcgcttcgccaagcgcgccgacgacgccgacgccgacgccgtcgcagcgggcacgatcaccgcgccgcgtccctgcgtgctcgacttcagcggctacggcgtggtgcccaccttctgaggnggcgcctaacttcgtgtcctgcttcctccggcgaacgtgccggctgcgtgcctaattaacccggcgcggcatggccggcacgagcgcgccgacgtgcatgcgtcgtgttccctcttgtataattgcatgtaatgtttttcgagctggctgatcgctggctggagtggagtatactgctgacatgcatgcgcgcacgcatgtttcgctagaactagaatagaataatgcagatagttctagctgactagtctacctgtacccttttttgggctagcttgatgggaaattatgctagggcgacgtaacgtctttgctgg

SEQ ID NO: 6020 - DNA, 1455 bp, Hordeum vulgare
  Predicted polypeptide sequence is orthologous to G1480
cagcgccattgcctgccggagctaagaggatcgaccgggtacgctcagcttagggctattaggtagttagttatgatggagctgcgcaagtactggggcgtggggggaaggcggtgcggggggtgcgagggggcggcgccggcggcggtgcactgccgggactgcgcggggtacctgtgcacggggtgcgacgcgcgcccggcgcacgcgcgggcgggccacgagcgcgtctgggtgtgcgaggtctgcgaggtcagccccgccgccgtcacctgcaaggccgacgccgccgtgctctgcgcggcctgcgacgccgacatccaccacgccaaccccctcgccgagcgccacgtgcgcgtgcccatcgcgcccatcggctcccccgaggccgccgcggtggccgccgaggccatgatgctctgcggcgccggcgacggggacgccagggcggatcccgacgaggtgcacgaccagttgcaccaccacggacacgggggcatgctgaacctcaacgtggaggccggcaaggagggcgggaagatggactacctcttctccgacctcgtcgacccttacctcgccgtcgactttacccgcttcgcccacgccgacagcgtcgtgcccaacggcgtcgccaccgccgcggtacccgccgtcgtcgacctggacttcgcgtgcgggatcggcgccaagccgccgccgtcctacagctcctcatacacggccaacggctccggcgcgcacagcggctcatcatcggaggtcggcgtggtgccggaggccatccacggcggcgcggggagcttcgagctggacttcacccggcccaagccgcaggcgtacatgcccgcgtacaccccggcgccgccgagccacggcgtgggcatgcagcaggcgtcggcggtggacatggggtacctgacggtgccggagcggccggtggcggtgaccggggagggcagggtggcgaggctgatgcggtaccgggagaagaggaagaaccgccggttcgagaagaccatccggtacgcgtccaggaaggcctacgccgagtccaggccgcgcgtcaagggccgcttcgccaagcgcgccgaccaggacgccgacggcgacggcgacgacctggacgcggaggcgcatgccgtgccgtcttccacatcctacttgctcgacttcggttacggcgtcgtgccgtccttctgatccgtacgtcggcgcgcagcacgggccggccgccttgtacttgtaccattgatgcatgtacagagtaccgtaggggactagtaatccatgtactctcctgagctagttcgatcgcgctagtgatgtactagtagcaatactgtaaactgtaacagtagtattctggccaatacgctcgtttaattttggatcgccgaaaactagtactactagccgcaacatatggatcatcaattattattccgttttact

SEQ ID NO: 6021 - DNA, 539 bp, Hordeum vulgare
  Predicted polypeptide sequence is orthologous to G1480
taccctgaacactccatgaaccacagcatgtcaacgtccgaggtagcggtggttccggacgcgctgtcagccggcggggccccggcgccagcgccgtcggtggcggtggtagcgagcaaggggaaggagcgggaggcccggctgatgcggtaccgggagaagcgcaagaaccggcggttccagaagaccatccgctacgcgtcccgcaaggcgtacgccgagacgcggccgcgcatcaagggccggttcgccaagcgcaccgccgaggacgacgcgctggagcaggacgggccgttctcgcccgcgtcgtcggcgcacctggcatcggacggtgactacggcgtcgtgccgtcgttctgaggactctgctatagttttggcgcgcgcatccgtccgagtgcgcgcgagtgcggggtggctgcgacgcgtgctccgtgtaacattgaataatctgtacagttttgttccatgggattagtactgtgaccgtgccgacctgatgtactcactgttttccttctcccgaatccagtttttgt

SEQ ID NO: 6022 - DNA, 1031 bp, Hordeum vulgare
  misc_feature (872)..(872): n is a, c, g, or t
  Predicted polypeptide sequence is orthologous to G1488
gcctgcactgcaaggcggtggagacgccgcagcggaggtcaaggccgatggggcggggtaccctctgcaacgcctgcggagtctggtacagtaaaaacgggacgctgccggagcaccgtccggtggcaagcccaatcgtcgattcgccactggagagccagatctgggagcccgacgtgcctggggccatctacctggtcagaaagtcggccacggagaggcggcctcccaagacagaagccgcgccagcgccacggccggggacgagctgcttgcactgcgggtcgtcagagccacctttgtggatagaagggtccatggggcggagggaagtctgcaccgcctgcggcatgcggtacaagaaggggaggatgctgccggagtgccgtccagctgggtgctcagtgacggattcctggcagaagagcccaatcatcaactcccctccggagagtcccatctgggagcctgaggcgcctccggccgtgcacctgccaagaaagccttcgaagaagaagaataggaggcggtcgagaagccaagccccttctgtgccatggccggcaaataaggggagaggtgccagcattgtgggtcgtcagagacgccccagtggaaggaggggccaaaagggcgaagcacgctgtgcaacgcgtgcggcgtgcggttcaggccggggatgctgctgccggagtaccggcccatggcaagccccacatttgtggccttcaaacatgccaattcccaccggaaggtgcttcatatgctttggaccaggcctagacacgataagcattcgtcaccgttgcctgccatcaagttgccaactcttaccaatcctgtagaccttccgaacaactaacaagtagttntgcccatgaaaaccgccaaaaatggggctacttgaaaaccataaaacgcccgactgaagtaactatctttttagtaggcgactttccacctctttttttggtaaatatatttaattcttcttctccgcaattataactagagtgaataaaactcttccc

SEQ ID NO: 6023 - DNA, 716 bp, Hordeum vulgare
  Predicted polypeptide sequence is orthologous to G1494, G789
gttagctagacattcgcgcgatttcccagcaaaaatgaaacaagagagatcaccatgatttgctacaattttcctgccgggatctcaaagggggcagaagatggaagaacttggttcccatcagcgtttcctctgctccatgtatatactgctgtacttgctgctgctgtgccgccgcagttcctttccattttattgttcctcttatctcgttttcgtaattacctcatcttttgtttgggtgtatcgcgtttcccggcgcggtgttggcggtagcggcaggcgtaccgctgccattgggcacgtggtggagcgtcggactctgctgcagggccttcggccctagcgggtagtagcccaccccctgcgcaaaatgctggtggtggtggtggtgggccggcggctgcaggtggtggtggttgacgccgaggaagtgcgcgtactgctccggcaggcttccctgctgctgcggtgccatgaagggcatccgcgccatggacgcgggccccatctgcggcaggtactggtgcatgcccgggaacatcaccgccggcggcgccgccatgccgccgcccatccacatcatctgcacctgcatctgcagcgtcttcaggtactcgatcgcctcgtccagcatcgacgccttgtcagtcttgttgcagtggggtatgagctcttgcagcgctcgcatcttctcgttgatcctgtctcgtctc

SEQ ID NO: 6024 - DNA, 675 bp, Hordeum vulgare
  Predicted polypeptide sequence is orthologous to G15
cggcacgaggtatgaagctatttgtgggacagtacttgtagagtagatgggggagaaggaaagggaagcaagtttatttaggaagttatgatactgagcaaaaagctgccagggcatatgatgttgcagctcttaaatactggggactaaatacaaagctgaacttttcgatttcagaatatgaaaaggaactggcggacatacaagacatgtctccagaggaatgtgtgacatacttgcgaaggaggagcagctgcttctcaagaggggcttctatttacagaggagttacaaggaggcagaaagatggtcgatggcaggcccgcataggactgattgctggaactagagacatttaccttggaactttcaaaaccgaggaagaagctgcagaagcatatgatattgctgccattgagatacgtgggaaaaacgcggtgaccaactttgaccgaagcaactacatggacaggggcatgcattgtatagaaggggcagggttgaagctgcttgcaacgaagccagaatgatttgatatcgtatattgaacagatttggtaagccatattttggggcttagtggtacatacaagatagaagaactggtcgcagcctgtcagtatttgctgctgtatgattcttcagattatatatagttcttccagagagaatttc

SEQ ID NO: 6025 - DNA, 661 bp, Hordeum vulgare
  misc_feature (10)..(10): n is a, c, g, or t
  misc_feature (627)..(627): n is a, c, g, or t
  misc_feature (655)..(655): n is a, c, g, or t
  misc_feature (657)..(657): n is a, c, g, or t
  Predicted polypeptide sequence is orthologous to G1506
cgttggcagnacgcacattgtacaatgtaaatcagggcgataatgacggtgcaagcatgaacaaaccgcacaaagccctaccggtgatcggtaaataaagataccatgatgatccaagaacctaagggaaactactgctaccgcctgtttctatgctggttgctagtctacggttgcttgaggcggccctcgccatcagcaaccacgtctgcggaggtggagcttcgggctactgagctaagttgaaatggttggtaaagaagctctgcctctggctgccgtgcattgagaggaacctccagcagcaagtcttgatcagaattatccatgtactgtggaggggccagcatggatattttatctgggggtaacatgagtaagttaaatggcgctcctccagatttgggcaaaaatgaacctttgaactgaggagccatagtcacagatttgcaaacttttttggcaatcctcatggttccttctgggcagctttgcaactggctttcgtgaggccttttgagaggcttcatgttggatttggtaaggtctttcaaagcactggtattttcatttcctcctgtttccttagtgtcttctccctctaaagctactgaaactaaagctgancctacattttccagggtatgctgctttnantaat

SEQ ID NO: 6026 - DNA, 571 bp, Hordeum vulgare
  Predicted polypeptide sequence is orthologous to G154, G1797
aaagcttggaggtcaaaattgacaaaagcctcctaggcatcagggcaatgaagactcggcggtttgaagagcagctctctgcgttgaggctcaaggagacgaagttgcggcaggacaatgaagatctgtatatccagtgccagaaggagcagcaccttgagttggaggcgccccctgctccggtgaccatggcggagcagggccaggacgacgcggttgaagtggagacggacctatttcttggactgcccggcaccggccgcccctgagatggagtctccaggctttggaggaaaatgcccagaataagctggccatggagttgcaagcagcagcaagcaatcgatgcggacggcgtatatagatataaaccctgtggagccgaaaccttgagagtacatacatgagttagttgatgtcgtcgtttccccgggtccttcctggccgtggtgtgccgatgtcttgatgagatgagaggaacaggacgatcctctggagaagaaagtggcggagaggggcgaaaaggatatttatggtgcccaaaaaaaaaaaaaaaaaaaaaaaaaactcg

SEQ ID NO: 6027 - DNA, 808 bp, Hordeum vulgare
  misc_feature (726)..(726): n is a, c, g, or t
  misc_feature (737)..(737): n is a, c, g, or t
  misc_feature (746)..(746): n is a, c, g, or t
  Predicted polypeptide sequence is orthologous to G156
tcgacccacgcgtccggcgacgcgcgcgtcggcgtcgtcatcttctccagcaccggcaggatgttcgagtactccagccccgcctccagcttgagggatctcattgagcagtaccagaacaccaccaacagtcagttcgaagagattaaccacgatcagcaaatatttgtggagatgacacggatgaggaacgagatggagaagctggaggatggcatacgcaggtacaccggcgacgacctctcctccctctccctcgtcgacgtcaacgacatcgagcagcagctcgagttctccgtcgccaaagtccgtgcaaggaagcatcagctcctgaaccagcagctcgacaatttacgtcgcaaggagcatatcttggaagatcagaacagtttcctgtgccgcatgatcagcgagaaccagcatggcggtgatggaaagatggcggtgatgccgccggtgctgtcgatgctgacgccggccttcccggcgacgccgtactacacgggcgaggagtcgtcgagcaccgcgctgcagctgacgtccccgcagcttcagctccacgccgccgaagccgccgggttccggctgcagccgacgcagcccaacctgcaggacccggcgtgcagcagcctccacgccggccacggcctccacctctgagatttgatcatctgatcatcacgggcgcggtgatggacatgctgattcatggattctaggaagaanaagatcacggncgatggaanattgacccttatgatgcatgcatgaggatgactatttaatttgggagctatatgtatgtatg

SEQ ID NO: 6028 - DNA, 840 bp, Hordeum vulgare
  Predicted polypeptide sequence is orthologous to G1635
cagcaacccctcgctcaaacaatcatcagctagcagcctcgaatcatcagcatggcttctgctggccgtcgtcccacggtgctcctgcagatcgctctcttcgtcgtcgtcacggcggtcatcatcaacagctccgtctgccttgccgccggtggccacgacagcaccggcactgtagtaattggtccaggcaccggtagtggtagcaatgacccaaaccatcctgttttcccgtcgccgcctggtaaaccctacaccggccgtgggtgccgcacagtttactgatgtagaccaccggtaggtggccaaccctgaaaacacccgtgcgcatacccgcctattttccaaaacaatgcaaggatgaaagatgaaaaacctacgggcggcctaaatgcttatattatatgcatgcatgcattccttactgcatctattgattctactgtatcgtgagccagataccctacaagattggcgcatccttgatacatgtcatatagcagttggttaacatgaccaaacatgatttgcacttgtagtgatcatctacacgtatcccctcatgatgttgtttgagaacgtgcaattcaagtgatagattctgcatggagggtaccacgtgacgccatgtctctctacgttgaggtcgagtgattaatacaaaaatgcactaggccgagccaagtgtttagagcgaacaataaatatatgacaagaacgattcgcgcaagatatatatcttaaaactgcccgatatgatggcccaatatccatatgtgcacgctcagtcgtgttatacgtatatataataaataatgataacgacactcgtttatctcg

SEQ ID NO: 6029 - DNA, 797 bp, Hordeum vulgare
  misc_feature (11)..(11): n is a, c, g, or t
  misc_feature (29)..(29): n is a, c, g, or t
  misc_feature (795)..(795): n is a, c, g, or t
  Predicted polypeptide sequence is orthologous to G1635
ggttctttagnaacacattggcacaaagnaccgctgtccaaatccgaagccatgcccagaagtttttctccaaggtggtgcgcgaacccggagctaaaattgagatcgagatccctccccctaggccaaagaggaagccgctgcatccatatcctcgcaagcgtgcggactcttgcaacggggcaaacccagcaaatggaccatccaagcttgctcaaatttcatcatcttctggttctgaccaagagaatggttctcccgtgtcagtgttgtctgcaatgcagtcggatgcttttggatcatcgatgtcaaacccgtcatctcgcagtacttccccagagtcgtcagatgaggagaataatgttcctccaatggtcagcagagaggaaggtcaacaaacagggataaatcaatcccacaaggaggctgatcaggaaaacaaagatacgggtacctccgaagaggattcttctggtgaggtgcaggtaacaagcgtgaagctgttcgggaagacggtcgtcatcccagacccgaggaaaaggtgctccccggatccaggctcagggcatgaaaacggagggcaaacctcacattcctctaacaaaggaacatcacaagccccactggctgtagagattccaacacatacaaagggagaacaaatctcacaatcctctaacaaggcaacatcacaagccccattggctgtagagggtccgacgtatacaaagggagagcaaatctcacaattcttttacaaggcaacttcacaagccccactggctgtagaaattnca

SEQ ID NO: 6030 - DNA, 867 bp, Hordeum vulgare
  Predicted polypeptide sequence is orthologous to G1646, G715
gctcttcccccaatcccccgccccctcctcctcctccccgaaaccctagctgaaatggagcccaaatccaccacccctccgccgccgggccccgtgctgggcgctcccgtcgggtaccctccggccgccgtctaccctcccgcaccgccccccggctacccgcacgcgccggcgctctacgcgccccagccgcccccggccgccgtcgccgccgcgtcgcagcagaccgccgcgcagcagcagcagcagctgcaggtcttctgggcggagcagtaccgcgagatcgaggccaccacggacttcaagaaccacaacctgcccctcgcccgcatcaagaagatcatgaaggccgacgaggacgtccgcatgatcgccgccgaggcgcccgtcgtcttcgcccgcgcctgcgagatgttcatcctcgagctcacccaccgcggctgggcgcacgccgaggagaacaagcgccgcacgctgcagaagtctgacatcgccgccgccatcgcccgcaccgaggtctttgacttcctggtggacatcgtgccgcgggacgaggccaaggacgccgatgccgcccgtctcgcgggcatgccccatcccgccgccggcatgcctgccgtcaacaagggctactactatcgttcgaaacgataatgcccactctttttgttcccgccgaattcaatttccatcattaacatgaggactgaagaatagagacgcttacccttgcggatgtagtgtttcccgcctcacttatttcaccaatattattttagcctctaagaggaacccattacctgccgcgaattgttgccccgcaaatataaaccgcagccattatatgcgcagacaaaatattaaaca

SEQ ID NO: 6031 - DNA, 589 bp, Hordeum vulgare
  Predicted polypeptide sequence is orthologous to G1660
caataaagatgatctcaatttctcagtacattaatcagcaggccattagcattagctcatgttaacaacggcaacatgctactgtagctcaggtcacagacattcagattgtacagactacagagcaaagcaacacctacagcacattgattcaaataatttcatgtacatctcgtcccggaggcttttgcattcagaccttcatgctgcttcttcagtcatgctgcacttgagaggccatctgaattttgtttcattttcaactgaggaaccagctgcagcaccggaaccgggacggcacgcggccggtcttccggatgcgctgcacctgacgggccagccggactgcccgccggttccgcctcgcttcgaccctcgcctgcttcccctccaccttgtagctcaacgtggacagcctcttggtcaggctgttctttgcccgcgccttcatttggtcggcctgcacctctgcatgcctcatcttggcttcgaatttcgatttctgacagttctcccactcctgaatcctcacctccttcctctgatatcttgatgcgagcttgcacttcttggactctgcccatgccgt

SEQ ID NO: 6032 - DNA, 819 bp, Hordeum vulgare
  Predicted polypeptide sequence is orthologous to G1752
cttcaacacccccgaggcggccgccatggcatactgaccacggccgccttctccgtgcggggcgccgccgccatcctcaactaccccgtcgaccgcgtccaggagtcgctgcgcaccctcgcgctccgtccagacacggccggagggtcccccgtgctggccctcaagcgccgccactccatccgcaagcgatcccccaacaaggccaagaagaccaccgccggtgctaccatcctcgctcccaccaacaccaagatgatcacgacgaacgacgtcgaccaggcggcagccgcgtcgacggcgggctctggcgtggtggagcttgaggacctgggcgccgactacctggaggagctgctccgggtgtccgacgagccgtcggcgtcatctaccatggtgatgacagggtacgatcaccaacaccatcaccatgtttatgtggacgaccaatcggcgctcaccaacatggggccgatgctattccctcattgctagctagctacctagctccatccatccatccatcatccctcctctggtttgagttgaattgcaaatagtgcccacccagatcaaccgaacgctccatcagtcgtagccagtttcctttcttccttttcagcagcagccttttttctttttctttttcttgttgctgttggttgccaagttgcatgccccggcaccggcaattagtcaggcgggaaaacggccaagggacaacgggttttggatgcatgaatggtatgtatgccccctctcttttcaacggtcggagcggaccttataaaaagaaacttgttttggaaaaaaaaaaag

SEQ ID NO: 6033 - DNA, 677 bp, Hordeum vulgare
  Predicted polypeptide sequence is orthologous to G1760
gatcaaagactgacacagcgtgtcatccatactcaaaagtcaaaagaatagcatcattaagcaagtacagacctattcaacctatcctcgaccaaaaatctatcttattgacttgttcactgaatcaaatcgagagttgtgcaaatttgagactctgaatattcaggatgcagatggagtgcagagttgaaatcctagaatagaactacaagtgtacatgaggagggacgtgaacaagagttaatctgtttgttcttcgtccacatacaacatacaaagatctgtggcttcatctcagttgagaatgtctgtgaatgtaagtttcagggaggctggactagccttcaaatgagttctttttaaggtgtggaggggtgacgcggtgaagaaatgctccatgggtccatgtttccagtatttacctgactaaatttcctatttcacattgcggtctggcagacggagtcagcaagcttgagacagcaactgcacaacttgcaagaaagtcacgattatgaagacccatagattttgtaacttccttgaaagtaatgcagttgttgcctcatgcttggtgccaccacatgcaataactcaaaccctcggcgcatgcaggcggccaggcgcgcccaagaacaagcactcccggctgcgggaggagaggcggacctaaaact

SEQ ID NO: 6034 - DNA, 681 bp, Hordeum vulgare
  Predicted polypeptide sequence is orthologous to G1767
aagggaagagagggggtactaggtaggaatgtacaaatcatcaggctgttacaagggataggatttcgcctccacgcacacacatctcggctaacttagtacacaaattatttgatccattccgctccgcatccaaacacatgtcaaaaacacaaacaatcccagccgccgcccccgctgcattcttcctcctttcaccaatcacctcaaatcgctatcaccacacacaagccccatccgccttgtccatagtccaaattccacccttctccatcctcaaaaaattacttcggtaccaccaatgaagctccacatccctccttgcaagcctgccaaatccgagaaactcctccgaaaacagtttggcctctcaatcagaatgtgtgtgtagcataagatgcggcaggttgggctatgcggcttggcttatccccggcacaaaataattccttcatttatccccggcaagattagaatttgcatcccataacaacccatgcttgccgtacttcacatttgaagcggttatgcactctcgacagggaacagcccaaggtttccttcgccatgcgctctctttggccgccacgttgtatgagccttgaccacgtcagctccagactccagctggagcagatggtcgcactggatggcggaatctgggccgccgtccgcgcattc

SEQ ID NO: 6035 - DNA, 727 bp, Hordeum vulgare
  misc_feature (543)..(543): n is a, c, g, or t
  Predicted polypeptide sequence is orthologous to G1772
caaaaatccgcgaccaaactgccgagctttccttctccccgaagcctttccggaaaaaccctcgccccccttcccccaaccccggccgcgatcaacccccgccaccgccatggccagcgacgacgacgactgctactactactgcgacgacgacggcgacggcgacggggaggcggacgaggaggcggccgactggaacggcctggcggtgggggcggacgaggacgacctcggcctgctcgaggaggaaccgccgcccccggagcgccgcgtcgactgctgggctattacaggagacaccctttctgcagcccagcaagaagacttgtccatagtgatgaatttgctcaatataaagcagcaccaggcacgctctctgttcatcttccaccgatggaagatagactgcatctatgattgccttgacaggaaggggcgcgaccgcatgctcagagaagcaggcattgtactgcaggagaagaatagcatgctaataggtgcctcaagaacaccctcgacaagtgtccagtgcaatgtgtgctntgatgatgacttgtccccggctgctgtctcaactatggactgtggccattgcttctgcaatgactgttggacagagcacttcaatgcagccatagacggtggcaagaagcagatacgttgcatggaggtgaaatgcttggctatttgcgatgagggcattgggcaccgcctacttggccagaag

SEQ ID NO: 6036 - DNA, 690 bp, Hordeum vulgare
  misc_feature (616)..(616): n is a, c, g, or t
  Predicted polypeptide sequence is orthologous to G1772
agagagcttgaagcagttacttctacaataaatttgcaatttgcagcacaaacatagtagaacatgtctagagttctcttccccccccaaaaaaaaagtcatcttctcgctcaaggggtagatttggcattataggaactatgcacaacggcatcatgtcatgtcatgatatacaagaggacaagttgaaagttttgctctattggtcgggatcacagccccagggcgaggttgcggccctagggcaacaaaagagaacacaaattcctttatgtagctgaagaaacacaggtcagctgtacagttgcagcggaatgttccgtcagatactggagcttcagatcttgtccgccacttcggctggcacgttgagatcaaaaagagcaccgccgccatgagcatctcttctttctctcttgtgagacgggcgtccactgttgtcggaacttgatccgtgcagctgaagaataggtcgctttcccgtaagagatgagcctgattcactacataaaccaggttgactcttgtgttcatcctgactacatttcatagatggggcaatattatgaggcgtgcggagagggtacacaaatcattctcaatgcactgatacatntgcttgcagagcctatctaccacattggaaagattgataacatgcttcattgtatccataacctcctcgtcgct

SEQ ID NO: 6037 - DNA, 700 bp, Hordeum vulgare
  Predicted polypeptide sequence is orthologous to G1777
gtttttttttcttaatttgatcaatcagtactttattttgtgttggagaaaaggggattgaaattcacacctccgagtagatcattaattatacacttttgagaatttagttcattcttgtatgcccgcttcccaaactgttcgactctgacaacttcttccatgattttgtcggcgctacgaattgagaacggaatttcagaccaccgcttccacgttgacacaaaagcccgtatattttcagctagccaagtacaatcgttgtagcagtacatgcttccagcaggctgatgggcataacaagcagatgatgccgcacgataaatgactaaaatttggattgatagattcagcaacccagacgcacattcggctaagagattctcaatatttctgaaaaaaatcagcttaggaagggacggttgggttatatcatttatacgttggtaggttgagatcggcaaaatcctcgaatgtttcaataactgtttttagaactacttggggtaaggcagaaatccaataattttcatttcctcttaatttttgcttatcctggaagtagttcaatgaggatgcagcacttgtggaccctaactgtgacgcgtggttttctaccctgtctttccttatttcaggacttttatcttctattgtttcttcaccccagccccaggcatcgactacttcgtcttctaag

SEQ ID NO: 6038 - DNA, 904 bp, Hordeum vulgare
  misc_feature (498)..(498): n is a, c, g, or t
  Predicted polypeptide sequence is orthologous to G1789
gtagttcaggtcataggtcgaggtacgtacatagcagctttgccagcttaattgtcgatcgaggaaccaatcgtcgagcgacgtcaatggcttctctgtcaatgagcgtggggtggacgccgaagcagaacaagctgttcgagcaggcgctggcggtgcacgacagggacacgcccgaccgctggcacaacatcgccagggctgtcggcggcggcaagtcggcggacgacgtgaggcgctactacgagctgctcgtccatgacatcgcccgtatcgaggccggcaaggtgcccttccccgcctaccgtcccccatgtcccggccccggccacaacgccagctacgaggccgacaggttgaagcacctgaagatctaggagataatcggttaatggacaagaaatgatgcacactaagcagatggattgaacgaagcaacatgtgcatatggggctttggggtgtaccttttactataagcgtggctgcgtgggcattntggtcatgtaatatatacatgccaaacctacccggccgaaaaaagtcggcccgaccatgcagtggcatgcatgtttcataatacactagtgggctattggctaggggggcttttaagtatgtactggagaccggacttgtgcttctttaaaaaaaaaaataatttataataatataaattattatatttattatattaaaataaaataagggaaaaaatgaaaaagaaatatataatataataactctggggggggggcccggggccacatttgctccttaagggggtggttataaaatattttgtgcgcgcgttttataaacggtggggagtgggaaaaccctgtggggtccccatcttattaactttggaggaaaattccactttttacaagtgggggagaaag

SEQ ID NO: 6039 - DNA, 638 bp, Hordeum vulgare
  Predicted polypeptide sequence is orthologous to G1789
atcgtagctctgaagtgcgagaaacatactactctactcctcattcccatccaggtcgagatgtcttctgggtctacgagctcatcccgtggcggcgccaacgcggtgtggagcgtcagggagaacaagctgttcgaggaggcactcgccaactacggcgagggcacgcccgaccgctggcacaaggtgtcgcgcgccatgggcgggaccaagacggccgacgaggtgcgcaaccactatgagatcctcgaggaagacatcaagctcatcgagtctggcagggtcccgttccccaagtacaagtacaggaactgattcatcgcggagcgaagcatctgaattctgaagttcctgcaatgaggagaaccggttgataatctagcgtttacctggaataaaaagaagaaaacatgtgtgtgtgtgtatgtctgtgtgtgtacgcgcgcgcgtgcgtgcgtgtgtgtatgttgtggttttaagtttgtaagcaaatcaagtgcggttgctcttgcagacaatagcatgtagttttaagtcttccccaataagttccggagtaaacatcagtaatgtaaatctcctgtacttatttgtaatgtttatgaacatgtgcttggtaccaaaaaaaaaaaaaaagg

SEQ ID NO: 6040 - DNA, 615 bp, Hordeum vulgare
  Predicted polypeptide sequence is orthologous to G1797
gcggaattttttttttttttttttttttcacatacatataattcgttaaattaatttggatagaaaaacaaataaaagcatatgcatgcagatcgatcttgcgaccaattcttttttataagacctgcactgcacgcatgctgcagcctgtcaattattttttgcatcgctatctcccagtctcacaccgacctaattgaatcgattttatatatggacaaacatatttgatcgatttttgaatcgatcttcatggactgattgattgagcagatttaatcaatcaattctctactgctgctagctagacgacccgggccttccaatgaccagctcagtctccacttccatgtaatggccgtgccgctcgtccctctcattttcttcagctccagcaccatcaggcgatgtttcagcagcagcagcagtcgccagctctagcagaggcagcgccttgtactcttcacggagtaccgagttctccatcaacaacttcctctccttctccctcagctccgagattttatccagcattttctgttgcttcttttgccggatgcagcttaggctctttccagctgcagcttcagctcgtgcagctcatgggacgaacag

SEQ ID NO: 6041 - DNA, 768 bp, Hordeum vulgare
  Predicted polypeptide sequence is orthologous to G1804
gcggagatgcaggaggaagcaccctatgccggcaggggtcgttctccctgcctcccccgctgtgccgcaagacggtggaggaggtgtgggctgagatcaatagggagccccgcccggtgcatgcccagcctcaggccgcgcgaccctaaccgcagcctcctgtgcagccacctgcggggaacggcggcggtgcggttgcggccaacggccggcaggggacgctaggcgagatgacgctggagcacttccttgtcaaggccggcgtggtccgaggatctgtggccggcggccaggcgcctatgccgggcggcatggtccatggacagatgaaccccttgcagcaggggcagcagcctgtcccaatgatgtaccagatggcaccggccaacgggatgttcccggtgatgggcgacggcctggggttcgtccccaacggttattcagggatgcccttggtgccgccaccaccaccttgtaggggtggggcgggtttccctatcccccgggtctttgcacgggaaggagccccatgacgccttctttcttgatgaactgcttggtcaaatggccgataatagaaatacgggagggccccggacatggctgactctaaggggaccaattgttgccaaaggtcccctctgacgatcccctctgcccgttggcctagaaacccttttttaaaaccctcaaccggcaaaaacttaacccgggtttatcgcggggctcttttaacacttaactaaacccttgtggaaagaggacatg

SEQ ID NO: 6042 - DNA, 849 bp, Hordeum vulgare
  misc_feature (468)..(468): n is a, c, g, or t
  misc_feature (614)..(614): n is a, c, g, or t
  misc_feature (620)..(621): n is a, c, g, or t
  misc_feature (639)..(639): n is a, c, g, or t
  Predicted polypeptide sequence is orthologous to G1855
gagcgagggttcatcggcacttaccaggactggtgtgaagccttctcgacgtatccgagaacctacgaccttttgcacgccgacagtttgttcagcatctaccaggacaggtgcgacataaccgacatcctcctggagatggacaggatactgaggcccgagggcacggcgatcatccgcgacacggtcgacgtgctcaccaaggtccaggccatcggcaatcggatgcggtgggacagccgcatcctggaccacgaggacgggcccttcaacccggagaaggtcctggtggcggtcaagacgtactggacggcggacccgtcggagcacagctgagctgcagctctccgaactcagaaatggcttgcgcggtaaccggccgtgatggtgatgatcgtgtcggtttcgccatctcagtgtgtgtttgtgtgtgtagtaagcagtgcgcttggttctctcgcctttttntgtctaattctttggagttcgggtcgaaatgaaaaccagaaaatacgtcgaacagagcataggttttaattagcttggacgaccagagattgctactatgtactactacccaagattgactaactggaaaaaataggtctttaaanaaaaannaaaaaaaatataaaaaanaaaaaaaataaaacctggggggggggggcccgcggaccccaacttcgcccttttagggagggcgtatttacatttcaccgggcgcgtgctttttaaaagcgttgtgtaaatggggaaaaacccgtggcgtttcccaactttaattgggccttggagcacaatcccccctttttgccgggtggcggtataagcagagagaggccgcccacg

SEQ ID NO: 6043 - DNA, 582 bp, Hordeum vulgare
  Predicted polypeptide sequence is orthologous to G1863, G2334
cggcacgaggcaagcgttcaaacgcaaaaacagcacgcacagcacgcaccagacactcagacagccacgggtgaagggcacactccagagatgaccgagcgaaggcaggaggaacactcgccgccgtccaagctcccccgcctctccggcgccgatgacgacgccgacgccaacgacggcgtaggcacggtgaccatggccgcgccgttgccgctggctcttgggctgggcctcggcgtgggcggctgctgcagtgacagcaggcgcagcgacgcggaggccacgcggccgtcggcgctgacgttcatgcagcggcaggagctggagcaccaggtgctcatctaccgctacttcgccgccaacgctcccgtgcccgtgcacctcgtcctccccatctggaagagcctcgccgcctcctcctccgctcctcagaggttcccatcactggcggggctggggagcatgtgctacgaccagaggagcagcatggagccggagccggacaggtgccggcgcacggacggcaagaagtggcggtgctcgcacggcgtggtgccggggcacaagtactgcgagcgccac

SEQ ID NO: 6044 - DNA, 552 bp, Hordeum vulgare
  Predicted polypeptide sequence is orthologous to G1863, G2334
cggcacgagggggagccctgtccttcttcggcggcggcggcggcgacttcgacgacgactcggctgcggtgaagcaggagaaccagacgctgcggcccttcttcgacgagtggcccaaggacagggactcgtggccggagctgcaagaccacgatgccaacaacaacagcaacgccttctcagccaccaagctgtccatctccatgccggtcaccagctccgacttctccggcaccaccgccggctcccgctcgcccaacggtatatactcccggtgaacggcgtcggccggcctgatctctgctgatttgccgtggtcacgacggacgtcctcaaatcatcacagatgagcgaaccggccgacccgatcgaatgtgtctgtgagccgactgcagcttgcttgctcattttgtatggatcgtcgtccagcaggaacaaaacactactcctttaatttcctttctttaatttcacaacgttttttctgggttttgccgtgtatcggccggaactgtactaccaagttttctatagcctcgatggtcatgcacg

SEQ ID NO: 6045 - DNA, 615 bp, Hordeum vulgare
  Predicted polypeptide sequence is orthologous to G1863, G2334
aatggataacacacatcatatttgatcttcaagagagctgccaatactacacttaacttgcaagcttttgccattaatcaacactatctacatacttaacgcacgcctagagatcatccaaacttaattaacactatgccaaactagaatagtaatcgatcagcgtgcagttgatgtccagctcgtctcaacttcaaatcacagcccatatatacaggctaaaaaccaaagattaaaatcgctggagaaacgatttaggggcggcctgtcttagcagctataccggatgctgcatcgcgggcaatggagacaaatagaggcgacttttccggaggggggagatgatttctagaggtttctgccgatcttgaagccctatagaggatttggcggcggcagcagctatctcggctattttatgggagatggagatctgatttcatgctaaaaaacactcgaccacgctgctatcggcttagccagcataaactctaattcatgctaaaaaccactcggggacgcacatcatcaggtcatcgtcccgccccagcacgtctgccccgctgaaacccggctgctgctggcaggttcccgtcgagaaggacgagctcgggc

SEQ ID NO: 6046 - DNA, 669 bp, Hordeum vulgare
  Predicted polypeptide sequence is orthologous to G19
aaggtgaggaggtgacggagaaagcgccggcgccagcgcggaagacggcgtaccgtgggatcaggcgccggccatggggccgctgggctgcggagatccgggaccctaggaagggtgcgcgcgtgtggctgggcacctacgctaccgcggaggaggccgcgcgcgcctacgacgtcgcggcgcgcgatatccgcggggtgaaggccaagctcaacttcccgcccgccgtgggcgcgccgcaggcggcggtggcgggggcgcccaagaagcgtccgagggtcgcggcagaggagagctctgcgtcttggtctccacttccgggcacagctaccggcgtcggcagcacggacagcctgcgggagagcatgtccgggctggaggcgttcctggggctgaaggacgccgccggggacgacgacgtccagcccttggaggccgtcgatatcatcttcgagtagtcgtgtgccgtcgccacataccgaccgctcttgcggggtccataggtacatttgccgataaataagcggtcgttcggctttcctgggcttcgtgaggcatatccaggtcatttgtacctgaatgtatgtaagtcgagcacgactatcacaaatgccgacaaagtttaaaaaagtggtattttcagcaaaaaaaaaaaaaaaaaaacttgaa

SEQ ID NO: 6047 - DNA, 585 bp, Hordeum vulgare
  misc_feature (404)..(404): n is a, c, g, or t
  Predicted polypeptide sequence is orthologous to G1944
cggcacgagggttgtgcatgtgcctgccatgagcgcaagctctgagccacccaggcagaagcgcggccgtccgcggaagaacaccccagatggtaccaagctgccagctatcttccctgcaccatatcctattggtcttgtggcttccccgacaccagctctacccccgggcttcacgttgggattgtggggcgtaggcgtcgtgaggccccaggcaccaccagcactgccgtcgccattaccgccaccaccctttgagaattcaaaacaacgggccaagaagaagagggtatggccgccgagctccacaaccagcaagaagcagcgggagttggctgtagcagagccaggtgccactggattagttcctcaggtcatcacaatccaaggtggagaggatgtancagtgaaagtcatgtcctattgtgggaatgggtgggcagtttttatcatgtctgccgagggcgccgtacgcaatgtgacattgaagcaaccagcttcttcctgtggaactgttatttatgagggttattttgacattgtctctttgtctggcgtgtacgtgccgtcaaaaagtaatggact

SEQ ID NO: 6048 - DNA, 718 bp, Hordeum vulgare
  misc_feature (547)..(547): n is a, c, g, or t
  misc_feature (575)..(575): n is a, c, g, or t
  misc_feature (614)..(614): n is a, c, g, or t
  misc_feature (664)..(664): n is a, c, g, or t
  Predicted polypeptide sequence is orthologous to G1944
gcaggaatgttttttttttttttttttttgatcgagcaccatatatttaatcacaaggacatacaaaatagatccacaaggaaaatgaattaattgcacggtgtaagtatgcatatataaattttgaactattgggggcatcgatgagttcagttcagttcatatggtgtataattttcaactatttgaatccctccgaatttctccgcacgtttgcagcgccctgagagcgagagacagacgagactagcttgctgagccagctcctgcggcttctgaagttctgaagactccacgacggagcagggctggctggccggcgagcactcgtcctcttaaccctccggagacggggacccttgattacctccgacgacggggtcctcctcgcctcggctgcgggcggtgccgacgccaccggctgcgcggtccagttctccaccctgaacgccgacgcgcccttgccggcccgcgcctggctgccgctgtacgagtccgccatgtcgccgccgctggagatggtgaaacccaccgtcggttgcgccgncaccgtcttcatctcgatcaccggtttnttgccttctgctccatctggtagctcggaaggaagtttncacaaccacctgaacagggcttgcaagcacaagaatgccagttacgccgnctccgatgacgcggccatcggcggttgctagagaagacgcttattctaccgcag

SEQ ID NO: 6049 - DNA, 346 bp, Hordeum vulgare
  Predicted polypeptide sequence is orthologous to G1950
ttttttttttttttttcccaaacgcaacctgccctctccgtgtgagactcgatccaacggaaagacagatagacaaccaaccgatccaatcgatgatgatcaatcggcagatcacttcatcattcttgcttaaaacctatgcactaatccgaaccaaaacggaacagacagacacacacacgagacactactatgaacagcaaaacagacacgcagcgcatgcgtatgcatgcagcaagttcggtctaaaaccagcagcgcatgcatatgcatgccccaagttcagtccacaacaacaacaaccaacgaacctactactactaccaaaataaacaatccctcgtgc

SEQ ID NO: 6050 - DNA, 1815 bp, Hordeum vulgare
  Predicted polypeptide sequence is orthologous to G2
ggcgcagggccctctcctcgtcctcctccagtcctcatccccatggccaccaccaccgcctccaccccccaccactacttctactcctcccgcctcgccctcgcagcccgcggccaccgcgctcccatgccatagacgccacccagctgatcggtcgacctcgctcggacgcggcacggcgagcgaggcgggcatacctgcgtttcatttgcgagttcccggcgcgcgggcctcggatcggaggacggagatggtgctggatctcaatgtcgagtctccggccgactccggcacgtccagctcgtccgtgctcaactccgcggacgccgccggcgccttccggttcggcctgctcgggagccccgatgacgacgactgctccggcgagctggcgccggccgccgcgtccgggttcgtgacgaggcagctgttccccgcgccgccgcccgcgcccggggtcatgatggggcaggcgccggcgcctccgcccacggcgccggtgtggcaacctcggcgcgccgaggagctggtcgtggcgcagcgggtggcccccaagaagaagacgcggcgggggccgaggtcgcgcagctcgcagtaccggggcgtcaccttctaccgcaggaccggccgctgggagtcgcacatctgggattgcgggaagcaggtctacttgggtggtttcgacaccgcgcacgcggccgcaagggcctacgatcgcgcggcgatcaagttccgggggctggaggccgacatcaacttcaatctgagcgactacgaggaggatttgaagcagatgaggaactggaccaaggaggagttcgtgcatatcctccgccgccagagcaccgggttcgccagggggagctcgaagtaccgcggcgtcacgctccacaagtgcggccgctgggaggcaaggatgggccaactgctcggcaagaagtacatatatcttgggctgttcgacagcgaagttgaagctgcaagagcgtacgacagggcggcgattcgcttcaatgggagagatgctgtgactaactttgatagtagctcctacaatggagatgctacacctgacgtcgaaaatgaggcaattgttgatgctgatgctcttgacttggatctaaggatgtcgcaacctaccgcgcacgatcccaagagggacaacatcatcgccggccttcagttaacttttgattcccctgagtcgtcaaccacaatggtctcctctcagccaatgagctcatcgtcccagtggcctgtgcatcaacatggcacagcagtaccacctcagcagcaccagcgtttgtacccatctgcttgtcatggcttctaccccaacgtacaggtgcaggtgcaggagaggcccttggagccaaggccccctgagccgtcctccttccccggctgggggtggcacgcgcaggccgtgccgccgggctcctcccactcgccgttgctttatgctgcagcatcatcaggattctctaccgccgccggcgcgaaccccgccccgcccgccgtcgtaccccgaccatcaccaccgcttctactcccccgcccgccggacaactagctctctgcttactcccatggacggtggtcgacgggtgtgggcgtgtgcgcgggcgcgatcgacgtgttcgcgccttgtcggtaacagttgttgtgaattaatcggagagagataacattgccgagccatgtgtcactggctggttcctctccctcgccatgatcagaatcacaggcatcatggtttcccgttcagactacgtatccatgctttcaatcatgatcatgatcatgcggttgtcc

SEQ ID NO: 6051 - DNA, 661 bp, Hordeum vulgare
  Predicted polypeptide sequence is orthologous to G2011
cggcacgaggggcgcatggaccacacgcacaccggcaccaacaccacgcccgccgcagtcaccgcctccgccgccgactccatggacgccgcgctgctgctcgagcccaagctcgagatgctgcagcagcagctgccctcgcccccgggccactacgccgcgctggaccatcacctgatcccgcccccgcccgcgctggtggtgccctgcgagccgccgcggcccctcgaggcgctgctgcaggggcagcagctgccgccgttcctgtccaagacgtacgacctcgtcagcgagccgcagctggacggggtcatctcctggggccccgccggcaacagcttcgtcgtctggaacccttccaccttcgcccgcgacgtgctcccgcacaacttcaagcacaacaacttctccagcttcgtcaggcagctcaacacctatggctttcgcaaggttcatgctgatagatgggagtttgctcacgagggatttctgcggggcagcaaacatttgttgaagacgattgtcaggcgccggtcgtcgccgacgcaacaaagcagccttcagcctggttcatctgtattcaggaagatccagtcaggttcttctggtgagtccactctggaccctgaactgagctccctgagaagggagaagaacgcgc

SEQ ID NO: 6052 - DNA, 544 bp, Hordeum vulgare
  Predicted polypeptide sequence is orthologous to G2057
gccgagcaggcgccgagccgcgcatgatgccgtggaacgtgcccgacccaggcggcgggagcaccggcggctacctgttcaacgtgtcgcagcaggcggcgcatatgcaggcggcgctgagtggccagagccagttcttcttccagaggggaccccttcagtccagtaaccagccctccgaccgaggatggccggagaccgtcgaagctgacgacaacaacccgatgcagcagcagcaccaccaagggggcttgaacccttccgtgtcggccatcgggttcgggcccggcgtcagcttctccgggttccgcgtccccgcgaggatgcagggcaacgaggagcacagcggcggcaatggcgacaagccgccgtccgtttcctcggcttcccgccactgacagcagcagcagtggacgacagatgacttcaccaccaacctccacagcgtaccagtaacgacatccgccatcagctcctccacttgcatcactggtgcgaaaagctaattcgatgccgcttcttcacaggagctggcgatcgattg

SEQ ID NO: 6053 - DNA, 1300 bp, Hordeum vulgare
  Predicted polypeptide sequence is orthologous to G2071
gtggggagggccggagggggtcatggacttcaggagcagcaacggcgggtcgtcctcggagcgcaggccggctgcggagggggcgtcgctgacgaggcaggggtccatctattccctgacgttcgaggagttccagagcacgctcggcgggggcgccggcgtcggaggcggcgacctcggcaaggatttcagctccatgaacatggacgagctgctccggagcatctggaccgccgaggagagccaggccatggctgcctcggcctcgggcgcgggcgccggcgcgccgccgatgtcgctgcagggccagggctccctcacgctgccccgcaccctcagcgccaagacggtcgacgaggtgtggcgcaacctcgtgcgcgacgacccgcttccggtgggggcggagggtgccgagccgcagccccatcggcaggccacgctcggggagatgaccctcgaggagttcctggtcaaagccggcgtggtgcgagagatccccaccgctcctgcggtgccgcccccgcccatgcagccgcggccggtccctgttgcccctaaaggcgctaccttctacgggaatttcccgagcgccaacgacgtcggtacggcggcgctggggttcccgccggtcgccatgggggatctggccttgggcaatgggctcatgccgagggcactcggtatgggcggcgcccccctggttgtgcaaactgcggtcaagccggttgattccggcagcaaggggagcgaggatctctcatcgccgtccgaaccaatgccgtactcgttcgaggggattgtgagggggaggaggaccggcggcggcgtggagaaggtggtggagaggaggcagaggaggatgatcaagaacagggagtccgccgccaggtcccgcgcccgcaagcaggcttatacaatggagttggaggctgaggttcagaagctcaaggatctgaacgaggaactggtgaagaaacagaccgagatactgaaaatgcagaaaagagaggcccctgaaatgaaggaccagtttggacggaagaagaggcagtgcttacgaagaacgctgaccgggccctggtgaggatcaaggagtcaacatcgacattccgccggtctacctgctttgtacatataatttgctctattgtaaaccgatgatggaccagacctgtgcttgattgaccttctagtttcctttctcgtgctgcttcagagaccgctgacctgtaggctagtgtgtagtcgaggaggggagccgtaagtaagaaccgctgtaatttggcagttgtccttcaga

SEQ ID NO: 6054 - DNA, 331 bp, Hordeum vulgare
  misc_feature (66)..(66): n is a, c, g, or t
  misc_feature (78)..(78): n is a, c, g, or t
  misc_feature (155)..(155): n is a, c, g, or t
  misc_feature (195)..(195): n is a, c, g, or t
  misc_feature (197)..(198): n is a, c, g, or t
  misc_feature (210)..(210): n is a, c, g, or t
  misc_feature (216)..(216): n is a, c, g, or t
  misc_feature (219)..(219): n is a, c, g, or t
  misc_feature (224)..(224): n is a, c, g, or t
  misc_feature (230)..(231): n is a, c, g, or t
  misc_feature (235)..(235): n is a, c, g, or t
  misc_feature (249)..(249): n is a, c, g, or t
  misc_feature (251)..(251): n is a, c, g, or t
  misc_feature (259)..(259): n is a, c, g, or t
  misc_feature (270)..(270): n is a, c, g, or t
  misc_feature (291)..(292): n is a, c, g, or t
  misc_feature (295)..(295): n is a, c, g, or t
  misc_feature (306)..(306): n is a, c, g, or t
  misc_feature (313)..(313): n is a, c, g, or t
  misc_feature (315)..(316): n is a, c, g, or t
  Predicted polypeptide sequence is orthologous to G21
tttttttttttttttaaaagaaggctaaatataagccatacgattttcagttgcctcaaaaacagntccaacaaaccnaatcacaaccacaaccgggggaaaaaaaaacagatcctatcaggcagtagatgaacacagatcctatcaggcagtanatgaacccagctatggggactgggagcgaaggaagggaancnnacggggcggggntgatcnganggatncagccnntganggccttttaaaacntngttccaangtctttccttncccgaaaatcggccggacgannccntaaacggcccnttgaagnanncggacaacctttcaa

SEQ ID NO: 6055 - DNA, 969 bp, Hordeum vulgare
  Predicted polypeptide sequence is orthologous to G21
ctcacgctctcgctcgctcatcactccccaactactaactccaccaccagcagcaggcagcagctagcgcgcggcagccatgggcgccacggaggattcctcctccggctccgagacgaccacctcgtcctcggtggaggccctggcctcgccgccgtccccgacggccaccaccgcgtcgtccaagaagaagcgggcgcgcaacgacgggcggcacccgacgtaccgcggggtgcgcatgcggagctggggcaagtgggtgtcggagattcgggagccccgcaagaagtcgcgcatctggctcggcaccttcgccaccgcggagatggcggcgcgcgcgcacgacgtggccgctctcgccatcaagggccgtgccgcgcacctcaacttccccgacctcgcccacgagctcccgcgcccggccaccgccgcgcccaaagacgtccaggcggccgccgcgctagccgcctccgctgacttcccggcctctgccactgccactgccaatgccggcgccaagaaccccgacggcccggaacccaacgccgcctctgcgtcgacaccgccggacacagccgaggacgcgctgttcgacctccccgacctcctcttcgacctcagacacggccctccgtcctgccaggtctcgtgcgcttccacgtgggacgacgacgtggccttcgccggccccggcgccggcgtgttccgcctggaggagccgctgcagtgggagtattgaaaacccgcccggtcgccgccgccgccgctgcatgcatgtgtggctcgtagatggtcgttaccacatcggaccagaaatcatgtcgaaacgatcggtgaaccagcgctgcgtttgcctttactaaatttaggagtcgggccatgtacaaattggggttagccctgtgttctttatcgtatttgctttgcgtggattgtggggcaaaaaaaaaaaaaaaaaaaaaaaaaaaa

SEQ ID NO: 6056 - DNA, 1015 bp, Hordeum vulgare
  Predicted polypeptide sequence is orthologous to G2107
gcacactcctcagtcctcagtaagctcaagcaccatgctcagactgttcaagaaggaagccgcctgccaatcacccagcactctgccggtagccatggacatgggccttgaggtctcgagctcctccccctcctcctcgtcggtgtcgtcctcgcccgagcacgcggcgaggcgggcgtcgccggcgaagcgccccgctgggcgcaccaagttccgggagacgcggcacccggtgtaccgcggcgtgcggcgccggggcaacaccgaacggtgggtctgcgaggtgcgcgtccccggcaagcgcggtgctcggctctggctcgggacgtacgccacggctgaggtcgccgcgcgcgcgaacgacgctgccatgctcgccctgggcggccgctccgccacgtgcctcaacttcgccgattccgcgtggctgctcgccgtgccgtccgccctgtccgatctcgcagacgtccggcgcgcggctgtcgaggccgtcgcggatttccagcgacgggaggctgccgatggctccctcgccatcgctgtccctaaggaggcctcctctggcgctccttcactatctccgtcgtctgggtccgacagtgccggttcgacggggacgtcggaaccttccgccaatggagtgttcgaggggcccgttgtaatggacagtgaaatgttcaggcttgacttgttcccggaaatggacctgggctcgtactacatgagcctcgcggaggcgctgctcatggacccgccgcctacagcgaccatcatccacgcgtacgaagacaacggcgacgggggagctgatgtccggctctggagctatagtgtcgatatgtgatttcccagatgattctgctctgttttgactgtgtactgactgctgagtagtttttttgtttccttaggaaagttttcctcttttagagtgaagatgttgtagctaataaactgaagctgcttccaatccagcactgaatgaaacagttttagtcgctgcaattcttatgcc

SEQ ID NO: 6057 - DNA, 915 bp, Hordeum vulgare
  Predicted polypeptide sequence is orthologous to G2107
gtcctccggcgcttctccacacacagcaacttactcaaccacgcactccagtcaagcgtctccactaacactagctagctctagaaatggacgtcgccgacatcgcctccccgtccggccagcagaagcagcaggggcacaggacggtgtcgtcggagccgccgaagcggcccgcggggcggaccaagttccacgagacgcgccacccgctgtaccgcggcgtgcggcgccggggccgggtcgggcagtgggtgtgcgaggtgcgcgtgcccgggatcaagggctccaggctctggctcgggaccttcaccaaccccgagatggccgcgcgtgcccacgacgccgcggtgctcgcgctctccggccgcgccgcctgcctcaacttcgccgactccgcgtggcggatgcggccagtgctcgcgaccaccgggtcgtttggcttcagcagcacgcgggagatcaagcttgccgtcgccgtagccgtcgtcgcgttccagcagcagcagattattcttccagtagcgtgtccatcgccggaggcgcccgccagcccgagcgccgctctgttttacatctcgtccggcgacctgttggagctcgacgaggagcagtggtttggcggcatggacgccgggtcgtactacgcgagcttggcgcaggggatgctcgtggcgccgccggacgaaagagcgaggccagagaaccgcgagcacagcggcgtcgagacaccaataccactatggagctatttgttcgactgctaatttagcacgcagtgtaaagttgtttacatagttgtgttgtgttcctctttttttttttttttagaaaaggaggatctcatccgattcaattgtgctaagttaaactttgagtttgtgttatgctcaaaaatgctacacctacaaacacttc

SEQ ID NO: 6058 - DNA, 1010 bp, Hordeum vulgare
  Predicted polypeptide sequence is orthologous to G2107
aaaccacctgcttccactccctccccctgcttacactccagcagccagcatagccaggcagccatggacgttggtgccctcagcagcgactactcgtcggggacgccgtccccggtgggcgcggacggcggcaacagtgagggcttctcgacgtacatgacggtgtcttcggctccgccgaagcggcgcgcggggcggaccaagttcaaggagacgcggcacccggtctacaagggcgtgcgccggaggaaccccgggaggtgggtctgcgaggtgcgggagccgcacagcaagcagaggatatggctcggcacgttcgagaccgcagagatggcggcgcgcgcgcacgacgtggccgcgctggcgctgcgcggccgcgccgcctgcctcaacttcgccgactctcctcgtcggctccgggtcccggccgtgggtgccagccctgatgagatacggcgggcggcggtagaggcggctgaggcattcctgccggcacccgaccagagcaatgcgcccgccgaggaggtagccgctgcaccaacgatgcagttcgccggtgatccgtactacgggatggacgatggtatggacttcgggatgcagggctacctcgacatggcgcaggggatgctcattgcccctcctccgttggtaggtccgtcagcgactgccggagacggcgacgatgacggtgaggtcagcttgtggagctactgattacgcgcatttgagttatgccatgtgtggtgcgacgaactactaatgcatgtgcagctttatatagtaatcgagtagaggaagtgtactgcatggttgccctttccttttctccactttgttctaaacttctctgggtaatgtacgtttgctctctgatgaactgcgatcagaagaagcagagggcctgatcttgagtgtagtgttcgagctccgaaggagtgttggggctagctatatgtatctcccttgtttattatgcatgagcggagtgtcttcgtcggtgtttggtt

SEQ ID NO: 6059 - DNA, 817 bp, Hordeum vulgare
  Predicted polypeptide sequence is orthologous to G2107
ccacaacgcactctcgacgctagctgcgagccatggacacagttgccgcctggccgcaatttgaggggcaagactacatgacggtgtggccggaggagcaggagtaccggacggtttggtcggagccgccgaagcggcgggccggccggatcaagttgcaggagacgcgccacccggtgtaccgcggcgtgcgacgccgtggcaaggtcgggcagtgggtatgcgagctgcgcgtccccgtaagccggggttactccaggctctggctcggcaccttcgccaaccccgagatggcggcgcgcgcgcacgactccgccgcgctcgccctctccggccatgatgcgtgcctcaacttcgccgactccgcctggcggatgatgcccgtccacgcgactgggtcgttcaggctcgcccccgcgcaagagatcaaggacgccgtcgccgtcgccctcgaggtgttccaggggcagcacccagccgatgcgtgcacggccgaggggagcacgacccccatcacctcaagcgacctatcggggctggacgacgagcactggatcggcggcatggacgccgggtcctactacgcgagcttggcgcaggggatgctcatggagccgccggctgccggagggtggcgggaggacgacggcgaacacgacgacggcttcagcacgtccacgtcgctgtggagctactagttcgactgatcaagcagtgtaaattagtattagagttgtagtatcagtagctagtactactagctgtgttcttccaccaggcgtcaggcctggcaagcaatctcaaaccatgaatatgc

SEQ ID NO: 6060 - DNA, 599 bp, Hordeum vulgare
  misc_feature (12)..(12): n is a, c, g, or t
  Predicted polypeptide sequence is orthologous to G2107
cggcacgagggngtaccttcgacaccgccgaggccgccgcgcgcgcgaacgacgccgccatgctcgcgctcgccgccgggggcgcgggctgcctcaacttcgccgactccgccgagctactcgccgtgccggctgcctcctcgtaccgcagcctcgacgaggtccgccacgccgtcgtggaggccgtcgaggacttgctgcggcgcgaggcgcacgcagaggacgacgcgctctcggtctcgggcacctcctcgtccgcgccctcctccatcaccgacgacgactcgtcctcttccccggcggacgagggctcgccgttcgagctggacgtcctgagcgacatgggctgggacctttactacgcgagcctggcgcaggggatgctcatggcgccgcctgcttccttggccgcggtgctcggcgattacggcgaggctcacctcgccgacgtgccactctggagctaccagagctagcaagctagttcgcgccacttccagtttttaccttccctttctgccgtcgtcttggcttccgattgatgccaaaattttgatgctgctgtacagtttctggtaatgtggtggtgcaaattgggg

SEQ ID NO: 6061 - DNA, 334 bp, Hordeum vulgare
  Predicted polypeptide sequence is orthologous to G2107
gcaaaaagtaacggaaaaacaatctccaacggactgatggagtgggcgtgctgcggcagcggctactcgtcgtcgggaacgcagtccccggcggccggcgacggggaggagggctcgtacatgacggtgtcgtcggcgccgcccaagcggcgggccgggaggaccaaggtcagggagacgaggcacccggtgtacaagggggtgcgcagcaggaaccccgggcggtgggtctgcgaggtgcgcgagccgcaagggaagcagaggctatggctcggcaccttcgacaccgccgagatggcggcgcgcgcgcacgacgtcgccgccatggcgctcc

SEQ ID NO: 6062 - DNA, 1041 bp, Hordeum vulgare
  Predicted polypeptide sequence is orthologous to G2107
caagctcgagcatctcgcacctagctcacagcagcaggcttgactgatccgcaaggaagcaccgagcactctgccggttgccatggacatgggcgaggtctcgagctctcccccctcctcttccaacgagaacgcgtcgggacggtcgtcgacggccaagcgcccggcggggcgcactaagttccgcgagacaaggcacccggtgtaccgcggcgtgcggcgccggggcaacgccgaacggtgggtatgcgaggtgcgcgtccccggcaagcgcggcgctcggctctggctcgggacttacgccacggccgagatcgcagcgcgcgcgaacgatgccgcaatgctcgccctgggcgtccgctccgccgcgcggctcaacttcccggactccgcgtggctgctcgccgtgccgtccgcgcactccgatctcgccgacgtccggcgcgcggcggtcgaggccgtcgcggacttgcagcgacgggaggccgccggtgggtccatcaccgccacagtcggggaggaggcctcccgtggcgctcctgcagaatcgtcgtctgagtctgaggatgccggttcgtcggagacgtcgaaaccttccgccggtggagacttggcggtaccggtcggaatggacgtcgaaatgttcaggcttgacttcttcccggaaatggagtttggctcgtactacgcgagcctcgcggaggcgctgctcatggacccgccgccggtggcgaacagcacgggcgcgtactgggataacggagagttcggcgaggtggcaactgagttcgcactctggagctagttgccgccgattctccttcgttttgattctgcagcctttttttttttcttcgcaaagttttcctatttcgggagaagactctgtagattgtactactctactactccctctgttctaaaatataagaccttttagagatttcagtagaaaactacatacgtagtaaaatgagtaaatctatattttaagataaaaaaaaaaaaaaaaaaaaaaaaaaaaaaaaaaaaaaaaaaaaa

SEQ ID NO: 6063 - DNA, 1111 bp, Hordeum vulgare
  Predicted polypeptide sequence is orthologous to G2107
ttccagtacaaaaactactccacacctctcacgagcatgtcgaatccgattcagacggacgtcgccggcatcgcctccccgtccggccagcaggagcagcaggggcaccggacggtgtcgtcggagccgccgaagcggcccgcggggcgcaccaagttccacgagacgcgccaccctctgtaccgcggcgtgcgccgccgcggccgcgtcgggcagtgggtgtgcgaggtgcgcgtgcccgggatcaagggctccaggctctggctcggcaccttcaacacggccgagatggccgcccgcgcgcacgacgccgccgcgctcgcgctctccggccgcgccgcctgcctcaacttcgccgactccgcctggcggatgctgcccgtgctcgcggccgggtcgttcggcttcggcagcgcgcgggaggtcaaggccgccgtcgccgtcgccgtcgtggcgttccagcggaggcagattattccagtcgccgtcgccgtcgtggcgctccagaagcagcaggttccggtcgctgtcgccgtcgtgacgctccagcagaagcagcagcaggtcccggtcgccgtcgccgtctcggcgctccagcagcagcaggtcccggtcgccgtcgccgtcgtggcgctccagcagctgcaggttccggtcgccgtcgccgtcgtggcgctccaggagcagcagattattctaccagtcgcgtgcctggcgccggagttctacatgtcttcaggcgacctgctggagctcgacgaggagcagtggttcggcggaatggacgccgggtcgtactacgcgagcttggcgcaggggatgctcgtggcgccgccggacgaaagagcgaggccggagcacggcgagcagaccggcgtccagacgccgctatggagctgcttgttcaactaatttagcactactgtcaacatgtagatagttgcgttcttccagatttgggaggaaagagagtaggcagttggtactacttttggggaaaaggggctagattgcttaattcaacaattggtactgaactcgattgtgtatcgtgcactccatgaatcgaaatcaaggatttttgggagaagaaaaaaaaaaaaaaaaaaaa

SEQ ID NO: 6064 - DNA, 1036 bp, Hordeum vulgare
  Predicted polypeptide sequence is orthologous to G2107
ctcgactcgagcaaccataacaaggacctcaagccggccaaagaagaaagaagagagccatccagagcagagcaagactactctctcttgttggactttgatcggagcaaagaagatgtgtcagatcaagaaggagatgagcggcgagtcgggctctccctgcagcggggagaactactactactcgccctcgacgtcgccggagcatcagcaggcgaagcagcaggcggcgtggacgtcggcgccggcgaagcggccggcggggcggaccaagttcagggagacgcgccacccggtgtaccgcggcgtgcggcgcaggggcaatgccgggcggtgggtgtgcgaggtgcgcgtgcccggcaggcgcgggagcaggctctggctcggtaccttcgacaccgccgaggccgccgcgcgcgcgaacgacgccgccatgctcgcgctcgccgccgggggcgcgggctgcctcaacttcgccgactccgccgagctactcgccgtgccggctgcctcctcgtaccgcagcctcgacgaggtccgccacgccgtcgtggaggccgtcgaggacttgctgcggcgcgaggcgcacgcggaggacgacgcgctctcggtctcttgcacctcctcgtccgcgccctcctccctcaccgacgacgagtcgtcctcttccccggcggccgagggctcgccgttcgagctggacgtcctgagcgacatgggatgggacctttactacgcgagcctggcgcaggggatgctcatggcgccgcctgcttccttggccgcggcgctcgccgattacggcgaggctcacctcgccgacgtgccactctggagctaccagagctagcgagctagttcgcgccacttccagtttttaccttccctttctgccgtcgtcttggcttccgattgatgccaaaattttggtgctgctgtacggtcattacttacagttcctggtaatgtgatggtgtaaattggggaaaaaaaaaaaaaaaaaaaaaaaaaaaaaaaaaaaaaaaaaaaaaaaaaa

SEQ ID NO: 6065 - DNA, 1285 bp, Hordeum vulgare
  Predicted polypeptide sequence is orthologous to G2107
cgaccatacaacctcgatcacaaaaccaatgctagccagctgcagataagcgaatccatcgaccaaccgataccatacaagatggaccactgcggcgtgggcctctatggcgagtacgcgacggtgacgtcggcgccgcccaagcggccggcggggcggaccaagttcagggagacgcggcacccggtgtaccggggcgtgcggcggcgcggcgccgcggggcggtgggtctgcgaggtgcgcgagcccaacaagaagtcccgcatctggctcggcacctttgccacgcccgaggccgccgcgcgcgcccacgacgtcgccgcgctcgcgctccggggccgcgccgcctgcctcaacttcgccgactccgcggccctgctccgcgtcgacccggccacgctccgcactcccgaggacatccgagcagccgccatggcgctcgcccaggccgcctgcccccacgacgccgcgtcctcctctgcccccgccctgaaggcggcctctgcgccggcgccagcgatggtgatggtgcaggaggccgcggcggcgccgtacgacagctatgccacggccctgtacggcgacttgacggacctggacatgcattcctactactgctacgacgggatgagcggcggcggcgactggcagagcatctcgcgtatggacggagccgacgaagacggcatctacggcgcaggagacgtcgcgctctggagctactgattgtctgagattgatcggccggtttgttcagctaccgggtcctgctcaagtgctgctgcgcaacgtcgtcatacgatgaagaagatgaaacagagttcctggggaagaaagatccatgccagccgcaggacatgtcacagcaccaccggcaggccggcgccgcctcctccgcgtgcccatgcaatctgtcgatcggcagggcgtacttcttctgggaggtcacgtggtcagaacggactgagatttgagcgaagtgttgtctgaacgcacgacatacttgcatcagcgagtttcaagcacgcctactctgcttcccctgttcttcaaaagtggcgctaaaactgcacaatcccacatgagctagttttcgtagggtatagtgctagcaaaaatatgcacacccagtttgctgagtgattatacaaccagaagacctcactccaatttatttttcccttctatgtaaatactccctctgttcataaatatacgccattttagagatttacatataaactacatataaatgtatataaaaaaaaaaaaaaaaaaaaaaaaa

SEQ ID NO: 6066 - DNA, 892 bp, Hordeum vulgare
  Predicted polypeptide sequence is orthologous to G2107
ctaagtcctccggcgcttctccacacacagcaacttactcaaccacgcactccagtcaagcgtctccactaacactagctagctctagaaatggacgtcgccgacatcgcctccccgtccggccagcagaagcagcaggggcacaggacggtgtcgtcggagccgccgaagcggcccgcggggcggaccaagttccacgagacgcgccacccgctgtaccgcggcgtgcggcgccggggccgggtcgggcagtgggtgtgcgaggtgcgcgtgcccgggatcaagggctccaggctctggctcgggaccttcaccaaccccgagatggccgcgcgcgcccacgacgccgcggtgctcgcgctctccggccgcgccgcctgcctcaacttcgccgactccgcgtggcggatgcggccagtgctcgcgaccaccgggtcgtttggcttcagcagcacgcgggagatcaagcttgccgtcgccgtagccgtcgtcgcgttccagcagcagcagattattcttccagtagcgtgtccatcgccggaggcgcccgccagcccgagcgccgctctgttttacatctcgtccggcgacctgttggagctcgacgaggagcagtggtttggaggcatggacgccgggtcgtactacgcgagcttggcgcaggggatgctcgtggcgccgccggacgaaagagcgaggccagagaaccgcgagcacagcggcgtcgagacaccaataccactatggagctatttgttcgactgctaatttagcacgcagtgtaaagttgtttacatagttgtgttgtgttcctctttttttttttttagaaaaggaggatctcatccgattcaattgtgctaagttaaactttgaaaaaaaaaaaaaaaaa

SEQ ID NO: 6067 - DNA, 967 bp, Hordeum vulgare
  Predicted polypeptide sequence is orthologous to G2107
ctccacacacagcaacttactcaaccacgcactccagtcaagcgtctccactaacactagctagctctagaaatggacgtcgccgacatcgcctccccgtccggccagcagaagcagcaggggcacaggacggtgtcgtcggagccgccgaagcggcccgcggggcggaccaagttccacgagacgcgccacccgctgtaccgcggcgtgcggcgccggggccgggtcgggcagtgggtgtgcgaggtgcgcgtgcccgggatcaagggctccaggctctggctcgggaccttcaccaaccccgagatggccgcgcgcgcccacgacgccgcggtgctcgcgctctccggccgcgccgcctgcctcaacttcgccgactccgcgtggcggatgcggccagtgctcgcgaccaccgggtcgttcggcttcagcagcacgcgggagatcaagcttgccgtcgccgtagccgtcgtcgcgttccagcagcagcagattattcttccagtagcgtgtccatcgccggaggcgcccgccagcccgagcgccgctctgttttacatctcgtccggcgacctgttggagctcgacgaggagcagtggtttggaggcatggacgccgggtcgtactacgcgagcttggcgcaggggatgctcgtggcgccgccggacgaaagagcgaggccagagaaccgcgagcacagcggcgtcgagacaccaataccactatggagctatttgttcgactgctaatttagcacgcagtgtaaagttgtttacatagttgtgttgtgttcctctttttttttttttttagaaaaggaggatctcatccgattcaattgtgctaagttaaactttgagtttgtgttatgcttaaaaatgctacacctacaaacacttctacgtaagcttacttaaaacagttatttccttccctaaaaaaaaaaaaaaaaaaaaaaaaaaaaaa

SEQ ID NO: 6068 - DNA, 888 bp, Hordeum vulgare
  Predicted polypeptide sequence is orthologous to G2107
ctccggcgcttctccacacacagcaacttactcaaccacgcactccagtcaagcgtctccactaacactagctagctctagaaatggacgtcgccgacatcgcctccccgtccggccagcagaagcagcaggggcacaggacggtgtcgtcggagccgccgaagcggcccgcggggcggaccaagttccacgagacgcgccacccgctgtaccgcggcgtgcggcgccggggccgggtcgggcagtgggtgtgcgaggtgcgcgtgcccgggatcaagggctccaggctctggctcgggaccttcaccaaccccgagatggccgcgcgtgcccacgacgccgcggtgctcgcgctctccggccgcgccgcctgcctcaacttcgccgactccgcgtggcggatgcggccagtgctcgcgaccaccgggtcgtttggcttcagcagcacgcgggagatcaagcttgccgtcgccgtagccgtcgtcgcgttccagcagcagcagattattcttccagtagcgtgtccatcgccggaggcgcccgccagcccgagcgccgctctgttttacatctcgtccggcgacctgttggagctcgacgaggagcagtggtttggcggcatggacgccgggtcgtactacgcgagcttggcgcaggggatgctcgtggcgccgccggacgaaagagcgaggccagagaaccgcgagcacagcggcgtcgagacaccaataccactatggagctatttgttcgactgctaatttagcacgcagtgtaaagttgtttacatagttgtgttgtgttcctctttttttttttttagaaaaggaggatctcatccgattcaattgtgctaagttaaactttgagttaaaaaaaaaaaaaaaa

SEQ ID NO: 6069 - DNA, 791 bp, Hordeum vulgare
  misc_feature (651)..(651): n is a, c, g, or t
  misc_feature (657)..(657): n is a, c, g, or t
  misc_feature (696)..(696): n is a, c, g, or t
  misc_feature (699)..(699): n is a, c, g, or t
  Predicted polypeptide sequence is orthologous to G2145
ctccaccgcgcgtgggcggtccgcatctagtaactagtcggaatcccccgggactgcaggtaattccgcacgagcaagggcaagggcgcctcggtctccttcacggagggcgagaaggtgctcgcctaccacgggcccctcctctacgaggccaagatggaacgtcggagtcgtctgcatcgtgaaagctcgggccggccacggaccggcgagcgacccccacaacttgtatgcaaagagaagaagggagaagatcaacgacaagctttgggttttgcagaagctggtgcccaacggaaccaaagtggatctcagcactatgctcgaggaggcagtcctctaccttaagtttttgcagctacagatcaagtagctcggagaggaagaagaaagaagaggagttgcatgctggatgaatctagattactccaacccaaccccagtacttggtagatgttataccttcaggaagaatgtttttttttccgggcttcccccttttaacttgggcccttcaaagggggttaaagggggccttaattggggggggggaaaaaaaacacgcgtttgttaaaaaactttttttttttttttagagagttgtttttgggggcccccccaccaatataagtaagttgtgttggtcgagangttgcnggggtgggtggggggaaaaaaaaaaataaatttatgagnggngatatgaaacccgctttttcttgtcccgttgtgcggcgggggaaaaacagcgtaacaatatacagtaggttgtttgtcgctggcgcccgcca

SEQ ID NO: 6070 - DNA, 601 bp, Hordeum vulgare
  Predicted polypeptide sequence is orthologous to G2150
tttttttttttattatatataatggcaatacaaatgatgtactattacacatcttcaatgcaatcccctcttatttgagggagaatggataggaagggtgccgcgctacctaccgatcgatcttgctactaggcttagcagaagaaaggagctataccgtcagtcacacggccggccgcgctccattttcttgttcaaaataaccatgggtgggtggaaattagaagctaagacactgctagggcccaacattgttaggttgaatctcagagtgcttccatggacggcaagcaagcttggctgacatgactggctctcaggctctgaattgcttctcctccctatgtacagcgggcgtcgtcaaggcgttcggtggtgggatcgagcttcttccctggtgatcatgtcaaagctccattttcatgtggaccgtctgcaacgagccgtcgtagctgttggacgaagtggcgatctcctggctctgccccatgtccatctgaaccacgctctgcagatcttgccagaaagccccaacctgagaggcggggtcgctgaagaagtgctgctgctgctggtgcaaccccatgggccggcagaaagg

SEQ ID NO: 6071 - DNA, 682 bp, Hordeum vulgare
  Predicted polypeptide sequence is orthologous to G2156
ttttttttttttttcaaccaatagttcagcaagcagcagctcactgaaattaattactatcatcacgagtaaatactgagttaggcaattgattacactggtaataatgtagtagcttctgacacggcacacacgacacgataccatgaaactacagcagtcacaagcacagcatccagtactacaataagtacaccagttactagagaggttcagattattgaaggcacggtggctgaaatcacactcgatttacattgtacaagatgcagacaaacctaacgcacaattttactggtggcagaggcctagttgttgccagcagaagtacgtcaattttaactgatactgaggctacatgtcccaaatcgctaactgtccaatccaggccatgttccgcttgcagctgtgttggcggctggggctggggctggggctggggttgctgcatttgatgtacctggggttgaggttggggcagtggcggcacttgcgtcggctgatgtggttgctgatggagctgcagttaaaattgcaggggattgctggggcctgaagttgcaacaccagtggtgcccggccgcaaatggagccgcaattgaaattgcacaagttgcctggggttgaatctgaagaattgaggttgcaagggttgcctgtggttaaaggctgattataccgc

SEQ ID NO: 6072 - DNA, 435 bp, Hordeum vulgare
  misc_feature (46)..(46): n is a, c, g, or t
  misc_feature (131)..(131): n is a, c, g, or t
  misc_feature (381)..(381): n is a, c, g, or t
  Predicted polypeptide sequence is orthologous to G2157
cacgactttttttttttttttttttttaagtcgattggttactcancataactgactgaatcaagccaatttacaaatgtggtccttgaaattgaccaaaacaagttggaagagtagagcattggatgtanctagtttcagtcagccatggagaaatggatggatatccactgaaccaccaaagtgccggcctgttcattcctgatcagcagctgcagcagtttacactgtccaaacttgtgttgtgtggggagtagactaggtcaaggtcgacggtgtcctcgttgggatttgggatcccggtcgtcgtcctcgtccatggagacccgcggctgcggaagcagaggaggcccagcccgatacgcccttgcaccccatggncagtggccgcaggagcacgttcgaggaagaggagccgcgagtgggggcaagaga

SEQ ID NO: 6073 - DNA, 371 bp, Hordeum vulgare
  Predicted polypeptide sequence is orthologous to G2157
ggttgaaaataggggggaatggttagttagaaagaaagaatcctaatcaacgtgtaaccttatgtaactctttgtatgtctagcatttttgttttatttcagtttggtccgtctgtaatcttggtgtcccgtacgagagtacgaagctgtgggacgctgctatggccactggaggacggtggtccgtttgttggtggtggctgccggctgccactgttgccggacggccctctctttctctctcagctcgaggacacgctcctgtctgaagaaatgggacaaggaaatgtgcatcgcagagttatgctctgcttttatgttgttcttctccttttattgagtaataaaactagatcgtgccaaaaaaaaaa

SEQ ID NO: 6074 - DNA, 1270 bp, Hordeum vulgare
  Predicted polypeptide sequence is orthologous to G222
ctccgtccatccacgctgcttgcccagcccagctcatcatcccggagcggaatcaactgatcgaatgggacgcccgtcgtccggcgccgtggggcagcccaaggtccgcaaggggctgtggtcgcccgaggaggacgagaagctctacaaccacatcatccgtcacggcgtcggctgctggagctccgtccccaggctcgccgcgctgaaccgctgcggcaagagctgccgcctccggtggatcaactacctccgccccgacctcaagcgcggctgcttctcccagcaggaggaggaccacatcgtcgcgctccaccagatcctcggcaacaggtggtctcagatcgcgtcgcacctgccgggccggacggacaacgagatcaagaacttctggaacagctgcatcaagaagaagctccggcagcagggcatcgaccccgccacgcacaagcccatggcctccgcggacacggcaacggcagcggccgcattgccggacgcagaagaggaagaccgtaagcccctttgcccggcggtcgacggcagcctcgttccgaagcagccggcggtgttcgacccgttcccgctgtgcgtcgactacggcgccgggttcgccgaggaactcggcgcggcgaacgctgcggcattgtatggccagctctgcggcgggaaggaggtcgcggacgacgacgccgggttcggcgccgcggactacagctgcgtgctggacgtgtcggagaacctgggctacggggagagctcgagcaacagcagcaactggaactacggcggcgaggtgggcagcgtgctggacggcgaggtgccgcactgggccaagccggagccggccttcgcggagatggagaggcagcagcagcactcaccggcggagcagaagctttcgctgccctgccaagaacagagcctcctcgcaagtttcgatttcaacctggaattggaaccatacttctgaaattcccccctcttttttcccttcatttttcaccttcttgaatcatatcacgatttccaaccacgtatattcacacgtcaacaggatggcaaggaaccatccgaaagccaattagggattgtacgtagagtacaaacaaagacacacgcttgtttgatttttcacagagacgacaatacggtaagtatgtcgtggaacattgttgtgtaggcgctgcttagtcacggagacgacatatagcaatcaaacacttgtaaaaaataagcacaaacatttatatacatactggagtattac

SEQ ID NO: 6075 - DNA, 634 bp, Hordeum vulgare
  Predicted polypeptide sequence is orthologous to G2251
agggacgccctatgctgctgctctccctcgtcggcctctgccgctccccgcgccgctccgtggacgacgccccgctgcccgaggaggtcaaggcgcggctcccggccgtcgagttctcttggctggcgcgtccggagcagcagcagcaggggtgccacgacggcgcggcggcgtgcatcgtgtgcctggagaggctggaggcggcggacgaggtgcggcggctgggcaactgcgcgcacgccttccaccgcggctgcatcgacgggtggatcgacctcggccggaccacgtgcccgctctgccgctcccacctactgccgcgcgcgcggagggccagccccagcctcctcacgcgcgtttggtgagcaccaaccgcgcgcccgatcgttagctcggacgcccccacgtctttccttttcccagcgcggtggcggccggcagctgggtccggggaggtggcgccgcaatgctgcacggagattcgcgatctggaccggctacatgtatatttattctggggtctatacattatctcaaaattgagattatttagctttagggtttgtatatatagagcacaccaataggtgcatacgcataggtttctattctcctggagaacgattaattagtc

SEQ ID NO: 6076 - DNA, 796 bp, Hordeum vulgare
  misc_feature (767)..(767): n is a, c, g, or t
  misc_feature (775)..(775): n is a, c, g, or t
  misc_feature (778)..(778): n is a, c, g, or t
  Predicted polypeptide sequence is orthologous to G229
tatagatcagggccgccaaaggaagatcatcgcccatccccttgatctctcacactaactccttttggacgcgagcgcggatcgactacacgtctacacccaccgcgctcgacctgctatagtatctagctagctagcctcggccggcgacaacgggcggtttgctcgtgtgttgggagatatatagggaggctcgtcgtatacaaggggatggggagggcgccgtgctgcgagaaggtggggctgaagcggggaaggtggacggcggaggaggacgacatactcgcaaactacattgcccagcacggcgagggctcatggaggtctctacccaagaatgcagggctactgaggtgtggcaagagctgcaggctgcggtggatcaactacctgagagacggggtgaggaggggcaacatctccaaggaggaggacgacctcatcgtcaaacttcatgccacccttggcaacaggtggtccctgatcgccagccacctaccaggacgaacggacaacgaaatcaagaactactggaactcccatctcagccggcagatccacaccttccggcggatatacaccaccgtcagggacaccaccataaccgtcgacatccacaagctttccgccgcccgggaagcggcgcggcggccggaccccaggccagtcgccaaagagcagttcaaagaagaagcagcccgtgcctgagcccgtcacaacgcaaaggggcacctcgtaacaagcgtcagccccgcctcatagcgacnaagcttanaancgcggtgtccgacccgga

SEQ ID NO: 6077 - DNA, 247 bp, Hordeum vulgare
  misc_feature (228)..(228): n is a, c, g, or t
  Predicted polypeptide sequence is orthologous to G2291
ttttttttttttttttttttgtacttaagtccttctaaattctgatgccttttgcacattttctttcctgaataaaggaatatcagaaggtatcatcatttcagtccaaagaggggctctaaaactcgagtaacacaaattacacccctgaatctgggaaagctaaagaggtgacagggggagatctaaagttctttttcttatgtatggtacacaggaaaacgttangatctttcaggatgatcat

SEQ ID NO: 6078 - DNA, 770 bp, Hordeum vulgare
  Predicted polypeptide sequence is orthologous to G2344, G929
catgacctctgtcgccgacgctgtttcaggtgatcatagagctgatgagcaacagcagaagcaagctgctcacgggaaccaggaagaggccccagctactagtataggtaatcaggcgatggcggcaacaccttccacagattatgtcacaccctatggccaccaggaagcttgccatgcaatgggtcaaattgcttacccaactattgatccatactatggaagcctttatgcggcctacggtggacaacctatgatgcatccaccaatggtcggaatgcatgcagccgcaataccgttgcctactgatgcaattgaagagcctgtgtatgtgaacgcgaagcaatataatgccatattaaggcggcgccaatctcgggctaaagcagagtcagaaaggaagcttatcaagggccgcaagccatatctccacgagtcgcggcatcaacatgccttgaaaagggccaggggagccggaggccggtttcttaacgcaaagtcagacgacaatgaagagcattctgattccagctccaaagataagcagaatggagttgcgccccgcagcagcaatggccaaccgtcttcctctcagtctcccaaaggcgcaacttcggccgacaagacgggaaaccctgaatgagatgctagaagtccgccggacgcgacgatccatgccaacagttttgtacagtatatatatgctagtgagcaagaagatcgcgccggcgggtgctgtaagatatatatctggaaccgctccgctctat

SEQ ID NO: 6079 - DNA, 856 bp, Hordeum vulgare
  Predicted polypeptide sequence is orthologous to G2394
gagctactcaggagctaatcgatgcattgccaacctacaaatttaaaccaaaacgaagcaaaaactgggttcttgatcatgcttcgagctcagagaatcttagcgagggcggcatcctgggcccaggaactaaaaaggaaaggattgtttcggctgaagatgctgtgtgctgcatctgccttactaagtacggagatgacgatgagcttcgcgagcttccttgcaaccatttgtttcatgtgcaatgtgtcgataaatggctcaagataaatgcagtatgcccactctgcaagacagagattggaggcgtggttcgatcattctttggattgccctttggccgccgccgtgttgataggatggcaggaagaggtgtagctagctcaagatttgaggtgtagaacacgtgcttgtgctccgatgtgtgctggctgtgtagggagttgaatgcctagggaagctcatgggattcaaggtgcggatgctgaggggaagacggtgagcgcttgtgtatagactatggtacgttttgttgccaagcgggttgcggctttgtggcggccgagggcgccggcaggtgtaggtcttataagcgggggtcggaggggagggggggcgagacgagatggacgcggtctggtctttgggtggagggggtcaatgtgtgaggggggacgggggagtgtttgtgtgcgtcttatttgaggggtgggtgtgtgggagaggggtgtcgtggcggcgagtgaagggagagtagtgtaggagacgagcggggggggagtgcgtggggtgtgtggggtggagggtagcgagtagagaaggtgtggcgcggggggtatcgagggggagagagcgg

SEQ ID NO: 6080 - DNA, 1180 bp, Hordeum vulgare
  Predicted polypeptide sequence is orthologous to G241
cagaagaagggagcacgggcacggctagcctggccggggtgcctgtggatgccgcggagtgcaagatcctggtcgcacacatccacagccacggccacggcaactggcgcgcgctgcccaagcaagccgggcttctgcggtgcggcaagagctgccggctccggtggatcaactacctgcggccggacatcaagcgcggcaacttctccgacgaggaggagcagtcaatcatccagctgcaccagctgctcggcaacagatggtccgcgattgccgccaggctgccggggaggacggacaacgagatcaagaacgtgtggcacacccacctcaagaagcggctcgaccccagcgcgcaggagcagcaagaggaggccggcgccgccaagaagcgcaagaagccggcggcggcggcggcggcgccgaggaagcgcgacggcaaggtcaagatgaggaacctcaacgcgctgaccgccagggctgcggcggcggcgcccgtgtcctcgcccgagcgctccgtctcatccacggtcaccgagtcgacgtcgaccgcctcggcggcggcggagcagcacggcaactcggggagcagctccgcgtccgcgtccgcgtccgtcaaggaggagtgcttcacctcgtccgaggagtcggaggagttccagatcgacgagagcttctggtcggagacgctgtccatgccgctggacgacctcaacgacgtctgcatggagccccacgacgcgttcggcaagcccgacggcgacatggactactggctcagactgttcatggagggcggcggcggcagcggcagcggcagcgacgacaacaacaaccatgacggcgcgctagacttgccacagatttaggctcctgatgagatgatttgatcgttctttttctctctctctctctacatctgcgtgcgccatcttcgctgcatcggagggattgctaacaggggaagagtttccggcccgccccgtggaggaaaccagtatccagccagcaagaacgctgatcatgcgccgggtagctttcttcgatccattttggttagtcatttaccttgttgtatagaaggagatgatgagagatcagtgttcagtgatcggaaccgatgcattctctgtactatcatggagtttatctgaaatggagtctgtctgtccgcttttcg

SEQ ID NO: 6081 - DNA, 879 bp, Hordeum vulgare
  misc_feature (724)..(724): n is a, c, g, or t
  misc_feature (850)..(850): n is a, c, g, or t
  misc_feature (856)..(856): n is a, c, g, or t
  Predicted polypeptide sequence is orthologous to G241
cccgggctgcaggaattcggcacgaggattcttccttgcagctcagacagcagccatttccttcggactagcgtcaacacactgagcaatccatccatcacacgcacagcgcaagaggtttaattaatcgtccgagaagagcagaggagtgagcaaggtagccatggggaggtctccttgctgcgagaagatggggctcaagagggggccgtggacagcggaggaggacatgaccctggtggctcacatcgagcagcacggccacagcaactggcgggcgctgccgaatcaggccggcctgctgcgctgcggcaagagctgtcgcctccggtggatcaactacctgcgccccgacatcaagcgcggcaacttcaccagcgaggaggaggacgccatcatccagctccacgccatgctcggcaacagatggtccaccattgccgccaggcttcctgggaggacggacaacgagatcaagaacgtctggcacacacacctcaagaagcgactccagtcctcgtccaagccgtcaggccaggcagcgcctaagcgcaaagccaagaagcctgctatggctgcagcgagcacagccgatggctcggcctccgtgccagtgtcgccggagcaacccatctcgtcgtccgccaccgattactcgatggcatcgtcgttggagaacacagacagctttacatcggaggagtttcagatcgaggacagcttnttggtcggagacacttgcaatgacggtggacaactccggttccccgatggacgccggcgtcaccttgggcgcccaagacagtgcatcgccctcgtccacacggaccgaggtgactttctgggtcanactgtncatgcagctgggcgagggcccaa

SEQ ID NO: 6082 - DNA, 997 bp, Hordeum vulgare
  Predicted polypeptide sequence is orthologous to G2457
gcccatacatatctctctctccatcgatctgacctacatacacacagagaaagttagagaagcagcagtcgtacatgtaacctagcctggagttctccaagccaacgcttcttcttcttcttcttggctgccgcctggcgaacctcgccgtagtctgaacggccagggaggggggcagcgaggcggcggcgccaggggataatcagaaggaatgtcgtcgtcgggccagatcgcaccggcagaacaagtctgctacgtccactgcaacttctgcaacaccgtactcgcggtgagtgtccctgggaacagcatgttcaacgtcgtgacggtccggtgtgggcactgcacgaacctgctttcggtgagcctgagagggcaggtgcactcgccgctccctgctgctgcacaggcccaggagagcagcctgggcaagcccagtggcatcaacggcttcattcgtgatcacagcgtctacaatcacccggagtttggttcctcttccacgtcgtgcctccaaattccagctggccacgatgatgttctcctcccaaaatgatctgctgcatgaacagacgctacacgcacgctctacggagaaaggcaacgtgttccttctgcgacaacagaatcttaaggaagaaatccaaggataaagcaacaaccccgactttaccacagggaggcctcacccccccgcaagaactgggccattacccaaacttcatttgggctacccccggagcaacgggggaaagagctgcctaaaaaagccccccgggtgcaaaaaaaccaaggtttgtttctagaccaagggggttggggccaaaaaaagaagaggcttatatgagtgaaggggggcgccatatttatttgtcaccaccgcgcctggtgggaaccaccgggcacccaataaagatagaggcctccacgtatctgagattaaaaccgcgaggtggggggcgaacaaccaagctgagctggaattatagatgggtct

SEQ ID NO: 6083 - DNA, 849 bp, Hordeum vulgare
  misc_feature (685)..(685): n is a, c, g, or t
  misc_feature (744)..(744): n is a, c, g, or t
  misc_feature (766)..(766): n is a, c, g, or t
  misc_feature (768)..(769): n is a, c, g, or t
  Predicted polypeptide sequence is orthologous to G2457
tcggcacagatcgcgccgccggaacatgtctgctacgtgcactgcaacttctgcaacacaattctcgcggtcagtgttccaagtaatagcatgttgaacatggtcaccgtccgttgcgggcactgcactagcctgctatcggtgaacttgaggggattaatccagtcaccacttcctgtgcaagatcattctcaggagaatttcaaggcccaaaacatcagctttcatggaaattaccctgactatggcacatcttctaaataccggatgccaatgatgttctccacaaaaagtgaccaggagcatatgctacacatgcgacctcctgagaagaggcagcgggtcccttcagcgtataaccgatttattaaggaagagatacgaaggataaaagcaaacaaccctgacataagccacagagaagccttcagcaccgcagcaaagaattgggcacatttcccaaacattcatttcggactaggctccaatgagagcagcaagaagctggacgagaccatcgccacgcctatcccccagaaagttcaaggtctctactgagacatgcagtcctatatgaatgatattttcatattgtaagtaacttaaggaaaattgaaagtatttctgaatcagtttgtgagtgcatacatagatcatgagcgaatgatatgcatgaagtgagaanagagcatatggtaggtgcatgcagctagctaacgtccatgcatataaaaaacgcccttngatcgccagcttgggtattaantnngctgaaatatcactttccttgaacatgtttgtggtattaggaattggtttggctaggtgcaaaaaaaaaaaaaaaaaaaa

SEQ ID NO: 6084 - DNA, 1284 bp, Hordeum vulgare
  Predicted polypeptide sequence is orthologous to G255, G664
ccgcaaacaaaatggagcagcaagagagcatcggaagaagaagaagatcttgccgaaacagggcaccgccggcaagatcatcattctttctccttcctgcatctctctctcttccactcctgcaaaccccaacccaacccaacccaacccaccaccgagaagcacgaggaagaaagaggacggtgtcatcggcggcggaccatctaaagcgatggggaggtcgccgtgctgcgagaaggcgcacaccaacaagggcgcctggaccaaggaggaggacgaccgactcaccgcctacatcaaggcgcacggcgagggctgctggcgctccctgcccaaggccgccggcctgctccgctgcggcaagagctgccgcctccgctggatcaactacctccgccccgacctcaagcgcggcaacttcagccacgaggaggacgagctcatcatcaagctccacagcctcctgggaaacaaatggtccctgatagccgggagactgccggggaggacggacaacgagatcaagaactactggaacacgcacatccggaggaagctgacgagccgggggatcgacccggtgacccaccgcgcgatcaacagcgaccacgccgcgtccaacatcaccatatcctttgagtcggcgcagagggacgacaagggcgccgtgttccggcgagacgccgagcccgccaaggcagcggcagcggcagcggcgatctcacaccacgtggaccaccatcaccgtagtaacccccagcttgactggggccaggggaagccgctcaagtgcccggacctgaaccttgacctgtgcatcagccccccgatccacgaggaccccatggtggacaccaagcccgtggtgaagagggaggccggcgtcggcgtcggcgtggtgggcctctgcttcagctgcagcatggggctccccaggagctcggactgcaagtgcagcagcttcatggggctccggaccgccatgctcgacttcagaagcatcgagatgaaatgagcatagcagagcaccccctctctgctctgctcttctctcccctgtctgtgacgtggagatattggtttagcctgtaggtgaaaatacagcgagcgaaagagagagagatgcaggaaggagaaagaatgatgatcttgccggcggtgccctgtttcggcaagatcttcttcttcttccgatgctctcttgctgctccattttgtttgccccgttgtaaaaaaagaaaaattaccgtttgactaatcatgagcaaaaaaaaaaaaaaaaaa

SEQ ID NO: 6085 - DNA, 1102 bp, Hordeum vulgare
  Predicted polypeptide sequence is orthologous to G255, G664
gctagctggtaggaggagctaggatcgaatcggatcgaccggcatggggaggtcgccgtgctgcgagaaggagcacaccaacaagggggcgtggaccaaggaggaggaccagcggctgatcgcctacatcagggccaacggcgagggctgctggcgctcgctgcccaaggcggcgggcctgctgcgctgcggcaagagctgccgcctccgctggatgaactacctccgccccgacctcaagcgcggcaacttcaccgacgacgaggacgagctcatcatccgcctccacagcctgctcggcaacaagtggtctctcatcgccggccagctgccgggcaggacggacaacgagatcaagaactactggaacacgcacatcaagcgcaagctcctctcccgcggcatggacccgcacacgcaccgcccgctcacggccgtcatcgacgccgccgcgccgacccgcccggcacagatagccgtgccggcgagggcggcgcccaccacgatgttcgccctgccaaccaaacagcagcagccgccggtgccggtcgagtcgtcggacgacgacggcagcagcggcgcgacgagcaccggggagccacggtgccccgacctcaacctcgacctgtccgtgggcccgccggcggccgacacgccgacgtcgcacccggtctgcctctgccgccacctcggcttccgcggcggggaggcgtgcagctgccggcaggccgacagcgcgggctcccagggcggcggctttagatatttcaggccgttggaggagggccagtacatatgagagacgacgggacggctaggccctagaactccacagcaatttgtaagacagggaaatttttctacttactcctcctccagtccacagcacctagcgctgctggctggctcacaaaacggtgaaaacaaaatctaatctgttcatatccttccttgtacgccaaaaccgcgaatttgtccgctctcttttgttgttggttggtgctgttgcgttgggtgggaaaaaccaggggataatgtgacaaaggttggtgtgtattttgtggaaaaagggagggcctgatgtgaggcagcgaccacggtc

SEQ ID NO: 6086 - DNA, 558 bp, Hordeum vulgare
  Predicted polypeptide sequence is orthologous to G255, G664
tcaaggcggagccggtgacggaggagagcaagccgcccaggtgcccggacctcaacctggacctctgcatcagcctgccgttccaagaggttgaggaacggccgccggcgagagcatgcgcgaagccggtcaagatggagctatctgcagggcggcggcggcggcctctgcttccgctgcagcatcctacgagtgagaggagcggcgacggagtgcagctgcagcagcaacttcctgggcctaagggccggcatgctcgacttcagaagcctcgagatgaaatagaaatttgggaataattattccatcaaactttctgctgtaaattgttgctccctccctcctaccaagtttttatttagcttttaggaaaagatatactactcctactcctattagaaggtgaggaggagactggtattattaggtgatagaggatttgtagcgagatcctctctgccctcctcgctctgctcagtttcatgtaaattattactgctccactgatgaaatggaatggaatgaaataatacagtactgtctaacaaaaaaaaaaaa

SEQ ID NO: 6087 - DNA, 661 bp, Hordeum vulgare
  misc_feature (175)..(175): n is a, c, g, or t
  Predicted polypeptide sequence is orthologous to G2604
ggtatacaggaccaatattgattagcttcacctagacctggttagccaactcttgttggtgagttggtgtaacctgctcgactgatatccgcggacgaacattccgctctccaatttcagtgacaaaaagacacaaagaacatttaaccgcaggagccccaaaaggatacatcangcaatgtctcacattgtccacagtgtacattcccaacttcatgtgcttccaatactaggtttattgtccgacaggcagaacactgtacatgaacggcacctctaggataagcaataagttcatagcagcttccacacaccatttgacctatttctttgtttacgaaagggggtggtggtggtggcagaagttccaccgcgtccaatgaacaaggagcggcctgaacatttggagaagatgactgctgccttagctggggcaatgacccctctgctccattctccaatcgcgggagtactgtagttgcactgtccatgtttgcatccatcgcctgcgatgctggcggtagcagaactgttccctctgagttaacagtaacacaatctgtggcaggtacatgcaccggggtgtccacagcatgtgtcgtaacagaattcatctgtggctctagctgtggcaataacccgctcttcgacggtgatgaca

SEQ ID NO: 6088 - DNA, 751 bp, Hordeum vulgare
  misc_feature (445)..(445): n is a, c, g, or t
  Predicted polypeptide sequence is orthologous to G2604
gacaaaatcccatccggaatcaacttctccccctccgatcctctttctccccccttccccgccgcctccgccggcgagaatcgccggcgcgcccgttgcaacgacccaggagccctctgtcacgggcgggcctctccccggagccaccggagggctgggacgggcggccagtctcgtccagagccgcttcgattgcaggtatgcagagccagatcgtgtgccaccgttgccggagggtgctggcctacccgtcaggggcgcccagcgtgtgctgcgccatgtgccgagccatcaccggcgtgccacccccagcgccagcagtggaaatggctcagcttatatgtggtggttgccgaactttgctgatgtacacccgtaatgcagacactgtgagatgctcatgttgcaatacagtcaatcttgtcagaccaatcaataatatacnccacgtgaattgggggtcgtgccggacactttgatgtatccacattgaacaccttctggcaatgggccatctgcgattttttacaatactgaaataacacctgtaactgcacatgtccaaggcctcttaaatgaatttgatataatgttataaacttttggtccccatttaaccccaaaatgtacccttgtgttagaaacctaaaatggtgaaaaaagggtaactggtcaagacttataaacagaattccctggaaaaaatgaataaaatgatttaacagaaaaaaccttttttgggattttaaaa

SEQ ID NO: 6089 - DNA, 670 bp, Hordeum vulgare
  Predicted polypeptide sequence is orthologous to G2604
ctcgactcgctcgctcgtctcgacatctgcaccggatcgagctcagcaaagcccgagccggaggcgctcgtctgcccggggagcggcgccatgcgggtccgcctcttcctctgaaccgggcaagcgcgagccgccttcttcctccggctcggcgtcggcggcgacgacgagcgtcggtggcggcatagcacggtccagcgacgagcaggatttcatgtagaggagggcaatctgttctcatcccctcgacttccagcagagcgtgcgaagtctcttccgcagcaacgacgacgccggctcaggcagccgcgggcacggcaatgccggttcctcttgccccttacccaactcctcctgcgcccttcacgccacccgctcccaatgcaggggctcaaagccaacttgtctgctctgggtgccggaatctgctcatgtatcctgccggcgcaacgtcggtatgctgcgcggtttgcagtaccgtgaccgctgttccggctcctgagaccgagatggcgcagctagtttgcggaggatgccacactcttctgatgtacatacgtggtgccacaagtgtacagtgttcttgctgccacactgtcaacctggcaatggaagcgaatcaggttgcgcatgtaaactgtgggagttgccgaatgctgctcatgtacca

SEQ ID NO: 6090 - DNA, 287 bp, Hordeum vulgare
  Predicted polypeptide sequence is orthologous to G2604
ttcttgctgccacactgtcaacctggcaatggaagcgaatcaggttgcgcatgtaaactgtgggagttgccgaatgctgctcatgtaccagtacggcgcaaggtccgtcaaatgtgcagtctgcagtttcgtgacatcagttggggcatcatcgggtgcagagcagaagcccagcaactgaaatcctgcaagttcattacgaaggcagcttcccgaaataagaatgctttgagtgcacatgtatagagttcttcccagaagcaaccttttcctcccagcggccgcca

SEQ ID NO: 6091 - DNA, 698 bp, Hordeum vulgare
  Predicted polypeptide sequence is orthologous to G261
caacccccaaccaaccaaccagacccaaccgaagaagccgagccgaaccccaccccgccgatcagccgccatgcgctgaggccgaaccgccgcagcccgaggaggaggaggaggtggaggggatggagggcagtggcgggtcctcgtcgctgccgccgttcctcatcaagacgtacgagatggtggacgagccggccacggacgcggtggtggcgtggacgccgtccggcaccagcttcgtcgtcttcagccaggccgacttctgccgggatcttctccccaagtacttcaagcacaacaacttctccagcttcgtgcgccagctcaacacctacggctttaggaaggtagatccagaacaatgggaatttgcgaatgaagaattcatacgagaccagcggcatcgattgaaaaatatccataggcgcaagccaatattcagccattcatcgcacactcagggtgctgggccattagctgatagtgaaaggagagactatgaggaggaaatcgagaggctcaagtgtgagaatgcatcactaaacttacagcttgaaaggaagaaaactgatatggacagtaaaatgacggcttttgaaagacaaactacttgctatcgaggatcagcagaaaaatcttatttcttatgtcacagaaattgttaaggcgcctggatttctttttaacttcatagaaca

SEQ ID NO: 6092 - DNA, 676 bp, Hordeum vulgare
  Predicted polypeptide sequence is orthologous to G2632
ccactctaccgcagtatacaaacacacgccatccatcccgagtctgacaatcaatctcacacgcgcacagcctgctagttcttctccactcgcacacatccgacacaagaggggtgataacagaacgcgaaagccaagaatgaattgcctggacacagcagcaggccctgaatccccgaccagcccccacgccgtggcgacgtggcacgacggccggcggccaggaggagccgctgttctaggttgcatcaaggtgctgccacttcacgcctgacggagatgcaggtccggcggcaccacccggaggtagtcggaggcgctctgctcgcctttgcccgcctcggctccgccgccgccgtgctcgtccttcttcgtgttgaggaagcggccgccggtgcccctcgcccgacgcatcgcgtgctggtgccgggactcgtggaggtaaggcttcctggccttgatcgccttcctctcgagctcggccttggcgcgcgactgcctccgtctcaagatgccatggtactgcttcgcgttcacgtacaccggctcctccgacacttccagaggcagcggcatgcgcgagtgggtcagccccggtagctggaagtgagccactgcttgagcgccataggggccaaccatgcctgcgtagtaagcatcagggtacgggtacggt

SEQ ID NO: 6093 - DNA, 672 bp, Hordeum vulgare
  misc_feature (633)..(633): n is a, c, g, or t
  Predicted polypeptide sequence is orthologous to G2724
aaccgagttgtggtttgtttttttttaaaacagtcaaaaatcaaattgcaaaatcctcagggaaattctggaaaatacaattgtgtctgcaacttttttttgctgatcatgctaaaattctggagattgagggcaattcaattgccaaagctgggcaaattgcagattgagggccattcaattgcaagagctgggcaaatttgtctgagtgaagatcaaaaggtcaatgagttgttccaatgcctatgaacttcttttagttctacaactagcggtttttcctctctgtacctatctcccctgatgtactacttgcgaatatagcccttgtacctaagtgttcacaacctggcttgattacttgaccctgtactggccttcgcctttacacatgtagaactggggtgctagataataaagctgctgactcttggctcttgaattgcatctggtctatttaggttgcaccttgcttcattgcatagatctgtggagtcctccatcttaaaaactgccatgtcaaggatggcgggaaagatgttcttgcctagtttttactatttcactagcccactgtagatagtctctcgcgcatcagctcaaaatatggatccaccccgacagagcaaactngccccgtgtaaataagtgcctgcttgctactatttgcta

SEQ ID NO: 6094 - DNA, 830 bp, Hordeum vulgare
  misc_feature (657)..(657): n is a, c, g, or t
  misc_feature (733)..(733): n is a, c, g, or t
  Predicted polypeptide sequence is orthologous to G274
ccgagatagaattgagaacattgctgaaatgctttgctggaataaaatatatgagaaggaagatactgttatttggcagaaaaaggaaaattcaaatccatgccataacaagaatagtcgtactagcaagatgtgcaaagttcatttatggagatgacatctggtataagaaaatggaaacttgtataacaccaatcccagagggagcacatcagctacagaagtttccagagagactatttgtagttcctccaagaattcttgacagtacccaaggtgttacagaagaagtctatgaagaggataagaagctgtggaagaagcatgttgatacatacaagaggataaacaagctgatagggaagtcaaggtataggaatatcatggacatgaatgcaggccttggaagttttgctgcagcgctgaattctcccggctcctgggtcatgaacgttgtgcctacgatatcggagaggaacaacactcttggtatcatctatgagcgaggtcttattggcatataccatgactggtgcgaagcattctctacgtaccctaggacatatgacctgatacatgccagcggcgtcttcagtttgtacgagaacaagtgtgacctgggagacattcttcttgagatggataggatcctgcgtnctgagggcactgtcatactgcggggacatgtcgaggtgctgaacaaggtcaagaggaccgtggcggggatgcgatnggaagtccagctacttgatcacgaagatggccctcttggcctggaaaactctgattgctgttaaagatactgggttgcccggcaagaaggaaagatt

SEQ ID NO: 6095 - DNA, 713 bp, Hordeum vulgare
  Predicted polypeptide sequence is orthologous to G274
attaacagagagacactagttcatgctgagtgatgaatggaattaaattacaaaactgttacaacaatatactgctgccgatcaacagcaaggaagaaaccttggttgcttcattgctaccccggagaagtgtaggccattctgttcgcacctgaggactccgtatctcaattcctggacgccagcttcaaaggtgcatcccagaattccccgtgttagaatatgttcttgttcacgatgcggccgtctggtttccaccaacccaatactgcttcacagcgtacaagaccttctcacgcactaggggaccatcctcgtggtcaactaggttcgtgttccatctcatgccccgggcgagtttgttcacctttgtcaagacatcgacatcgtcacgcattataacagcgccttcaggcctcaagatgcggtccatctcaaggaggatgtcttccatgctgcacttattgctatacaaggtgaaaaggccactagcgtggataagatcataggtccttggataagtagagaaagcttcacaccagtcatggtaaatgccaatcaatcctcgctcataaacagcccccagggttgcaatctttgcaacggttggcaccacattcatcacccaagattttggggactcaatagccgcagcgaaacccccaaaacctgcattcatgtccatgatgtttctgtacctaccagtaagtaga

SEQ ID NO: 6096 - DNA, 644 bp, Hordeum vulgare
  Predicted polypeptide sequence is orthologous to G274
cacgcgtccgcgagttttgacatggcacattgctcgagatgttaatccatggagtggaagtaacggtatgtacatgatggaagttgatagggtacttaggccgggtgggtattgggtactgtcaggcccacccattggttggaaaattcactacaagggatggcaacggagcaaagaagatctccggagtgagcagagaaaaatagaacaattcgcagaacttctttgctggaagaagatatctgagaaggatggtattgccatatggagaaagagattaaatgacaaatcttgccccaggatgcaagataattcaaaagttgccaagtgtgagttgacaagcgacagtgatgtatggtataagaaaatggaagcctgtataactccccttcctgaggttaaaagtgtgtcagaggttgctggtggtcatctagagccatttccaaagaggctcaatgcagtaccacctcggatagcccgtggttttgtatccgggttctcagttcaaacatatcaggacgacaataaactctggcagaaacatgttaatgcttacaagaaaaccaatgacttgcttgatactggaaggtaccgcaacataatggacatgaatgcaggtcttggtagctttgctgctgtactgg

SEQ ID NO: 6097 - DNA, 693 bp, Hordeum vulgare
  Predicted polypeptide sequence is orthologous to G2754
actgggagtaacagtctcatttccagactccttcagcagactactattaccataacagtcttaacatagctactagggtggttgccttggatgaaggcacgagctcgagttacatcgcaacacagctcgccaaaggatcgatcagctcctaatctagggggtgcggtatacactgcaacgccctgtcgtccataattacttaggggggataggcctttgacatgtccacatcatgtcacaaaaacacaggcggcgaacacaaaaacactggagggtgtcggtgtggtcgtcaggcgccaggcctgccgcccgcacgaggttggctcagctggtgagcgtcgagagcatgccgccgccagcagccaacacgacctcccagccaggccctttcagggggaagtgcgggacggcatcagcagccgcacgcgcaccggtgaggtccctccggtccatcaccttcaggaggtcctcgtcgctgatgtctgtctggatcatcctgtcttcctcgtcctgctcgtccctcagaagcgccagcagctctccctcatctaaggcattaggcttcgcggcatcttgctggaactgtcccttcccaatcacgacgtgctctagcttcaactttccaaaagctttcttgataatccgtccctcaacagaattggatgtcgccaaccgataaacatgaactggctg

SEQ ID NO: 6098 - DNA, 629 bp, Hordeum vulgare
  Predicted polypeptide sequence is orthologous to G2766
tgccttacatacttaaatataacacattctacttgtcacctcctagtagtcttgaagccattgaagctaatccatagtacaaccaaggaaggagaagatgggcatggagactacttgacgtgcgaaaggcatttacaacttaatccccggaagcaaaacttggtcttgctaatcacattggtacaaagtacaaacataacctcgcatatctggttctgtggcgtcagcacttctgatcggctgagcaggagcagtttccttggtcctgttttagtttctcaatttggtcctgcaacactttgatgtagtctacagcaatgtccagcatgtctgaagtatttgtttgcttatccatgttgggcacgaggtcttgcaacctcctaagcctcttgctgatccttgttcttctttccctctcagcgatgcttcgcgggtgagtagcgcagccgcgcttggcgcggactctgcaggcgacggagtcctgctgcagctgcaggtagtcgtccatgccgggcatgtccagagacgagccaaactgtgagtcgatgttgctgaagctggtgaccatgccgtcgtcgccgtcggccatcaccttggccttcttgccgccgggcggcgcggagaagatc

SEQ ID NO: 6099 - DNA, 641 bp, Hordeum vulgare
  misc_feature (1)..(1): n is a, c, g, or t
  Predicted polypeptide sequence is orthologous to G28
ntgggcctaaatttgtttgctgccatctataaaaatatcatgtcaccggtgtactccaaaaacaaatattacatggaactacatgcataatgagtggatggacatcaattaataacctttttgcgtacactttctcttggacaccaacaagtccagtacaacaaaataaggtaataataattggagtattttgccaacaattatggtttatgctgagcacgaattgaagcccgggcaacatgatgagcagctggagctttctcgttgataataatttgttctgggaagtccacacgaattgacttgaacttatagtgctgttctttccaagatatatctagaattttgtagtatggttccagcagttccacttgatcgccttctttaattgcttcattttgtagcccataaactgatagtatgaaataagactgatccaagtcacatgttaaataatacagtggagcatcttcgtcatgtcttatccaaagaaccactttacacacaacagcaactgtcttgttcaaacctcctgataagatgcttatggttgctttcttgtgggatgacttgaaattgacttcattcatagatgacaccaatgatgctgatctcttgggttgtagttgtcccttcgttgc

SEQ ID NO: 6100 - DNA, 832 bp, Hordeum vulgare
  Predicted polypeptide sequence is orthologous to G280
gaaaattcccccctccccgctgcccgcgcccgcactctagctctagagctcggctccaccgccgtgggctctagccgccgtcgctgccatggcgaccgaagggtctcccaagtccggtgacatcccgccctaccccgagatgattctcgcggctatcgaggcgctgggcgacactaacggctccaataagtcggccatttccagctacatcgaggagaagtacgagggcctcccttccgcgcacgcctccctcctcacggccaacctagccagcatgaaggaggccggcaagctcgccttcgtcaagaacaactacctcaaggccgacgcggtctccgccaccccggccaagcgcggccgcggccgcccgcccaaggaccccaacgcgccgcccaagcccaagccggatcccaacacgcccaagcgcggccgggggcgcccgcccaaagaccccatgtccgtcgccgtcaaggaggccgtcgccaaggccaccaccggcatgcccaatggccgcggtcggccgccgggccccctccgcgggccagaaggccaaggtaaccaaggaggctgagtctccggcgggcgcgtctggctcgctcctggcaagcgcggtcgtgggcccccacgcaaggtggcggcttgaagcccgcatgcctgtgccctttcggtccgtgtatttcgcccggggtaccaccggtggaaacctcctaagggtgacggtgcctggtccattccggccttcgaccaatagggggactcggatctaatggttcataagccggaaaccggatccataataactgggcccaagggatggattgttggatcgatc

SEQ ID NO: 6101 - DNA, 1114 bp, Hordeum vulgare
  Predicted polypeptide sequence is orthologous to G280
ttggaatgccagcttcgaccgcgcgtattaaccctcactaaagggaacaaaagctggagctccaccgcggtggcggccgctctagaactagtggatcccccgggctgcaggaattcggcaccagggccggtggctccgacagcgccgccgcggcgcaggcggccgcgttcaagaaggccaatgaggggaggaaggcgtagatcaaccggatcgccgtcgagagggctttaatttagctagctggctgcctatatctgtggcatgcgtgcgtttaggccggacggacgtgtgcgttgcgttttggttgtttcatttgagttcgtggtttggttgtgtacgttggtgtcttcatgggctagcttcgatctatcgtactatgtgtgttgtaatgaatctcgtttaagttttttgcagttcaaaaaaaaaaaaaaaaaaactcgagggggggcccggtacccaattcgccctatagggagtcgtattacgcgcgttcactggccgtcgttttacaagtgtcgccgccccggccctgtacctcctccattattttagtcgttgcactgatccgtggtactcttgttgcgacgtgaggtttgtgtgttcgtttactctcactgattatggttcccgccttcgtctcttgtctaggccctctagctatatatccatttacttcgctcactcccgtaatctggatctgttgtcactgcgttagcctgtagtcggagaccataccttcttgactagctactctcccgtcatctacctgcaacatcggctagatttcgacgaacgacatcatagtctgctatgattcgcgagtcgatgggtatgctgcggagtatcatgatccagctcgaatatctccccctccctcggtgacaggtatcccgctctccgccttctccgctcctcgcggcgcctcacccgtccgtgtctcttccctctcctcccctaatctgcggctagtctctctctgctccctcgtgcatcgctacctattcgcgttcgtggatagttcgatattcgtgcgtagccgtagtgtcgtcgtcgtttgtcctaggtgtctgcgtttatgtcctgctatgagtctagactgactttctgccctccc

SEQ ID NO: 6102 - DNA, 700 bp, Hordeum vulgare
  misc_feature (620)..(620): n is a, c, g, or t
  Predicted polypeptide sequence is orthologous to G2802
gatggtgcacgggcgacacaaggggtgcaagaagatcctagtcttgtacatcaacttcggtaagacacgaaaggcagagaagactaattgggtgatgcaccagtaccacctcggcgacctagaggacgagaaggagggggagttgatcgtatcaaaggtattctatcggacacagccacggcagagtgccgctgccacaacatcgacattattgcatgagccttcgaccgctactgccgtccagatgctgcgacagcaacaccaaatgctgaagcaaggtgatgaggtaacttacttagatgaataagggaaatgaggggcaggaccaacagcaacagaaattcgaccacagtcctgctggcttggaaggactaataatggcctgcaaatcagcaagtacaaaagaaatacttttatatcaggatgtcgagaggaaggaagagaaattatatcacaatgtccaaaggaccaacatcccatttaaaagcacagaaccacgatagtattcaactattcattgccacaacaatatgcgcatgggcttttatttatatcgttgcttcactcccaattaacaccttctagataatattgacaattgtaattttattttgtcctgngaaagggaatgagaatcaattttattattctgatcaattatgtgcgggattagtggattgtcttgttgacaacgcaacaa

SEQ ID NO: 6103 - DNA, 360 bp, Hordeum vulgare
  Predicted polypeptide sequence is orthologous to G2837
agaaggtcaaggagtatgtatacgggtcaggttcacacaagaaaccaaatggcaagcacgacaatagtagtgatgatgactcagatggtggtggtggaaagggcaagaaggcaaagaagacccgcttcactcacaccgcgaagggaaagggcaaatccaaagcttgatgagagatgtagtattaaccaccgctgctggagctcattttgggtaccatatcgcgtcctagtcgtagtttaacatgctgaagcatgatcatcttaagaaacaaacattttagagttcgttttgtgttgcttttgaaccctgatgtgctgaagccttgtggtaccatggcagtatgccacagccatcttgagc

SEQ ID NO: 6104 - DNA, 384 bp, Hordeum vulgare
  Predicted polypeptide sequence is orthologous to G2885
ttttttttttttttatcttttggggatgtcatgtgaacttcgagcacaccaagtaaaaaatcacaattgtataggtacatgttagagataaaggacaatcgactggatgaacaacttcttcatagagaagataatgtcatagcctatttagtctattttgtagtaaaatggaatcaaacatccgatgaagatttcagaatgtctaattttcttggatgattttggaaggtacatataaagattgtccaagtgaacatggtgaagatacaaacttggagcgcagatacaaaaaccaaatcagtcttggaaaaaattaattagttccttcttggattcatgctgcttttcaccttgacaagttgaaggactgatgatgcctcgtgc

SEQ ID NO: 6105 - DNA, 643 bp, Hordeum vulgare
  Predicted polypeptide sequence is orthologous to G2898
aggagttcttcgacaggtacaacaggcagttgagatcagaaagggaaggccggagcagcagcggcagcagcagcaatagcagctcctaatgatgtacaggagttgcgtgctgcttagatgttagccattctgcacttggtagaacgaataattagaagatcgatggggcgggaggtcagctaacgccgcacgatctatgtgtggtggttgcatgtacagggtcaggttggcaggaaacctaagccaactcgtactgttgcggtattcttcagatgtaattgtactcatcatgtatcaatctcccacggctctcggagcggccgctggaggatttccggaaaacgtatcaggaagaaaatccaagtgtaaaagcaatgcaggatgtagggaaagcatgcggcgagaaatggaataaaatggcatttgaggaaaaggtgaagtattatgatcaagctaccgagaggcgtgccgagtttgagaaggcgatggctcagtacagcaagaaaaagataaacggtgaattgtccgaggaatcagagtagaagtgaacattgggttctgatgatgccacaagttaaatggatgaatcattcaaatgtatattacgtgcctgaacattgtacgaattctgttatcaatagat

SEQ ID NO: 6106 - DNA, 700 bp, Hordeum vulgare
  Predicted polypeptide sequence is orthologous to G2982
aactgtctgatgatctccaaaacatcaagttacgtaacgaaacactgcaaagctcagcagagaacgtcaatggcatccgccttccatttgtattggtcaagacatctaggaaagcaagggtggaaattgagatttcagaagactcaaagtttgcccatttcgagttcaatggtgcaccattcacattgcacgatgacctctcaatcctcgaggggataaggcgtaacagcataggaagagctggccgtgccaccctccactagagactgaagaatattacaaatgaagtaaaagtgtcagagctggcacagccagattcttttgcacagctatgtatagctatatgttctcatgaaaacttgacctagtttataggacaatctctcaggcttgagaagattttaacctgcaaattttgtctcctttttgtgcctagcaggttattaggtctaagatagatgattcgtatatgtgctgctatgtatacattgatagcagctttggcggcacaagcttcgttgagcggccgctgtgccgaatgtttctcagtgctttacattctgagatgaaacttttatccgcaccttgcatgccaaggtcaaaaactttcactgctacaaccatctgtttttggtttagctttgctctgtacacagaaccgcaacttcctctcccgatcaagttagattctgtgaagttc

SEQ ID NO: 6107 - DNA, 336 bp, Hordeum vulgare
  Predicted polypeptide sequence is orthologous to G2990
agtaaggaaatggatgcattcacattcgggtttccataatcctcattcaccgtctagttgttataagagtattaaccgattcgattcggaacttcagcaaaaataccaatgagtagtactgtatgattgatctatcaagaagcagtcaagagcttaagatagttttgaccaagactctgaatcgtctggtcgatcagccagccgcctagctcgcaccgtccgtcacttcggcgatcttggcgcgaccgccgtggaccgccgcgtggggcctgcctcgacatcgccgtcctccctcttctccacgaccgccgcctcctcctcctcgccgttctccgt

SEQ ID NO: 6108 - DNA, 897 bp, Hordeum vulgare
  Predicted polypeptide sequence is orthologous to G2996
accggagggagtccgacttccccgcgggggccgagggctcgcccttctctcccaccgcaatggtcccctacggaggcgtgccgcaccaccagttctcgccctactaccgcaccccggcgggctacctgcaccaccaccagcaccacatggccgccgcagccgccgcggtcgccgccgctgccgcaggccaccctcgaccgctggcgctcccgtccacctcccacagcggccgcgacgacgccgaggagctgtcgggcatggcggcagggcccatgtcggcgctggccccgctgagcagcatgtccctgggcgcgggcccgtcggggtacggctccgggtccgggtccggcaagaagcggttccgcaccaagttcacccaggagcagaaggacaagatgctggccttcgcggagcgcgtggggtggcgcatccagaagcacgacgaggcggccgtgctgcacttctgcgacgaggtgggcgtcaagcgccacgtcctcaaggtctggatgcacaacaacaagcacaccctcggcaagaagccgcccagcatttgacgccgcatgcaaccaccaccaccaccccaagaaaaagccgcatgcacgacgcatctggcgtcatgggcctcagccgagctagctgatcgacccaccatggcatggctagccccccgataggtaccagcatctgcatgttgctttcttgttcagcttatagccattgcattcgcgcttgacggcgttcccctccggcccgaacggggcatggcttgctgggctggctggctggctaacattaaggttaatccggtaccagaagtccttgggtcttgggatggaattaggtggttccctattctattccattgcattccggggttatatatctaatgtggccccc

SEQ ID NO: 6109 - DNA, 519 bp, Hordeum vulgare
  Predicted polypeptide sequence is orthologous to G2998, G2999
cggcacgaggcagagctacttcgccacttgctttccctttcaaacgttcgtctcgcgccgcctaagatggggcctcggcaggaccggtccgccgtcgacggggggcaaggtaacggcgcgcggccagccatcgtccggtacagggagtgccagcgcaacctcctggccgggaacggccggcatgtcgttgacggctgccaaggcttcatggcgtcaataggcgtcgatgaggctaccacgttcctctgcgcggcgtgtggctgccaccgcagcttccacaggcgcgaggtcgtcgacgagttcggcgtcgactaccatgctccggggacgccccccgccaacgaaagccgccgttgaagcaatgaagcttattgctgatgcctcttgttgctcacggtgaattggatctggctggatcatgcatggcccaggcgcagctagtagtgttttaattcgtcttccttgtcgtcttatgaaatttgtgcggatgaataatttgcggggaggccccgtccgcgt

SEQ ID NO: 6110 - DNA, 707 bp, Hordeum vulgare
  misc_feature (250)..(250): n is a, c, g, or t
  misc_feature (280)..(280): n is a, c, g, or t
  misc_feature (340)..(340): n is a, c, g, or t
  misc_feature (356)..(356): n is a, c, g, or t
  Predicted polypeptide sequence is orthologous to G30
gccaccaccgcaccgcaccgcaccgcaacaacaaccgccgcgcccgcgcagagcaccgtcgaacactcggcgccacccatggctcccaagaacgcggcccccgtcgccgtcgcagccgcagccgcagcgggcggcggcatggagcccaggttccgcggcgtgcggaaacggccgtggggcaggtacgcggcggagatccgcgacccggcaagggaaggcgcgcgtctggctcgggaaccttcgacaccgncgaggcccgcgcgcgcgcctacaacgccgncgcgcttcactaccgggggccccaagccaaagaccaacttttcccgtcggcacccgtcgnccgctacgcgcacgtnccgctcccgctcccgctttccgccgccaagaagctggccgtcagccccagcagcagcaccgtcgagtcctcgtcccgggacactccggctgcttcccccgcggccccgccggcgctcgacctgagcctggcgatgccggccatggtggcggcgcagccgttcctgttcctggaccccagggtcgcggtgaccgtggccgtggcagcgccggcgccggcgccctgccgatcagcggcgatcagcggcatgaagaacaaggtggcgtcccgcgaggaagagcagagcgacaccgggtcgtcgtcatccgtggtggacacctcgccggccgtgggcgtggggttggacctgaac

SEQ ID NO: 6111 - DNA, 866 bp, Hordeum vulgare
  Predicted polypeptide sequence is orthologous to G3055
tggcagcacacgaggtaggccacggaacagagagaggagcaccagatcccgatcatgacgtcgaccaacgtggtgcctggtgacagcgtgtatggcagagcgtacaaggggcggcactgcaagaagttctacaccgaggagggatgcccttatggcgacacatgcactttcttgcatgatgagcagtccaaggcgcgtgagagcgtcgcaattagcctatcgccgtcggttggcgggggcagctacaactctgctggagatgccggcgttccaaatggacctacaattctgaagccgtcgaattgtaagacgcagatttgagacaagtgggagatgactgggtactgccctttttgtaacaaatggcactttggctcacagaacttgttaactccacaattacggggggggacttgcgcacattgacggggggggattgcattaactgcggactggaaccggcggggcgtcctctaacttgttgtggaattactgaccgatgccatccggggcgacgaagcgacggttcccctgacaggaaggagttgtagtgtttccctttgtctacccacggtcggggggtgttgcggggcccttcgggctagggtagggccccgttgggttcggcttgggtgctggtggactgggagacgagagggggtttaaattaacgcgcgcgtatggtgtgttccacagatgagtcactggggtagagggagaacattcgttggcacgagatgcggccgcgtatagtgctattctacacctacacccttacgagagctgactgtatcattggtggatgagacggtctcggcagcatcgagatggggatgtgtaatcgccatgcgcgccgggtcacgtcg

SEQ ID NO: 6112 - DNA, 832 bp, Hordeum vulgare
  misc_feature (17)..(17): n is a, c, g, or t
  Predicted polypeptide sequence is orthologous to G3060
gtttcacgcgccgtcgncgacgccgacttcgcctcgccctttccccgagctctccatggacgcgggccgcaagagggccctgccggaaggcaccaacggcggcgccggcaccaagcgcgccagagaatcggagtcgggtcaaacgggtgtaggaagcaaatcgaagccatgcaccaaatttttcagcactgctggttgtccctttggttcgagttgccatttttctccataacttccctggaagtcaccaggctgtttcaaagatgaccaacttgggtggtccagctgtttcagctcctccaggaagaatgcccatgggacctggtgttcctgatgggccaccacccagcatgaagactcgcttgtgtaacaagttcaacacagcagaaggttgtaaatgggggaacaagtgtcattttgctcatggagagagggagcttggcaagcccatgctgttgaacaactcaatggcacctccaatgggaccaagacccaatggtcacttccagcccccaccgatgcctggccctgacatggttcctccctcaacctttggcgctttggccacagccaagatcagtgttgatgcatcccttgctggcgccattattgggaagggtggagtcaacacaaagcacatatcccgaatgactggggccaaactggccatccgggataatgaggcagaccccacccataaaaacattgagctcgaagggatcgttgatcaggtaaaccatgccagtgcaatggttgaaggagcttatatcttcccattggtgggaaccgccccctcctaaagcaaagaccgccagggaggggtccctggggg

SEQ ID NO: 6113 - DNA, 840 bp, Hordeum vulgare
  misc_feature (449)..(450): n is a, c, g, or t
  Predicted polypeptide sequence is orthologous to G3060
gtttttttttttttgttgtgctggaaatataatgagcaaatttgccatattaaaacgcgtgagaaaccgttcaaaagttggaagcacaccagagggaaaaaaacacggcattccacttaaccctacaataaaaaacctcaaaagcaaatccattctcggatatttatcggttacagcgagctgatcacactcaagccatggggccatgacagtacctcccaaccaacaacagggttatgcaactgaatcaatatgaccaggggggaacgggttctgagctcaaacttggtaaaggcttttaatcatgaaaagccatgaaaaaaaagcatttctgaagccggagccgacttgcgcagttcactttcaccatgggcaaagtggcatctgtctccaaatgtgcaagagccttttgtgaagtgtcacacacttaggtcttgaaggtgattccnnaagcccttgaagaacccgttgccttgtataatttagttgaaggaggggccgtctcccacctgtacgaaaaatttagtcttgtttccacattggcgggggggcttggtaagaacctagaccaaccggaacccgttagggcctatagagatttaattgggggggggattttggaccaaatttaactcaggaagggcctcgttgggccccgcattcagctcgggtaatatggtacttggggggggaccctccgccctttcgagtatggttgtgggtataattaagggggtggtcttgtatccattttgtacttttgcgggaaaggcctaaaagggggccattaattctatgaaacggacaacctcgtggtgtggggaaacaacaactggaacg

SEQ ID NO: 6114 - DNA, 650 bp, Hordeum vulgare
  Predicted polypeptide sequence is orthologous to G3067
gttttaaagcacgtaacaaaagcaatccttggtttccgtcgatgtcgtgtagcaaatagcactgcgtagtgaccaccaggaaaggaaaatggtgagaagcaatcagctcctacacgtgaaggcattcacgtacattcacaggaatatggacaaacgcatctggccgatactaccaacaggcagcccgtgcaaacgttaacagagtggcaaaccgagagagaaagaatggttaattcgagggctcggttagcgcgggaatgggatggatggatggatggatcaaggcttgcagatgaccacgaagcacgggagcagcgccctcgggttcagcaggtagagctcctcgatgttggcgtatggcccgaccttgccggccagcgagtcgaacccggtctgccccacgaactccctcacgttctccagcggcttgtgcaccctgccggcgatcaccctgcacaccagcagcgccctgcgcgcgccgccggccgccgccggggcgtcttcctcgtcggcggactcgaacgcccggccgctggtggacgtggtgaagacgccgacgctggccttgccctccttcttggagttggagttggacgaggaggagaagccgtggcggatgatgcggcagacggcgcacttgtcggaagcgc

SEQ ID NO: 6115 - DNA, 841 bp, Hordeum vulgare
  Predicted polypeptide sequence is orthologous to G3074
gcttcctctccctccgatccgatgtccccgccttcgtcccccgcgccgatccgacctccagccgccgcgttctctccgccggggacgctccctccggcgccgccggctccgcgccatgaggaagaagctcgacacccgcttccccgcgcctcggattaagaagatcatgcaagcagatgaagatgttggcaagattgctctagctgtacctgttcttgtgtccaaagcgttggagctatttttgcaagacttgtgtgataggacatataatatcacaattgaaaaaggggtcaaaacagtgagttcatcgcatttgaaacagtgcattcatagttatgatgtgtatgattttttgaagaacgtagccagcaaagtcccagatttgggtgcacctgattctaatgctgatgataagcttggcaaaagaaggaaacatggtgaagatgaaagcgaggaggaaacaaagcggacaagagatgaggcagcatgccacacaagcaacggcagagggcgtgggaggggacgcgggagaggtcgccgtgccgggcgtggagctgagagggagattgaacaccatgaattagctcgcactgaatttagcaacccaggccacctaaaggtagagactggagatggttttgacacaactgaaaccaagaagcatacccctttgagtaatgccagggccctccttagggacattgacttggactaaaatcttgctgactatgagaaggatacggggcaccacaagccgaaccttgtcccggggtgaatcggggcgtgcaagtccaaaattaagggcctcgttttactgtttagagagggggaaccagggtcc

SEQ ID NO: 6116 - DNA, 1158 bp, Hordeum vulgare
  misc_feature (418)..(418): n is a, c, g, or t
  misc_feature (702)..(703): n is a, c, g, or t
  misc_feature (731)..(731): n is a, c, g, or t
  misc_feature (752)..(752): n is a, c, g, or t
  misc_feature (774)..(774): n is a, c, g, or t
  misc_feature (962)..(963): n is a, c, g, or t
  misc_feature (989)..(990): n is a, c, g, or t
  misc_feature (1070)..(1072): n is a, c, g, or t
  misc_feature (1074)..(1078): n is a, c, g, or t
  misc_feature (1080)..(1084): n is a, c, g, or t
  misc_feature (1088)..(1090): n is a, c, g, or t
  misc_feature (1092)..(1092): n is a, c, g, or t
  misc_feature (1099)..(1099): n is a, c, g, or t
  Predicted polypeptide sequence is orthologous to G3074
caaagatgaggaagaagttgggcacccggttccccgcggcacggatcaaaaagataatgcaagcagatgaggatgttggcaaaattgcattggctgtgcctgttttagtgtcgagagcccttgaattgtttctgcaagatttgatcgaccgctcatacaaaattactcttcaaagcggtgcaaagacactgaattccttccacctaaagcaatgtgtgaagaggtacagctcttttgacttcctaactgagattgtcaacaaggtgccagatctcggtggcggtgaatcttgtggagatgaaagaggattacccagaagaaggaaattttcaaatggaagtgacccagagaatgaggagccccgatctagcaaaatgcccataagaaacttgaacactagtcccagaggacgaggcanaggtcgaggaagagggcgagggcggcctccaaccaagagaaaggaaattggttatgtacagtttgaggatgagagcagcatgtatgctgaacaaagtgaacccttgccaggagatgagatagttccagagaccaatcgtggcaatgagagtattccccaaagctcacatcctgtagcggaggctccatcagctgcgacgccagctgtgacttcaaaggttgaagaagctagcaccaaccatcagccggattggcctatgccagatccattggaggcattgtgtnngaccatcagtttggaatctgacggtgcnggtgatgaggaaaggactacnataatgaggataggcaggcttnctctattcattatatcctctaacagaccagtctcctgtggtgacattgtaaaattgttccagagtacccgccgcatatgataaccaactttctttcaccaaatagttgtactaaacgcctccgggtgccctcaccgcggcggggggaaacacccctttgtgggagagagataatttattctctctcgnnaaaacaaacatacctttaacccagtnntcgataaaggaggcgggcggcccccactcttctgcttattatcttctccctctccacccctagacacacccagaatatannnannnnntnnnnntttnnncnacatccnttcccaacaagcaccacctctctcttcatcgctggtgcatttatatcttctatatctcc

SEQ ID NO: 6117 - DNA, 795 bp, Hordeum vulgare
  Predicted polypeptide sequence is orthologous to G309
agcaacgccatgttctactacggctccgtgctcgactccatggaggcgtccatgtccttcagccgcggcggcgccatcggcaacgggtccggcgccgacgcgtacctgcagagggagatcttcaacatcgtgtgctgcgagggcagcgcccgcacggagcgccacgagccgctcgcatactggtgcgcccggctctggcgcacgggcctcgcccacgtgccgctgggccccaccgcggccaatcaggcggccaagctcgtccgcgtctactccggcgacgggttccgcgtccaggagatcggcggctgcctctcgctcgcgtggcacgggcgccccctgttcacggcgtccgtgtggagcgcaatgcccgccgccgacggcgccggcacctccgagtccgagcagcacggtgacaagcacaagctgaagatgggcatcggcgagagcagcggcggccgtctgccgggcgccgccggggcgcaatgatgaaagagcttgagcgacggggccggttgaataattgttagagttggaagggaagttgttaatcggaacttatgcgcagtcgtgggaatcaagtcggacgcaagcattagtcagcgtggtatatgaaatcactctaaatctcagatggatatcgggctagttcgtctggggtaaataaagtgtgggtcttcaaacttgggaaactattcgccgggggaaaaaagacaggggagccattccttgcgtcaggggtggtaactgatttcggataacggtttctggatctatgtgggaagcaatagttggtac

SEQ ID NO: 6118 - DNA, 638 bp, Hordeum vulgare
  misc_feature (502)..(502): n is a, c, g, or t
  misc_feature (579)..(579): n is a, c, g, or t
  Predicted polypeptide sequence is orthologous to G309
ttttttttttttttttttaaaacaggacgaggggctaaaaatgatctaacattatttgatgcaaatcaccaccaattcattcaacagaaaagcaacagatgaggaaacaccctggaatcaaacggaattcagatggctctggtttattttctcctcagctaatcacaaggaaccaaccccctttgttcccacacaatcgtccagccatccagcagaaacaaaaaaggagaaatcgttaagagagcgtcaccataattacaatcttctatcccaagggagcaccgccacgcaatgatcggcgaaatcttgccgtcatgtggtgcaactcataagccttctgctcttttagatcttccaggtcacgacagcatcattaatcgacatttgggggcaggggtcgcgaattcgcacgataaaacagtgcacttcaatcccactcctagcagctcatcagacgtcccagtgaacactcatcattgtacccttttctgttgaaaggcancaacagtttggggggaagcaagtggcttcgtccctaaccacgccaagctgtttttgcttcttggggctcaaaagggnggggttccgtcaattgagtatgtccctggtgcatccgggttttccaatttcccgaggct

SEQ ID NO: 6119 - DNA, 901 bp, Hordeum vulgare
  misc_feature (755)..(755): n is a, c, g, or t
  misc_feature (766)..(766): n is a, c, g, or t
  misc_feature (901)..(901): n is a, c, g, or t
  Predicted polypeptide sequence is orthologous to G309
agcaggggggcggggggctcgcccagttcgcgcacaccatccgcgtcgacttccagtatcgcggcctcgtcgccgccacgctcgcggacctggagccgttcatgctgcagccggagggcgaggaggaccctaacgaggagcccgaggtaatcgccgtgaactcagtggggggagatgcaccggctcctcgcgcagcccggcgccctcgagaaggtcctgggcacggtgcgcgccgtgcggccgaggatcgtcaccgtggtcgagcaggaggcgaaccacaactccggctcattcctggaccgcttcaccgagtccctgcactactactccaccatgttcgattctctcgagggcggcagctccggcggcccgtccgaggtctcatcggggggtgccgctcctgccgccggcgccggcacggaccaggtcatgtgcgaggtgtgcctggggcggcggatctgcaacgggggggcctgggagggcgcggagcgcacagagggggacgagacgctggggcgagtgggggaagcgggctgggcagcgcgtggggcgggacggttcccgtgggcgccgaggccggcgagggggggggggcggctggggggccgtgtgttgcgggtgggggaggggtgcaggggggcgggtagcgggggaggggtggtgagtggtggggggaggtgcgggctgttcgtataggcgcacctccggtgcgattcgatgtcggcgcccgcacgtagttatataggccgggagtnttgcgcgggcnaagagcaagactgcgcgtgaacacagcgggtggaaaaagcacgccgggactaccatcccagaagaccacgccgatagacttgatcacactaatggagggagtgtggggcccagtccacgacggggtaggtcggan

SEQ ID NO: 6120 - DNA, 699 bp, Hordeum vulgare
  misc_feature (663)..(663): n is a, c, g, or t
  Predicted polypeptide sequence is orthologous to G309
ttttttttttttttttttttctttttttttttttttttttttttttttttttttttttttgggtttttgggccttttttttttttttttttttttttttctctcaggctgactgactgacaagtttgaaagccacccttttttgaaccaaaacgaactaaaccgatttccatttgaaactgaaaggggattttatttgacaccctgactgatgactgacaaccgacttgacttaaacaaatggagaataagctccgactaaccaactgacactccaactttaacaattattaaaaccgccccggcgctttaactttttaataaatgggccccgggggggcccggaaaaaggccccccttgttttccccgatgcccattttaagcttgggcttgtaaccgggctgttcggactcggaggggccggccccctcgggggggggcattgtcctccacacggaccccgggaacagggggcgcccgtgccacccaagcgaaaggaaaccgccgattttctggacacggaacccgtcgccggagtaaacacggaccaacttggccgcctgattggccgcggtggggcccaacggcacgtgggcgaggcccgtgcgccaaaaccgggcgcaccactatgcgaacgggttgtggggcttctgcgggcgcttncctcgaaaacacgaagttgaagatctcctctgcagg

SEQ ID NO: 6121 - DNA, 845 bp, Hordeum vulgare
  misc_feature (2)..(3): n is a, c, g, or t
  misc_feature (41)..(41): n is a, c, g, or t
  misc_feature (103)..(103): n is a, c, g, or t
  misc_feature (467)..(467): n is a, c, g, or t
  misc_feature (715)..(715): n is a, c, g, or t
  misc_feature (733)..(733): n is a, c, g, or t
  misc_feature (825)..(825): n is a, c, g, or t
  Predicted polypeptide sequence is orthologous to G326
cnnactcaagggagtcgcccaatggaaagacgaatgatganggtcatacggcagttacatgagctcgcggaggtcgacatgggcggcggtcagataacacctngtgaggaggcagagcaagctgctcatcagttgccttcctggacacagccacactacactgctggaaatggcgattttggcacagataacagccatgaggttgcaaccatgccaacccctggttacgagaatggtggatggaacaacagcaatcatcatgccttaaatgatgcctgcaaggccgagtacgaacaggagcaggctccagcaagctcagctgaagcatgcttgtcatcgtttgttcaaatgccagaactttgccccagcatgagcaatggaagtatgatggacgatagccagcaggcaaatcctggtattggtatgccaatgcaagctttccccaaaagaagtggctttgatgttgntgctggccctgaccgcgacattgtcatttcccgctataaagaaaagaggaggacaagaagatttgacaaacaggtccgatatgagtcccgcaaagctcgtgcagacagcaggttgaggatcaaggggcgttttgcgaaggcaaatcagagttaagccttgactttgcagtatattttgcatattggacatatggaagaacactaattaggagtgagtgcagatggggcagaaggcgtgaacattttgnttgccttcagttgggcanatggtagctcgtgtcaatctgaataatgtatggtgccaacatatggctatattaatggtttgaggggagttgttctttagtccaacccttgnatatagtttccatctatgaa

SEQ ID NO: 6122 - DNA, 540 bp, Hordeum vulgare
  Predicted polypeptide sequence is orthologous to G326
gcaccttatataccagtgtaaaattaagctatgtgttctgaggagaaaagtagaggtctcttacaaaaaaaacaccgtgaatatgatcctctggatcacgatgctgaaaacgataacgaacacaaaaaaatagctgagcaatgcacggcatcatgcttaggtgcggcgcaggatgtcatctccgtgctgcgagcaaggaagaaggctcatccgccattgctgccggcattgagcgcttcattcgacttgacaaaacggcctttcacgcgcttccgggtatccgccctcagcttccgggactcataccggatgtgcttctcgtacctgcgattcttcctcttctctttgtaccgctgcatcgcgctatccctgtttagggcgagagtctcactgtcgatccttgtggtaggcctctcagctccagtcgggacgattgtttgatcaccaaaggagatctccctagtgggagctgctcctctgtcatgggaagagctcgccaaggtccctgaagcaggcacgttgctcccagaggttgttggg

SEQ ID NO: 6123 - DNA, 1384 bp, Hordeum vulgare
  misc_feature (602)..(602): n is a, c, g, or t
  misc_feature (604)..(604): n is a, c, g, or t
  misc_feature (606)..(607): n is a, c, g, or t
  Predicted polypeptide sequence is orthologous to G328
tggggactatccacgcgcattaaccctcctaaagggaacaaaagctggagctccaccgcggtggcggccgctctagaactagtggatcccccgggctgcaggaattcggcacgagggccagggtgcaccggtacagggagaagaggaagatgaggcggttcgagaagaccatcaggtacgcgtcgcggaaggcctacgccgagaccaggccacggatcaaggggcggttcgccaagcgcgccgacgccgacctcgaggtggaccagtacttctccgcagccgcgctgtctgactccagctgcggcgtcgtgccgactttctagggcggctcggtggagagaccatgagcgttcctccttccatggtcgatcgatcgacgcctgcatgttggttggctctccttaatttgccgaatatcctaaactttactggaggcatcaaagcttcacctgtaaatactaaatacagtattatggaaagatgccagatagatcttttcttgtaaaaaaaaaaaaaaaaaaaaactcgagggggggcccggtacccaattcgccctatagggagtcgtattacgcgcgttcactggccgtcgtttaacaatntngnntttttttttcttctctcttcttgtctcgctggctcttgtctctctgtcctttgcccggcttgttgttgtgctggtgtctgctgggttgggctggttgtgtcgtcgctctgctgtggtctcagcgtaaaactctctttttggggtgagaggctcctctagggaacctcgcaatgtttgtcacgtgttcgtagacctggtgttggtccccgctgtctcatgtgggtccgcttgatcattgggtgtccgtttggttaggccattgtggggttcttcctgcaaagatcggtttgtcggtcaacaatgtcggtgtgtagctctcggagggggcctcgtgtttgttggttcgtgttttccttcgaagagagttgctggggggcggcgttttttttctgagcgggaggtggtcgtgcactgatggtcgttagtattttctccgggggcgatcgtctttggtggcgggcgacacaatctccctttgtggagtggggctcgttgcgtagtcaaagaatatgtgtgggcgcttttcctccagtcgtctcccagctcagggtggggctcacctgctgtggcgtgtatctctccctcacacctccatgtctgttgtttgtatccccctcgcgacccgtctcgacggggtgcgcccgcctggcgctctctgctttggcgattacttgtggcgacagcagtgcccgcacgtctttggacgtagcgcgtggccgctccagtgtagagtctggcgggtctccgcgcgctattagctcgagatgttgccctccc

SEQ ID NO: 6124 - DNA, 1171 bp, Hordeum vulgare
  Predicted polypeptide sequence is orthologous to G328
gatgatcaaggccgagccggacctccgtggccagctgcgcggcagcgctggcgtcggcggcatgcagctgcagcagcgctgcgactcgtgccgctcggcgccgtgcgcgttctactgccgcgccgactcggcggcgctctgcgccgcgtgcgacgcggacgtgcactcggcgaacacgctggccagccgccaccgccgcgtcccgatgggcgcggtggccccggcctcccctgccggaggcgccttcgtcgtccgccccggcggcgtcaactcctcctggcccatccgcgagggccggaggtcctactacgacgaccgcgagggagaggaggaggaggcgacgtcgtggctgctgctcgatccgctccggggatcggaggcggatgcgccggcgttcggcgacgcgctcgtcgctgacttcctcgacctcggacgagcaggcgagaaggaggcgtcgagcaaggactaccacggccacgggatggagagcaacgagggcagccacgaccacgagctcgtcgtgcccggtgagccggtggcgcagctgcatgagcggcagggcttcacggcggagatggcgtacgatgcacaaaactctaaccatgggtacggatttggcgcaacattcgaacgcagcctttcaatgtcatcgtcaccggacaacagcagcaccgtccaggatgtgagcagctcgtacatgaggcgcagcgagagcagcgtcgacctcttctcaacggcggcgcacacgtcgccgcagttcatgggcatggcgatggacagggaggccagggtgcaccggtacagggagaagaggaagatgaggcggttcgagaagaccatcaggtacgcgtcgcggaaggcctacgccgagaccaggccacggatcaaggggcggttcgccaagcgcgccgacgccgacctcgaggtggaccagtacttctccgcagccgcgctgtctgactccagctgcggcgtcgtgccgactttctagggcggctcggtggagagaccatgagcgttcctccttccatggtcgatcgatcgacgcctgcatgttggttggctctccttaatttgccgaatatcctaaactttactggaggcatcaaagcttcacctgtaaatactaaatacagtattatggaaagatgccagatagatcttttcttgt

SEQ ID NO: 6125 - DNA, 643 bp, Hordeum vulgare
  Predicted polypeptide sequence is orthologous to G328
cggacgaggccttcctggtgcaaaaatgaccccttcctcccatacggggcaaagaaaactgtaatcccacacgtcccacgacccatctccttccaaaccccacgcccgatctcgtctctctccccagtaaacttgcctccacttgtgctcgtcggtccatcccctacacaagatctgttggcaggagccgtctcgatctagaggaaggggatgcatcccatcccgtcaagctgtcccttcccccgccgtggaagagagagcgagagatttgagagagggatgagcatagcgtggtgctggccgatcccgttcgttcccctcgcttgcgatccagaatcctcatcgggtgccatcgcgatcgtaccgctatttaccctcatccagcggggccgaagtctacggcacgagaggggtcaagaagcgcctggctggagacagatgagaggcgggtggaataggtggttgtccagctccggtgtggggtgaacgcagtggagacatagaggcgggacttctgtcggggctaagcgaacggcgagagagatagaggatcgtccatagccgcacatgctgaacaagcagagcatgcacctggagttgcgaggcgacctcaccatcctcctttgtactcggttgcaagttt

SEQ ID NO: 6126 - DNA, 470 bp, Hordeum vulgare
  Predicted polypeptide sequence is orthologous to G351
tttttttttttttttttttttttttttttttttttactcacaccaaacaaattaattaatcaatgaaagaaccgttctactgagatacagtacgtacgtactatatggaaaatatagaaattagatatatatgtactacgtacaccaatcgatggccagctccatcgatcgacctctacgctccactggctggctaggtacgtgttaacgggtgtacgtatcaccaaccggccgagcataagcaatccaaaagaatacacaccaactggttgatgattgaaaatttctttgatgatttagctacgccgggatcatcagcctcggcttcttgaatgccagcgggctgaggacctcctcctcatcggccggcaccggtacgcaccgctcgcgctcggtgacgacgacgatgtccggtagcgccggcaggttgaggtcgaaccgtcggctcgcgaccgcggtggtcccgccgc

SEQ ID NO: 6127 - DNA, 626 bp, Hordeum vulgare
  Predicted polypeptide sequence is orthologous to G351
gatgttcatgttacacagtactgctagttcatgaccaatcataagttcatgttacacagtactgctagttcatgaccaatctctgtatgagtatgtatgaactctggactacaatatactgacgcctacacaacaactcaaggaggatacaagcactcctccgtcgtttacaaggaaccaacaagatctaggacctatatctacgtatatggctactggagtatgtatgtatgtatgtatgtagtattactcactcgctcactcactcaatctgtacaggagcagaacaaattaaaccaaacgaatgaacgaatttcaccactggatcgactggaccaaaaacttgggatggatcgatgggatccatgcagcagctagctgctcacgcggtgagaagccgaggcttcttgaaggcgagagggctctgcacctcctcgtcgtcctcccacatcatcttgcccttggcgcacggcctccacacgaactccggcacggccgggatgttcaggtcgaaggcccgggcggcggagctcccgttgccggtgctccccacctcggactcggcggccgcggcggccaggagctcggtggacgaggcggcgacgccgcccaacgcgccctcgtgc

SEQ ID NO: 6128 - DNA, 480 bp, Hordeum vulgare
  Predicted polypeptide sequence is orthologous to G354
gaaagcaaaacgtagtctatcgtactgtaaattcgtaattacaatgtccaaccaataacctatctcaaaataccatcctaatcaaagacatgtacaagtgatttcctccctgaaaaaattgtgacaactagtgtacccagctagctacctagacgaatagctcgagcaagacgggcggctggtaattggcggcggtccggtgccccaccacctcctgatccggctccccgacgctgcgccacacccactgatcgccgtcgtcgccgccaccgccgccgccgcgcagcgccatctcctcgcggtgtcgccgcatgtggcccccgagcgcctggcccatctcgaacccgagcccgcagatgtggcactcgtgttgccgctcctcctgcttcttccgctccctgatggccctggcaacgccgacgccgagctccagcccgtgacggccccggaggtggctggtccggtgcccgcccagcgcct

SEQ ID NO: 6129 - DNA, 638 bp, Hordeum vulgare
  Predicted polypeptide sequence is orthologous to G354
cagttaacgtgtatacataatctccgaaccaatgaatgaatgaatgaatcaagtcaccaaatatgtccacaaaagtacacgaatgaatgaaccaactaacgatcaatacctagctaagctacgagtatgtgtgtctgtgtgcagcgacgtacaaatctacacaggtcgatcacgaactctgtagcataactaaagttagctaatcatcaacctagacgaacagctcgagcaggacgggcggcggctgcgccaccgcggcggcggcggcctcctgctcgcggtggcggcgcatgtggcccccgagcgcctgccccatctcgaacccttgcccgcagacgtggcactggtgcgcctgcttctggtccgtggccttcttgtgctccggccccgtcccggcgagtgcgagcgcgagcccgttgcggccgcggaggtggctggtgcggtggccgccgagcgcctggaacgtcgggaaggagcggtcgcacgtcttgcacatgaactccccaccggcggcggcggcgcggcgcgtcctcttggtgctccggtcggcgccggcgccgagcgagagcgagagggagagagacacgagctgctccgccgatgatgctctctggtgcttcgtcatggaggtactatat

SEQ ID NO: 6130 - DNA, 708 bp, Hordeum vulgare
  misc_feature (506)..(506): n is a, c, g, or t
  misc_feature (588)..(588): n is a, c, g, or t
  misc_feature (599)..(599): n is a, c, g, or t
  misc_feature (621)..(621): n is a, c, g, or t
  misc_feature (623)..(623): n is a, c, g, or t
  misc_feature (666)..(666): n is a, c, g, or t
  misc_feature (674)..(674): n is a, c, g, or t
  misc_feature (690)..(690): n is a, c, g, or t
  Predicted polypeptide sequence is orthologous to G385
cgagatcctcatggacgtcaaccagtacgcggcagtgttctcgagcatcgtgtcaagggcggcgacgctggaggtgctgtccaccggcgtggctgggtgctacgacggcgcgctgcaggtcatgtcggtggagttccaggtgccgtcgccgctggtgccgacaagggagagctacttcgtgcgctactgcaagcgcaacgctgatggagcctgggccgtcgtcgatgtgtcgctggacggcctgcaaggggtcaagtgccggcgcaggccctccggttgcctcatccaggaggcgcccaacggctactccaaggtgacgtgggtggagcatgtggaggtggacgacaggtccgtgcacaacatctacaagccgctggtcggctccggcctggccttcggcgcccgccgggtgggtcggcgtcctcggccgccagtgcgagcgcctcgctagcgccatggccagcaacatccccaccagcgacatcggagtgatcacgagctcaganggggaggaagagcatgctgaagctggcggagaggatggtggcaagctttctgcggcggcgtgacggcctctgtggccccacnaatggacaacnctgtcggggagcggcgccgaanangttagggtcatgaacaagaaaagcgtcgacgacccagggaggncgccgggnattttcctcacgccgntacctcccttttggtccc

SEQ ID NO: 6131 - DNA, 896 bp, Hordeum vulgare
  misc_feature (471)..(474): n is a, c, g, or t
  misc_feature (520)..(520): n is a, c, g, or t
  misc_feature (522)..(522): n is a, c, g, or t
  misc_feature (526)..(526): n is a, c, g, or t
  misc_feature (532)..(534): n is a, c, g, or t
  Predicted polypeptide sequence is orthologous to G4
gccaaggttaactttccagaggaaccagcaactcctcaaaagcgtcgagcgcgccctgctcctactaaagcacccaagccaagcgcaacacaggaacctgcagtcaacaaccttgccagcccaagtgctttcgtctacccatatgctgactttgcatcaaaccagccacttgctctgccttacaacatgtaattagatcctgcaatgaactctgctgcccctgttgaagcctctgttatgaatctgtactctgaccagggaagcaactccgttggcttctatgacctggtctgggattttgacaccgagactccagatatatcacccattgctcccatttataccactgctgaaggagcggaatctgcacttgttcagagtgacgcatacaacccagtggtgattgctgaagtacctgaatctgtacttgtccagagtaacacctacaactcagtggtgcctggggggggnnnnaaacaatgatggccgattcccgagccctggggggaggggggggggncntttnatggcnnnttggacgagtcgattgacagccttgtgaactttggggtgcctaggaatgtattggggacatggacctttggagcttcaatgacatgcccatttggggagaattttgctgattgttccaaatcctttattttaaaaataaggggaataagaggttgggaagattgggaaaccacccttgttgaacctttgggtgggcaacgaatttggttcgaccttaaaatgcaaaaaaatacggtttgaaaaattcctcttgtaatgagacccgtttcctaaatgaacggttctttggggccacccgattttggataaaccggagcatcagtgatttcgacaccttttgtgaaagccttccagttcctaag

SEQ ID NO: 6132 - DNA, 700 bp, Hordeum vulgare
  misc_feature (6)..(6): n is a, c, g, or t
  misc_feature (162)..(162): n is a, c, g, or t
  misc_feature (696)..(696): n is a, c, g, or t
  Predicted polypeptide sequence is orthologous to G4
caccgnggggtgcgcctccgcaagtggggcaaatgggcgggcgagatccgcaaccccttctccggcaagagggagtggcttggcaccttcgacactgccgacctggcctctgctgcctaccaggccgcctcccggagctttatcgaggagaagcgtcgccgncgtggccagtccggtgccgcggcctcacctgctcagtcggccacgtcctcaccggcgtcgtcttccacaccgacggcatcttcgtcgtcctccacctcggctgctccatttgcgcacccgtcaccgtcttctgttctggaagccaccaagctggcagctgagtccatttcgcctgagccgacaccagttcccgtcatggtgtccaccacacccgagacagcgcagcttcccgacgacccagagttctaccaggacctcctgcgtgggcttcagctgccggacattgacccgatggacttccgcgcggggcttgatgccttggacgtctcggaggcgtcggcttacttggacggcgaacaggacctgctgctcggcgacttggccgacgaggagctggagctggacatggacctcgacatcggtgacgacttcctggagatgcccggctgcgactttggccgaggcatggatgatttcctgcaaaaccgtcgattttctgcgtcttgaattgggggagaaggtttaaagggtttnacta

SEQ ID NO: 6133 - DNA, 928 bp, Hordeum vulgare
  misc_feature (2)..(2): n is a, c, g, or t
  misc_feature (9)..(9): n is a, c, g, or t
  misc_feature (573)..(573): n is a, c, g, or t
  misc_feature (770)..(770): n is a, c, g, or t
  misc_feature (798)..(798): n is a, c, g, or t
  misc_feature (814)..(814): n is a, c, g, or t
  misc_feature (837)..(837): n is a, c, g, or t
  misc_feature (856)..(856): n is a, c, g, or t
  misc_feature (865)..(865): n is a, c, g, or t
  misc_feature (876)..(876): n is a, c, g, or t
  misc_feature (914)..(914): n is a, c, g, or t
  misc_feature (916)..(916): n is a, c, g, or t
  Predicted polypeptide sequence is orthologous to G4
antaagccnccctccccggcgacgactagcgtcgagtcaccgccggcaacaaccatgtgcggcggcgcgatcctcaaggacctcaaggtccccgcggtgacgcggaaggtgacggaggcggcgctgtggcccgagaagaagaagcccaggcaggccgacggcggggcccggcgcctcgggctggtcgacggcgaggaggacttcgaggccgacttcgaggagttcgaggccgactccggggactccgacctggagctcgggcgcggccgggcggctgagaaggacgacgacgaggtcgtctagatcaagccctacgccgccgtcaagaggcccctctcccaagatgacttcagcatcattactactgctggttgtgatggtcctgcacaaaggtcagcaaaaaggaagagaaagaaccaattcaggggtatccgtcagcgcccctggggtaagtgggctgctgaaatcagagatcctagcaaaggtgtccgtgtttggcttggtactttcaacagtgctgaagaagctgcaagagcctacgatgttgaagcacgcaggatccgtggcaagaangccaaggtaaactttccagaggaaccaacagttcctcagaagcgccgtgttcgccctgctcctcttaaagcacccaagctaaccgcatcacaggaacctaccgtcataccagcagtcaacaaccttgcccaacccaaatgcttttcgtctacccatctgctgactttgcattaaaccagccactgtttcagccctgntaaccgtggccattttgtttccttgcanatggaagttttggctngccccctttttgaaagcctcccntggtttatgaaaatattgntaactcttngacccaagggnaagcccactttcttttttggggcttgtttctttgaacntngggccttgggga

SEQ ID NO: 6134 - DNA, 1140 bp, Hordeum vulgare
  misc_feature (236)..(236): n is a, c, g, or t
  misc_feature (783)..(783): n is a, c, g, or t
  misc_feature (1090)..(1090): n is a, c, g, or t
  Predicted polypeptide sequence is orthologous to G4
cccgtctcgtctcgtctcgcagcgtttcactcttcccctttcctttcgcttagctctccacccgcggccgcacgtgctcccagccatgtgcggcggcgccatcctctccgacatcatcccgccgccgcgccggcccgccggcggccgcctctggcaggcggacaggaagaagaggagggccgggccccgccgcgtgcccgaggaggagcccgaggaggaggcggaggagggcgacnaggacttcgaggccgacttcgaggggttcgtggacgaagagtccgacggcgaggtcaagcccttccccgcccgcaggagcggcttctccggagatggattgaaggcaactgctgctggtgaatatgactgtgcctcagggtctgctaaaaggaagaaaaagaaccagttcaggggcatccgacgccgcccttggggtaaatgggctgctgaaataacggatcctcgcaagggtgtccgtgtctggcttgcgacttacaactctgccgaggaagctgccagagcctatgactttgacacccgcacaatctctgggaagaagggcaagggtaattttcccacacgaaagctctatggcttctcagcaacgctgccctgagcctaccggctgggaagggcctgaattcaacaccgaacaaaaccgggacctcaataacagggcaaggcgaatgttattctgcgctgctgggacgcccctgaaaaacgatgcggcaacccagacatgaccgtcgcctccagaatgcagttaggctcttcatgaattttccngatcggggagcatacctctatggccaactttaggggacatgagtcagaaccttcctacatttggcgggtcactgccccctccaaggataaaactcgttttcgcaaaaggcaatgtcaaggcctccttgagggaggcgacagaacttccctgcggccatcaatgcgctcgcgcggtcggtagaaagcgaactaccgctagtcggcagcggcaccatacccgggccctatcgcccatatcggtcttcgcgcgggggggcccgcgtttgcaggcggagtgcaaacacggttattggcttgcctccaaccntcttctccgggtaccgcgacggtcacatgtcggccgctcggaaccccccg

SEQ ID NO: 6135 - DNA, 857 bp, Hordeum vulgare
  misc_feature (515)..(515): n is a, c, g, or t
  Predicted polypeptide sequence is orthologous to G4
cgcccgcaaagctcgcctcctcctcactgtgccgcccgtgctcgcctctcccggcaggcaccgatctagccctccctcccttgatccacagctcgccatgtgcggcggagccatcctcgcgggattcatcccgccgtcggcggccgcggcggcggccaaggcagcggcgacggcggaggaagaagcagcagcagcgcagcgtgacggcagactcgctctggacgggcctgcggaaaaaggcggacgaggaggacttcgaggccgacttccgcgacttcgagcgggactccagcgaggaggaggacgacgaggtcgaggaggtcccccctccgccggcgccggcgacgggcgggttctccttcgccgccgcggccgaggtcgcgctcatggcccctgcccgccgagatgctgctggtcaacatgatggacctgctgccaaacacgtaaagcgcgttcggaagaatcagtacagagggatccgccagcgtccctgagggaaatgggcagctgaaatnccggaccctaacaagggtgtcccggtatggctcgcgacatacaaccctgctgaagaagcagccggggcatatgaagctgaggcccgcaggatccaaggaagaacacccagtcccgctccccacgatgccccgattggtcacagggcaccctggagccgctgttggtaaatccacaaagttgcctccacctccacaggcctggcaagaataccctctaatatcgctggcccaagagcaacagctatcgtccgcattgttcgccttcacagacacaaggtccgcgcaaatcagctgacccgtcgagttccatcgggcactggccgagctaccggcagcaaagag

SEQ ID NO: 6136 - DNA, 692 bp, Hordeum vulgare
  misc_feature (478)..(478): n is a, c, g, or t
  Predicted polypeptide sequence is orthologous to G4
ctcgccacctttcttcacaggttccttagttcctactgcccagctccacatcagcgcactcctctatctacttacttacagcatgtgtggcggcgcgatcatctccgacttcatcccggagcgagaccaccgcggcggcggcaagcggggcccctccaccgccgacttctggacgcacgccgccgccaccgagttcgacgaccctaccgaccaccactacttctaccccgacgacctgaccggcgccggcgcctgcacgttcccacccgagcaccaaggtacgtgccgcgtacgcgcagcagaggagccgagcaggaagcgggagcgcaagacgatgtaccgcggcatccggcggcggccgtggggcaagtgggcggcggagatccgcgacccggccaaaggcgcgcgcgtctggctcggcaccttcgccaccgccgagggcgccgcgcgcgcctacgaccgcgccgcacgccgcgtncgcgggaccaaggccaaggtcaacttccccaacgaggacccgccgctcgacctggacgactacgaccttctcaacggcggctacaacgtggccgccttcttccaccagccgttcatggccgacggcgccgcgccggcgacctcggcgccggaggtggcgtacgtgccgcagctctggagctttgacagcatcaacactcaagtgcctatgtgat

SEQ ID NO: 6137 - DNA, 987 bp, Hordeum vulgare
  Predicted polypeptide sequence is orthologous to G4
atgtgtggcggcgccatcctagcgcagctgatcccgccgtcggcgggccgtccgtcgaagcaggcggcagcgggcggccgggccccgcccacgagctccaagaagggcggcgtgagcaagagccgccacagcagcaccccagatgccgacgacgacgtcttcgaggccgccttcgaggacttcgatgaccacttcgacctgcgggcggaggaggacggcggcgacgaccatgtcgtctttgcatccaagcctgccttctctccacgtccggcctacgacggtggccgcgcggcgcatgcggcgagcaggaagaagcgcaccggccacctccatggcatccggcagcggccgtggggcaagtgggcggcggagatccgcgacccgcacaagggcacccgcgtctggctcggcacgttcgacacggccgatgatgccgcccgggcctacgacgtcgccgcccgtcgcctccgtggcagcaaggccaaggtcaacttccccgacgcggccaggaccggggctcgcccgcgccgcgccagccgtagaaccgcgcagaaaccgcaatgcccccctgcgcggacgacggcgtactctgccaccgcagcagcacgcgcacagccggagcaggacgctatgatggtcaaacccgagctgatggagtttttcaacgtggacgccatcgtccacctgaccactgccgtcgccgcgctaccgcctgtcacggcgagcaccttcgccgacacgatgccgagggtcgacgaggactcttctgtggggagcggcggcggcgccatgctggggttcgccgacgagcttgggttcgatccgttcatgatgttcctgctaccctgctcggacatgtacgaatccgccgacagcatcttcgccggagacgctgtcatcccggatgccctcagcgtggacagtggcatggacgccgtcagcctctggagcttcgacgagttccccatggacagcgccattttctga

SEQ ID NO: 6138 - DNA, 801 bp, Hordeum vulgare
  Predicted polypeptide sequence is orthologous to G450
ggcgggcctcgggttcgaggagaccgagctgcggctcggcctgccaggcggcggcaacgaggctgaggaggcggtgaggagctccggcaagaggggctacgccgagaccatcgacctcatgctgaagctggagccagcgtcggcggccgcgccgccgtccgaggatgacgaggaagtggccgacggtgccgcggaggcgcagccgtctccggctgctgccgacgggcagttgaagcggtcgccgagccagagcagcgtggtcaccgcgcagccggaagaggaccccgagaagccgcgcgcgcccaaggcgcatgcggtggggtggccgccggtgcggtcgttccggaggaacatgctggcggcggcgctggtgaaggtgagcatggacggcgcgccctacctgcgcaaggtggacatgggcacctacaagagctaccaggagctgtccaaggccctggagaaaatgttcagctccttcaccatcggcaacgactgctcttaagcctcgggcatcaatggcatgaacgaaaccaagctgggcgacctggtaaccgggtccgactacgtgcccacctacgaagacaaggacggcgactggatgctcgtcggcgacgttcccctgggagatgttcgtcgcgttgtgcaaccgcctccggattatgaaaggatcagaaaccctcgggctcgcgccaagggcaatggagaaatgcaagaacaagaactggacgagggtccctttcaagaatataaatgggtctatgcttgccccactctgtaccctaatattactaagactggctc

SEQ ID NO: 6139 - DNA, 877 bp, Hordeum vulgare
  misc_feature (425)..(425): n is a, c, g, or t
  Predicted polypeptide sequence is orthologous to G450
cagctcctcttcttcatcatcacgccccacccctccctctccctctccctctccggcccgaacaaaaagagctccttctacacctccccacctcctcctcggacttccttccttccttccatccatccttccatacatccaatgccgccgccgaatctccaagcgcgcgactacatcggcctgggccctgccgcgccatcctcctcctgctgctcctcctcgggcgagacgggcccgcacctcgcgctccgcctcggcctgccgggctgcggctcagcggacgaggccgccgtcgacgccgcgctcacgctcgggcccgctcctgccccgacacggggcggcgccaagcgtgggttcgccgactcgctgctccaccgtactgccggggcgggcggggaggaggacaagacgaagggtgaatcccncgccgccggacccggagccggagctcctccagccgcacaggctcaagttgtcggatggccacctgttcggagctaccggaagaacacgttagccggcaacgccacaaagaccaaagcggagagccaagggtagaagcgaggcgggatgctggctattcaagggcaagatggatggagccccatacctaaggaagggcgatcttaagactacttcagctttgacaaacctttccctggggctggaggaaaatggacacctgcttaaatactggccaaaaccgttacctggcaaaaattaaccaaagaaaggcttaccggggggagtagggcctaagctcctacagacccaaagtttgggcctttcctttgaaaacaaaaaacttaagggatgcctgatggggaactaccctgggaccttggacccacatcttcagggagaaccagagaagagg

SEQ ID NO: 6140 - DNA, 1024 bp, Hordeum vulgare
  Predicted polypeptide sequence is orthologous to G450
tcagagaattgagcaccccccgggctgcaagttcgcctccccggctccgaccccgaccgcaagcgcgcctccacctccgaccccgactgcccctccccgacctccgccgccttcgactctcccccttcccccaaggcgcacgtggtgggctggccaccggttcggtccttccggaagaacgccctcgcgtccgcggcctcgtccaagaccaagttcgtcaaggtggccgtcgacggcgcgccctacctgcgcaaggtcgacctcaaggcttacgcgggctacacaagccctgcctcctacgaccagctcctcgccacgctccaggacaagttcatctcccacctaaccgtccgcaagcttggtaacgaggagatgaagctcgtggacgcgctgagcggcacggaatatgtgccaacgtacgaggacaaggacggcgactggatgctcgtcggagacgtcccctggagaaggtttgtggagacctgccagcgcatccgtctaatgaaaagctctgaggttgtcaatctaccaccaaaacctgtccgggaggcacaatccttgctcctttttctacagaccgcttcaaaagaagaaatgtcttttgctcaaggaggttctttcgcaaggttccgaagtaagaaaggggtacagccatctctacttttttgccccagaatgctattgagttccggaaagggccgttaacctggaattcccttctcccaggccagtgcagttgtttcctacaatgaaagatgggagaaaggtggagaagccctccaaaaatttaccccctacaagttcgtgtactggatgaaaaaataaccagaattgcccgtgtattccctgaggcgtgctttggttcctgggaaaaatagcgcttacgccgatgagaaaataaaaataatatacaacgccccggagagggggggcgagagatcaccatcatttagacccgtttatgtgaacatggatttacgaatccgccgggacgccgcggcgtgttcaacctaatagaagacct

SEQ ID NO: 6141 - DNA, 961 bp, Hordeum vulgare
  misc_feature (140)..(140): n is a, c, g, or t
  misc_feature (143)..(143): n is a, c, g, or t
  Predicted polypeptide sequence is orthologous to G450
tttagtagtatgtatcatagttgcgcgtcatattgaatagagtgttgttgttctttattatctctgtcaatactatcttaattctaggagtgatatattatatatccgttaaggagtttcgggtttgttaaggggtgggntantgatattggagatcgtatttaagttttgtattctaagctggagctcaaccgcagtggcgttctggtctatattaaactaatggatccccctggctgaatgaattggcacgagggcctccggtccggtcgttccggaagaacatcctggcggagaagtcgtcgccggcggctgcggcgttcgtcaaggtgagcatggacggcgcgccttacctgcgcaaggtggacctcagcatgtacaagacctaccaggacctctccaaggccctcgagaagatgttcagctccttcaccatcggaaactgtggaacttaagggatgaacggcatgaacgagagcaagctgatggatctgctcaacggatccgagtacgttccaacgtacgaggacaaggacggcgactggatgctcgtcggggacgtcccgtgggaaatgttcgttgagtcatgcaagcgccttcggataatgaaaggatcagaagctattggccttgcaccaaggcgatggaaaaatgcaagaacaggaactatgggaagatgtactaaatgtttgcaagaatcaaatactataaccttgttgctaccctgatcaattctttggctaatctagtctgatctctgatagtgaatatttggttgtgactttctttcagtattagtccaatctatttgtatttctagaagagacccaacattgaatgtatttactgttgccataatgggtttttttttaaaaaaaaataaaaaaatcttagggggggccgtaccaatttccctattggaactgttttaacctcttaattgcccttatttaaaaatctc

SEQ ID NO: 6142 - DNA, 921 bp, Hordeum vulgare
  misc_feature (8)..(8): n is a, c, g, or t
  Predicted polypeptide sequence is orthologous to G450
tgtagacngcgcgtaggaaccccactaaagggaacaaaagctggagctccaccgcggtggcggccgctctagaactagtggatcccccgggctgcatgaattcggcacgaggccgggaagaggggctatgaggacaccattgacttgaagctgacgctgcccaccggcggcatgcaggaagactccgccggcaagccggagccggcagccgacaaggccaagaggccggcagaggccgcggccgctgaccccgagaagccacctgctcccaaggcacaggctgtgggttggccaccagtccggtcgtaccgcaggaacgccatgaccgtccaatcggtgaagatcaagaaggaggaggagaccgagaagcagcagcctgctgctaccgctgctgctggcgccaacggctccaactttgtcaaggtgagcatggacggcgcgccctacctgcgcaaggtggatctcaagatgtacaacacctataaggacctctccattgctctgcacaagatgttcagcaccttcaccgcaactgggaatgaggggaagatggttgaggcagtgaacggttcagatgttgttactacttacgaagacaaggatggcgactggatgcttgttggagacgtcccatgggagatgtttgttgcttcatgcaaacgcttgatgatcatgaatggttccgaagccatcggtcttgcaccaagggccaaggacaagtacaagaacaagagcttaacatggggcagttagaggaagactatgatgccataaaggatggtgggttttggcaatgtggctggggggttcttaaaaaatataaaagggttttcaacccccacccccggccttacagacacggccaccccttgccccctgtcaaacatcgggtgggcggggacccaaaagccaaaaattttc

SEQ ID NO: 6143 - DNA, 563 bp, Hordeum vulgare
  Predicted polypeptide sequence is orthologous to G450
caagctcccagcactttcaccatcaccatctttctatacgtagtagtagtagtagtagagagtgctacagacgagtaatgaaaccaacatcttttcacgactcaagagcatcgggcgaccgaaagcggtaagcgaagataatagctgtacacgttcctatctcctcatcagagcaaagccccctcctcctttcaggcagcaccattcgtaagggccacgcagtgcacctcaccgggcagctccaggtgctaggttcacggcctcggagttcttcatcaggcggacgcgttggcaggcctccacaaacatcttccagggggacgtcgccgacgagcatccaatcgccgtccttgtcctcgtaggtgggcacgtactccgtcccgttcaccgcgtccaccagcttcttctcgtcgttggcgaaccctcgtgccgaattcctgcagcccgggggatccactagttctagagcggccgccaccgcggtggagctccagcttttgttccctttagtgagggttaattgcgcgcttggcgtaatcatggtcatagctgtttcctgtgtg

SEQ ID NO: 6144 - DNA, 656 bp, Hordeum vulgare
  misc_feature (19)..(19): n is a, c, g, or t
  Predicted polypeptide sequence is orthologous to G451
aacttatctactacacggnacacccaagtcccggtcctttcttacatggctgcctgaacctctggctgtacaacatcagtacgtgcatgtactctactacctactactccgacaaaacagtactgctagtctgctaccgctactgcatgctacctgcgcgccgatccggccggactggccgccggagctcgcgcgcctgtgagtccctggacccagcctcgcgttcgtaccgagcgggtggatgcagatcagtacacttcacagagcgcgcgtgcgtgaaccggctagctcacgggtcacggcctccgtcgccgttcacccatggccggcccgatcatgcatgcgtctgtgtgtccgtctctgatcatgagccacgtacggcaagtttccatcgtctccggatcgcttcatttatgtatgtgtgcacgatcgtgtccttttcgtcgccatcatcgtgcttccgagcttttcattatcctcagcctcttgcaggacgagatgaacatgctgcaaaaccaaacgaagaaatcacccgttagttagactcatttttggtcagttggtatatgcaaattaattaagatgggtacgtgttggtgtgcttactcccaggggacgtcgccggcgagcatgaggtcgccgtccttgtcctcgta

SEQ ID NO: 6145 - DNA, 812 bp, Hordeum vulgare
  misc_feature (291)..(291): n is a, c, g, or t
  misc_feature (300)..(301): n is a, c, g, or t
  misc_feature (312)..(313): n is a, c, g, or t
  Predicted polypeptide sequence is orthologous to G468
cagattcctacacacgctcatatagcctctctctctctctcgtccgatggagtgcaaggcggcgagcgagccgtcctcgtcctcgtccgcgccctcttcttccatggatagctgtggcgccggcgggccgcgggcgacggcctccacggcgtcgtcccgctaccggccggcgatcgacggtggcctgagcacggaccttcacctcgggctcagcctccggtcgtcatgctcctcctccttccacacggggccgaccgcgtctccgctttccacttccaaggggagcacccnttgacgacnngacgaaaccgnnaaccccggcataggccacggcatgccggatccggcgtcggccgcagcggcggcgccggcggccatgggcagcagacgctgtttgtgaaggtgtacatggagggcgtccccataggccggaagctggatctgctgctgctggacggctacgacggcctcctcgccatcctaggccgcatgttcaacgcctccatcatacatccggatactgtcggccatgatcaccaagtggttcttggggagaagaaggctcgccatgttgtcacgtatcaagacaaggagggggactggttgatggccggggacgtaccgtgggagctgttcctggccgcgggtgtgaagaaattgaagatagcaagggcggattgatcaagcatctttgattgattcaggttatgcaaagtcatacagccgatgtgtggtcttgtggagtgaccctttatgtgatgctagtcggcggttacccttttgaggatcctgatgaccccaaaaatttcagg

SEQ ID NO: 6146 - DNA, 894 bp, Hordeum vulgare
  Predicted polypeptide sequence is orthologous to G519
agcgccgacgaagcgcgtggcgccccgcgggggtcgcaccatggggatcaagaaggccctcgtgttctacgccggcaaggcgcccaagggggtcaagacggactggatcatgcatgagtaccgcctcgccgacgccggacgcgccgccgccagcaagaagggctccctgaggctggacgactgggtgctctgccggctgtacaacaagaagaacgagtgggagaagatgcagctgcagcagcagcagggggaaggggagaccatgatggagcccaaggcggaggagaacacggcgtccgacatggtcgtcacctcgcactcccactcccagtcccagtcgcactcgcactcgtggggcgaggcgcgcacgcccgagtcggagatcgtcgacaacgacccgtcgctgttccaccaggcgcaggcgacggcgttccagacgcagagccccgcggccgccgcggcgcaccaggagatgatggccaccctgatggtgcccaagaaggagggcggccgatgagggccagaagcaactgttcggggacctgaggtaccaccacgtccaagacatgtgcgacggccttgaaattgatgccccccggggacgaactgatttaatcctctttgtttccctccccagggtccgggggggcccagccgggtccgaggggatgccacgccggtgttgggcaccagaaagggggccctcgcaccgtcgatccagtcgaggagacgggcaggtaaattttttgcgtcggcgaaggaccgatatttgggcgctttggagtgcctgttgggacgcggaggggggtggccgggattgtctagaaaacccgcgggtgggcggggcggggtgtagtgtgtattgtagattagaaaccgccgcgctgggcgagg

SEQ ID NO: 6147 - DNA, 678 bp, Hordeum vulgare
  Predicted polypeptide sequence is orthologous to G525
cggcacgaggccccaccggtatacggaccaaccgggccacggccgccggctactggaaggccactggaaaggacaaggaggtcttccaccaggcgaccacgagtctcatcggcatgaagaagacgttggtcttctacatgggtagggcgcctaggggggaaaagaccaactgggtaatgcacgagtataggcttgagagtggaaagcaaggaacacctggcctacccaccgacatcaccaccgccgccgccattaacgcatcttccaaggaggagtatgtggtttgcaggatattccataagagcactggactcaagaaggttgtgatgtcgtcgtacgccattcccatgccaatgtccatgggagcagcgcagcaacatggcttccttgaatctggtgcattgccttctctcatgggctatggcacatcatcgtcatcaccggcgccctcatcgttgctacctgcagcttcttcataccagctgcataacgtcggggtgagctcgtctatgatgggtagcgcgatgctcccgatgatgaatgaccactactttgggaaccaccactaccagaagatgcccaccccaccacagccgctgatgtcgttctaccaccaagaccaccacccgcagcaacaacaattgattcaaatgccgatgcaaatgcagatgggtgcag

SEQ ID NO: 6148 - DNA, 796 bp, Hordeum vulgare
  Predicted polypeptide sequence is orthologous to G559
tttttttttttttttttgtagatcttggaatatataatatacccttaaggtcctagacacgcagaaacaactcgtcggaaaccatttttaatgggaagactgactaccacagtgactcgctaaggaaggtactcatgtacaacaccaatatacgaccatacggtactacgacaaccatgttccacgctgagtattataccgccataaacaaaagaactcgggcagcatccgttgcacaaccactgctatccatcctacaacctgtctgatataatcaaaagatattattttctctccgctcgcacataccatcaccatccttcaactcatcatgcttggctagattcgagtttttccccctctgctattgagatccatgttctttgtaacttggtctatgctgattgctgcgactgctgctgctgttgctgttgctgagcctgctgtgtctgggatgactgctgctgttgatgttgctgctgctgctgctgtatttgcagctgctgcatttgaatcagctgggagttcatctgctgctgtaggcccgccttcgacatacgagcatcggtaatctcaccggttgcaagtttcagccgctggacctcacccgttaacgcttcattcagagcatctctcagctgcgcctgttgctccattgcttgcagccttattttcaactcattgttctgagtcgcaagtcctccagagtccctctgcagcatcgtcaattgtgctgaaagcgtaatcgcctctgtctgcaagacctgtaccttatgctcgagttcttgcctcgtgc

SEQ ID NO: 6149 - DNA, 810 bp, Hordeum vulgare
  Predicted polypeptide sequence is orthologous to G562
ttttttttttttttccaagaaagtaaaattttactcctagcctttaaggacaatctattacagttttaacatgtacttaaccctctaacaaagctcatggtatcactaccataccagcaagagctcttctagtcttataccgtcctgatgtcacttcttgtagcacactaaaatataacaacaaatatagtaatctatcatacatttatctacaccttgtttcacaaacaactcactgaccagccatgactaagaccataaccaagtatgattatggagcttcaaaagggggtgaaacgctatcgggccatggcggggttagataataggaaactccaccaatcttctcgacttctacttcatggttggcactcaaatccagcccctcgttgtcgctcttgagcattcttatgtagctttgccgtctccgccatgatgcggctcggacggttcgacctggatgctcaaggtggtcacaacgctagggccctctgactgctgcattttatcatcgtgacctagtattttacccatcagctgtttattttccacttccatggttttgcagtcctccttgagctggtcgagttctgatctgagcgtgccgttcgcagctgtcagctcacttaccttctgggctagctcttcgcattcttgctgtttgcgtaatcttgatctccttgcagactctctgttggattgtttccttctctccctcttcagttcccgttcatccatctgagacagcgaagcgttactctgggaagaagctgcggcattcacctccccctgtcctaaggagcctcgtgc

SEQ ID NO: 6150 - DNA, 700 bp, Hordeum vulgare
  Predicted polypeptide sequence is orthologous to G562
aacactaaatttgggtatatgttcccataacttcttgcatatactgtcttcacacttctagtttgtatggcaccacaggttcagaaatctcaaaaggtctttagaaaggttggcatgaagcacaacacccctatattacaacactgctaattaaaattacagtgaaaacatggacacaacgagacttcagcatcagtgcctaaaagtacagtagctgttgggaaccggaatacggagtaaatataaccgccggagttcctgattatactcatcaaacaaatatacctacactgtaacgccgatgttatgtgagcagcatgagcttgtttaaaccccaggtggcatgcaaggtattagtctgcgccagagaaatgcggcgaatcaatcagcttgcagctacaacatccgtcgtcgtgctggagccgaggagctggcggagcttgggctcgctgtgctccatgtggttgtttacacctgacttgtttgtgtcatcgatcatcgacaagaaattctccacaatgcgaggggaggaggatggagcagctgctgctgctgatttgtccagaggcatttctgcgtcagctggtgctgccgcgcccttaagtttcaccactagagcagaattctctaatctgagcttctcagagctttttgctagcttgccgatctcagattttagagatgtgttctcagctgtaag

SEQ ID NO: 6151 - DNA, 712 bp, Hordeum vulgare
  misc_feature (21)..(21): n is a, c, g, or t
  Predicted polypeptide sequence is orthologous to G635
tgttccacagaactgactatnattgttgatcagttcaaaactacacaacaacatggtagactggtaaacctagtttacttaactaccccaggcatctcatgcaatggcaaagaatgatacgaagcgattacttcctgaggctactgatcttgtcattgattcacgggctaccttacaatatgctgatctccaaattactatcgctaagctattacgggtctgtttcatttggttgccatttccccttcgcatgataaaaaaccatccatggctaaaaaataaggccatgtttgcatgctttcgccatccttcttgctctcctcgtatttctgaagcaatgatgtccacacagatttgcactgtgccggtgtacgagttatcccctgcttcaacaggctaccagatatctcttcccaaagaaccattcttcctttcacggattggaatttctcatccatttccccacgcagctgtattaagctcttaatttcctcgggcttccacttgttctttcttgaagatttagctggagcgggagctgaagtgctggaatccttatcagttatgctgatcttgccgagctttggtttgttcccttgagctgaagcattgacaattcttgcaatttttactgctgtaggggatttgaaggactcccaaaaatgatccaatgttttaggctgatgtaaatcagaagataagaatgattcac

SEQ ID NO: 6152 - DNA, 865 bp, Hordeum vulgare
  misc_feature (26)..(26): n is a, c, g, or t
  Predicted polypeptide sequence is orthologous to G653
gggggcgctcgtggggttgttcgtcncatcgtcgcatcgggcgcaggggggcaggcagagatcagatcgggggagagggagaccacggcgacggcggcgaccatgttcagcgggacgcagcagaagtgcaaggtgtgcaccaagacggtctaccccatggaccaggtgtgcaccgacggcgccgtcttccaccgcgcctgcttcaagtgccaccactgcaagtccaccctctcctttagcagctactcctcgttcgaaggggtgccctactgcaagccccatttcgcgcagctgttcaaggagaccgggagctacaataagagcttccagtcacaatcccccgcgaaatctgcaacggacaagttgactcctgagctgactagatcgccaagcaaagctgctggcatgttttctggaacgcaggacaagtgcgccacttgtggtaaaacagcataccctcttgagaaggtgacagttgaagagaagtcttaccacaagtcctgcttcaaatgctctcatggaggctgcgccctctcagcctccaattacgcggcttttggaagcatcctctactgcaagccccatttctcacagcttttcagggagaaggggagctaccaacattctgatcaagtgcgccttcggtcaagcgcgcctcaataggcccaaaccgcacaggccgcggggtcaaacaccacaagcggctgctgaaatcccctggttatgctgccatctttaaagtggcctttgagcttggagattgggagcctcggccgttatttacaatggcacccgcgtgcgtctgggtcaacccccgggctccccgaccccatcattggttgtccctggggcttccggacccagt

SEQ ID NO: 6153 - DNA, 1069 bp, Hordeum vulgare
  misc_feature (979)..(979): n is a, c, g, or t
  misc_feature (1010)..(1010): n is a, c, g, or t
  Predicted polypeptide sequence is orthologous to G707
gaccgtgaacaatcttatctcctgcactatcaagaagatcaagacggcgctgcaatgcgcaacgcctgagtgttaggatggattttgccttggggatgaccggcgggcgctgagtctgagtcaagaacgaaccgcgcaatgaaaaaaaatcctttgctaggtgataaggatctttttgacaggtccttagcacaaagcaatggtggtggttcgggtattgactcggcctattccgtccggctgtttttccccagggccatgcattttatatattttttcagggacatgctatagtcccatcgttttagggtgaactttgggctggctcgttgccctgtgttttgcgcgtctttttttctgttgtaggggtgacctggtttccaggtagaccctcaaaaataccgggtagatctacggggccccccctttggtcctggtgagaggtttaaaataaaacttaaaccgttgaaaatcttttttgcacaaataatgttgtggcggttgttggggaaaaacatataatatttaaattatctgcatgatcactgacgtaataattttattttatctttgggggggggggcccgttcccaatttcgccttttaaaagagattttttataatatatctgtgcgggttgtttaacaattggtgaggtagggaaaacaccctggggtacacctaattttttgctcgcggcaacacttcctcttatcctcagattggggataattaagaaagaggcgccctataaattttctctcttccacaatatattgcccatacttatgatgcgcatattcgcttaaatgggccgttttattatttgtataaatatctcatgttattatcttactgtaatccctcacgtattttctatcaacatgcgcggcgattctgacgtcatattcttatactaaattacacattgactctactgttgcgtggttgtgttctcctgatattcagtaatctgtantcactctcataagaggtgtgtccgcacactncttgtgctgcaaaatgctgctatatgaaggttatacattcctttactgttatgcgtacg

SEQ ID NO: 6154 - DNA, 579 bp, Hordeum vulgare
  Predicted polypeptide sequence is orthologous to G732
aattgggtttttttttttttttttgtttagccatagctcacgtcatcacactaccagtaccacacaaacacgcattacattacacacaatatgataatatgctcccgagtcagagccacgggagactccctgcatcggccatgatatcatcgagctggtccggctggagcagcatctgaatctccggtggcagggacaggggcggcgccagtggcgactgcaggccgccgtacagctgcgtgaaggggaccgggatattctgtgcgttccttggaaccgccggcaagttccccgagcacgcggagctggaagttccgttgttccagaaggctgtacaggtagcaacgcgccgaagagagcacgcggttgtgttgttggaccaggctgcattgttgctgcatgagggcggtggtgacgcgcatggcctggttatagatctagacctgggccgcgcgagcggacaaactgccctcgcgctgttgcctatttacgcgggacctccgcgccgagaggcggttggaggtcttccgtttgcgctgccgctcctcctcggagatcgcgccgccacggcgttgaggc

SEQ ID NO: 6155 - DNA, 892 bp, Hordeum vulgare
  misc_feature (811)..(811): n is a, c, g, or t
  misc_feature (817)..(817): n is a, c, g, or t
  Predicted polypeptide sequence is orthologous to G783
cccgggctgcaggaattcggcacgaggctcaagcgatcacggagaggagaagagtagaaccacaggcagacgaacccctcgaagagcagctctgagctctgcggcttgcgctcccgaatccgcagcccttccccgcttcgatcggagacgcaggggaggtgccggatcgagcttcgcggtcggcatggtgcccagggacatggtgaatgcccccgccgagaggctacacatccaagggtctgtagtgaacaagaagtgtgagaagaaggtgccaaagaaaatccacaagtcagagagggagaagcgtaagcgaggcacgcagaatgacctctttaatgagctgggagccatgctagaactagacaggcagaacaacgggaaggcatgtgtattgggtgacactacacggatactgaaggatttagtttcacaagtggaatctcttcggaaggagaataccacactgaagaatgaatctcactatgttgtgttggagagaaatgaactccgtgatgataacagtatgcttcgcaatgaaatcctggagcttcagaacaagcttaggatgggtctgcaaagcaaccctatttggagccaggatactacaagatcagccgtcgcagtaccttatcccacaagaggagtgttcccagtacagcattcaccacatccaccagtcatcacctcgacggcactttctctgcaacctgtaatcactgagcaatgctatgttgccccaccacgagagctacagctcttcccggaaagttcatctgcatccactgaagacagtgaactgtcacaagaccangggatntccaatagtgtaacacggcctcaggcacggtaccctacaccagtggtgatgtcgccagtgaacgaattctcatcc

SEQ ID NO: 6156 - DNA, 676 bp, Hordeum vulgare
  Predicted polypeptide sequence is orthologous to G783
ggcacgaggcacaaacacacacaccagcggatcaagatccacccaagcggagatagggcaagcaaggactgcttctttagatgtgaattcattacaggaaccagaatcttggaatggtggctgatgcggagagctcagattcaatggctggcagctcaaggtctgctgccgaaaagcacgttgacaggtgttttgacaaaagagcccaggaaaaggctccaaagaaaaatcatgaagctgagcgagagaaacttaagcgtgatcagttgaatgacctttttgttgagctcagcagtatgctagatcatgatcgacaaaatagtggaaaagctacagtattgggtgatgctgcgcgagtactacgagatttaattactcaagttgaatctcttagaaaggagcaatctacccttctaactgagtgccaatatgtcggttcagagaagaccgagctgcaagatgagaatactacactcaaagcccagataatagaactgcagaacgagcttggtgcaaggatcagaaaaaataacctgaatttaagcagccttggggtgtcacatccaatagggagcagctgcactgctaatttagcaactcacccaacgcggcatgatatatggagcaatacttctaatgtaagcaccatgcgcatggtgcccccaacaaacacact

SEQ ID NO: 6157 - DNA, 956 bp, Hordeum vulgare
  misc_feature (617)..(617): n is a, c, g, or t
  misc_feature (619)..(619): n is a, c, g, or t
  misc_feature (632)..(632): n is a, c, g, or t
  misc_feature (634)..(636): n is a, c, g, or t
  misc_feature (638)..(639): n is a, c, g, or t
  misc_feature (642)..(643): n is a, c, g, or t
  misc_feature (646)..(647): n is a, c, g, or t
  misc_feature (661)..(661): n is a, c, g, or t
  misc_feature (727)..(727): n is a, c, g, or t
  misc_feature (940)..(940): n is a, c, g, or t
  Predicted polypeptide sequence is orthologous to G811
cccgggctgcaggaattcggcacgaggtggcgacgcccccctttacctctttctgtagctcctttgatctttatgccctcctcccctcactttatcaagaaatctcaggacaaatcttgaggcgcttttagagcgagagggagaccgatggcggcggcggcggcgagcgtcggaggcggggcggcgccgttcgtgtggaagacgtaccggatggtggaggacccggggacggacggcgtcatcgggtgggggaaggggaacaacagcttcgtcgtcgccgaccccttcgtcttctcgcagaccatgctgcccgcccacttcaagcacaacaacttctccagcttcgtccgccagctcaacacctatgtcagtccgttgattcatattactaatcctccatttgtcttgtccatttcctgtacttatcttgattcagagagggagagagagagagagatttctgtactccggtggagtacaagttcttatgtgcgtgtgtgtacaactgtgtatgcagtatgcgtgacattttttgggagtatatagttcgtctttaaaaaaaaaaaaaaaaaaaaacctggggggggggcccggcccccatttcccctttagggcgngntttttaccaaacncnnncnncanntanncttctcacctctcnttatcccctccccatctctctttaatctctctccctcacccccttcacttcttcaccttccccccnttctctcatcttaatttcatcttccccatttcccccccccctcccccctctttctccctcattcaatctctctccccctaaactttctagctccttttatcccgctctcacatatctcttcctactaatcctttttcggcaccctgagaggtcacgtccgtagcttttacttgacccaccgcttacgcccttgcctagccctacgcacacgtntcgtcgacgtcactca

SEQ ID NO: 6158 - DNA, 477 bp, Hordeum vulgare
  misc_feature (430)..(430): n is a, c, g, or t
  misc_feature (445)..(445): n is a, c, g, or t
  misc_feature (452)..(452): n is a, c, g, or t
  Predicted polypeptide sequence is orthologous to G811
gtccaggcggtgcagaggctgcgggacgagcggaggggcatggaggaggagctgcaggccatggaccgcaggctccgcgcggcggagaaccggccgggccagatgatggcgttcctcggcaagctcgcggacgacccgggcgtggtgctgcgcgccatggtcgccaagaaggaggagctggctgcagccggtgccggcggcatggatccaagaccagataagaggaggcggatcggggccgaggccgaggaggcagcacagagcagggccgtgccgttccccttctctaacgcgggacacgtgttctactaatagaccttgagagtggagagtagatagataggtgtacacgtgtgatgttttggtgtttatatgtatgtgtatacgtatgtatttctgtgaaaaacaacaaaactgtcccttttcaaanaaaaaaaaaaaaaanaaacccnaccaaaaaaaaaaaaaaaaaaaaaa

SEQ ID NO: 6159 - DNA, 816 bp, Hordeum vulgare
  Predicted polypeptide sequence is orthologous to G843
ttttttttttttttttggttgcacatgaatccgcattatcataaaccttatggacaaatgtttacatacatggtacatcattctccctcccctaaacctacaacaaaggcactatcacatcatcatcatcacagtacactttcaacagcaatggcgtctatctcctctttaaaaatcaaacagcaatggcaacaactcacgctacacattcccgctgccgggtaattttacaatttggctcgaatgccttattgcacttccttcagaaatctgacacaaatctcaatgtaacactgctacagccaagtcatgtaagtatagcctcctttctcacctgggcctccgtcgtgctgagaaaccaagatttggttctgggccaagcctagagcaggcagagcccaaattgcatagctaaaccatcggagcctcctcgttgttacccagcttttttgtcaccatatcgtaaaccgtatcgactttggcagggtcaactttaaacaatacatgggcatcttccttcttgacgatgttgcccttgaacatctcctgcatcaacacctcctgcattctcagataatgactgggtagcaatctgttctgacagcacagaagtttttcgctgacgcttaatagctctgccccaggaagaccaacaatgtcccaatcatcccattgcttagcgcttgttggtcctgtgctttttggagaatccctaccaccagcatccaaaatggcactacctttcttaagatccaaactcccatcagtctcaactttcataggccggtttgttttgtgccctgatttactatttga

SEQ ID NO: 6160 - DNA, 862 bp, Hordeum vulgare
  misc_feature (808)..(808): n is a, c, g, or t
  Predicted polypeptide sequence is orthologous to G896
agtgcatgaggtacatcctcaccgagcgcttcggcttcgccaacgactgcgtcctcatcctcaccgatgaggagagggacccgtgcaggcagcctaccaaggccaacatccgcatggccatgcattggctggtgcaggggtgtagctccggcgactccctggtgttccagttctccggcgccggcgcgcaggtccccgactgcgacggcgacgagcgggacggcatggacgaggccatctgccccgtcgactcgttccagcagggccccatcctggacgacgagatcaaccagtccatcgtccgcccgctcgttcacggcgtcaagctccacgccatcgtcgacgcctgccacaatgccaccgtccttgatctcccataccagagcaccttctccaatcagtacgggtgcctgaagtggatggactagcgccctttaaatggacctgcaagagcaccaacggagggcgtgccttgcttattagcggcagagttacgggaataatctatgaacgttctgctttagccaactcaacatatgagaactaaacaaaatttaaaaaagaagtgaataaaaaacaaaaacaaataggtaggtttgtttatttttttaaacaactataaaactttgatagaagataaaacaaaaggaccatattagttttaataaaaatgaaataaatttatggataaaagatattataataaaaatataaaaaaataataaaaataaaaaaaaaaaaaaaaaaaaaaaaaataaaaaaaatattttattttattaattaaattttattatttttattttttttntattatttttataaatattttataattaaatttatatttatttttttttattat

SEQ ID NO: 6161 - DNA, 567 bp, Hordeum vulgare
  Predicted polypeptide sequence is orthologous to G896
gctcgagcggccgctgggtacacacagaccacgatctggtgtctggaaaggaactagtggcggggaagctatttcatttagcggctgtgatgataatcagacatcagcagatacttcagccttgtcaaagatcacttcgactggggcaatgacattttgcttcattcaagctattgaacaaggccaggccgcaacatatgggagtatcctgaactccatgcgtccgacaatacggaacacgggaagtggtgcctcaatggctggaggcggtgcggttacatcactcatttcaatgcttctcacagggggaagcgctagtactggtggattgagacaggagccacagctaactgcatgtgatacatttgatgtgtatgcgaaaccattttcgctatgatacatttgtggtattctccactgtgttctgtgattctaccatgagtcgaggtttaaactatcatgtacagttaacagttgaaatggctcctccatatgtagagctaactttgtatcatgtgatgctcatattcgaattaaagtgtttgccccctttgaattgttctttgt

SEQ ID NO: 6162 - DNA, 1454 bp, Hordeum vulgare
  Predicted polypeptide sequence is orthologous to G921
ggtgtttgagggaccaatggatccatggatgggcagccagccatccctgagcctcgacctgcacgtcggcctaccgccgatggggcacccgcaccaccaccagagccaataccaggcgccgccgatgatcgcgctggccaagcccaagatcctcgtggaggagaacttcatgccactcaagaaggaccctgaggttgcggttcttgagtcggagctacagcgggtgagcgaggagaaccggcggctgggcgagatgctcagggaggtggcctccaagtacgaggccctgcagggccagttcaccgacgtggtcacggccggcggcaacaacaaccactaccacaaccagccgtcctccgcgtcggagggcgggtcggtgtcgccgtcgaggaagcgcaagagcgaggagagcctcggcacgccgccaccgtcgcatactcagcagcagcactatgccgccggcctcgcgtacgcggtggcgccggaccaggcggagtgcacgtccggcgagccgtgcaagcgcatccgggaggagtgcaagcccgtcatctccaagcgctacgtccacgccgacccctccgacctcagcctggtggtgaaggacgggtaccaatggcgcaagtacgggcagaaggtgaccaaggacaacccatgccccagagcctacttccggtgctccttcgcccccggctgccccgtcaagaagaaggtgcagaggagcgccgaggacaagaccatactcgtggcgacgtacgagggcgagcacaaccacacccagcccccgccgtcgcagccgcagcagcagaacgacggctccggcgccggcaagaacgccgggaacgggaagccgccccaggcgccggccacgcctcaccacccgcagcagcagcacaagcaggaagcggcagcggtcgtcgtcagcggcgaatcggccgcggcggcgtccgagctgatccggcgcaacctggcggagcagatggccatgacgctgacgagggaccccagcttcaaggcggcgctggtcaccgcgctctccggccggatcctcgagctctcgccgaccagggacatcaattaatccccacaggagcaagccacatttcagaaacactgcccggctcaatttttcttgcggtgtcgattactccgttcggcattgcttgctgcctgcctccgccgcctccgtcaaagcctcgcagacaaagcatcaagaaccggacgcctgaccagcgaagaagacgcgatcggtttccggcgagcgaagatcggagttaccgctcgtgtacatagaccgcgaacacgacggcggcgagggaggttataacatgtaatgtactccagtagctaggataatgcagtcattcaaatgttccgttccataatttccatggaactcgattcgattcaatgagaaagtcaatcaagtcacggtataaaaaaaaaaaaaaaaaaaa

SEQ ID NO: 6163 - DNA, 700 bp, Hordeum vulgare
  Predicted polypeptide sequence is orthologous to G921
accttcttttcccctgaacattatttttctgtggtacgattcagatcctcaaatagcaagaaaaatgcaaattatgcagtacaattcgggggagaactaggccctaaatctcagcagagaagtgctaggaacttcctttctgaagctgtacaagaaaaccgcacgggcggagtttctgaagtatgcacagtctcaacagattctacttgaatgctaataatccggcagcttccgcaggatggcggcggcgagcgcgtcggtgaactttcggtcgccggtgagctcgcgggccatctgctccaccagagccgcccggaactccggcgacgcgacctcccggcacaccttcttcaggtccggctgcgcctcccctgctgcctcgaccacctgcacacctcccccgtccttggtgaggtccagcgtgatggtcgggccggaggagttgatggagatggagcacggcaccgggccgccgccccccgccgcgcagctcggcagctcgccggcccgcgtggggcgcgggtggttgtgctcgccctcgtacgtcgcctccaccatcgagctgtcctcggcgcttctctgcaccttcttcttgacagggcaggacggcgcgaaggcgcatcgaaagtaggctcggggggaggggttgtcccgtgtcaccttctgcccgtacttccgccattgatacccgtctttcaca

SEQ ID NO: 6164 - DNA, 987 bp, Hordeum vulgare
  Predicted polypeptide sequence is orthologous to G921
cgaggaagacatggaggagcagtggatgatcgggcagacttgcctcagcctcgccctcggtgtcggccagccgacggcgccgcgaggtgctcccccggtgaccaaggtgctcgtggaggaggacttcatgtcctccaagaaaaatcaccaggttgaggcgctggaggcggagctccggcgagtgggcgaggagaacaggaggctgggcgacatgctccgcgcgctggtggccaagtactccgacctgcagggaaaggtcagcggcatgatggcggcggccaacaaccaccaccagtcgttgactacgtctgagggcagttctgcggcctcgccggccaggaagcgcgcccgcagcgacagcctgaacaccgccgaccgcaatccttcgccaccgctcgccgcagccggcagcgtcaacgtaggcccaggccagccggagtgcacgtccgtccacgagcccggcgacagcaagcgcgtccgcgccgacgaggacaaggccagcagggtctccaaggtctacgtccacgccgacccctccgacctcagcctcgtggtgaaggatgggtaccaatggcggaagtacgggcagaaggtgaccaaggacaacccatgcccgagggcctacttccggtgctcgtctgcgccgtcgtgccaggtgaagaagaaggtgcagcgcagcgccgaggacaagaccgtgcttgtggccacgtacgacggcgaccacaaccacgcaccgccgcccaagcatcaaggctctggtggcaggaagagcggcgacgcagcccccgtccgcgtgtcaccaccggcgccggtgcttgtccagctgcagcgggagcaggaggcttcgacggcggatcaggtggccgacaggaagaacctggcggagcagatggcggcgacgctgacgagggaccccgggttcaaggcggcactcgtctccgcgctttctggtcggatccctgttgcttgatcggaaatctcccagca

SEQ ID NO: 6165 - DNA, 719 bp, Hordeum vulgare
  Predicted polypeptide sequence is orthologous to G937
ttttttttttttatccaaaaactggagcacctttattccctttaggacagcaagagccgaacaatatacgaatctccctctatatatgtatgtaattctcggggcgaaaattggtggtctgcccgaaacgctcgcgaaaaaagcctcatgtacatcacaagaacaaggccatgatcagttcattttttgggcgctggatcaacgcccaatatccctggattcatggcctgcaccacaccctctcgatcgatcaggagtgtatgccgttattgtcatccatgccgcaaagctatctctacctctctctcatggaaatctcttgacggtcccaaaagccttcagatcatctccggctatagcctaccgacctgtcgtcttcctcagaactgtcgctgacggtgagtgccgagacggccacccctgaacaagagagctgaagggggccttcaggggaccgggactgcgagctgctttgctcctgatgagcccagagatctcccaccagcataatcggatggctagctgaggaagagctaggggacctctggttgtgcagacggtatttctggaggtggcttttcacttcatcgttggtgaggccatcaactttcatcacctccctgatttgctttggagtggcaacttgagggccaccgagttggtgcaaggcggcaacaaagtgccggtgaagctccggcgaccagcaccgcctcgtcttc

SEQ ID NO: 6166 - DNA, 651 bp, Hordeum vulgare
  Predicted polypeptide sequence is orthologous to G938
cggcacgagggtgcagtgcccgcacgccgaccacgcgctcggcttcctcgatcgcaacgcgcgcaacgcccaccagtacacctgcaggtacaaccagaaccaccccgccgcggccgcccagagcaagccggcgtcggccttcttcccgggggcgccctacagcccgcagagccaggctctcggcgggttcgacttcggcctgcccgtggccgaccagagatgcctcgccgggctgatgagcatgtacgagaccggcgtggccgcgcacagaggcgcaacaagcgacgacaccgctcccggcctgcagatcggcaccggcaaccatctggcgccacgctcgcttgctgactcgaacaaccatatgcagcagcagcatcatcagagcgcagcgttcttcatcggcgacgacgcgccgttcggcatggcggcgccggagctgggcaggttcggcgcagggttcgacctgtcagcggcggactacgccggcgccatgcagcagcagcagccgcagaagcacgttggacccaactggttctactgaacaagaacagccaaggaaccattcctcattagcatgtagctctaggccattagaattcataaggcttccattctcgatcagtccatggcgccttgcaacttgtaaggatc

SEQ ID NO: 6167 - DNA, 1406 bp, Hordeum vulgare
  Predicted polypeptide sequence is orthologous to G962
gagatgactcgatcaaggccgacgaccaccatggggggatcagtgccagaccaacaccaccagcagcagcagcacgacggggaagtggacggtgggcagctgcagcacggcggcgagcacgtggagacggtgatgcccgggttccgtttccacccgacggaggaggagctgatcgagttctaccttcgtcgcaaggtggacggcaagcgcttcaacatcgacctcatcgcctccgtcgacctctaccgctacgacccatgggatctccccgcactagcgtcgatcggggacaaggagtggttcttctacgttcctcgggaccgcaagtaccggaacggcgaccggccgaacagggtgacgccgtcagggtactggaaggcaacgggggcggacaggatggtgaaagtcgtggagggcaaccgctccatcggcctcaagaagacgctcgtcttctacgttggcaaggcacccaagggactccgcagcagctggatcatgaacgagtaccgcctgccacacggtgaaaccgaacggtaccaaaaggaaatttcgctctgccgggtctataaacgcccagggattgacgacaaccttcacctcaccggcacaacaacaaggtcgtctggctccagagcggcggcaacgaggcacagtacagcagcacaccggacgtcagcggtggcaactcaccgccagcagccgccagtgtttgtcgaaggcgccggtcaccactcatcatctgctctcaaggcgtacaacgcgcacacgacccaaggaacaaatgcagccagcaccatgacatcactgtcagcggcaggggtgacgccaccggcgatgttccggtcgacggcctctgtagcctcgctgagctctacgaattcgacagaggaggatggcacgtcgctctaccaccaccacctgaagggacacaacaacccagcagtaatgcaactgcattcttccactcacgctgcgctgctcaacaccaattcctcggcaatggcgaccatcccgatcgacgagctgagtcgggcgattgggtcctacagtcaagcttcaaaccctaaccagcccacggcgccaatgcagggcccattgcttaacttccctagcttggagaagatctgggactggaatcctctcctagaatctccaaaggtttgcacaagcttcaagtaacttcttagttgcatgaatggatccatgcacttatcatatatatgcctcccattatttgtatacttatgtatatgtggacaattatccgagctagcaaggctatatatgtaatggaataggtaacaaattaaggccgttttagtcccatgcaattaatttgtgtaacactgtcttgtccatttcaattccgaataaaggttaatcaaaattaaaaaaaaaaaaaaaaa

SEQ ID NO: 6168 - DNA, 652 bp, Hordeum vulgare
  Predicted polypeptide sequence is orthologous to G979
cggcacgaggaaaagacccccatgctccagccgcgcaccacatggaccttcatctcgatccccagatcggtgccatcgcgaaccctaggtcgcctccatcccacaggccttcgccgccgtccctccaccgcgaacgccatcccggatgcattcgccgccaccccggatcttctcgccccccatcccatctcccgtatcttgttggtcattgcctctcagcgacggctatccctagcggcagttgcacgagagatggatcttcatcctctcgaacacaaccacagaggcgagacggccgccgccatcctccttcgcgctggccatcgtcgtcgtcgtctccgtcgcgaatcttcttggtggcggcaaggaaatcactcgcgcgccgccgtcgccgccgtcgccgtccttctcccactcttcttcgatcgccattccccacaggcgagcgcggacgcagaaggccgggagcgccaaggcgaaggcgacgcccaagcgggccaagaaagagtcgagcaggagcaacaaggagtctgacgcctccaccaatggcgccgccgcatctgggaagaggagctccatctacaggggggtcacaaggtggacatgcagatttgaggcatacctctgggacaagaagaaagggaggcaaggt

SEQ ID NO: 6169 - DNA, 538 bp, Hordeum vulgare
  misc_feature (8)..(8): n is a, c, g, or t
  Predicted polypeptide sequence is orthologous to G979
gcctgctntaattactgctctattgccttgcacttacaagcgcgcgagaacaatacacacaaaactcgatcaggaagttaacattgcaattagcaagatacgatagtaattaaggacattgtaacaaactgaaacattactggggcacacacacacaccagcttatgttatttgaagttctgaacacaccagcaggcgccgcagcatctggaggctctgccaaatcacacggccgttatgtatatctctaccgtacgtagaggctagctctacataccatccatgttgacctgtgcgcctgaccctcctgatacatccgggtgatttctggaccggatctcgacaacttcctctgtccggaaagcctccgtagttgccaacatggtgcgcttctgtagatctgcatgcgccttgtcgtcctcggcgcgggcgctgtagccggcgactcgctcgacgaggtcgtagaacacgtccaggagctgggcggcgaagctggccatgggagctcgtgctggtaaatttcaacctgcttagctta

SEQ ID NO: 6170 - DNA, 414 bp, Hordeum vulgare
  Predicted polypeptide sequence is orthologous to G988
caacgcgaggcgccgcaaagtggcttcgatcattcggacgccaatacacatgcgcgaaagacggcggacggatctaggcaacaccatgaattgcaaccgttgtgtcgttccaatgcagcggtgtcggttgcagaagtattttagatgaggaaccgcacaggagaaatgaccttatctctttgaatgctttacggttttatccttctgatttttgttatttctgaaaaaggcattgcatcatcttgcacgttcaaacgaagggcggtgtagttcttgctgatgatactatcacatgacctttttgaaggaaagacagagtcggtgaacgacagatttcatagcaactacagcttgtggcttcatccattttcttaactgatgagaaaaggccacatcaaggctcagcggccgcca

SEQ ID NO: 6171 - DNA, 576 bp, Zea mays
  misc_feature (76)..(76): n is a, c, g, or t
  Predicted polypeptide sequence is orthologous to G1006, G22, G28
gcgcgtgtggctgggcacctacgacacgcccgtcgatgcggcatggcatacgaccgcgccgccgtcgcgctgcgcngggccaaggccaggaccaacttcgccgccgggcgcggctcccgcgccactccccccgtccaggctcgcccgctcccgtaccccgcgctggcgccgggccacttcggcgtgctcgacggcgcccgctcgtcgccctggcacgtcgtctacctcccaccgcctaggctgcaccacgccgtggcgccgccgatgcctctcgtggcagtggcaggggacgccgcctcgtcgctgccgtccacggcgctggagctccggacagggcccaaggccctcccgttcgacctcaacgagccgccgtcgctgctgttgggctcgcggtctccataatggacgtggagacggaggtgatggtaggtcagtagtatcgagtagggatcatcgaccattgaactaggtggtaggattgactagtgagggtaatcaactggtgggagtggagaccatcgctccggttgtatatatctaccagaacctattttaggaaaaaaaaaaaaaaaaaaa

SEQ ID NO: 6172 - DNA, 974 bp, Zea mays
  Predicted polypeptide sequence is orthologous to G1006, G22, G28
cacacccgtctcagctcactccctcctcctccagtttcgtcagctcatcatcatcataaaccgaacacagagctctcgattccattccaggatgctgctgaacccggcgtcagaggcgtcggtgctagacaccatccggcagcacctcctcgaggagccagccgacgagagcttcgggagcctggtggcggaccagtggagcggctcgctcccgttccgcaccgacgacgccgacgacatggtggtgttcggggcgctgcaggacgccttcgcctacggctggctgcccgacggctcattcgtgcacgtgaagcccgagccggtgcggtcccccgactcgtcctcctacccctgctcctacgacggctcaccctgcttcggcctcctggacccggagccgccgctgacgcccggcaccaccacgcccagtagtagggggcaggaggaggccgcggcggccatggcccggggcaagcactacaggggggtgaggcagcgcccgtggggcaagttcgcggcggagatcagggaccccgccaggaacggcgcgcgcgtctggctcggcacgtacgacaccgccgaggacgccgcgctcgcctacgaccgcgccgcctaccgcatgcgcggctcgcgcgcgctcctcaacttcccgctccgcatcggctccggggacaagcgcccgtcgccggcgccgcccgagcccgccacctcctcggactcctcctcgtcttcggccagcggctcgcacaagaggcggaagcgaggcgaggccgcggctgccaacatggccatggcgctggtgcccccgccctcccagcttaacccggcggcccagccgtggttccctgccgcgccggtcgagcaggcggcgatggctccgcgcgtggagcagatcgtcgtctagtctagtcatgcgccggcgaaagcgggggcagggcctgcgctgcacttgcgtgacagctccaccggatgga

SEQ ID NO: 6173 - DNA, 709 bp, Zea mays
  Predicted polypeptide sequence is orthologous to G1033
tttttttttttttaatgaccttcgtatccttttttttctactttatttcgtagccaatgaagaaaacaacaacaaatgtaatcaagaacagatagagtagcagtaatagtagtacacatttagaagaacaagacagaaacagttgtacacaaaaaaatagagagaaagagagagaaaaagagacaagcacgagttttatttgttcaaatatctcttttttcacatacaaaacaagaatgtcattctacaacaatataacaagtagtatatagaaaaaaaattctgaactcgacaaaggaaaaggataaggaacggttagagatttaattttattttagtttatttattcttcatcgtcttcatcttcatcatcgtcatcatcatcatcatcattatcttcatcggatgatttcgattttgctgcaggtttctttttaccacctttagctggtgcagcctttttgcttccacctttagcagcacctttaccgcctttggcaggtgaactactagcaccaccaccaccgcttttcttgtattcagcaacacgtacttcatacttttgcttttcaacagcggctttttgttcataacgttttctaacatcatcactaacttttttccatcttgcaccgatttcttttgaaatatcaccaacggataatgatggactttttttcttatatctggtcgtcatcttgtgaaaaga

SEQ ID NO: 6174 - DNA, 879 bp, Zea mays
  Predicted polypeptide sequence is orthologous to G1033
gcacgagccagcccaaccttcacgcaccgcatttcccaagggaaccataccagagcggcagagccttcccctccgctccccagtcccacccgcaccctagccctcagcaaaccctaaccgctcgtcgccatgaaggacacctcgttcaaggccaccggcgccaagcgcaagaaggtcggcggcgccaagcgcgggctcacccccttcttcgcgtttttggctgagtttaggccgcagtacctggagaagcaccctgagctcaagggcgtaaaggaggtgagcaaggcggctggggagaagtggcgctctatgtcggatgaggagaaggcgaagtatggcggtagcaagaagcaggatggcaaagcaagcaagaaggagaacactagctccaagaaggccaaagctgatgttcgggagggagatgaagcagaaggttctaacaagtcaaaatctgaggttgaggatgatgagcaggatggtaatgaggacgaggatgagtaaatagtacgatggggaacagcagctttgcaattgagtgtttgctgctttacttatttttctatatgctgttccttttgatgttatatgctgtaaggaaaatctgtacatgatggtaccttagggtatggcatgctggagttcccctttaacccgaagagccggatacttttgccagcctcgtcagcatgtgtaaacagttgttttcttgttttatcgacttattgggtgactacccaagagttggtttgtagtcaatgaggtatgctgccccctgtggtgctacgcagctgcagcaacatcagatggtcaggctaaaatcatgttgtgggatctgattctaatgatgcttatttagtactattacaaatatcctcgtgc

SEQ ID NO: 6175 - DNA, 748 bp, Zea mays
  Predicted polypeptide sequence is orthologous to G1033
ggcatcagagcggcgccggcctacaaccgttttcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgagggtgacgagtgatgtatgacggatgaaactctgtccaagtgtttgcagtcagggaaaaaatctcgtcgttgtcggcctaaccgggttttctcgaaggactttctagatgcagtagattagtgccgtcttctgagtagtttccttgcaagtgtcgtcccgttcctggagtgaggcagtttagtttgtagtttcttcgcttcatcggcactcgaccgttgttggattgggatgtttagcctgcagtctgtacttaccccaagcatctatggtgcctgttttaaatctcacatcacaatagctcgtttgttttaaaaaaa

SEQ ID NO: 6176 - DNA, 769 bp, Zea mays
  Predicted polypeptide sequence is orthologous to G1033
ggcacgaggcacactcccgtttacgtgcacacctccaaaccctcatcacgatccggctccaaggtctcgagatgaagtcgagggcgaggtccggcggtggcgactccaggctctcggtgaggaagaccaaggttgagaaggacccaaacaagcccaagaggcctccgaccgcgttcttcgtcttcatggaggagttcaggaaggactacaaggagaagcaccccaatgtgaaacaagtctcagtgattggcaaggctggtggtgacatgtggaagtccttgtctgatgccgagaaggctccctacgtatctaaggccgagaagctgaaggttgagtacacaaagaagatggacgcctataacaacaagcagtctggaggaggacccacattgtctggtgattctgacaagtccaagtccgagggtgatgagtgatggatgacgggtgaaactctgggctgcccaagtgcttgcagtcagcagggaaatctcatcgtcgttgggcctaaccgggctttgctgctccgtagcgtctggaagctgtctgtcttttgagatgctgtagactagtagtgcctgctctgagttagtaattgaaagtgttgtccctgaagtgatgctgtttagttggtagtgtgttcgcttcttcggcacttatacttacccccaagcatcaacgctgccctgttttaaatctcaataggtgctgttttaaatctcagatctcaatatatgactactgatcgctgaataaaaaaaaaaaaaaaaaa

SEQ ID NO: 6177 - DNA, 1158 bp, Zea mays
  Predicted polypeptide sequence is orthologous to G1033
aacgcctccaagaaggatgagggcaggctccgggccggcggcggcggcgccggaaagctcaagaaggccgccgcgagcggcaagcccaagcgccctccctccgccttcttcgtcttcatgtctgaattcaggcaggagtaccaggcgcagcaccctagcaacaagagcgttgcggccgtgagccactttgcactctgttctccctttattttttttccatgttcgtctgcagatgatgtcttattttttcgtgttggtggatcaggtgagcaaggcagcaggggaaaagtggcgctctatgtcagagcaagagaagcaaccctatgtggaccaagctgggcagaagaagcaggactatgagaagactaaggcaaatattgagaaggagagcacaagctcaaagaaggctaagactgatgacgacgatggctcgaagtccgaggtcgatgatgaggatggcggtagtgacgaggaaaacgacgacgacgagtaaatagtatctccgctgtcgtgaggtagcaaatcgattgttaggtccccaattagctcactggtttgctatctttaatgttaagttgtttggaacaggtgtttatgaaggggatctattagtttcgtgaggttgttagtttagtgcattagcaaagaaaaagccgaatgctgctagctattacgttgcttttcttttgctaatcacttgtgtcacaactctctgtacctgtttcattgactaatctagtgactagtcagttatgggtttaatgtttggttttggttttatatatttctttgttgctttctgtgcggcctacggaagtcatctgtgctgtatgaatgatgaatatgtgcttgtggctcgtttcattttagtgagtttttgttttgtgactcaggttaatttacatgagtttgtttgtgactcaggttaatttacatgagtttgtttgtgactgttaatttgtgcgtttattggtgcagttagctttcttgtatataaatgcatggtggaaattctgttgatgatttctgagataaccaagctcacttgtttacatgataaactgctgcaaatttgttgctgttttctgagataatcaaattcacttgtttttgcattaaaaaaaaaaaaaaaaaaaaaactcgagggggggcccggta

SEQ ID NO: 6178 - DNA, 840 bp, Zea mays
  misc_feature (762)..(762): n is a, c, g, or t
  misc_feature (830)..(830): n is a, c, g, or t
  misc_feature (832)..(840): n is a, c, g, or t
  Predicted polypeptide sequence is orthologous to G1033
actggacgcctgcagtccggtccggattctttcgtagacgcacgcgtccgcgctacctctcccgtttacgtgcacacctccaaaccctcatcacgatccggctccaaggtctcgagatgaagtcgagggcgaggtccggcggtggcgactccaggctctcggtgaggaagaccaaggttgagaaggacccaaacaagcccaagaggcctccgaccgcgttcttcgtcttcatggaggagttcaggaaggactacaaggagaagcaccccaatgtgaagcaagtctcagtgattggcaaggctggtggtgacatgtggaagtccttgtctgatgccgagaaggctccctacgtatctaaggccgagaagctgaaggttgagtacacaaagaagatggacgcctataacaacaagcagtctggaggacccacagagtctggtgattctgacaagtccaagtccgaggtcaacgacggggacgaggagggtgatgagtgatggatgacgggtgaaactctcggctgcccaagtgcttaaagtcagcagggaaatctcatcgtcgttgggcctaaccgggctttgctgctccgtagcgtctggaagctgtctgtcttttgagatgcagtagactagtagtagtgcctgctctgagttagtaaccgaaagtgttgtccctgaagtgatgctgtttagttggtagtgtgttcgcttctttggcacttctacttacccccaagcatctacgcagcctgttttaaatctncataggtgctgttttaatctcagatctcatatatgactactgatcgctgaatagatttcatgctctanannnnnnnnn

SEQ ID NO: 6179 - DNA, 1162 bp, Zea mays
  Predicted polypeptide sequence is orthologous to G1048
gcacgagtggacatcgacctcttccccgacatcgaccttgacgccctcctcgcctccttctccggcgaccccgccgccgtctccggcctcatcatcccgtccccgcctccgccggcgccggcgacggcgcacgatgcggaggcggggtcgccggagtcggtgacctcccggacgaacccgctcggggaggtggcgctctcggagatcgagaggctcctgatgcaggagggggaggcggaactgggcggggaggtcgatgggatcagcgtggaccagttcttcgacgcgctgtacgacggcgaggaggcgaaaggtgagcgggaggcgggggcaagcgcggatgtggactccggcagggacgatgtgctggaagtcgtgacgccagaggcggggacggtggaggtggatggcgatgatcccatcagcaagaagaagatgaggcaaatgaggaacagagattccgccatgaaatccagggagaggaagaagtcgtacataaaggacttggagacaaagagcaagcacttggaggcagagtgccgtcgcctcagctacgcacttcagtgctacgcagctgaaaacatggcactgcgccagagcttgctgaaggataggcctcttggtgctcccacagccacgcaggagtctgccgtactcacggaaaccctgccgctggtttccctgctttggctggtgagcatcgtctgcctgttcctgatgcccgttctgcccaaccgaagcccagctgctccaagcagcggcggaagagacctcgtgatggcagccggaaagacaagcagtgagaccccagagatactggaactcatcctccatggaaggcgttgcaagagcacgagggcgaagattaagctatgtattttaccatttcatgcaggagctgcttgctagtagttgctaggctttgagcctcttgcaagcttacctctatatgtagtgtacccgcaaatcttaccgtgctcgctatgcgcctgtcttgcagagaagcctgtcgatatccatggagtagtaccttttttttgtttaatagctcctgtgctacccagaatatgtttaaaatctggattttgtgttattttctatttcttcaccttatctctagttgctcctgatataaagttccttcgctcgaaaaatcttagga

SEQ ID NO: 6180 - DNA, 798 bp, Zea mays
  Predicted polypeptide sequence is orthologous to G1053
atagtaatcctagtccacaattatatcagcatatgagatgtgagcttcattgcttaactaggactacaaccagagttcaacaatcttagtgcatgtgcaccagaggacactcgttgctaataatgtcatcagtttgacaggacatctgcaacatctagataacctttttgcagatatttcaccaaaatatagacccactacagggtgcggtagtcttatgagacccagaaccgtccgagccatacatactgctgtgctggatcatgtgcagcttggaccaaaatgaaaacctagtcaaacacacagtagagctatgttacaagggaaacctggtcgtcgcctttagaacctagtcaacatatgggccccttccaaatcgctttgcgtggagtcggacttttgtcaatcttcctaggcataccaggaaacgccttagatggtggcaacatcaccccttgcattttcggcttattgggaggaacattgtggggaacggcacaatgatattttgatgtaaccgccgcattctttttatggatcaagtcatttggtacttctgtcttcttttgtagtatattggctggagtctgattttcagctacaattgattgaaggccacccttggctgattcacatattataccctttgcctgagactggtaagctattacagtctgtctcaactcctttacttcacgttccactcttgccaatcgttgtttagcacaaatatccacatcatccattttctccaaatgatcaaccaaaagattattctcattttccactcttaacttt

SEQ ID NO: 6181 - DNA, 839 bp, Zea mays
  Predicted polypeptide sequence is orthologous to G1062
ctgaggccaggcaaagactctccgccctcccactcccacctcgccacctcctccttcctcgctcccaattttctttttttttccccttccccttcggcgcggcaggattttctccatctgctttccccatttccgccgtattttattcgatttcgaggtcggttttctgttgcacagggagaaaggtgggttctttgcgccgctgccggcctcggacttcaacgacgccgggatgagctgggacgacgaggacgagatcgaccaaagcgtcgacgcctcctcgatggccatctcggcctccatggagaatgctgcgggcgcggtggcgggggcaagtggcgccggcggtggcagcgggagaggcaagaagaaagggatgccggccaagaacctcatggcggagcgccggcgtcgcaagaagctcaatgaccgcctctacatgctgcgctcggtggtgccgaagatcagcaagatggatagggcttctatccttggcgacgcaattgagtatctgaaggagctcctgcagaggatcagcgatcttcacaatgaacttgagtcagctccgagctcttcgcttgttggaccaacatcagctagcttcaacccatcaacaccgacattgcagacatttcctggccaggtcaaggaagaactttgcccgggctcattcccaagccctactggacaacaagccacagtcgaagtcaggatgagggaagggcatgcagtcaatatccacatgttctgtgcgcgtaggccaggcatcctgctgtcgacaatgacggccctcgacagcctaggcctcgacatcgagcaggcggtcatcagctgcttca

SEQ ID NO: 6182 - DNA, 772 bp, Zea mays
  Predicted polypeptide sequence is orthologous to G1062
gggggcttcctcgggcggcggcggtgacacggtgctggacgacgccgacgacgacgacggcgggagcatcgacgcgtccgggctcaactacgactcggaggacgccaggggcgttgaggacagtgggaagaaggacggcaaggactccaacgccaacagcacggtgactggcggcgccacgggcgacgggaagggtaagaggaaggggttgccggccaagaacctcatggcagagcgccgtcgccggaagaagcttaatgaccggctctacatgctccggtccgtcgtgcccaagatcagcaagatggacagggcctccattctcggcgacgcaatcgagtacctgaaggagctgctgcagaagatcaacgatcttcagaatgatctggagtcgtccccttccacggcctcgctgcctccgacgcccacaagcttccaccctctgaccccgacgctgcccactttaccgtctcgcgtgaaggaagagctgtgcccaagcgcattgcctagccctacttctcagcaaccgagggttgaggtgaggatgagggaaggccgggcagtgaacatccacatgctgtgcgctcgcaggcccggtctcctgctctctgccatgagagcgatcgaaggcctcggcctcgatgtccagcaagctgtcatcagttgcttcaatgggttttccttgtacatcttcgaggccgagctgtgcaaggaaggccctgggcttctgccggaggagatcaagcccgtgctcctgcagtccgctgggttc

SEQ ID NO: 6183 - DNA, 433 bp, Zea mays
  Predicted polypeptide sequence is orthologous to G1078
cttttttttttttttttttttttttttgacagggaaaaacatccaggagccttctcctatattccatcactctactttgagctatatattatattatattatattttgcagtttccctatataagtaaactactgaatcacccagagagagaaaggatggtctcttggtaattctggtggggcaagaggtcctaccgcactgacccagctcggcggcacaccacgtcaagagcttcaaccactgtccctgagaaaccggctatggcttggaatatacccggcaggcctgtctggatgttgttcagcgtcattgaccgcgtgacctcgatggccttagcgtgcctcgccatctcgtcctccaccttccgacggcactgggcgatctcggttttcttctccgcaagaggatcacgggcgtcgtacgcgtggctgt

SEQ ID NO: 6184 - DNA, 1295 bp, Zea mays
  Predicted polypeptide sequence is orthologous to G1078
ggcacgagggagaatctttatgacgaggagcaaccactctacaagttaatcaaggatgaagaatttgcaaggctccagtataagaaacatgtctcagtgctacaaaagctggaatcaggagggcatgatagactgcatgccgaaagacttcgggattctattgaagaactttatactcggataatctggttggaagaagctgtgagtttggcatgtttttccatatcaaatctcagagacgaggaattatatcctcagatcattgaattatctgcagggcttgtgcatatgtggaaaaacatgcacgagtgccatcaggtccagaaccatattgcccagcaagttagtctccttggcaacagacctgggagtgaaccaacaagtgacactcatcgccaggcaacatctcagctggaaattgaggtgtctggatggcacactgccttctgcaatcttatcacatcgcagcgtgaatacgttagcatccttagccaatggattggtctcacagactgccttccggatgatggtggcttaatgagaagttcatctggaatccttagcctctctgaggaactccagcgtgctcttgacaggctaccagagaaggtagcagctgaagcgataaagacctttatgtcagtcatacactctatagttgtacagcaaagtgaagagcgccaactaaagaagaagtcagataacatggatagcaagttccagacccagttagagaaacacagtgaaaatacaatgcaaaactcggcccagcctccaaataagaataactattcagcatcaaagaatggaacgaaactggatgcatttataaagcaggtcgaggaggagaaagccagatacctaacctctgtgagggtaagccgagccatgacactgaacagtctgcagacaagccttcgaaatgtgttccatgctctggagggattctcaggagtgtgcgtacaggcatttgaaggtatcagcagatgcagtgaagttgctgttattcactcgggagcagcttcacctgctatttcctcgtgaccttgcttcaatgactgtgattattcattgtaagtaggcaaaggataaactggttccacgtgaatacccttcgcttctaattttcagaactttgaatagctttcgggggattatgtgaagtcaatataggcataatagtcttgaatacatcacaatgtctcaacttacattttggttcttattgcatgggatgtactgctctgtacataatcatttacattttgaccgaaccaaaaaaaaaaaaaaaaaaa

SEQ ID NO: 6185 - DNA, 594 bp, Zea mays
  Predicted polypeptide sequence is orthologous to G1078
gcaaggcaaccttaatgtctgtacattataaatctctcccctcccactccccccaaaaaaaggaaaacaacaaatcctgggcaaaatcacattatctacaactacaactgaaaccatcctgggacagggcaaaacatccggggaaccatcttctatacttgaccactctactttgagctatatatataatatattgcagtttccctatataaataaactactgaatcccccaaaaaaaaaaaaaaaaaaaaagaggcagcaaatggtctcttggtaatcctgatgggaaaaaacttcttctaccgcacaaacccagctcggggggagaacacatcaagaacttccaccactgtcccccaaaacccagctatgggttggaatatacccggcaggccggtctgtatgttgttcagcgtcatggaccgcgtgacctccacggccttggggtgcctcgtcatctcctcctccaccttccggggggactgggcgatctcggtcttcttctccgcgagagggtcgcgggcatcgtacgcagcgtggctttcgatgccatcccgcccgctgccggggaggccgaggccgaccatggagtaa

SEQ ID NO: 6186 - DNA, 810 bp, Zea mays
  Predicted polypeptide sequence is orthologous to G1078
aaccttctcggcgcgcagctcctctgtctacctcgcctccagctccactacatacgctagctagctcgcgcagctgcagcagcagcttagcaagcaaagaatgggggccgcctcgtcgcgggaaggggacgcggcgcgcgagcacacgaggcggtgccgggagcggcggcggctgatgcgggaggccgcgcgcctgcggcaccacctggcggcctcgcacgccgcctacctccggtcgctcggcgtcgtggcgtccgcgctcacgcgcttcgcggtcggcgagccgctcccggtgtccgaccacaccccgcccgccgtgctcgcgcaccgcccggtcgtcgccccctccacgccgccgccgctgctccgcgccatcgaccagccgcagcgcgaggaggcgcggggcggcgcttctgccggcgtcggcgtcggcagcggcagcgccggtgctgctgcaggggaggacatgatgaggatggtggtcaggcaccggagcctcgcggaggtcgcggcggggctggaggagtacttcctcaaggccagcgtcgccggagacacggtgtccagcctgcttgaggccagttccaccgccgagttcaacggtggctcacacagcttcttgggcgccctctgctgcctttcggcgccagcgcttgaccgcgtcgacagcatgggcagccggcagaggcacagcgccaccttgcagcagctcctggcgtgggagaagaagctccacaaggatgtcaaggtgccaacatatatataatcgaacccaattgcttttgcttgctaaaagtagtcatgaaggca

SEQ ID NO: 6187 - DNA, 880 bp, Zea mays
  Predicted polypeptide sequence is orthologous to G1089
ccaaaggatctcaagaagacaaggacaccgtcgagtcgccgccagtcgctcgatggggtgcgggcagtcaaagatcgatcaagaggaggcggtgtttcgatgccgggagcggaagcggctgatggctgacgccgtggcctcgcggaacggttttgccgccgcccacactggctacactgtccgcctgaagagcaccggcggcgcgctatccgatttcgcccaaggcgaggcgccggaccctagcctggtgtcctcccatacccaccacgctccggctgtggcgacgtcatctgtctcgactccgccaggcccctccgcagcttccgtcaacagcccctccccgccgccgccgccattcgccgacttctctcattctagcctccaaagatcctcatccacccccaacattcctatgccggagccgagggccgcagccaaaaaccgccctcctgccgatgcttctatccgagaggaggatgaggatgaggatgaggaggaacaggatggacatatcaagatcgatagcgatgacgacagtgacgacgacagtgacgaagacgacgatcaccatgagcatgacgatgttagtgtggatgacatggtgcatggacaacaatcaaagcggattttgatgagtagtgtgggatcttctccagtaacaccacctccgcctccaaggttgaaccacaccccaccaacgcttgccacagcaacgccaccgcccccggtgctggagtcacagatggctacctgggactacatctttggcccaactccccacccatcacccaccctagagcagcctgctgctgatactttgtggatggaaaggcgtgataaggagccagtggctgaggtgaaggcacttgtggcaaaaaca

SEQ ID NO: 6188 - DNA, 533 bp, Zea mays
  Predicted polypeptide sequence is orthologous to G1136
gatctcggggctggaggccatgatccgcgtgcagtgccacaaacgcaaccacccgtcggcgcggctgatgacggcgctccgcgagctcgacctggacgtgtaccacgccagcgtctccgtcgtcaaggacctcatgatccagcaggtcgccgtcaagatggccagccgcatgtactcgcaggaccagctcagcgccgcgctctacagccgcctcgcggagcccgggactgtcatgggcaggtaatcaggcaggagagctcatcagctcgcctgtgtgtgcctgccggatagggacgataccgatacactgctacccaccacggggactgtcatcgcggtcaccatggttacaaaacacacacacgcacgataggccatagagattcaggaggaggtggaggacggcgacgacgatgatgatgctggtgttgttgaaaactctagaaggatggatggatgatgacacctagcttccggctgctgttcatcatcctcttgtgtttttgctagtagcctggtaattagcaggatta

SEQ ID NO: 6189 - DNA, 1072 bp, Zea mays
  Predicted polypeptide sequence is orthologous to G1140
cgatggcgagggagaggcgggagataaagaggatagagagcgcggcagcgaggcaggtcacgttctccaagcgccgccgcggcctcttcaagaaggcccaggagctctccgtgctgtgcgatgccgacgtcgcgctcatcgtcttctcctccacggggaagctctcccagttcgccagctccagtatgaatgagataattgacaagtacaacacgcattctaaaaacctggggaaaacagaacagccttcgctggacttgaacttagagcatagcaaatatgcaaatttgaatgagcaacttgcggaagcaagccttcgactcaggcagatgagaggtgaagaacttgagggattgaatgttgaagaactccagcagttggagaagaacctggaatctggtctgcatagggtgcttcaaacaaaggattctcaattcttggaacagatcaatgacctcgagcgtaagagtacgcagctggcagaggagaacatgcaactgagaaatcaagtatcccagatacccccagctggcaagcaagcagttgctgatactgaaaatgttattgctgaagaagggcaatcctctgaatcagtgatgactgcgttgcactctgggagttcacaggataatgatggtggttcggatgtatctctaaagttagggctgccttgcgttgcatggaagtaaacaggaaatgaggctccttgtcgattctgggtgtggatgtgggtgtgggtggagctgcggcctcagcggataggcacttgtgtatggttttatggacgaccggcccccgactacgtactgcaataatcttgcattggaagcgagatcggttaacctgatttgtcatccttgtggcttcatgatgcgatgttccgcttgtaccgtttgctagcatgttaactgaatttttagaatcgcatatacttttgttcttatatatcactgtcgtactgctcgtaagatgtatctactttattctatccaatgttgtaacctatcacctaccaacttccctactgttttggcgcgccgcaagctttgctcaagcatgcttcatgtttgtt

SEQ ID NO: 6190 - DNA, 1036 bp, Zea mays
  Predicted polypeptide sequence is orthologous to G1140
tcgtgggcgtaggacgagagagaggatcggcggcggcgtgtgggagatggcgcgcgagaggcgggagatacggcggatagagagcgcggcggcgcggcaggtgaccttctccaagcgccggcgcgggctgttcaagaaggcggaggagctcgccgtgctgtgcgacgccgacgtcgcgctcgtcgtgttctccgccaccggcaggctctcgcagttcgcgagctccagtgtgaatgacatcgttgacaagtacagtacacattctaagaatctggggaaatcacatcagcagccttctattgatttgaatgtagagcagagcaaatacagcggcttgaacgagcaacttgctgaagaaactaatggacttagacagatgagaggtgaagaccttgagggattgagtgtagaggaattgcaccgaatggaaaggaaacttgaagcaggactgcatagagtgattagtacaaaggaccagctattcatgcaacaaatcggcgaattactgcaaaagggcacacagctagaagatgagaacaggcgtctaaaagaacaaatgcctcaggtgctaacggctggcacaatggtggttgctgctgctgcagaaaatatcctcactgaagacgggcagtcgtctgaatctgtaatgactgcattgcattcaggaagctcgctcgactgtgatgatggttccgatatatccttgaagttgtcgttgccttgaaaggaaggaccatcgcatcgcatgttatctgcatgagtggggctgacaccagtgcttctaagaagacaaagactgggatagtcccattcgcggcattatattggtttaaccagatgtgctgtccttgtgcatgtctgtacttcaaagtggctaacgcgaaatttgtatatataatagtgtatgcgctgcgttatcttcgttctaaaaatctgtattgtttcgttgctggtgctatatttgttggtgtattatatatatgcacttaactgttatctctattctattaagaacataatatagacacatgatgct

SEQ ID NO: 6191 - DNA, 1167 bp, Zea mays
  Predicted polypeptide sequence is orthologous to G1140
cctctcctctccttccgcatcacacaccacgactcccaaccgccggttggctttgctgctccgagctcttcctcttccacacccgccctctctcttgggtcggcggccgagtgtctgcgtcgtccacggagatcagggatcggcggcggggtatggcgagggagcgacgggagataaagaggatagagagcgcggcggcgcggcaggtcacgttctccaagcgccgccgcggcctcttcaagaaggctgaggagctctccgtgctgtgcgatgccgacgtcgcgctcatcgtcttctcctccacgggaaagctctcccagttcgccagctccagtatgaatgagatcattgacaagtacagcacacattctaaaaacctggggaaagcagaacagccttcacttgacttgaacttagaacatagcaaatatgcaaatttgaatgagcaacttgtggaagcaagccttcgactcaggcagatgagaggtgaagaacttgagggattgagtgttgaagaactccagcaattggagaagaatctggaatctggtctgcatagggtgcttcaaacaaaggatcaacaattcttggaacagatcagcgacctcgaacaaaagagtacacaactggcagaggagaacaggcaactgaggaatcaagtatcccacatacccccagttggcaagcaatcagttgctgatactgaaaatgttatcgctgaagatgggcaatcctctgaatcagtcatgactgcgttgcattctgggagttcacaggataatgatgatggttcggatgtctctctaaaattagggctgccttgtgttgcatggaagtgaaaaaacaagatggtctgtgttgatctgggtggagctgcggcttcagcagataggcacttgtgttattgtcttatggacgacccccgactactgcaataatcttgcatcggaagcgagatcagttaacctgatttgtcatccttgtggcttcatgatgcgatgttgcgcttgtaccgtttgctaggatgttaactggactagaatcgtgtctacttttgtactgctcgtgaatcctatctactttgtgctatccaaagttatgacctaccacttgcatcggcatggcgcgccggccgtaagctgtgctcaagcatgcatgcttcgtgtt

SEQ ID NO: 6192 - DNA, 754 bp, Zea mays
  misc_feature (24)..(24): n is a, c, g, or t
  Predicted polypeptide sequence is orthologous to G1140
ttttttataacagaaacaccaccnttcgggttttaccggctcatatattaccagtataaatacaatccgggtactcctacaataccactgctactatctttaataaaaagctgtacaggaggggagtatctgcatgctaactactcagtgaccattagcgcctgctatctaaccgcattttgcttcgttttctgtcggttaaacgcaggaatcagtgtccaaaggcggactaatcaaggttgtcccggttgcagtagcagcaactatgtgaaattgtgagtggaacttcagagagatgggcatgaagttgaagggacatctgagaaataagctctggcctgcatgaaagcggctactcgtctcaggaaaggtttttgctatagcgcctgacttgccatcttttcttggcagatccttgacagtgcttctacatggaagttttgtagttcttcaagaactttaacatctaggcccctgaggtcctcaccctttagtttggacacgatgctttccaattccttgcagcgcattctttcaaaattgtatgcagctcttgcttcttcaaaagtactgaggccatcccagcacccattatccgatgcttgcatttcacttaccagtctaccactatcagtcttggatgagtgaaagccgttttgctttgcttttaaattcaaatacatcctgttgagagttttctttctttatcttcaaaagaagggccccccatgcttgccagttcatttttcaactc

SEQ ID NO: 6193 - DNA, 893 bp, Zea mays
  Predicted polypeptide sequence is orthologous to G1140
caaaagagtactctctccctcctaccacacacagcctccggactgctccggacgcgcgcctcagatctactccaacacctccgcagcggcggcgcccgcgggtggaggagcaggagaggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaatccttgacgagatcagcggtctggaaagaaagagaacgcagctgatcgaggagaactcaaggctgaaggagcaagtgacacggatgtcgaggatggagacgcagcttggcgccgatccagagttcgtgtacgaggaagggcagtcgtctgaatccgtgacgaacacgtcctatccgcgcccgtccaccgacaccgacgactgctccgacacatcgctcaggctcgggctaccactcttcagctccaagtgacggagatttgacatgtccggtagcggagcggtgccgattgcttgcccttctccactctagatagg

SEQ ID NO: 6194 - DNA, 657 bp, Zea mays
  Predicted polypeptide sequence is orthologous to G1146
tttttttttttttttttttcggaaagacttggatcgttatatgaaataaatgcaactcaaacgtgagcgtgttaatgcagccttgttcaggcttgttataataaataatgcagcagccttgttcagtcttcaaaagagcaaagccttgttcaggaaaggggttcccgtgggcaaggactagcagtagaacatgagccttctcagttcacccttgatctccggaagcggcttcggaccagcagcagcagcagcagcagagggagctgatgaaccataagagccgacacttgtcgccgcatcagagtcttggttgacgtaaaagcgggcgcggaacgctaacttgtgggcgtagtatgctgggggagcgattgacacagagcgagtgcagcttgaatacaagaagcataggttatatgtgagagactgcagcgcgtctgcagtgaagttgttgtcgtctctcaggacatgggaatgcgcaggacggctagttcccttgatcccagcatgggtgcgcaggaagaaatcaaattctgttgggtggcagatatccttgtcaacaacagtgccaggtagaatatttccactcttgtccgcccattggcgatcatttgggttgtttgggaagagccttgtgtggtgcctcttctgcaccactag

SEQ ID NO: 6195 - DNA, 2419 bp, Zea mays
  misc_feature (284)..(289): n is a, c, g, or t
  misc_feature (380)..(385): n is a, c, g, or t
  misc_feature (839)..(843): n is a, c, g, or t
  misc_feature (995)..(999): n is a, c, g, or t
  misc_feature (1337)..(1341): n is a, c, g, or t
  misc_feature (1381)..(1385): n is a, c, g, or t
  misc_feature (1587)..(1591): n is a, c, g, or t
  misc_feature (2183)..(2188): n is a, c, g, or t
  misc_feature (2344)..(2349): n is a, c, g, or t
  Predicted polypeptide sequence is orthologous to G1146
gcacgagatcaaatttgctgctcgcgctgatctccaccatttggctatgtttcttgctgggaggcagccagatgcccctcaagaggctcttcaagtacttgacatcgtgctacgtgaaatgcctactgccaagtattgtcctgttggtagatcattttattctcccaagttagggagacctcagcaacttggtgaaggtttggaaacttggcgtggtttctaccaaagcataaggcccacacagatgggtctttctctgaatattgatatgtcctctactgcannnnnngaggccctccctgtaattgattttgtttctcagcttcttaatagagatatctcagttagaccattgtctgattctgatcgcgtgaagattnnnnnngccctacgaggtgtgaaagtggaggtcacacaccgtggaaacatgcgtaggaaatatcggatatctggccttactccacaagcaacaagggagttatcattccctattgatgatcgtggtactgttaagactgtggtgcaatacttcctggagacttatggtttcagtattcagcacaccactttaccttgtttgcaagtgggcaatcagcaaagaccaaattatctgcctatggaggtctgtaagatagttgaggggcagcgctactcaaaacgacttaatgataaacagatcactgctctactgaaggtgacttgccaacgtccccaagcgcgtgagaaggacatcttggagactgtgtatcacaatgcctactccaaggatccttatgcccaggaatttggtataacgattgatgagcgtcttgcatcggttgaagctcgtgttctgcctnnnnnaaggctgaaataccatgatagtggcagagaaagggatgtattgccaaaagttggccagtggaacatgatgaataagaaaatggtcaatggtggtagagttagcagctgggcatgcattaacttctcacggaatgtgcaagatggtgctgccnnnnntttctgtcatgaattggctttgatgtgccaagtatcaggaatggattttgtacttgaacctgtgctgtcaccttgctatgcaaggcctgaacttgttgaaagagcactaaagggacgctatcaagatgcgatgaacatactcgggcctcagggccgagaactcgacttgctgattgttatactgcctgacaataatggttctctttacggggatgtcaaaaggatctgtgagactaatcttggattggtctcccaatgctgtctgactaaacatgttttcaaggtgaacaagcagcagtatcttgcaaatgttgccctgaaaataaatgtgaaggttnnnnnaaggaatactgtgcttgttgatgctttggcaaggagaatnnnnnttgtcagtgacatagcgactattatctttggtgctgatgtgacccatccccatcctggggaagattctagtccttccattgcagctgtggttgcttctcaagactggcctgaggttacaaagtatgcaggattggtgagtgctcaagcccatcgtcaagaattgatacaggatcttttcaaggtatggcaagatcccgaaannnnnactgtctctggtggcatgatcagggagcttctcatatctttctggagggcaactggacagaaaccaaagaggatcatattctacagggatggcgtcagtgagggacaattctaccaagttctgttgtatgaacttgatgccattagaaaggcctgtgcgtcattggagtctgactaccagcctccagttacttttgtcgtggtccagaagcgtcatcacaccaggttgtttgctaataatcacaatgataatcgtgctgtcgataaaagcgggaacatactgcctggcaccgtggtggactcgaagatctgccatccaactgagtttgatttctacctgtgcagccatgctggcattcagggaacaagccgccctgcccattaccatgttctgtgggatgagaacaactttacggctgatgggttgcaaactctcaccaacaacttgtgttacacgtatgctaggtgcacacgctcagtatcgattgttcctcctgcatactatgctcacctggcagccttccgagctcggttctacatggagccagatacgagtgacagtggatctatggcaagccgtggccctccaccannnnnncgcaacaccaaggctgctggtgttgggaatgttgctgtgaggccattacctgccctcaaggaaaacgtgaagcgggtcatgttctactgctaagactgatgctgttaaggcagagctaccttttattattacagtatatcgtgaagactagagtannnnnnccatgtacttgatgatgctgagctaccttttattatgtcgtacgatatatatgcgtggtactggttacag

SEQ ID NO: 6196 - DNA, 1054 bp, Zea mays
  misc_feature (80)..(109): n is a, c, g, or t
  misc_feature (140)..(144): n is a, c, g, or t
  misc_feature (495)..(499): n is a, c, g, or t
  Predicted polypeptide sequence is orthologous to G1146
ccaacgaactgagaggctcactttatatataatgcatcaagtcaaagcagaaaatttcaaaagcaatgaccacaaggttnnnnnnnnnnnnnnnnnnnnnnnnnnnnnncacttgccttggacttctacgaagtccaccnnnnntaataggcattttctgacgagttttggatagaatactcgccaggcccaaaatatgatttggaggtcgtgcggcccgcccttcagggttacttcaccatagttacaccaacccagaattactcgattcatttcatggcaacaaaagtgtcgatgacggtccttcctgcaaaggccaccttcagcagtagaacatgaactgcttgacactctccatcactttcggcagctgcttcaccggaacagcgccatctttcatgcgagagctcgccactgaagacgacccctggtcggagaggtcatcgtccatgtagtggcgcgcacggaaggccgccaggtgtgcatagtacgccnnnnnaactatagagactgatcgagtgcatcgcgcatacgtgtagcacagtttgtaggtcaacgtttgcagtgcatcggcagtgaatttgttttcgtcaaacagaacatggtagtgtgctggccggctcgttccctgtatgccagagtggctacaaaggtagaagtcgaattcacttggatggcatatcttcgtgtcaacaacagttcctggcaaaatgtttccacttcgatccatctgtccatgtgcatgatgatcttcagggaaaagccgtgtgtgatggcgcttttgcaccacaatgaatgtaatgggaggaaggtagccctcttccaagctggcacacgcctgagtacaaacataaacgtaactcaattaggagattgcaacaaaagagaataatattgtgaagaaaaccacctttcgaattgcatccacttcataaagcaagacctggctaaactgcccctcactgacaccatctcgatagaaaattatcctgcttggtttgcggctcccgtttgccttatagaatgacacgagtagttccctgatcattgtcgt

SEQ ID NO: 6197 - DNA, 2635 bp, Zea mays
  misc_feature (158)..(162): n is a, c, g, or t
  misc_feature (363)..(367): n is a, c, g, or t
  misc_feature (628)..(648): n is a, c, g, or t
  misc_feature (1126)..(1148): n is a, c, g, or t
  misc_feature (1176)..(1199): n is a, c, g, or t
  misc_feature (1398)..(1403): n is a, c, g, or t
  misc_feature (1715)..(1775): n is a, c, g, or t
  misc_feature (2457)..(2466): n is a, c, g, or t
  misc_feature (2510)..(2514): n is a, c, g, or t
  misc_feature (2537)..(2542): n is a, c, g, or t
  Predicted polypeptide sequence is orthologous to G1146
ccgagccgacgcccaaggccgcgtacagagagatcatgacgaagctgttgtccgagaaccagcacacggatttcgacggccgcttctccgtgtacgatgatggtgactcgctcttcacagccggtgcgctgccgttcgacaccaaggagttcgaggtnnnnntctctgcaggcggcgacgaaaagatggacaggaagtacaaggtgatgatcaaccatgccgcaacgattagtctgctacagctgaggatgctgttagcgggctatcccacggacatccccgcgcaggcgctcgtggtcctcgacaccgtgctgcgtgacgtcttcaacgaacgcaatgacatggaatgcgtcgtgattgacnnnnnggatcgcacactgggtgttgacgcatggaaggggctctatctgagcatcaggccaacacaaaactgcttgtctctgattgcagacgtgtcctcatctgtattcgttcaacccctgctattgattgaattcgttcagaagatcctaaagatagatgccgtggataggaacttgactaaacctgagtatgacaagctcttgaaggccctcaggggtgtgaggattcaagtcacacacagagataatagacgccgagtatggtnnnnnnnnnnnnnnnnnnnnngccaactctctacgtacagagttgctggcttgtcagtgaatcctactaatgatttgagttttgaatcaaaggttggagtcacaacgactgtgattgattacttcagagaaatatacggcctggaactgaaatacaaatatctcccatgcgtcaatgctggcagcgagcaggatccaatctattttcctatagaggtttgcaagatagctcccaagcagtgttaccagaagaagctggaaggtagtcagttttctactccaaggaagtcagcctggatccatcctgaagccgagcaatcctgtcctcagattgttgagcagaggcagtacaaacaaaccaaacgtgcaaatgaatttgacttagaatttgatggcaatcttacaacagttgctgctagagttctgctgcctccaaatcttaagtatgatgattctgtatcacagaaaacatggtttccactggatgggtactggaatannnnnnnnnnnnnnnnnnnnnnnggtgccaagatcagaaactgggcatgtnnnnnnnnnnnnnnnnnnnnnnnnaaggaagatattaagaagttttgctttaagctggctgaaatgtctcgtattactggactggactttgccgatttgaagctcccaatattcactgcacgtccagatcgagttgaagatggtattcgtaggtgctatcaggaagcgaagaacaagctaagggatcagaagattgatttactgcttgctatactaccagatnnnnnngacagtttatatggaaatattaaaaggatctgtgagacagatattggtcttgtgtcacagtgttgtcgaaggtcaagagtcttagtgaataataatcagatattggcaaatattgctattaagatcaatgccaaggttggaggaagaatctcagtattcgatgacgtacagaagagtttaccggttgtttcaaataagccaacaattatatttggtgctcatgtttctcacccttctgttgtagatggttctactggcccttctattgcttctgtcgttgcatcccaagactggcatgaggtgtctaagtannnnnnnnnnnnnnnnnnnnnnnnnnnnnnnnnnnnnnnnnnnnnnnnnnnnnnnnnnnnnaaggagctccttcatgcatttgcaaacgagtccaaggagaagctccagcagctgatattctacagggatggcataagtgagggtcaattcaatcgaattttggagaaagaaatcccagcgatagaaaaggcttggaacgcactgtatgacaatgagaagccacaaatcaccttcgttgttgtgcagaagaggcataaactgaggctgttccccgtggacgacaactataagatccgttctgctaagaagaaaattgttgagcctggcacagtggttgatagtgagatctgtcacccagcagaatttgatttcttcctttgcagccaatctggtggtatcaaaggcccaaggcgtcctgtgaggtaccttgtactgcgagatgataacaacttcacggcagatgaactgcaggctctcacaaataacctgtgctacacttattcaggcggcaatcgttcgttgtcggtcgctcctcccgcatactacgcccaaaagctcgcacatcgggcccgcgtctacctcgccaaaggctcggacaataatgcagcagctgctaatggtggtcggaagcaaattccagagataaagaatgagctgaaggggtccatgttctactgctagtcctttgcctgctgaacggacgatgaattgttctatagtgaaagacttgagtgtgctctgnnnnnnnnnnctgaatctggagaaggatggcatctgcaatagtcgccgtgttcnnnnnagtacactagaataaatggatgnnnnnngtggacgcccatgttgaactagttttcttttccagtaagtacttcagaatgagtgagataaatatatcattcagcgtctggtggtctggcatt

SEQ ID NO: 6198 - DNA, 3777 bp, Zea mays
  misc_feature (54)..(173): n is a, c, g, or t
  misc_feature (201)..(231): n is a, c, g, or t
  misc_feature (258)..(353): n is a, c, g, or t
  misc_feature (375)..(379): n is a, c, g, or t
  misc_feature (956)..(962): n is a, c, g, or t
  misc_feature (1420)..(1424): n is a, c, g, or t
  misc_feature (1454)..(1458): n is a, c, g, or t
  misc_feature (1617)..(1622): n is a, c, g, or t
  misc_feature (2512)..(2516): n is a, c, g, or t
  misc_feature (2571)..(2575): n is a, c, g, or t
  misc_feature (2615)..(2619): n is a, c, g, or t
  misc_feature (3315)..(3319): n is a, c, g, or t
  misc_feature (3413)..(3418): n is a, c, g, or t
  Predicted polypeptide sequence is orthologous to G1146
ctgctttctccagtgagccgcacccgcactaccgctgacgctaattaaccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtgccattggtggagctggtaactnnnnnnnnnnnnnnnnnnnnnnnnnnnnnnncagccgtctgccgagcctgctcagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgagcgaactcaacaacctnnnnnaggacgtggctgggtgcctcaacagggtggccatggtggtgggcaacaccagggtcgtgatcgacattatcagggacgtggaggaccagggccacatcaccttggtagtggggcacctgagtatcacccgcgtgaataccagggacgtggtggtgaatatcagggacatggtggtgagtaccagggacggggtggtgactaccagggacgtggtggtggccgctccagaggtggaatgccacagccatactatggtgggcataggggaggtaatgttggacgcaatgttcctccaggtccgtccaggacagttcccgagctgcaccaagccccatatgtccagtatccagccccggtggtttcgccctccccatcgggacctggctcatcctcacagcctatggcagaggtgagctctggacaagtccagcaacagtttcagcaacttgccgatcgtggtcagagttccacgagccaagaaattcaagtggcaccagcatcaagcaaatcggttcgattcccgttacggcccggcaagggcacttatggggacaggtgcattgtgaaggcaaatcannnnnnngctgagcttcctgacaaagaccttcaccaatatgatgtatctataacacctgaggttacttcacgtggcgtcaatcgtgctgtcatgggtgagcttgtaacaatatatagacaatcccatttgggtgggcgtctacctgcatacgatggaagaaagagcctgtatactgctggaccattgccatttacttctatggcatttgaaattaccttgcaagatgaggaagatagtcttggcggtcgccaaggtggacataggcgtgagagagtatttagggtggtgatcaaatttgcagcccgtgctgatctccaccatctggctatgtttctagctggaaggcaagcagatgcccctcaggaagctcttcaagtgcttgacattgtactacgtgaattgcctaccgcgaggtattctcctgtcggtaggtcattttactctcccaacttagggagacgtcnnnnncttggtgagggattggaaagttggcgtggnnnnnaccaaagcataaggccgacacagatgggcctttcactgaatattgatatgtcctctactgcatttatcgagcctctccctgtgatcgattttgttgctcagcttcttaacagagatatctcagttaggccattgtctgattctgatcgcgtgaagattnnnnnngccctaagaggtgtgaaggttgaggtgactcacaggggaaacatgcgcagaaaatatcgcatttctggcctcacctcacaagcaacaagagagctatcattccctgttgatgatcgtggtactgtgaagactgtggtgcaatacttcatggagacttatggttttagtatccagcacaccactttaccatgcttgcaagtgggtaatcaacaaagaccaaattatctgcctatggaggtttgcaagatagttgaaggacagcgttactcaaagcgactcaatgagaaacaaatcactgctctactgaaagtgacctgccagcgccctcaagagcgcgagctggacatcttacagactgtgcatcacaatgcatactatgaagacccctatgcactggaatttggtataagaattgatgaacgtcttgctgcagttgaagctcgtgttctgccaccaccaagacttaaataccatgatagtggccgagagaaggatgttttgcccagagttggccaatggaacatgatgaataagaaaatggttaatggtggcagagtgagcaactgggcatgtattaacttctctcggaatgtgcaagatagtgccgctaggggtttctctcatgagttggcagtcatgtgccaaatatcaggaatggattttgctcttgagcctgtgctgcctccagtgactgcaaggccagaacatgttgagagagcgttaaaggcacgttatcaagatgcaatgaacatactgaggccacagggaagggaacttgatctgctgatcgtaatactgcctgacaacaatggttctctttatggggatctcaaaaggatctgtgagactgaactcggattggtctcccagtgttgtctgactaaacatgnnnnnaagatgagcaagcagtaccttgcaaatgttgcactcaaaataaatgttaaggttnnnnnaaggaatactgtacttttagatgctttgtcaaggagaatnnnnnttgtcagtgacagaccgaccataatatttggtgctgatgttacccatccacatcctggagaagattccagtccttccattgcagccgttgttgcttcgcaagactggcccgaggtcacgaaatacgctggactagtgagtgcgcaagcccatcgccaggagctgatacaggatcttttcaaagtatggcaggacccgcagagaaggacggtaactggcggcatgataaaggaacttctcatttctttcaagagggcaactggacagaagccccagaggatcatattctacagggatggtgtcagtgagggacagttctatcaagtattgctgtacgaacttgatgccattagaaaggcctgtgcgtccctggagcccaactaccagcctccagttacttttgtcgtggtacagaagcgccatcacactaggctgtttgcgaacaaccacagtgatcagcgcacagtcgatagaagcggaaacatactgcctggcaccgtggtcgattcgaagatttgccatcctactgagtttgacttctacctgtgtagccatgctggcattcagggaacgagccgccctgctcactaccatgtcctgtgggacgagaacaagttcacagctgacgagctgcagaccctgacgaacaacctgtgctacacgtacgctaggtgcacccgctccgtgtccatcgtgnnnnnggcgtactacgctcatctggcagccttccgagctcgcttctacatggagccagacacctctgacagcgggtcactggccagcggtgcccgtggnnnnnnacccggtgcggcacgcagcagcacgagaggggccgggagtgtcgaggtcaggcccctacctgctctcaaggagaacgtgaagcgtgtcatgttttactgctgagacgctggtgggctgccttcgccaaggaaaatgccctggagcattcccatgtacccgcactgtttcggtgatacagtactatctaacgccgattttgcgcgttaagacttccagtgatctgggaaatttcttgtacgactgttgtagtgttgtgtattcgtaatgtgatgacgcggcagttcttctaggagcttagtgccgtgtaaaatatctgttgtaagttgtaacctgtcaccctctagtgttatgtcatgat

SEQ ID NO: 6199 - DNA, 649 bp, Zea mays
  Predicted polypeptide sequence is orthologous to G1146
gagattgtactccagcgtgccgttaatgaattgattgaattcaacctagaaaacaccagaaggtttcttctacacccccttttcatagtacactggaacattggatgcatgcatctgaaccaacaagaactattatacaggcatttccgagtattttacagcgatcgctaacagattgattgttcatgatccaaatacgcatcccgtttcctcttcgttcctggagaaagctaatctaatccccctactgaaccctaccaagttagctacagcatgtgaatggttgttaaagtggtcacctcgtcaggagtagaacatcacccttttcaccttctccttcacagcaggcaggggcttcaccaagcctccgttcgtgccattggagctcttcgacgtctggttctccgacatctctggttccatgtagaaccgcgcccggaatgctgccaggtgtgcgtagtatgcaggagggacaacagaaaccgagcgtgtgcaccgggcataactgcatcaataacatgtatatcaagctaataaaattctcaaaaaaaaaaattaaaagtgcaaaggacaaatataaaatatacaaagaagtgcattacgtgtagcaaaggttgtttgtcagtgtttgcatttcgcccaacacaat

SEQ ID NO: 6200 - DNA, 1084 bp, Zea mays
  Predicted polypeptide sequence is orthologous to G1146
gcgggcacgcggttaaagtgaaggatccacaaaagggatttgttccctacctaatgatcaggcatgctaaacatcttagttgtctaacttagttcttcagataaatgatttgtcctttttttaaatgtcatatttttgcttcagggaactactcgtgccattctataaggcaaatgggagccgcaaaccaaataggaaaattttctatgggttcgtaattgtctgtttgaatgaattttgttgttgtctaaacttaaatctcttttccttgcatgtaaagaaaaagacctgccagttttctttatgttagtacatatttcaacagctaaacagctacaccttgtatacttggagaagaatcctggagttactttacttgtttccttgatttgcagagacatgccagtgaggagcagtttagccggttcttgcattatgaagtggatgcaattagaaaggcgtgtgccagcttggaagagggctaccttcctctagttacattcatagtggtgcaaaagcgccatcacacactgttttgtcctgaagatcatcgttcacacagacaaccagatcgacgtggaaatattttgcaaggatgaactagatgcaaaacctgaagagctggaaggagaagagttggaatctaagcttctagagcctgttgcagctctttcggtgcatccagtgcatgtcccaggaaacaagcaactagcttgccctacttcacagaaagttatagctaaatacgatgagctggctgcactacaagctgaaatggcattgtgatcaggattaacgcatggaccgaggaagcgcaatgacaagcctaatagcctgcaactgatgaaaggaatggtctctactacacgtattattgtccatcccatctttgtttaatggtcgtagctgctttatacaattattcctacctatgctagactgtgagccattgtatatcaatgtattttatcatattgatttcgtagcaacgtacgagcatatacctagtatatttataaacaatgtgtagcacttgccacatttaaacagctaatcttaaaaagacaaaaaaaaaaaaaaaaaa

SEQ ID NO: 6201 - DNA, 766 bp, Zea mays
  Predicted polypeptide sequence is orthologous to G1146
tttttttttttttttttttgatatgcaaagctccattgaaatagatataaatgtcgaaacaacaatggcgcaccaccatagagccattcagtcagagccctcaatattgagacaaccgaaatcgaacaattctttgatggaattttgtacatgttggtttttttggataagatcatttaccaatgttcaatgagaggcccatttgagttggacggaagcttgggtaatatcctctccagcactctagcccaccgcaatgtcctcatcaccaaaacttcttggagaaggaccaaaaaagagttacataattgagagaaggtgactcaagacaatatccagtgcttggattgcgtcatatggcgtgtcccttcgttgacaattgatcaattgatttttcggccctccttccccaacttgacaacgaactccaatgatttgaacgacatctcgcttgcagtgtacatgctcttgcttcaaatcatatgcacatgtgtcttgtgggcgcgagatgtcgcattgtgtggcttgacaagctctgagagcagcaccctgttggtccttcttccttttgtttcaggatttattaaaacctggtaaatgtgtatgggtcgagtcaaatatgtatggagcacaaaagaaaaacttccaaccagacattaagagataaacatctagtatttcttgcatacacaataaacataaatcactgatttcaacaaataaaacttaggacataatcgagcaagataacaaacaaatggatatc

SEQ ID NO: 6202 - DNA, 774 bp, Zea mays
  Predicted polypeptide sequence is orthologous to G1146
ttcgcgttctgcgcaagtgcttgctcaacaaggtctaacagcgaaacaactagagttactcatcataattctgcctgatatgagtggtttttatggaagaataaaacgagtttgtgaaactgagcttggtttaatcactcagtgctgcgcacctaagaatgtaaggaaaggagggaatcagtaccttgagaatctttccttgaaaatcaacgtaaaggttggtggccggaacacaatgcttgaagatgctttcaaccggagaataccgcttctgacagattgtccgacaatagtctttggagctgatgttacgcacccatctgctggggaaagttcatctccatctattgcagcagtggttgcatcaatggattggccacaagttacaaagtacaaatgcttggtgtcttcacaaggtcaaagggttgaaattataaatgacctttatacagaagtggaagatccacagaagggcattgttaaaggtggaatgattagagatttgcttatgtcattcttcaagtcaactggccaaaagccttcgaggattatattctatcgtgatggtgttagtgaggggcagttcagccaagtcttgctttatgaaatagatgccattcggaaggcatgtgcaagtttacaggataattatctcccaagggtcacatttgttgttgtgcaaaagcggcatcatacccgcctgtttcctgaaaatcatcgttcacgagatcaaacagacaggagtggaaacatcctgcctggaaactgtgttga

SEQ ID NO: 6203 - DNA, 704 bp, Zea mays
  Predicted polypeptide sequence is orthologous to G1146
cacactcctgtcgtaccacaaatcagaactaatgcgtcaataggcaccgtagttgataataatatctgccacccaacagaatttgatttcttcgtgtgcatccatgctagggccaagggaacaagccgtcctacgcattaccatgtgctacgagatgacaacaagttcaccgcagatgctctgcagtctctaacatataacttgtgctacattgcgcagatcatccagggcggacctataagatgtcaagtgtgtacgccccaacaacccacagatgcggctcgacgctctccatcgtctggtataccaggataggcttcaagagaggctaagaaaatctaagtgtttaggacttgaagaggctgcaaagaacaaaggttttgaccttggtaacgatgcactcattgcaaactgttgaggaggaataactatttggcagatgcagacatgcagtagcttcacacttggttcatcggacaacagttctttgaactaagtagagtggaaggaaactgaacctaacacccatccatgacccagcttacatataggtggttttactgggttctgcatcagatcctcgcatacaaggtgacttcacaaatttagccaataagttgtatagccgagtgaagctatgtttgacttatgctacgacgagccaccatcacatttgcaacatgctaaagagcaaaatgacacca

SEQ ID NO: 6204 - DNA, 1714 bp, Zea mays
  Predicted polypeptide sequence is orthologous to G1198, G1806, G558
gcagaaactctttgcttccgcctggctcgcgatgcttgtttgggtgcgcgggctgcggcgaggtgaggcgacggcggcgccgggcggttgcatggtggccgatggagagtagacggggagggtcgtcggcggcggcggcggaagatgcgggcggggcgatgccgagctttgggccaacgcagcacgccattcgcgcagatgtgaacagcatgcaaccttctcgagttactgactttggggcactggcacagtctgctggattccgaatagaagatcttgctaaccttaatgcaaatgctttgttcaatctgaagccaaattctcatacgattgacaacagtcctctccagtttggaaattacggaaagtctatttcttctcatataaatactacagaagcaacaacagctgcaacaagaattgaccctcagctgtcagcacagcaaacaggagcacaaccaattctggtggcgttaccaactggtaacatggagaattggggagagtcagctatggctgatagccctatgactgacacatctacagatccagacactgatgagaggaaccagatgtttgaacaaggacttgttgctgtccccacagcatctgattctagtgacaaatcaagggacaaactagatcagaagacacttcggcgtcttgcccaaaatcgtgaagctgccaggaaaagccgtttacgaaaaaaggcatacatccaaaaccttgagagtagcagactgaaacttactcagttagagcaagagcttcagcgggctcgtcaacagggtatttttatttcgacatcaggagatcaacctcaatcaacaagtggaaatggagctttggcatttgacatggagtatgcacgctggttggaggagcacaataaacatgtaaatgagttgagggctgcagtcaatgcacatgctggtgataatgatcttcgttgtattgttgatagcattatggtacattacgacgaaattttcaagctcaagggtgtggcagctaaagcagatgtttttcatgtgctgtctgggatgtggaagacccctgctgagagatgtttcatgtggttaggtggcttccggtcatctgagcttcttaagttactggcaggtcacctagagcctcttactgatcagcagcttgttggtatatccaacctgcagcagtcctcccaacaagctgaagatgctctttctcaagggatggaagcattgcaacagtcgcttgcagaaactctagcatctggatccttgggccctgctggaccttctggcaatgttgcaaattacatgggacaaatggcgatggctatgggaaaacttggcactcttgagaactttctacgacaggctgataatctacggctgcaaacacttcaacaaatgcaacgcatcttaactacccgacaatcagcacgagccctactcgcaataagtgactacttctctcggctgcgtgctttgagttctctttggcttgcccgtccaagggaataaattcaattaattcataactaggataatttttttgtactgtttctagtatggccattagtttcttcagaacgctcatgtgtcagtgagatatttggatcatattgtaggccatcatggtttactggacaactttgtaacaattttggagagaaaaaactgagttgtaaatacatctggaataatctaagatcttatgaaggggaaaa

SEQ ID NO: 6205 - DNA, 1163 bp, Zea mays
  Predicted polypeptide sequence is orthologous to G1198, G1806, G558
gagaactggggagagtcagctatggctggtagccctatgactgacacatctacagatccagacactgatgagaggaaccagatgtttgaacaaggacttgttgctgtccccacagcttctgattctagtgacaaatcaagggacaaactagatcagaagacacttcggcgtcttgcccaaaatcgtgaagctgcccggaaaagccgtttacgaaagaaggcatacatccaaaaccttgagagtagcagattgaaacttactcagttagagcaagagcttcaccagactcgtcaacagggtatttttatttctacatcaggagatcaacctcaatcaacaagcggaaatggagctttggcatttgacatggagtatgcacgctggttggaagagcacaacaaacatgtaaatgagttgaggcttgcagtcaatgcacatgccggtgataatgatctccgtggtattgttggtagtgttatggcacactacgatgaatttttcaggctcaagggtgtggcagctagatcagatgtttttcatgtgctgtctgggatgtggaagacccctgctgagagatgtttcatgtggttaggtggcttccgatcatctgaggttcttaagttactggcaggtcacctagagcctcttactgatcagcagcttgttggtatatccaacctgcagcagtcctcccaacaagctgaagatgctctttctcaagggatggaagcattacaacagtcgcttgcagaaactctagcatctggatccctgggccctgctggaccttctggcaatgttgcaaattacatgggacaaatggcgatggctatgggaaaacttggcaccctagagaactttctacgacaggctgataatctacggctgcaaacacttcaacaaatgcaacgcatcttaaccacccgacaatccgcacgagccctacttgcaataagcgactacttctctcggctgcgtgctttgagttctctttggcttgcccgtccaagggaataaattcaattaactcataaataggattttttttgtactgtctctagtatgtcaattagtttcttcacattgctcatgtgttgatgggatatttggatctaagatcttatgaatggatgacatgtatgtgttcaagtgaaaaaaaaaaa

SEQ ID NO: 6206 - DNA, 1864 bp, Zea mays
  Predicted polypeptide sequence is orthologous to G1198, G1806, G558
tggccatggtgcaaggcgaggagagttcttggaggatggagagggcagcgctgcctctcaaccaggcgctcgcgtacggagtccaagcccacgccgccgccgccgctgcaccgccgacctgcttcctggacttccagcctgcggccgcatccgctgcctacttcgggttcggtgagctggaggaggccctcatccacggtggtggcgccgccagcgccggcggcggcgtcgatccgggcgtgatcatcaagaacgacgtcgcgcaggcaaagtcagcggcaggatatctcgcgggcgctggcaccggcaggccccccacgctggagatcttcccttcgtggccaatgaggcaccaacagcagctgcacagtgggaattcgcagtcagtagggagcaccggcactgactcgagctcagctcagaacacaatgtctcagatggagttggtgtccccagcctcctctgcgccgcggcaggaggtcatgatggtgaccactgatgattacagctacaagccaggcctcgccgctgcgcccgctgctgccgccccgccgagctttcagcagcaccacccgctcccgctgcagctgcacggaggagagggagggggagaccatgacaagaggaagcatggatccacaagaaaagatggcaagttggtagatgccaagacggaacggcggctggcgcagaacagagaggctgcgaggaagagcaggctgaggaagaaggcttacgtgcagcagctcgagactagcaggatcaggcttcagcaggtcgagcatgagctccagagagcacggtcacagggcctgttcgttggagggtgcagcgccgccggggacatgagctctggcgccgccatgttcgacatggagtacgcgcggtggcttgacgacgacaccaagcggctggcggagctccgaggcgggctgcaggcgcacctgctggacggcaacctgggactcatcgtggaggagtgcatgcagcactacgacgagctgttccagctcaaggcggcgctcgcgcgctccgacgtcttccacctcctcaccggctcctgggccacccccgccgagcgctgcttcttctggatgggcggcttccgcccgtccgagctgctcaagatcctgataccgcagctggacccgctgacggagcagcagctgctggggatctgcaatctgcagcagtcgtcggagcaagcggaggaagctctcgcccagggcctgcaccagctgcaccagtccctggccgacacagtcgccgcgggcacgctcaacgacggcgccgccgcccccaactacatgaacatcatggccgtcgcacttgagaagctcgccagcctcgaaaatttctatcaacaggccgacaatctaaggcaccagacgttgcatcagatgcgccggatcctgaccactcggcaggctgcgcggtgcttcctctccattggggagtactacagccgcctcagagctctcagcaacctctgggcttcccgtccccgcgacaacttcatcgggacagagagcctcagccccacagcaacggaactgcaagccctgcaccaccagcagcagaaccagttcgccggattttgaggcctcacctggtgagggagggtgtaaaactttggccgcgagggtggtgttacaaagattagaggttttgagagggagatgcattgtaatgttctatcattaaagtactgagaaagcaacatcactaggcgaaaagggcggggagaaggaattgctgtagtgcgatgttgggtggctcacctgttcatatggctcttgaactgattgaagggttagcaccgcagaatttttgtgcgtgtcaggagagaacaaatcagttacac

SEQ ID NO: 6207 - DNA, 497 bp, Zea mays
  Predicted polypeptide sequence is orthologous to G1198, G1806, G558
tacagccgccttagagctctcagcaacctctgggcttcccgtcccggcgacaccttcatcaggtcagagagcctcagccccacagcaacggaactgcaagccctgcaccaccagcggcagaatcagttcagcggattttgaggccttacctggtggtgcggtggtgtcggagggtgtaaactttggcggcgaaggtgatgttacaaagattagaggttttgagagagagatgcattgtaatgttctatcattaaagtactaagaaagcaatatcactaggcgaaaagggcggggggaaaggaattgctgtggtgcgatgttgggtggctgacctgttcatatggctcttgaactgattgaagggttagccccgcagaattttttgcgggtagcagcagaaaacaaagcagtggcagaagattctggctgctcacttgccagagagcactaattgcagttagagtgacagagtaaccattaaaaaaaaaaaaaaaaaa

SEQ ID NO: 6208 - DNA, 952 bp, Zea mays
  misc_feature (778)..(778): n is a, c, g, or t
  misc_feature (872)..(872): n is a, c, g, or t
  Predicted polypeptide sequence is orthologous to G1198, G1806, G558
ggggctaccccctacattaatcaaaaagtacacaaatggacagaataatcattctcctaacagcaaaatgagaaaatgggatgcaacaataccaacatatactacagtaaccaaaggaagattcttgttactctcttcccattccgccccccatgtcccaggaagttacattaggactaaatctctaaccagtacaaacaacagaaaccctgatcctgccctctctaattattattgcattgctaacacacccataaatcaccataacttacaggattatattgacctacttgtacacccacctgagtacaatttggaccaagcagcggccaaaagtaattgtacaacaaaaacagtaccaccaaagatctgtgatgcatcgctgcgaacgacgcagcagcaccgtaaggcagagggaactcaaaatactgacggcccttcgttattcacgtggcctagcaagccacagagaacttaaagcgcgcaatcgtgaaaaatagtcgtggattgcaagaagagcacgagaagcctgtcggatcgttaggatacgttgcatttgatgcaacgtctgctgtcgcaggttgtcggcttggcgaagaaaattctctagcgtcccgagtttgcccatggccatggccatctgacccatgtagtttgccacatttcctgaagaacctgctggaccgagagatccagccaaagtctctgccaaagattgctgcagtgcttccatgccctgtgacaacgcatcctctgcttgttgggaagattgctggangttggtcaaacccagcatttgctgctcagttagaggctcgaggtgattcgctaggagctttaaagctcagatggacgaaaaccccaagccatangaagcacctttcagcaggtgtcttccacatgcctgaaagttatgaaaaacatcagcctttgcagcacacctttgacttga

SEQ ID NO: 6209 - DNA, 764 bp, Zea mays
  Predicted polypeptide sequence is orthologous to G1198, G1806, G558
gagtggttttggatccttttgctggagatgtgcatagtgtgagcagagagagagagacgggtggaggatggtcagagccttcataagggcttcaggtggggctctgctggagacgacgaccgccgccgccgccgccaccaccatcgccaggcatctgagctcccccaaattctctgctggagcgcccctagcttcccaccgccgacgatgatggcggcctcttccaccatgagcaaggaggaatcagcagcaagctacgacatggcggaatttgaccagtcagcaatcttcctctacctcgaggatggccacgatcaagaacaacaacgacagactctgaacatctttccatcgcagccaatgcatgtggctgagccaattcctaccaagggtgttagcatgggcatggtggcagccagcatcatgctgcccaacggaaactcttcttcacccaagagacaagagcaaggtggtggccagcagaggaatgtcgctgctcctgcaggcgccgctgtgccgttgcctaataacttagccaaggataacaggaatagccttactaagaaggaagaatctagtggtggaaagggtgcagcatctgccgcaggtggtgttcaggagagagtgaaagaccctaagacactgaggaggcttgcacagaatagagaggcagctaggaagagcaggcttatgaagaaggcttatatccagcagttagagacaagtaggatcaggctcagccagcttgaacaacaagttcaagt

SEQ ID NO: 6210 - DNA, 904 bp, Zea mays
  misc_feature (25)..(25): n is a, c, g, or t
  misc_feature (49)..(49): n is a, c, g, or t
  misc_feature (868)..(868): n is a, c, g, or t
  misc_feature (877)..(877): n is a, c, g, or t
  misc_feature (893)..(893): n is a, c, g, or t
  Predicted polypeptide sequence is orthologous to G1198, G1806, G558
actggtcaaaccagttccggtccgnattcccggctcgaccccgcgtccngatattcttgatggcaagaggaacaaaataagcagataaatgagctgaggactgcagtaaatgctcatgcaagtgatagtgacctccgtcttatagtcgatgggataatggcacattatgacgagatattcaggctgaagggcattgctgcaaaggctgatgtgttccatatactttcaggcatgtggaaaacacctgctgaaaggtgcttcttgtggcttgggggtttccgttcgtctgagcttctaaagctccttgtgaatcagcttgagcctctaactgagcagcaattgatggggctatccaatctgcagcaatcttctcagcaggctgaggatgcattgtcacaaggaatggaagcattgcagcagtccttggcagaaacgctggctgggtcccttggtccatcaggatcttctggaaacgtggcaaactatatgggtcaaatggctatggccatgggaaaacttggcacactcgagaatttccttcgccaggctgacaatctacgacagcagaccttacatcagatgcaacgtatcctgacaatccgacaagctgctcgtgcgcttcttgcaatccatgactacttttcacgtttgcgcgcactgagttctctttggcttgctaggccacgagagtaacatcacccccgttggggtcactcgatgaactgatctgtgaatgtgggactgctggctgcaaactcgcaaagcatttgcagatgactggaggatcagtcctctctgtacaaagtgtattaacatcttctggtctcatattgtgctccagtgttgtacaatttagggaaaagctggnattacttgntagtatcatgaaattngtattggcata

SEQ ID NO: 6211 - DNA, 791 bp, Zea mays
  Predicted polypeptide sequence is orthologous to G1198, G1806, G558
cttttgttccatccccaggcgtacatacggaacctcgagacgagccgcgtgaagctggcgcagctggagcaggagctcataatggccaggcgccagcagcacggcgcgtacggcgtgggaggaggagtcgcaccgccggcggcgcccgtggacccgcgcgtcgctgcgttcgagctggagtacgcgcactgggtggaggagcagagcaggcaggcgacggagctgcgggcggcgctgcagtcgcacgcgccggacgtccagctgcgggtcctcgtcgacgccgcgctggcgcactacggcgcgctgttccaggccaaggcgagggcagcccggtccgacgccttcttcgtgctgtccggcgtgtggcggtcccccgcggagcgcttcttcctctggatcgccggcttccgcccctccgacctgctcaaggtgctggagccgcagctgagcccgctcatggaccaccaggcgtccgaggtgcgcaagctgcagaacacggcgcggcagctggaggacgcgctgtcgcagggcatgagcaagctgcagcagacgctggtcgacaccctcatgaccgtcgacgtctccccggacggcgccgggggcggatacgcggggcagcagatggcctgcgccgtgggcaagctcgccgacctcgtcgacttcgtggacaaggcggaccacctccggcagcagacgttgcggaacatgcacaagatcctgacgccgcggcaggcagcgcgcggcctgctcgcgctcgcggactacggtcagcgcctgcgcgcgctcagctc

SEQ ID NO: 6212 - DNA, 906 bp, Zea mays
  Predicted polypeptide sequence is orthologous to G1198, G1806, G558
ctagcggctagcgcagcgcattatttgccttcccgtcctcgcgccgattccatcccgcgaggctagctgctccgtcgacccgtctgtcgtttactcacgccgccggctcttgactctgccgccttgcctcggccagcatcgccggcagcgccgtctcgccgccggagtacatggcgtcggcgtcgccggcgcagttcgcggcggcgcccctcaggatggggtacgggaggccggcgccggcgccgcccccgcccgtgatgggcatgtggagcagcgagccgttcagggtcgacagcggcagcgcccacgccaccagcgcgtccaccgtcaacaccaagctggaggagacaaggttagaagacgacgcacaggtagcacttgagccggcaagaagtacggagcaggaaaccagtaggccgccagagagggcccagagaaggctcgcgcagaacagagaggctgctcggaagagtcgcctgcggaagaaggcctacatccagcagctagagacaagccgcatgaagctgtcgcagctagagctagagcttcaacgggcgcggcagcagggtgcatatgcgaatagtgggagcatgggagactcggctctcggctacagatgcccgatagatccaggtgtttctgtgttcgagatcgactacagccactgggtggacgagcagaagagacacacggcggagctgacgtcggcgctccaggggcagcagacatcggagctggagctccgcctgctggtggagacgggactcagcaactacgagcacctgttcaagatcaaggcggcggcggccaacgcggacgtgttctacgtcatgtcgggcttgtggaagacccccgccgagaggttctttctctggatcggcgggttccggccgtcggaagtcctca

SEQ ID NO: 6213 - DNA, 828 bp, Zea mays
  Predicted polypeptide sequence is orthologous to G1198, G1806, G558
gacaggtgaacatcaatgtgcattctaatggttcgctgcaaatcaggggcatacagagtgagaattttacagcagttggtaatgatacatcaacaacacttaactacaaagctaagcagcctaagctacatgaacatccccttctatttgggtcatagtatgtgcagatatgtccgaatcaagtctgtcgcagccttgtcaaatctcctgaccattgaaaaccaaattgtgaaaagtattgcagtcaaatagcatgttcttgctattccttgggccgagcaagccagagagagcttagggcacggagacgtgaagagtaatcacttatcacaagtagcgcccgagctgactgtctagtggtcaggatcctttgcatctgttgtagagtctgacgaaggaaattctcaagcgttccaagttttcccatagccatggccatttgacccatgtagtttgccacatttcctgttgatccagaagacgaaagagacccagccaaggtttcggccaatgattgctgaagggcctccattccttgtgaaagagcatcctcagcctgctgtgaagattgctgaaggttgcttatccctgacagctgctgttcggtgagaggttcaagttgtgtcgaaagaagctttaaaacctcagatggtcggaaacctcctagccacaaaaaacacctctccgccggtgtcttccacatgccagataagacgtgaaaaacatctgccttggctgcattgcctttgagcctaaaaatctcatcatagtgtgacatgatcttatcaacaacacttcgaagaacagtatcacttgcatgagcactga

SEQ ID NO: 6214 - DNA, 797 bp, Zea mays
  Predicted polypeptide sequence is orthologous to G1198, G1806, G558
gtcctttgaagctgggctagacgctagagcacatcctgtgctgtgagaaacgtaacctaataaaccttgtgttcagcgatttgacggcctccgttatccgaagaaacaacttcaaccagacatgtggcgagcgaggtgattagctagtgacaagtgttgatctaagggagatcgttttgagcatgctatgatggagctctactccggatatcttgaagatcatttcaacctccacaagctaaggtcatgagaaggctcgcgcagaacagggaggctgctcggaagagtcgcctgcggaaaaaggcctacatccagcagctagagacaagccggatgaagctggcccagctagagctggagcttcaacgggctcgacggcagcagggcgcgtacgcaaatgggagcatgggagacccagctctcggatacacagggtcgatcgatccaggcgtcgccgcgttcgagatcgaatacaggcactgggtggacgagcagaagcggcacacggcggagctgatgtcggcgctccaggggcagcagacgtcggagctggagctccgcttgctggtggagacggggctcagcaactacgagcacctcttcaggatcaaggcgctggccgccaacgcggacgtgttccacgtcatgtcgggcgtgtggaagacccccgccgagaggttcttcctctggatcggcgggttcaggccgtcggaggtcctaaagattctgagcccgcagctggagccgctggcggaggcgcagcgcatgctcgtgggcggcctccagcacacgtcaac

SEQ ID NO: 6215 - DNA, 886 bp, Zea mays
  Predicted polypeptide sequence is orthologous to G1198, G1806, G558
ggaagacatcgctactaccccagccacagtacccattgggtatttatctgctcccttgctgaagctggaatgtgcagctcgatcggttagcgctacgagtcctcgctgaatccagccaaatgatccccttgagcttgccagttagagcacgcacctaatataatgctggccttccgtcagaagtaacagctagctaagagaagcacaagaaaaatctggtagcttgagttctgactcgaactcagagatggcttatgcaagccccgggactgatgatacgtcgacagatctagatactgacgagaagaatcacatgttggagctagggcagcttgtgtcccttacagcttctgatcccggcaacaaagcaaaggacaagctactaggtcaaaaggcactgcgccgtctggcccagaaccgtgaagctgctaggaaaagccgtctaagaaagaaggcatacgttgagcaacttgagaatagcaggctgaaacttagccagctggagcaggaactccagcgtgctcgccaacagggcatcttcattcctactccgggagacgaccagcagccaaactctactagtgaaaaaggtgctttggcgtttgacaaggactacgctggatgggaagacgagcacaggaagcagataagcgagctgagggccgcgctcagcgcacacgccggtgacgacgagctccggcgcatcgtggacggcgtcatggcgcatcaccacgaagcgttcaggctcaagtgcgtggcagccagggccgacgccttccacgtgctgtcggggatgtggaagacccccgtggagaggtgctttatgtggctgggcggatttcgaccgtcagagattctaaagtttctcgcaagccatctggacccc

SEQ ID NO: 6216 - DNA, 906 bp, Zea mays
  Predicted polypeptide sequence is orthologous to G1198, G1806, G558
aacgacgccctcgcttggaggagttggagggcgggacgatgcccagacggagctgagggcgcggaggcggcggtggtactcgctgatggagacgaagcaccgagccgtctggcgggtcgtcaggatccgccgcatctggtgcaaggtctgctgcctcaggctgtccgcctggcggtaaaagctctcgagggtgtcgagcctgtcaagtgccagggccatgagagcggtgtagttggcgacattcgcgccgtcgctgagaggactagcgcccacggcgtccgccagcgactggtgcagctgctgaagcccctgcacgagcgcctcctcggtctgctccgacgaccgttgcagattgtacatccctatcagctgcggctccgcgagagggtcgagctgcggtatcagcatctgcttgaggatttcagaaggacggaaccctcccatccagaggaagcatcgctcggccgtggtcgcccacaggccggtcatcaggtggaacacgtcggatcttgcgagcatggccctcaggtggaacagctcgtcgtagtgccgcatgcagtcctcgacgatggcccccaggttcgcgtcgatgatctggggctgcagcacggcctggagctccgtcatgtgcttggtgtcgtcttctagccaccgggcgtactccatgtcgaaaatcacagcgcctgaactcaagtctccagccgcaccacctcctctcgggaacagaccctgaaacatgcatggtgatggtggtaataacgctattcaaacactagatcagatgttctatatatgtcccctgtctcctgatgcgtctagagaactttgaacctgtgagcgtgctccatgcagctcctgctcgatttgctgaagcctgatccgactcgtctctagctgctgtacgta

SEQ ID NO: 6217 - DNA, 884 bp, Zea mays
  Predicted polypeptide sequence is orthologous to G1198, G1806, G558
ctcgtgtctcgtcttgggtagcgtacgcaccttagctcgcaaccatccatccatccacggggctcgggcgcagcagcctcccccgtcgtcgtcttcgtcgtcgccttgccgccgctctgatccgtgcccgatgcatcgtcagccatctcctcacgccttcagcagcagcggcagctgggcggagcagggcgcgggcgggtaccgccacggcagggacggcgccaccttcctcctccccgagctcctccagcgcagtaataacgccgccctgccccttgtttatccgcctgcctgcgtattttgtttcctttctttttcttcttgttggatttctcatggctgttggttgcacgcgcgcgcatcgcgggggctaatgtgaaggccccaaccccagctccaagtcctccagcgccgccaccttcgtgccgccgctcgccgccgcgcatggaggaggagtagcggccccgtttggcatggcgccgctgggagtggcggcggcggacgaagcccggttctgcatgacgccgtggtcagcggcggcgcacttcgagaactggggcgactccggcatcgtcgtcaccagcccgctcgccgagacggcctccaccgacgtcgacatgggtggaggtggagccatggcgcagagcgtcgacggacatgacaactcattgccggcgtgcaaggtggagcccagggatcacaaggcgcagaggaggcttgcgcaaaaccgcgaggcggcccggaaaagccggatgaggaagaaggcgtacattgtggagctggaaaacagccggtccaagctgtcccatcttgagcaggagcttcaaagggcaaggcagcaggggatgttcatttgcagtggacgctccggagatcatggatgc

SEQ ID NO: 6218 - DNA, 906 bp, Zea mays
  Predicted polypeptide sequence is orthologous to G1226
cgcagctagcttcgcaacaagtaaacgatacctcgcgtcgccaagagcttaccgacaccgagaagcagccacgcgctcgcggagctagagctagagcctagagctagagcgcgagagcgaccgtcggccactcgccatgtcggcgctagtggacgcgctgtgcgcgccgcccagcgacaccgcgctcgtctacgacaccttcaacgcggccaacttcctcttcgacgccgccgcgttctgtgacggcgccggcattgtcgccgccccggcgtccgcgcaccaggcgcccgtggaggcgcaggcagcgacgacgtcggcggcgccgacgacgacggctagggccaggaagcggcggcggcggccgaggagctgcaagtccagggaggagaccgagacccagcggatgacgcacatcgccgtcgagcgcaaccgccgccgccagatgaacgagtacctcgccgcgctccgctccatcatgccggaggcctacgtccagaggggcgaccaagcttccatcgtcggaggggcaatcgagttcgtgaaggagctggagcagcaggtccagtgcctcgaggcgcagaagcggaagctgctggttcaccagcgcgtggcggcggcgaagcctgcagacgcgacgccaatgcgcgccagcagcagcggcgccagggcctgctgcgcggattcggcggcggcggcggcgacgacgagcaactgcagcagcggcttgacgacggaggacgcggcggcggaccacgcgctgccgccgcccccgttcgcgcagttcttcacgtacccgcagtacgtgtggtgccactcggcggcgcgcgactccgcggaggaggaggacgggcggcggtcaggggtggccgacgtcgaggtgaccctggtgagacgcacgccagcgtc

SEQ ID NO: 6219 - DNA, 564 bp, Zea mays
  Predicted polypeptide sequence is orthologous to G1246
ttttttttttttttttaccccttgttttttcttcttcttattttttttttattcaaaaattgccaaatcaatgtggtatcctggaaagttttgttgttggttgtgccatattcataaaagttgaaatgaataaaataaaatcatcgcttgcgctgtcataatttcacgcttttctcacaaaagcacgccattcacacattggttaccgtgactttcttcagtgaaggataacatcatgaaagtcggtcttgtgctcatcggcatgctcgccgtagtgaacaggtccaagcttgaggatgcggtagctgttgttggagctggagctggagctggacgactcagtcgaggctcgtcgaggagcacagggacgagtgtgagagcgggcagccggcttctgagggtatgagggagaagtggctggggcgagagacaggaaagaagacttgggagccggggtgagagggaggaacttttgaggaggaagagcagacattgtgaattttgtagtagtaaagagttgctgttgtggttgtggttgtggttgttgatggtgatggtgatggt

SEQ ID NO: 6220 - DNA, 777 bp, Zea mays
  misc_feature (577)..(577): n is a, c, g, or t
  Predicted polypeptide sequence is orthologous to G1247
ctctcccttgccccaccgagtagatttgaggatctccagctttttgaggacaatccagttttcgtcgaagttcaaaatgacggtggtggaggcgggtgaagtgttgaacttgaaggtgggcgagaaccctctactggagggtgaggccaagacggggtacgtctcgcccgacgaccaagacggggagaccgccagcgaaaaaccctgcggcgcgccccagctgaagaagggcccctggagtcccgatgaagataagcttctcaaaaattatgtcgaggcacacggcgaggggaaatggaacaaggtgcagcgcaactccgggctcaatcgctgtggcaagagctgccgcctccgctggaccaaccacctcaggcccgatctcaagaaagggcctttcgacaatgagcagatcgacaagattttgaagttttacctcaagtggggccccaagtgggccaagatagcctcgcgattgcctggtcgcacagataatgaaataaaaaacttttggaataccagaataaagaagactgagaaacagggtttgcctatctatccggaacatgtgctttctcangttaagcaaccgcaacaagacatgaactgtgaaactcctggattgtcacatggcaagaaacggataagagagattgagattcatgatcttatggatgtcaaaatcttatttcagcaccttgactatcataaggatctagtggttccaacaaaaccctttgaaacgccgtgcatctattggtagtctggaaattcctggtg

SEQ ID NO: 6221 - DNA, 335 bp, Zea mays
  Predicted polypeptide sequence is orthologous to G1272
ttttttttttttttttttgatcgaacagaaagaacacaaatacaaaaaaaattatagagtatttgcattgatttcatccaaacagagtgttaggccttcaagaccatgctccagtcatagcctagctactccgaataccgagagacgaaaataagagcaaccagctccatatcaaggataagttacgaaaataagaaagcttgaatgctaaacttggagcagctcagcagtagaacataacgtccttcacgttgtccttgatcttgggaagttgacgcacctcgacaggcccctcacgggctactgtctgcccgctgctgccaggtgtcgagcca

SEQ ID NO: 6222 - DNA, 3158 bp, Zea mays
  misc_feature (77)..(82): n is a, c, g, or t
  misc_feature (336)..(340): n is a, c, g, or t
  misc_feature (418)..(422): n is a, c, g, or t
  misc_feature (671)..(675): n is a, c, g, or t
  misc_feature (841)..(863): n is a, c, g, or t
  misc_feature (1046)..(1050): n is a, c, g, or t
  misc_feature (1131)..(1135): n is a, c, g, or t
  misc_feature (1525)..(1529): n is a, c, g, or t
  misc_feature (2315)..(2389): n is a, c, g, or t
  misc_feature (2427)..(2431): n is a, c, g, or t
  misc_feature (2854)..(2859): n is a, c, g, or t
  misc_feature (2945)..(2968): n is a, c, g, or t
  Predicted polypeptide sequence is orthologous to G1272
gtttcggtggggttcttgccgctgcggttgttcgtgcggcgcggatttagggagggttctgaggcgagggcttttgnnnnnntcgagcgatttgcagctttgggtccgatacagtgctcatcaaggctcactaaatggagtctcacaatggcgaggccaatgacttgcctccaccacctcctctgattgctggtgttgaaccacttaaagctgatgaaacaaagatgccattgaaacctaggagtctggtccagagaaatggatttggcagaaaggggcagccaataaagctgataacaaatcacttcaaagtttctcttgtgaatgctgaagaannnnnctaccattactatgtcaatttgaagtatgaagatgatacaccggttgatcgcaaagggtcaggaaggaaagtgattgnnnnnctgcagcaaacttatgctgctgaacttgcaaataaagattttgcctatgatggtgagaagagcctgttcacaattggtgctcttcctcaagttaaaattgagtttactgtcgtggttgaagacgtttcaactggaaagactcctgcaaatggcagtccaggcaatgatagtcctcccggaagtgacaggaaaagggtccgaaggccttacaatacaaagacctataaggttgaactctcttttgcggcnnnnntccctatgagtgcaatctcacaggctttgaggggtcaggagtcagagcacactcaggaagcaattcgagtgattgacattattctgaggcagcactcagctaagcagggttgcctattagtaaggcaatcattcttccacaacaatccttccaattttgttgaccnnnnnnnnnnnnnnnnnnnnnnnagaggttttcattctagttttcgagcaacccagagtggactttcactcaatatcgatgtgtcgactacaatgatagtgaaacctggtcctgtcattgactttctgattgccaatcagaaagttaatgatccaagcatgattgattgggctaagggcaagcgtgcactgaagaacttgaggatnnnnntaagtccagcgaaccaagaacagaagattgttggtctcagcgaaagaacttgtcgtgagcaattattcacactgaaacatnnnnntggtaacaatggtgactctgaagagatcactgtttatgattacttcgtaaagccgcgtggcatagtgctgcaatactctggtgatcttccttgcatcaatgtgggaaaactaaagcggccaacatattttccaattgagttatgcagtcttgtgcctttacaaagatacactaaagctttgaacacacttcagaggtcatcactcgtggagaaatctaggcagaaaccgcaggaaaggatgtctgttttatctgatgtgctgcaaagaagcaactatgatgcagagcccatgttgaaggcatgcgggattacaattgctagaaatttcacagaagttgatggtagggtattgcagccacctaagcttaaagctgggaatggtgaagacannnnnacacgcaatggtagatggaacttcaacaataagaggctcattagagcttgtagtgtcgagaaatgggcggtggtaaacttttctgcacgatgcaatgtcagggatcttgtccgggatctcatcaagtgtggaggcatgaagggcattatggttgatgctccttttgctgtatttgatgagaatccttcaatgagacggtcacctgctataagaagggttgaagacatgtttgaacaagtgaaaactaagcttcctggagcaccaaagtttcttttgtgtgttctagctgaaaggaagaattctgatatttatgggccttggaagaagaaatgccttgctgaatttgggatcgttacacaatgtgtggcaccaactagagtgaacgaccagtatcttacaaatgtcctacttaagataaatgcaaagctgggtggcatgaattcgttgctccaaattgaaacatccccagcaattcctcttgtatccaaggtcccaactataatcttgggaatggatgtgtcacacggttctcctggacattctgatgtaccatctattgctgctgttgttagttctcgtgaatggcctcttatctcgaaatacagagcttctgtccgcacccaatcacctaaaatggaaatgattgactcattgtttaagccacgggaagctgaagatgatggtctgatccgggagtgtctgattgacttctacaccagttctgggaagagaaagcctgaccaagttatcatattcagggacggtgttagcgaaagtcagtttaannnnnnnnnnnnnnnnnnnnnnnnnnnnnnnnnnnnnnnnnnnnnnnnnnnnnnnnnnnnnnnnnnnnnnnnnnncacgttgattattgcccagaagaatcatcacactaaannnnncattcctggaaagccagataatgtcccaccaggaactgtggtggacaacaaagtctgccatccaaagaacttcgatttctacatgtgtgcgcatgctggaatgatcgggactacgaggccaactcactaccacatcctgcatgatgagataggcttcagtcctgatgatctgcaggagctggtgcattcgctctcttatgtgtaccaaaggagcacaacagccatatcagtcgttgctcccatctgctacgcacatctggcagctgctcaggttggccagttcataaagttcgatgagatgtcggagacgtcctccagtcatggcgggcatacttcggcgggcagcgttccggtccaggagctgccgcgcctgcatgagaaagtgaggagctcgatgttcttttgctgagccgtggttttacnnnnnnggtggatggtgaacccctctagttatgtcggtagacgctcttggatgacgctctagttgtggtccaggaaggctcgagctggtacnnnnnnnnnnnnnnnnnnnnnnnncgtcgctgcggctatgttggtgcctcaggaagacttggaacctggttaggatgtcgttaaatctaccccttatcgttcctggttcgttgggctgttgttcttattgtccgtcctggtgtctgatttctgctttgttgcatgcaagtgtgaggcccagcttgatattgaaaagtttggcgtacatgtcgtt

SEQ ID NO: 6223 - DNA, 2052 bp, Zea mays
  Predicted polypeptide sequence is orthologous to G1272
accggtccggaattcacgggtcgatccacgcgtccgaaaggccaagcgtgctctctagggcttgaggattagaaccactcctgcaaattcagaattcaagatttttggtctcaacgagaggatctgcaaagaacaagcgtttccgctgaggcagagaaatggtagcaacggagattgtgataccattgaaataactgtctatgactactatgcaaagaaaggaatcgatctaaagtattctggtgatttcccctgtataaatacagggaaggcaaagcgcccaacatattttccaatcgagctatgctcgcttgttccgcttcaaagatacaccaaagctttgtctacgctacaaaggtcatcccttgtggagaagtctagacagaagcctgaagaaaggatgaccgttctaaatgatgcactgcaacgcagtaactacgattctgaccccatgttgagggcatgtggtgtttcagttgctccaaaatttacccaagttgaaggaaggatccttcaagccccaaagctgaaagccggcaatggtgatgatatcttttcacgaaatggacggtggaatttcactaataggaagttttatgaaacctgctctgtgaataagtgggcggtcgttaatttctctgcacgttgtgatgttcggaatcttatccgtgacctgatgaggaatgcatctgcaaagggaattcaaatggaggaaccttttgatgtgtttgaagagagtccctctatgaggcgtgcacctgtgtcaagaagggtggatgatatgtttgggcagataaaatcaaaacttcctggagctcctaggttcctcttgtgccttctccctgagaggaaaaattgtgaaatctatggtccttggaagagaaagtgcctggccgagtttggtattgtcacacagtgtctagctccattaagagtcaatgatccgtacctgcttaatttgctgatgaagatcaatgcaaagcttggtggtctgaactcgttgctgcaagttgaagcatcttcgtcaataccacatgtgtcgcaagtacccaccatcatcttaggtatggatgtttcacatggtcatccaggacaagatagaccttcggttgcagcggtggttagttctcgtcaatggcctcttatctctagatatagagcatcagtgcacacccaatctgccagactagaaatgatgtcctcgttgtttaagccgcggggtactgatgatgatggcctcatccgggaatcactgatcgacttctacactagctctggaaagcgaaaaccagaacacataattattttcagggatggagtcagtgaaagtcagtttacccaggtcatcaacattgagctggatcagatcattgaggcatgtaagtttctggatgagaagtggtcacccaagttcactgtgattgttgctcaaaagaaccatcacaccaagttctttcagacgggcatcaccagacaatgttcttcctggaactgtggtggatagtaaagtttgccatcctaagaacttcgacttctacatgtgtgcacatgctgggatgattggaacaacaaggccgacccactatcatgttctgcacgacgagataggtttcagtgccgacgagatgcaggagtttgttcattcgctctcttacgtgtaccagaggagcacgacagccatctcagtggttgctccagtgtgctacgcccacctcgctgcagcccaggtgagcacgttcctgagattggaggagatgtcagacgcgtcctccagccagggaggagggcatacctcggctggcagtgctcctgtgccggagctgcctcgcctgcatgacaaagtcaggagctccatgttcttctgctagctgatgtgcgtgcgcatcaggatcgagctccatgttttgtgttagtaaggcctagttagtaaggctgtagaaagaatgtttaatgtttgcatgctaaagtagctcaggaatgaaacgagccaagggcagaaccaaaacaatcaaaaccactactatatctaccagagcactgatcgatcaaaca

SEQ ID NO: 6224 - DNA, 759 bp, Zea mays
  Predicted polypeptide sequence is orthologous to G1272
ttttttggggagtaatcttctatttcttaattgccaaatgttcgaatacaagagataaataggcattatgccttctaacaaacatagatggaaaaactcctcaaattgagaccgtggttttctggccgcggtgactcagtctccaccgatgatttgttgcaacccaatgatcaacacctgattaaattgactttcgctaacatcgtccctggagatgatgacttggtcagcctttctcttcctagaacggatcagaccaccttcagcttccccccgaattaaacaatgagtcaaacatttccattttaggcgattaggtgcgaacagaagctttgtatttcgagacaacaggacattcacgagaactaacaacctaagaaaaacaaaatgaaacagtcacagtagctactatttattaaatatcatataaaattatcaaacgtatatttacagagcattgttcatatacaaagagagcgttgttcaatccagatccgaaagaatgtacaaaaaatctagttcctggaccaaataagtatcacaaatatcaactttcaaattgtcgttgtaagattggtagaaagcataaaaattttccagcaagtagacgtgtgtattctggcttttaaaggttgaaaatgtgcatgccttcctagttattgaaatcacgccaaagtgataagcatcaaatgatttaaagataataaagtgaaattttgctttcaggcaactatgtaacttagtcaaggtttgatagta

SEQ ID NO: 6225 - DNA, 832 bp, Zea mays
  misc_feature (666)..(666): n is a, c, g, or t
  Predicted polypeptide sequence is orthologous to G1272
ttgctccaaattgaaacatccccagcaattcctctcgtatccaaggtcccaactataatcttgggtatggacgtatcacacggatctcctggacattctgatataccgtctgttgctgctgttgttagttctcgtgaatggcctcttatctcgaaatacagagcatctgtccgcacccaatcaccaaaaatggaaatgattgactcgctgtttaagccacgggaaactgatgacgatggtctgattcgggagtgtctgattgacttctacaccagttcagggaagagaaagcctgaccaagtcatcatcttcagggacggtgttagtgaaagtcagtttaaccaggtgctgaacattgagttgcaacaaatcattgaggcttgcaaatttcttgatgagaaatggaatcccaagttcacattgattattgcccagaagaatcaccacactaaatttttcattcctggaaagccagataatgttccagccggcactgttgttgacaacaaagtctgtcatccaaggaacttcgatttctacatgtgttcacatgctggaatgattgggactaccaggccaactcactatcacatcctgcatgacgagataggcttcaatcctgatgacctgcaggagctggtgcactcgctctcttatgtgtaccanaggagcacaacagccatatcagttgttgctcccatctgctacgctcaccttgcagccgcccaggttgggcagttcataaagttcgacgagatgtcggagacttcatctagccatggggggcatacctcggcgggcagcgtccctgtacaggagctgcccgtctgca

SEQ ID NO: 6226 - DNA, 794 bp, Zea mays
  Predicted polypeptide sequence is orthologous to G1272
ggagaggaagcaggacctgggagacctcgcctcgtccgtcctcctgcctacttccttgcttttggtaggtgctgcttgttttatcttgaaatgggctctcatgatggcgaggatgaagagttgccacccccccctccggtgccaccagatgtgattcccattaaagctgaagatgctgtgggtgaatcaccagcaaaccatatattaaagccaaagagattactgatggacaggcctggtataggaagaaaagggcagccgacccagctctattcaaatcactttaaagtcgctgtgaagagtacagaagacgtcttctttcactactatgtaaacctgaagtatgaggatgatcgacccgttgatggtaaagggatcggcagaaaggtgattgataaactgcagcagacatatcgtgcagagctttctaacaaggactttgcatatgatggagaaaagagcctgtttacagttggtggtcttccacaaaaaaagaatgagttcaccgttgtcttggaggacgtatctactggaaagactgctgccaatgggagccctggaggtaatgacagtcctggaggtggtgataggaagagagtgaggaggccataccagacgaaaactttcaaagtggagataaattttgcagcagaggttcctatgagtgctattggtcaagtcattagaggcgaagaatctgagaactccctggaggcgcttcgtgttcttgatatcatactgaggcagcattccgcagaacaaagctgctttttggttaagcaatcatttttcta

SEQ ID NO: 6227 - DNA, 811 bp, Zea mays
  Predicted polypeptide sequence is orthologous to G1272
cggaaagaagcccggccgggtcggaaggggagcagttctcgccttctcggggaggtcgccagcgggttgggcagaggctttgcagcttttgggtcagacgcagtgttctccaaggctcactaaatggagtctcacaatggcgaggctgatgatttgcctccaccaccccctttggctgctggtgttgaaccacttaaagccgatgaaacaaagatgccattgaaacctaggagtctggtccagaggaatggctttggcagaaaggggcagcagataaagctgataacaaaccacttcaaagtttctctcatgaaggctgaagattttttctatcattactatgtcaatttgaagtatgaagatgatacaccggttgatcggaaagggtcgggaagaaaagtgatcgaaaaactgcagcaaacttatgctgctgaacttgcaaataaagattttgcatatgatggtgagaagagcctgtttacaattggtgcccttcctcaagttaaaatggaattcactgttgtggatgaagacgtttcaactggaaagactcctgcaaatggcagtccaggcaatgatagtcctcctggaagtgacaggaaaagggtccgaaggccttacaatacaaagacatataaggttgaactatcttttgcggcaaaaatccctatgagtgcaatctcacaggctttgaggggtcaggagtcagagcacactcaggaagcaattcgagtgattgacattattctgaggcagcactcagctaagcaggtttgcctattagtaaggcaatcgttcttcccacataatc

SEQ ID NO: 6228 - DNA, 816 bp, Zea mays
  Predicted polypeptide sequence is orthologous to G1272
gctcggaaatcataattgggatggataaattcatgcataagttcttgagttatggccataggttacagaataaaagcatcaacaatcagctaacagattcgtcagaacacgtgatccaaaattactgctcttaaaaatgagcttcattacgccaacagttcttcaacattatgatcagtacttgaactctgagctatattctcatatcaaaatctgagaacaagaacaataaactgaagcagatgaggctttaaaatctgtacttgagaggtcaagcacagagaggagcatagacttaagatgatgaacgtaagtcatagttttaaaatctgtacttctgaccactcgtcattgtctccatttgagacagaaggaatttctgaagatgatgacttggtcaggctttctcttcccagaactggtgtagaagtcaatcagacactccctgcagcaacattaaaatccaacaagcaatgggagaaagcatgtcattagtacataacttaacaaatgtaatgcaggctaaaatatcttacctgatcagaccatcatctttagcttctcgtggcttaaacaatgagtcaatcatttccattttaggtgattgggtgcggacagaagctaacaacaatagatggtacctcacaatgtccaagagaaccatgggacacatccattcccaagattatagttgagaccttggatacaagaggaaatgttggggatgtttcaatttggagcaatgaattcatgccacccagctcatgtcaccggtgtgcccgtggtcccgtccccggtgtcggtggtcgtcgatgc

SEQ ID NO: 6229 - DNA, 527 bp, Zea mays
  misc_feature (19)..(62): n is a, c, g, or t
  Predicted polypeptide sequence is orthologous to G1273
ttttttttttttttttttnnnnnnnnnnnnnnnnnnnnnnnnnnnnnnnnnnnnnnnnnnnncagctggtatgacaactgtgagagtgacttggagttgtaaacaaaataaagaaaagtaaaggcagcagtctttaatggaattgtgaaaccagcagcttaggctagatttaagtactggaacgaagaatctgaacttctggttgtcttcgtctctactccggcggcgtcatgtcgtcaataccatgcgtgtcacacatcacagcatctgtgcttgtcgacagcaatggcttcctcgggggacaaggcttgcccggcttcaagtgggtgggctcaccactatacacgatctcaacaacctggccatctggcgtcgtctccaccttcctcttcacagggcagctagggtgagtgcacttgtagtagctccgcgggaactcgctgactttcactttcttttgcccgtatttactccacctgtacccgtcaagtgacaagcgactgcgctcaccattccgcctcgcagct

SEQ ID NO: 6230 - DNA, 736 bp, Zea mays
  Predicted polypeptide sequence is orthologous to G1274, G1275
tttttttttttttttttgagtgctctctgcttcccttaaaattattacttgcactgtgtaagtgtaaaactatacaagtaggtcagaatttaatccggctacagcgatagcttctagagtattttatctctataaattgcatctccaacactaatttgaatagctgcagcagttgagactgtttagccagccgctgaacattcttcttatccgacgactggagtgtaaaggtaactatgggtcaaggcccggaaaagtcagaaggctagggagcccgagtaggaggtggccgacggggagccgctgtgcggcgggctgtagaagccgctattgccgccgccgctgccgtacgggacgatgatagcagcggctccggggctggcgtggttgtggacgccgtcgtaggtggtgatgacgtagcgggggtcgtcgcggtccctctccacccgcttcttcacgccgcagccctccgacgagcagcggtagtagttccttggatttgggctgttcttgacggccttcttcccgtacttcctccacttgaatccgtcgtccaagatctccacctctgacctcgttctgaacccgatccttccgttgcttctgagtcttctctcgtcaccaccaccctcacaccacatcatcttctcgttgcgatcgccgcccccagccccggctccggcagcagtgacgatcggcgccggtgagtagtcgaagtggtgaatgtcgtcgagct

SEQ ID NO: 6231 - DNA, 467 bp, Zea mays
  misc_feature (332)..(332): n is a, c, g, or t
  Predicted polypeptide sequence is orthologous to G1274, G1275
taattccgctacaacgacagcttctagagtattttgtctctatattgcagctgcagtaattcgaatagctgcagcagttgagactgtttagccggccgctgaagattcttctcatccgacgactggggtgtaaaggtaactatgggtcaaggcccggaaaagtcagaagactagggagcccgagtaggaggtggccgacggggagccgctgtgcggcgggctgtagaagccgctattgccgccgccgctgccgcacgggacgatgatagcagcggctgcggggctggcgtggttgtggacgccgtcgtaggtggtgatgacgtagcgggggntcgtcgcggtccttctccacccgcttcttcacgccgcagccctccgacgagcagcggtagtagttccttggatttgggctgttcttgacggccttcttcccgtacttcctccacttgaatccgtcgtccaagatc

SEQ ID NO: 6232 - DNA, 866 bp, Zea mays
  Predicted polypeptide sequence is orthologous to G1274, G1275
gtcactggtcacaccgcgcagcgcaacggcagcagcagctcatcgctagctccacggtcgtcggtgttccctgtgcctgtgcgtgcctactactctactctacatggcggcctcgctaggactcgcccacgaggcggccccgttctacgccgccgcctacccgccggccggcgctgcttacgcttacctcgcaccaccacccggcgacctcgtcgtcgagttcccgccgcgcgccgccaccatggctgacgactgctgctaccagttcggccaggagatgggcggcgcctactgctcgccgccggtgttcgacaatggcatgacgagcctgctgtaagttcgcgtacatacgtgctgttactagcagctagcttgcgtgctaataatgtgcgctgtcgccgtcgttgcgtcgcgtcacacgtaacgtacgccgtggcagcggctatactcaatgctcatcccatcagttgcgtacctgtggtttggctggggcttcaggaactatggcgtcgaaggcgacgggaggaggccggtgggcggaccagctggcggtactgggaacggcggcggccggccccggccggcgtcacggatcgggttccggaccaggtcggaggtggacgtgcttgacgacggcttcaagtggcgcaagtacggcaagaaggcggtcaagagcagccccaacccgaggtacagtagcagaatacaacactagctagcttggcgcacatggcgccaccgactccgacgaccacttcaattcccgttcattgtcacgctcatgcatgcaagcttgacgacgacgtgctgatccgcgcgccgcgccgtgcgtgcgtgcaggaactactaccggtgctcggcggagg

SEQ ID NO: 6233 - DNA, 724 bp, Zea mays
  Predicted polypeptide sequence is orthologous to G1274, G1275
ggcgcattgactgatacacatatatacaacaagcaaggcggctagctacagcggctagtgcgcgcgtggtgcaggcgcatctagctactacctggtgcttgttgtgcatacaatggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtatgtatatatgcaacgcacgcagcaaaatattattactgtgtctgtgtgtgtgctagttattgttggttggtgtcggcgcccctgctagctgcttactacagtttgcttcggtgatttcgctcatcatcaggtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggtactactatactacacaaatacacatgcaaattaatagagcagctagctaaattcccccaacatgaaagtcaagacaagagcaaagagatgaatt

SEQ ID NO: 6234 - DNA, 129 bp, Zea mays
  Predicted polypeptide sequence is orthologous to G1309, G237
atcaactacctgcgccctggactgaagcgtggaatgttctcccaggaggaggaggacgtcgtcatcgatctccaagccaagctgggcaacaagtggtctcagattgcgatgcatctgccggggaggacc

SEQ ID NO: 6235 - DNA, 789 bp, Zea mays
  Predicted polypeptide sequence is orthologous to G1313
ctctatctctctctcagtctctctcttcctccttaaaactctctctcccagcactgaaaattctccacatactctgctgctgctaagtggtggcatctcgtttacgcgagatccccctcctcccccgctttccactcctctcctccaccctagtcgactccttccctgcaatccgctggccggctcacagtaccagaggagtccaccggaggagctcagctagactcccaccctggtggctcgatcggcaccggccgctgcctgcgagactccgccagcgcgcgatgtaccgggtgaagagcgagggggagggcgagggctatggcgactgcgaaatgatgctgcaggaacagatggactcgctggtggccgacgacgtcagcagcggaggagggtcgcctcacaggggcgtcggcacgcccctgaagaaggggccatggacgtccgcggaggacgccatcctggtggactacgttaagaagaacggcgagggcaactggaacgcggtgcagaagaacaccgggctgttccgctgcggcaagagctgccgcctccggtgggcgaaccacctcaggcccaacctcaagaagggggccttcacccccgaggaggagcgcctcatcatccagctccacgccaagatggggaacaagtgggcgaggatggctggtcacttgccagggcgtactgacaatgagatcaagaactactggaacactcgaataaagagatgtcaacgagctagccttcctatttatcctgctagtgtatgcaatcaatctacaaatg

SEQ ID NO: 6236 - DNA, 843 bp, Zea mays
  Predicted polypeptide sequence is orthologous to G1313
ccctagcggaacaggtgacggcggcgcgctaccggtgacgggggatacggcggcatcgtcctcctcggcccctcctccatccccggcgtggcggcgccagcagccggcctgcagaagattaaaggagccccaggagccccaactttcggaggacgacccagctgccttcaaagttcaaaatcaaaatgacggtggtgagggtggacgagaaccctgcgccggatggagagaactctcccctagacgatgagtacgtctcggccgacgatgaacacgttgatgatgaagacaaggagaccgatagcatcgacgactatgaaaaccccagcgggacgccccagatgaagaagggtccctggtcgcccgaagaggataagcgtctcaaagactacgtcgaggtacacggcgcggggaactggaataaggtgcagcagaatgccaggctcaaccgctgtggcaagagctgtcgtctccgctggacgaaccacctcaggcccgatcttaagaaggagcctttcaacgctgaggaagaggaaaagataatcaagcttcacattagacggggccccaagtggtccatgatggcctcatatttgcctggccgcacagataatgaaataaagaacttttggaataccagaaaaagaagaaaacagagatgtggttcgcctctctatccagaatatatgctttctcaggttagtcataaagacatggactttgaaactcttggagagtcacatggcaagaaacggtcaaatgagtgctcaaaagaaaaggttgttgatgtgcaagaacttgtggatgagttaattgtatttgagcaccttgactatggtaagg

SEQ ID NO: 6237 - DNA, 918 bp, Zea mays
  Predicted polypeptide sequence is orthologous to G1313
cggcgccgtctccggcgcgccgagcgctgggtgcaccaggccgaacagcgtgtccatgtcgtcaccccgacgctgcaggccgctgattctgctctctgggactgaaactccgcaatcatgccgctccagtgcagcgccgccgccgctggccgggaccagcgcctgcggttcgaccttgatgacgtcgtgcagctcctgcagcatctgttcgaggctcgccgcgttctgatgatccggcagcgcaagtccggcggcgacggcggcggccgaggtcggcggcgccggctggccgtattggtttgaagggagctccactctggggccgggggacggcgagagcggtgggagcctgctctggtcggcagcggcggcggcgcgcgcgccgtggccgccgagagacaggtccggcatggccgggtgcaccggcccggtcggcgtcgacggggacacgggcgacgagtgcgcgagctggaagtactgcgcgttccgcgcgaacggcttggcccacggggacgacggcgccgagaagggcggcggcgagaggaactgcgccgtctgctgggtcgtcgtcgcggcgagctggctgcgagccaggtcgagcggcgccgggcgcgagctggcgtacccgggcccggcgcccagcgcctggacatcggtcgtcgtcgtcgccgacagctgcggggacgacgcgagcggcgggaagtcgtagtcgtcgtagtggcagcgcttggagagggcaaggtggagctgcacctccggcgggtacacgggcaggccggcgcgctggcggcgcttggtcctcgtgttccagtagttcttgatctcgttgtccgtcctcccgggcaggtgcgcggccatgcgcgcccactgtttgcgagctgcgcgtggagctgggctatgaggagctcctcgtcgggg

SEQ ID NO: 6238 - DNA, 590 bp, Zea mays
  Predicted polypeptide sequence is orthologous to G1324
gtcccttccagtttccctttttagaccaaagatcattggtacagcttactgcaggaagatctctaacacctaaaaaacacaaactaacttaatactcaccagaatctaaacaaccactatgcaaactcatctaaaaacctaccagcaaaaaaatgcgacaaatatacaaccacagctgcatttaccttcagcagttcatgcaaaacaacaccaggctcctgctacctagccaaaattcaaccacaatagagaaaacaacactctaattttgttcaatgttgtttaccatgttcctgataagctctgccactctttctttatccttctgtgataccatcaccgtccagttctgcagcaaggccaccagcttgaataagaccactaccagctaccaccttggctcctttatcaagttgttggaactttgttttgttaattctgactgctgattggatcctacaatggaatgccatccactgaaagatattcaccagtgtaagagctatgcagtcttatacgtccaccttatgttgattcaccacaccaccataagttaaatctttgtatagagattttgttgtgtctccctg

SEQ ID NO: 6239 - DNA, 441 bp, Zea mays
  Predicted polypeptide sequence is orthologous to G1324, G2893
ctaagccgccacggtcaaggttgccttctattgccgcccgacccttgaagtgtggctgcagtagttcgtcgtgactcgtggagtcttgtgataagcctcgccgggcgtggaggtaaccgggtgagagggaattcctcatcgtcgtcatacgtacctagtggctgtcgtacgccatggctagccaatctgccaccaccccatcagcgaggttacgagtcacctgaagagcaagttggtacctggaatctcaagtcccaggtcaagaacaggtaccgcaggatgaggcgcatgaaggatgttgtgacgacttcgtgagaggtgtaggccgtcatctcccagtcaactttgggttgctggatcgttgtctccttatgatgtaattatttatttattttgtacagaactcctattatatagtaaagatgtgacattgctttttgt

SEQ ID NO: 6240 - DNA, 938 bp, Zea mays
  misc_feature (345)..(345): n is a, c, g, or t
  misc_feature (348)..(348): n is a, c, g, or t
  misc_feature (351)..(351): n is a, c, g, or t
  misc_feature (582)..(582): n is a, c, g, or t
  Predicted polypeptide sequence is orthologous to G1335
cccgggctgcaggaattcggcacgagcagggggagaggggaaaaaaaaaaatctaaccctagcatccgcagcgctagggttcgggggttgcgatggcggcggcggcgagacagcgggggacggtgaagtggttcaacgacaccaagggcttcgggttcatctcccccgaggacggcagcgaagatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggangangangcggcggcggctacggctcccgcggcggtggcggatctggcggcggcggtcgcagctacggtggtagctggggcggcggccggagatccggcggcgggggcggtcccggcgcgtgctacaagtgcggcgagcccggccacatggcaagggactgccctatcgccgacggcggatgcggctacggcggaggcggctacggcggcggcggctacggatgaagaagctgttaancgttgtggttgctttcaattgtggtgagccttgacacatggccacggcactgctccaccagcccgccgcggctttccgtcgtgacccgccctcgctggtccgtatctttttctcttacaagtcgcaccgccctgcttctctttctttgtatcctcccaccactcctcttgttccttatccccccgtgttatttcccccccgtcgcactccgcttgtacccccgaccttcctcgcttctctcattccttcttttccccgctgcccgttgtttgttattctgtcacctccttgcgattcttctccgccttctgtcccttcttattttttcgtcgctctccttctctgggtgcctagaa

SEQ ID NO: 6241 - DNA, 638 bp, Zea mays
  Predicted polypeptide sequence is orthologous to G1335
ggtaaccaaatcaagcacaagcaggcaggattataatctgggagaataatcatctcatctccttcctcagtctgatggaacaaaccacaaaaaagaaaagaaaagcagattggacttcccctcggcaacacaggaccaaatcatctcttaaaaccttaacgacgacgacgaacgacggacgacgaccaagcacacaccatgataacttaacttaacttgagagttcttctacgaaccgaacgaaatctgaaaacggcggacgggatcctcttacgaaagaggcagcgggcactcgtgcccggatcggcaaaactaaagcggtactccgacacacagcgagagggggatgtttttttaagcgagatctagaagggggcggcgccatcagaccagcaggtggtggagcgatccgatccgatctggctggctggacggacgcggacacacctcacgtgggacagtcgcgggcgatgtggccggcctcgccgcagttgtagcaggagcggtcgcctccacccccgccgccggcgaacctccctccgccaccgccgccaccgcttgggcagtccctggccatgtggccggcctggccgcagttgtagcagccgacaccaccaccgccgccgccccaacacaat

SEQ ID NO: 6242 - DNA, 1039 bp, Zea mays
  Predicted polypeptide sequence is orthologous to G1335
gcacgacctttgtccgcctcccctaccatctagggtttctagggttatccaggaggaggaaatggcgtctgatagggtgctcgggactgtgaagtggttcaacggaaccaagggcttcggtttcatcacccccgacgatgggagtgaggacctgttcgtccaccagtcatccatcaagtccgacggctaccgcagtcttaacgacggcgatgccgtcgaatacaccgtcggcagtggcaacgacggccgcgccaaggccctggatgtcaccgcgcccggcggcggcccgcttgccggcggggaacgtcccgacggcggcaacggcggtgggcgaggcggatacggcggcggcgaccgcggttacggcggcggcggtgaccgcggctacgggggaggaggcgaccgtggctacggcggcggcgaccgtggttacggtggaggtggcgaccgcggctacggcggcgaccgtggctacgggggaggcggcggctatggcggtgggtacggtggaggcggcggtggaggcggccgcggctgcttcaagtgcggcgaggagggccacatggcaagggactgctcccagggcggcggctacggagggggaggcggcggcggccgcggcagcgagtgctacaactgcggccaggagggccacatctcccgcgactgccccaacaaaaggcgttaggcgcggcgccaccgtcgcctcggatccggcgggagtcccatgtcgcctctcgccgcatccctacccctccaaaggtatcgctcggctgactctcgcgtgaagtcgtcggagcaaactatctatcagtagtactagcagtgtcgtttcgttttggtctgtcgtggtagtaagaaatgcaagtgagcagcaccaatatctttccgtttaaatcagttgtaaggcacccatggtcatggttgcctctcccggatctatctgtcatgaactatctataataaatcgttatcaatgttatgcaaagagtctttggcattgagcaaaaaaaaaaaaaaaaaaaaaaaaaaaaaaaaa

SEQ ID NO: 6243 - DNA, 780 bp, Zea mays
  Predicted polypeptide sequence is orthologous to G1341
tttttgagacgtgcagttgaagtctgcatgaatcctttccataatttaaagccacatatgttttatgatacttcacatctcttctcaaattgagagttgagacattgtgatctattcaagactattatgcctatattgacttcataaaatcctccgaaaactattcaaagttctgaaaattagaagaaaagggtattcacgtggaaccagtttatacttcgcctacttacaatgaataatcacagccatcgtagcaatgtcacgagcaaatagcagatgaagccgctcccgagtgaataacagcaacttcactgcatcagctgataccttcaaatgcctgcacgcacactcctgagaatccctccagagcatggaacacatttggaagggctgtctgcagattgttcagtgtcatggctcggctttccctaacagaggttaggtatctggccttctcctcctcgaccttctttctaaatgcatccagtttcgtttcattctttgatactgaatagtgattcttatttggaggctgtgccgagttttgaattgaattatcactgtgtttctctaactgggtctggaacttgctatccatattatctgacttcttctttagttggcgctcttcactctgctgtacaactatagagtgtatgattgacataaaggtctttattgcttcagctgctaccttctccggtagcctgtcaagagcatgctggagttccttggagaggctacggattccagatgaactcctcattaagccaccatcat

SEQ ID NO: 6244 - DNA, 781 bp, Zea mays
  Predicted polypeptide sequence is orthologous to G1341
ggttgcaaggtatcattgttactaaaacctaggactgtatacattttatacaacattgcttcaggtcagcagcctcttcgggtccgagctccgcttgaagttgtacaccgactcaaatgcctccatgcacacgctggcgaagcccgtcatcgcctggaaaacgttagggaagccagtctgcaggttattcagggtcattgctctggtgaccccgatgctcttctcgtatttgatcttctcctcgtcggcacggctcctcagagcctcaaccttcgcccgcttgtcagctaccgatgattttcgtgacatttctctgtaaccttcagcgccgacatattttgactccagggctctcagctcctctgccttcttctcaaactctttgaatgcagactccgacctcttcttctgcttatgctcctcagcttgttgaatgacgacagcatgaatcactgtcaggagagtcttgatcccttccgaggccaccttatctgggattctgtcgatggctagctgccattcctcacacaagccatagatatctgagttctgagctttagtcagtgggtcgtggtggcagaacagcgatagacgaagccagccggtcaatgagtagacgtagtctctctgggatttcaccagactacagaaggctgaataccacctgtcaacctctatctcgagctgaagagctgcttgccggtggacattggaagtcggattggtattccgagcattgttcaggtactccagctgctgcacgatgtgggtctgaacttga

SEQ ID NO: 6245 - DNA, 723 bp, Zea mays
  Predicted polypeptide sequence is orthologous to G1361
ttttttttttttttttcggagctattcttttctcttttttttttccttttgatagatgatgtaattcagcagcactcaaaaaaaactttgttggcgtggctagctactgaccaggaagtctctccggatgcgtgtagcagatgccgttctcgccctcgatggtggggatgaactcgtcgacgagcgggtgcagcttgcgggtgtccggcctcgccttcccctccaggtgctccagcagctcctggtccgtcggatcgaacttcacgcccgccggcagccccggcaggtcctggatcgccgccgcctgctgcacctgttcgtcatactgcgcgcggtgtccgcaggaggggcaggtcctgatgaggttgacgtgggaggaggcctgcagctgctgtttcttggcggcggcggcggtggccaggttgtcctccacggcacgcacgtcgttgaagctgttgcaccatgtcatggccgtcgacgacgacgatcgatctccgccggccccaagctagcctagccttgtcaccacgtcccggccctcctctttctactaaaagctaggggggagggaagcaggggaagggatagcagagagagagagatagggagggagatcgatcgaaagcctcttgttgtccgctttgctcctcagctcgcccccatatgatgcaacgccaaggctgatccccaggggaatgacaggccgcgcaaaagctcgtgccg

SEQ ID NO: 6246 - DNA, 1455 bp, Zea mays
  Predicted polypeptide sequence is orthologous to G1361
gcacgacgctctctccggccgatccctgtcgagccgggcgctagcgctacctcttgtcagcccttgcccttctttaatcgcgcctgctgtcttctcctcgctcatggagacgtcgtcgttctagctactagatcagttactgccttagccttactgctagctagctagtcgtcgtcgtcgtcgcccgcccgcgcgcgcgcttcgcttgtttttcgttatctatcgatcgagaaggaagcagctaataattagggggtccgatcaattcgttgttatgacgtggtgcaatggcttcaacgacgtgcgcgccgccgtggagagcagcctgtccccggccgcagccgccgtgggcaagacggcggcggcgtcgcttgccgtcctggtcaagatgtgcccgtcgtgcggccaccgcgcgcaatatgagcagaagagcacgacgatccaggacttgccggggctgccggccggcgtgaagttcgacccgacggaccaggagctgctggagcacttggaggggaaggcgaggccggacacgcggaagctccaccccctcgtcgacgagttcatccccaccatcgacggcgagaacggcatctgctacacgcacccggagaggctccccggtacgtacgcaccgtgtgagcaaggacgggcttgtccggcacttcttccaccggccgtccagggcgtacacgacggggacgaggaagcggcggaaggtgcacagcggcgacgacggcggcgagacgcggtggcacaagacgggcaagaccaggccggtgctgtccaacggcaggccccgcgggtacaagaagatcctggtgctctacacaaactacggcaagcagcgcaagcccgagaagaccaactgggtgatgcaccagtaccacctcggctccgacgaggaggaacgcgacggcgagctcgttgtctccaaggtctttttccagacgcatcctaggcagtgcggctacaccatggccagggaatccgccgtcgttgtccctgccgccgccgcagtcaccggcagcagcaacgcgtttattgccggccatgatggtagcgtcctcagagaagcaaacggcggagctgatcagttctacagcccaagagcaatgatggggtatgaccagggggggcctggaaacagggcacctcctgcccctgctgtgcctccccacttcatgcctaactttgctgtccatgcagcaagggctagctttgccccttgaaccgagaattcaggacaatatacaaacctatcaaatttgccagatataaataggcatttaggagcatgtgcaaactcccaggacctgaacacaattcactacttgtgctgggattgtataaaaaatgtcatgttcttaccctctaacttcacgttcatttacaagctcctcccttattgccatgcaacaatgtgataagattaaagaaaaaaaaaaaaaaaaa

SEQ ID NO: 6247 - DNA, 677 bp, Zea mays
  Predicted polypeptide sequence is orthologous to G1361
caacacgtactcatcctcttattgtccaccattacggttcagtaaactcgtcgaccatttgtagtaagttattgcattcatgaagttgccattatctgcctgcatttccctcccctctaacctatatcagtcgaatagttcctcttgcgcgtcttggtcagggaccaaagccagcagcccccgatgtagtgtgcacctcaaagttaggcaccaggtgagcaaaagcggcaaccctgctgttaaaagctgcctggttgtagctaattagtgctgctgggctgtaaaaatctacaatgcctgcctccttcaacatgttgttgccgccgccattgccaccgtcatgggggtgggggtggtggtggtcagtcgctgcgttggcagcgagcgggatggcgtccttagccgtcgccgaaccgctgccgcactgcctcggctgcgtctggtaaaacaccttggagacgacgagctcgccgtccttctcctcctcatcggaccctaggtggtactgatgcatcacccagtttgtcttctccggcttccgctgcttcccgaagttggtgtagagtaccaggatcttcttgtagcccttgagttttccaccggtgaacaccgggcgggtcttgcccgtcttgtgccatcgcgtctcgccgccctgctcgtcggtatggacctttcgt

SEQ ID NO: 6248 - DNA, 1002 bp, Zea mays
  Predicted polypeptide sequence is orthologous to G1364, G481, G482, G485
gcacgacgctaaaataaactccccgctctcccccgcccgtccagctcttgctccgcctccgctgctctgtcctcttccctcctctgcgtttctcctcagagctgtttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtccgagttcatctccttcatcaccggcgaggcctccgacaagtgccagcgcgagaagcgcaagaccatcaacggcgacgacctgctctgggccatgaccacgctcggcttcgaggactacgtcgagccgctcaagctctacctgcacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatggggcagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggcatggctcagtcccgccgccggcttcttgcttggtgtcggtaattagcgctggttaagttaaccttcggtttttccccccttttcttttcgtggtaagtaatgttgtgctgaatggagccagtgatatggttaagatagctccataacctctcggtaaaaaaaaaaaaaaaaaaaa

SEQ ID NO: 6249 - DNA, 630 bp, Zea mays
  Predicted polypeptide sequence is orthologous to G1364, G481, G482, G485
atgccggactccgacacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgcagcctcagccgccacagcagcagcagcagcaacatcaacagcatcacatggcaatgggaggcagaggaggattcggccaacaaggcggcggcggtggctcctcgtcgt

SEQ ID NO: 6250 - DNA, 860 bp, Zea mays
  Predicted polypeptide sequence is orthologous to G1364, G481, G482, G485
gaccggttcctgcccatcgccaacatcagccggatcatgaagaaggccgtcccggccaacggcaagatcgccaaggacgctaaggagaccctgcaggagtgcgtctccgagttcatatcattcgtgaccagcgagtccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacaggtaatctatcgtactgtcatttgttagtaaaacaatactgcagctattttccgtctcactaaacatggcagaaaatttcgatcattacattattccactaataattttctctctgtacgcactcagtaccacaatggggaaacctaataaagggctaatacagcagcaatttatggtaatattattgctccctgaattttgttaactaaagattctgtatcatgctatatgtatgttcccttttttcttcttcttgttttgacattgcttctttctctacgggtttatcctcagctagggagtctctgcattgcttacatgtgttttggcagaaaacaggaggcccttcaaaaggtgttaatctctgcgaggctgcctctcaggggtaatgggttcggttagcgctcttttgccggttttcaggagattgactgtggtcctttggc

SEQ ID NO: 6251 - DNA, 1036 bp, Zea mays
  Predicted polypeptide sequence is orthologous to G137, G145
gcctgcgctcgcctcagctcytttctyccccgccccttggcttttgcttggttgcatcgggccggtcgagccggagaggaaaagctagctagcagctaccagctctcgsccggcggtggtagtctscctgcagctggggttagctgcaagggttgggagctagccatggggaggggtcgggtggagctgaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcattaccaaaacacttgagaggtatgaaaaaaacagttatggaggaccagatactgctgtacagaacaaggagaacgagttagtccagagcagtcgtaatgagtacctcaagctgaaagcgagggtggataatttacagaggactcagaggaatttgcttggtgaagatctggggtcacttggtgtcaaagagcttgagcagcttgagaagcaacttgattcatccttaaggcacataagatccacaaggacacaacatatgcttgatcagctcactgatcttcagaggagggagcaaatgctgtgtgaagcaaataagtgccttagaagaaagctggaggagaccagcaaccaggtgcatggccaagtgtgggagcacggtgccaacttactcggctacgagaggcactctcctcaacagcaggccccatcacatgttggcaatggtttgttctttcatcccctggaagctgcagcagagccaaccctgcagatcgggttcgctcctgagcatatgaataacttcatgccaacatggctaccctgaagatggatcttgaggcaaaggaaataaataaagatgcggtggcagcatcatactctatgcaagctaagagtgacagctgtgtttcagtcacatatatgatctagtctgtgtgtcaatgtgtcgaaaaacatgtctgtga

SEQ ID NO: 6252 - DNA, 867 bp, Zea mays
  Predicted polypeptide sequence is orthologous to G137, G145
aagatcagccggcaggtgacgttcgccaagcgccggaacgggctgctcaagaaggcgtacgagctgtcggtgctctgcgacgccgaggtcgcccttatcatcttctccagccgcggccgcctcttcgagttctccacctcctcatgcatctacaagacgctggagcgataccgcagctgcagctttgcatccgaagcatcagctccactagaggctgaattaaataattatcaggagtacttgaagttaaagacaagagttgagttcttacaaacaactcagagaaatctacttggtgaggacttgggtccacttagcgtgaaggagttagagcaacttgagaaccaaattgagatatctctcaagcaaatccgatcatcaaagaaccagcagatgctcgaccagctctttgatctcaagcgcaaggaacaacaactgcaagatgctaacaaagatttaagaatgaagatagaagaaactagtgaagaaaatgtgctgcgactgtctagccaggatattgggtgtagtggatctagtgggcatggtgatgaagccaaccaagaacaccttcaacttgctcttgatccttcgctgcatatagggtatcaagcttacatggaccacctgaacaatgattaagttgcttctttgtgcgctgtgtgctctagtggccatggatcttctatatatgttggacgtaatgcttttgataaatcctctatatataaccatatcggtcctagctttatgcatgctactgtatgtactaaactaagaagccctacgacttctgttgaggaagaatgttctgacgatcatgactttttcttgctaaataataactactgtatctcattttgaattaaa

SEQ ID NO: 6253 - DNA, 921 bp, Zea mays
  Predicted polypeptide sequence is orthologous to G137, G145
aagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcattaccaaaacacttgagaggtatgaaaaaaacagttatggaggaccagatactgctgtacagaacaaggagaacgagttagtccagagcagtcgtaatgagtacctcaagctgaaagcgagggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcctcgccacagcaagccccatcacatgttggcaatggattattctttcatcccctggaagctgcagcagagccaaccctgcagatcgggttcgctcccgagcatatgaataacttcatgccggcatggctaccctgaagatggatctttgaggcaaagggaataaataaagatgcgatggcagaatcatattgtactgcaagagtgacaattgtgtgttccactcacatatatgacctagttttgtgtgtctatatgtcgaaacccatatgtctgtgattttattatatgttatgtaagcacaaatgaaacatgccggactagttgcttttgcttgtctatgtatttgtatctgttctgtgt

SEQ ID NO: 6254 - DNA, 1210 bp, Zea mays
  Predicted polypeptide sequence is orthologous to G137, G145
ccacgcgtccgggcgcgcgcgaggaagaagttaggttagaaggactctccaaaagcgccgcttgagtaaaaaagatctcgccccaaggggtacgacgactacgatcacacaatataagcatctctctgctgctcaaagcaacccaggccggactcccgagggagcttttttagagcaagagaggacggagaggtagagagagaagggggacggaacaagcagctagctagcagggaagatgggtcgcggcaaggtggagctgaagcggatcgagaacaagatcagccggcaggtgacgttcgccaagcgcaggaacgggctgctcaagaaggcgtacgagctgtcgctgctgtgcgacgccgaggtcgcgctcatcatattctccggccgcggccgcctcttcgagttctccagctcctcatgcatgtacaaaacactcgagagataccgcagctccaactacagcacacaggaagtaaaagctccactggagagtgaaattaactaccaggactacttgaagttgaggaccagagttgattttctccagactacacaaagaaacatccttggcgaagatctgggcccactcagcatgaaggagctcgagcagctggagaaccagatagaggtatccctgaagcatatcaggtcaagaaagaatcagatgctactcgaccagctctttgatctcaaaagcaaggaacaagagttgcaggatctcaacaaagacctaaggaaaaagctgcaagaaacaagtccgcagaatgtgatccacgacgtctcctgggaggaaggcgggcacagtgggagtagtgttcttggtccgttccagggactccttcagcaccatggcaatgatccttccctgcagacacggtaccatcagcaggcctacatggaccagctgaacgaggacatggcggaccctgacgagcacggtcggtctggatggatatgagatgctccggtccgatgccccccaaataatgtcgatgcatgcatatagtttcctgcggtatgcggaactatatatgtgttgaaactgcaccaacgattagctgcctgattgtaatggttaccttaagaactccagtgtattgtattgttgtgtgctgtgctgtgttgtcagaagcttgcaactttgtatatgtacatgtatggtattctgttagtttcttggagctgcgcaaaaaaaaaaaaaaaaaaa

SEQ ID NO: 6255 - DNA, 1056 bp, Zea mays
  Predicted polypeptide sequence is orthologous to G137, G145
agagagagagagagagagagctccggctgcgctctgccttgctttcctgctacctgctctagcgcgagcgaagagaggtacggcggccgatctggcggcgcaggcggagggctcggccggggccggcaagtcggcgccgaacatggggaggggccgggtcgagctcaagcggatcgagaacaagatcaaccgccaggtcaccttcgccaagcgccgcaacggcctgctcaagaaggcgtacgagctctcggtgctctgcgacgccgaggtcgcgctcatcatcttctccaaccgcggcaagctctacgagttctccagcacgcagagcatgccaaaaacacttgaaaagtaccaaaaatgcagttttgcagggcctgaaacagcactccagaatagagagaatgagcaactgaaaagtagccgcaatgagtacctcaaactgaaggcacgtgttgataatttacagcggactcaaaggaacttgcttggtgaagatcttgagtcattaggcataaaagagctggagcacctggagaagcagctcgattcgtccttgaagcacataagatctacaaggacacaacacatggttgatcaactgacagaacttcagaaaaaagaacaaatgttttgtgaagcaaataagtgtcttcgaagaagactggaggagagcaaccaggttatatggcagcatgcgtgggagcaaagcgagcggcattctgaagtgcagccgcagcagctcaatggcaataacttcttccatcccctcgatggtgctggtgaacccacccttcagatagggtatccttcagaggcactgactagctcatgcatgaccaccttcctgcccccgtggttgccatgagatcgaactactgcgcaattccgaattaataagcatggccgcatgcagctgcctgtgctatacgttgtgcttggagtgtactttaaggttcttgcatggcaagtatgtgtgtaacatttgtgatgaacatggaaactatccacttaattctcgaataatcaatgaactgggtaaaaaaaaaaaaaaaaaaa

SEQ ID NO: 6256 - DNA, 1303 bp, Zea mays
  Predicted polypeptide sequence is orthologous to G137, G145
ctcagccagcagcaagcatatagcccagcaccaccacatgcccaagggccctccctctccctcgtcgtcgggccaattgagtgtgagagctcgaaaaaacccaggggatcggccggacgagcagcgcgcgagcgcgagcgcgagctctgtgtgcgtgcgtgtgtctgctctagattagatcacctccatcgtcaataattgcaggcagatccatagtctgctggtggcgagacaaagcaacggatcgtcgtcgatccggagagcggaaagcgcgcagatcgcgacggccatggggcgcggcaaggtggtgctgcagcggatcgagaacaagatcagccgccaggtcaccttcgccaagcgccggaacggcctgctcaagaaggcgtacgagctctccatcctctgcgacgccgaggtcgcgctcgtcctcttctcccacgccggccgcctctaccagttctcatcctcctccgatctgcttaagactctagagcggtaccagaggcacatctatgcttcagctgatgctgcagtgccatctagcgatgagatgcagaataactatcaagaatatgtgaagctgaaagcacgagttgaggttttacaacactcgcaaaggaatcttcttggtgaagaactggctccacttagcccaagtgaacttgaccagcttgagagtcaagtagacaagaccttgaagcaaataagatcaagaaagactcaggtgttacttgatgaactttgcgacttaaagagaaaggaacaaatgctgcaagacgctaacagggttctgaaaaggaagctgcacgagtttgaggcagaggctgcttctcccccacaattggcgtggcaaggcggaggcggcatgttgtcccatgaccctccacagccagaacacttcttcgtggctctggagagcaacgcgcctctgcaacctacataccatactatggacatgaaccagcagccagagccagcgccgggcggctgctaccctcctgcgtggatggcttagccagcgctttggttccattgccttgacaagtgccgtgtccttcagagatcgctacgagtcctgctgctgcttttgcgaaccccccctttgctgcctgccatgcttaccgaactgttcaaataagaaataaccacatggtcctatataggttgctgttgtctttatcttctgttgatcacgtcctgctcagatgctttaaacgctatgcaaaatggcttagcgatgcatgctggaatgggctgaactgcttgtgttttgggagtataaatcgcttgggcgcttggcaat

SEQ ID NO: 6257 - DNA, 1299 bp, Zea mays
  Predicted polypeptide sequence is orthologous to G137, G145
ccaccacccacatgccgcagggccctcacccgtcgagccaattgagtggcagccagaaaaacccagagcgcgagcagcgagcgcgagcgactcggcagcgagcgcgggctcctgtgtgcagtgtgtctgcgctagagggcgaagggcacggaccgccttcgtcaataattgcggtacgaacggggcaaatccgtcgtttaaagaggtcgctgatagcgcctgctggtggcgagagagaaagcagcagaatcgctgagggatcgtcgatccggagaggcaaaaaagccgagagatcaggcagggcaccatggggcgcgggaaggtggtgctgcagcggatcgagaacaagatcagccggcaggtgaccttcgccaagcgccggaacggcctgctcaagaaggcgtacgagctctccgtcctctgcgacgccgaggtcgcgctcgtcctcttctcccacgccggccgcctctaccagttctcatcctcctccaatctgcttaagactctagagcggtaccagaggtacatctatgcttcagccgatgctgcagtgccatctagcgatcagatgcagaataactatcaagaatatgtgaagctgaaggcacgagttgaggttttacagcactcacaaaggaatcttcttggtgaagatctggccctacttagcccaagtgaacttgaccagcttgagaatcaagtagacaagaccttgaagcaaataagatcaagaaagactcaagtgttacttgatgaactttgtgacttaaagagaaaggaacaaatgctgcaagatgcaaacagggttctgaaaaggaagctgggcgagtttgaggcagaggcggcttctcccccgcagttagcgtggcaaggcgaaggcggcatgttgtcccatgaccctccacagccagaacacttcttccaggctctggagagcaacccatgtctgcaacctacataccatacgatggacatgaaccagcagccagtgccagcgccgggcggctgctatcctgcatggatgtcttagccagtgcttcattccattgccttgagaagtgtcctgaccttcacagatccctacgagctttattactgcttttgcctgcccctttgctgcttgcggtgcttactgaactgtccaaatgaccacatggtcatatataggttattgctgtctttatcttatgttgatcacggcctgctcagctgctttagcgccatgcaaaatggcttgggcgatgcacgcttgaatgggtcgaactgcttatgttttgggagtataaatcacttagcaat

SEQ ID NO: 6258 - DNA, 962 bp, Zea mays
  Predicted polypeptide sequence is orthologous to G137, G145
gcacgagggacgaagctagagggacgcaaaacaagctagctaagctaggaggaagatgggtcgcggcaaggtggagctgaagcggatcgagaacaagatcagccgccaggtgacgttcgccaagcgccgcaacggactgctcaagaaggcgtacgagctgtcgctgttgtgcgacgcggaggtcgcgctcatcatcttctccggccgcggccgcctctttgagttctccagctcctcatgcatgtacaaaacactcgagagataccgcagctccaactactcacaagaagtaaaaactccactggacactgaaattaaataccaggattatctcaagttgaggacaagggttgaattcctccaaactacacaaagaaatattcttggggaggatctgggtccacttagcatgaaggagctcgagcagctggaggaccaaatagagatatctctgaagcatatcagctcaagaaagaatcaaatgctacttgatcagctctttgacctcaaaagcaaggaacaagaattgctggatctcaataaagacctaaggaagcagctgcaagaaacaaggccagagaacgcgctccgtgtctcctgggaggaaggtgggcacagtggcgcaagtgggaatgttcttgatccttatcaggggctccttcagcacctggacaacgatccttccctgcagttcgggtaccatcatcaagcctacatggatcagctgaacaacgaggacctggtggacccgaatgagcatggtcgatctggatggatatgaaatgctctgatgacccaaaataaagttgatgcacagcagggattcaccctgcaggacgcgagactatgtattgaagctaagacctcgtgtgtgttgtgttgtgtgcgaagcttggaactttataaatcgttgtcatgcccatggcgttctatttaaaaaaaaagggggggccgggtaccca

SEQ ID NO: 6259 - DNA, 1179 bp, Zea mays
  Predicted polypeptide sequence is orthologous to G1382
gcacgagaagaccctaccctggggatgactctaatgatgatgatgacttggactcaaaacgcaggaaaatggaatctgctggtatcgatgctgctttgatgggtaaaccaaatcgcgagccccgtgtcgttgtacaaactgttagtgaagttgatatcttggatgatgggtatcgctggcgcaaatatgggcagaaagtagtgaaaggaaaccctaacccacggagttactacaaatgcacacatacaggatgcccagtcaggaaacatgttgagagagcatcacatgacccgaagtcagtgatcacaacatatgaaggaaaacataaccatgaagtccctgcttccaggaatgcaagccatgagatgtctgcagctcccatgaagccggtggtgcatcctattaacagcagcatgccaggctttggtggcatgatgagagcatgcgatgccagggccttcaacaatcaatattctcaggcagccgaaagtgacaccatcagtcttgaccttggtgtaggtatcagccctaaccacagcgatgcaacaaaccagatgcagccctcagttccagaacctatgcagtatcagatgcgacacatggctcctgtgtacggtagcatgggacttccaggaatgcctgtgccagcaatacctggcagcatgtacggttccagagaagaaaaaggaaacgaagggtttactttcaaagctgcacctttggaccgatcagctaacttatgttacagtagtgctggtaacttagtgatgggtccatgagtgcctcttctgatggctatacctccatgaatcacacctatcaccgtcgtcatgaagttctcttcagaagatgctcctctacttcgtatcgtccgcacataattggaggcggtcaaggtatacctgggagctgcagcgatggcacatgatgtcttttgctgtgtggatgaactcgctgtatgtgacgctgcagctaaacattcgttgtacagcaaaccagttatgattaattagattatgataatttggttatgtaaacttctttctggacataaccgaagagccatctggtggcaaagctttgttatctcctgcatatgaacgatgccagtttgacattcatatgaaatgaaatatatcatttcccaaaaaaaaaaaaaaaaaaaaaaaaaaaaaaaaa

SEQ ID NO: 6260 - DNA, 817 bp, Zea mays
  Predicted polypeptide sequence is orthologous to G1382
cactcacctctccacacccccccgccaatggccgattcgccgaaccctagctccggggacctccccgccggccccgggggctcgccggagaagccggtcctggcggatcgacgcgtggccgcgctcgccggcgccggcgcgaggtacaaggccatgtcccccgcgcggctgccgatctcgcgggagccatgcctcactatccccgccgggttcagccccggtgccctcctcgagtcccccgtcctcctcaacaacttcaaggttgaaccgtctcccacaactggtactctaagcatggctgcaatcatcaacaagagcactcatatggacataatgccttcacctagggataattcagctggtagtggccaggaagatggaggttctcgggattttgaattcaagcctcatctcaattctcatttggcggctccttcagtcaacaatcaaaaccatcatgacactatgcaaaaatatagctcaaatcataccacaccatctagcaatttgaagactgaaaataaacctctctgttcacgggaatcgagtcacacagcacatgcttcaattgctccaaaccaaactgtttcgatagtttgtccgtctgacaacatgcctgctgaagttggtacaatggagatgcaccagatcaatagttctgaaaatgctacccaggagacacaaattgaaaatgtagctgaaaaatcagcagaggatggctacaattggcgtaaatatggacagaagcatgttcagggaagtgaaaatcctagaagttattacaagtgcacgcatcctaattgtgaaagtaaaaagc

SEQ ID NO: 6261 - DNA, 557 bp, Zea mays
  misc_feature (549)..(550): n is a, c, g, or t
  Predicted polypeptide sequence is orthologous to G1389
aatcaaaattatataaattagagaaacaatccgggtaggaatcattccgacccaccaatccgggacaaacgaacaaggcctaaagaattgcttgttggcatggtgttcaacaggtggagtaacttacgcctgaccggctgagagctgctatgcagctacaggtgccttcagctcagctccggggcgaagccaggaattacatgtagggaggccggccgaaagagccatcttgtaaaaaattatcgcggttcaactggtttggttactcgcacttagcggctgtctgagttaatacttgacaaaaaaaaacaagcacagctcaactggttaggtttctcgtagtggtggtggtcgttcggggttaattcatcgacttgacacggttgctcctatttttttctatatggattatagatagggagggtttattgtattttgatcgtagacgctaatcataaactgtaatgaatggacgccttcgttctctctgagtacaaaggccccattgaaatatgcatgagaaataaagcaaatttagaggaaataaannaaaaaaa

SEQ ID NO: 6262 - DNA, 1351 bp, Zea mays
  Predicted polypeptide sequence is orthologous to G140, G146
cccagagctaccacccctcttatccccacccctcctcctcctaccttttctccttcagacctcaaaatctgtgtgataggaacaagagcatgcacatccgagaagaggaggctacaccatccacagtaacaggcatcatgtcgaccctgacttcggcggggcagcagaagctgaaggagcccatatcccctggtggcggctccgcgtcggtcgctgggtccgctgcggagaggaacaacggcggcaggggcaagggcaagactgagatcaagcgcatcgagaacacgaccaacaggcaggtcaccttctgcaagcgccgcaacggcctcctcaagaaggcgtacgagctctccgtgctctgcgacgccgaggtcgcgctcatcgtcttctccagccgcggccgcctctacgagtacgccaacaacagcgtgaagggcaccattgagaggtacaagaaggcaaccagtgacaactccagcgcagctggtacgattgcagaggtcaccattcagcattacaagcaggaatctgctaggctgaggcagcagatcgttaacttgcagaactccaacagggccctgataggtgattctatcacaaccatgagccacaaggaacttaagcacttggagactaggttagacaaagctctcggaaagattagagcaaaaaagaacgatgtgctgtgttctgaagtcgagtacatgcagagaagggaaatggagttgcagaatgacaacttgtacttaaggagccgggttgatgagaatgaaagggcacaacagacagcgaacatgatgggggcaccatcgacaagtgagtatcagcagcacggttttactccttatgatccaataaggagcttcctgcagttcaacatcgtgcagcagcctcagttctattctcagcaggaggaccggaaagacttcaacgaccaaggtggaagataaatattggacctctcaagcttcagtacttatccgtgatgatgcatgacgtactgccagtgagaaactgagctacattactgtggaattatatgtaaagactagtactactgcttcatatgtgcatggcacacgcgcacgtagtatgcacaatttcatcccactattatggcttggcaccaactatgtctccttaattatcataggagaaaaataagtcacgcacaaaaaaattctaaagatgaggcgcagtgttggatgactgaaactgaaagataggattctcgtggatggcggtggtcatatacggcctgttttggttgatgtacccgagcgcacccgcggaatcttaaagcaagttgtgtttaattgactgcactttatatacgggttgaacagatgta

SEQ ID NO: 6263 - DNA, 1083 bp, Zea mays
  Predicted polypeptide sequence is orthologous to G140, G146
cttgcttgcttattgcaagtctctgcaagaacctgctagagaggaacaagctggtatcgtcgccagcatgggtagaggaaggattgagatcaagaggatcgagaacaacacgagccggcaggtcaccttctgcaagcgccgcaatgggctcctcaagaaggcgtacgagctctccgtcctctgcgacgctgaggtggccctcatcgtcttctctagccgtggtcgcctctacgagtatgccaacaacagtgtcaaggctactgttgagaggtacaagaaggcacacaccgttggctcttcctctgggcccccgctcctagagcacaatgcccagcaattctaccagcaagaatcagcaaaactgcgcaaccagatccagatgctgcaaaacactaacaggcacttggttggtgactccgtgggaaacctgtcactcaaggagctgaagcagctggagagccgccttgagaaaggcatctctaagatcagggccaggaagagtgagctgctggctgcggagatcagttacatggccaaaagggagactgagcttcagaatgaccacatgaccctcaggaccaagattgaggagggagagcaacagctgcagcaggtgaccgtggcacggtcagttgcagcagcagcagctgccaccaacttggagctgaacccattcttggagatggataccaaatgcttcttcactggcggccccttcgcgacgctggacatgaagtgctttctccccggcagcttgcagcagatgctggaggcacagcagcgccagatgctcgccaccgagctgaacctcggctaccaactggcgccgcctggttctgacgctgccaacaataaccctcatcatcagttctaaactggatgcatgtacgagaagcttttcaagcgaactgtgaacggtggaagctggctgttgcctctagatgttcttggcttccatgacctagcttattacggtgtgtattgttgttgccttttgtgtgtgattctccttgtgctactctacctgatggagaactaaacctaatcgattggacataatgatcaaatgctacagatcctgtg

SEQ ID NO: 6264 - DNA, 1166 bp, Zea mays
  Predicted polypeptide sequence is orthologous to G140, G146
gcacgagctcttccctgcagatcgagaggcactgcacaccaccaccaccaccaccaccaccaccacaccatgctcaacatgatgactgatctgagctgcgggccgtcgtccaaggtcaaggagcaggtggcggcggcgccgacgggctccggcgacaggcaggggcaggggagaggcaagatcgagatcaagcgcatcgagaacacgacgaaccggcaggtgaccttctgcaagcgccgcaacggcctgctcaagaaggcgtacgagctctcggtgctctgcgacgccgaggtcgcgctcgtcgtcttctccagccgcggccgcctctacgagtacgccaacaacagtgtgaagtccaccattgagaggtacaagaaggccaacagtgactcctccaactctggcacagttgcagaagtcaatgcccagtactaccagcaggagtcctccaagctgcgacagatgatccacagcttgcaaaacgcaaacactaggaacatagtgggagattccatccacaccatgggcctcagggatcttaaacaaatggagggcaagctggagaaagccataatcaagattagagctagaaagaatgagctgctatacgctgaagttgactatatgcaaaaaagggagatggatctgcagactgacaacatgtacctgaggagcaagatcgctgagagtaatgaaacggggcagccggcgatgcacatgacgatgggagcgccgccgacgagcgagtacgaccacatggcccctttcgactcgagaaactttctgcaagtgagcatgcctcagcactactcccatcagctgcaacctacaaccctccagctcggatgatgaaatcagcgctatacctggcggcgcccggcccccaatcgagatagatcacgcatgcagttatatcatgtgccaaatcgagatctcaagtaactctacgtacgtttgcttaattattaataattgtgattagtgcaactgttagggtatatatatttgtgagtgccaccactgtgtgcgtgcatttgtacgtgtgaatttagctgttgcatctactactattgtaccctccggccaggccatatcatcagaaacgcgggtttatttacgcatacttatatatatatatgatttgtgtgctttatatagattgaaaa

SEQ ID NO: 6265 - DNA, 965 bp, Zea mays
  Predicted polypeptide sequence is orthologous to G140, G146
caggaatgggctgctgaagaaggcctacgagctctccatcctctgcgacgctgagatcgctttgatcgtcttctctacccgaggccgcctatatgaatattccagtaacagcgtaaggtcgacgatcgagaggtacaagaaagcctctgccagcacttctggaacagctccagtgacagatgtcaactctcttcaatactttcagcaagaagcggcaaaactgcgccagcagatacaaaccttgcagaattcaaacaggcacctgatgggtgaatctactggcaatatgactgcaaaggagctaaagggccttgaaagcaggcttgaaagaggcattgggaggatccggtccaaaaagcatgagctgctgctcgcggagatcgaatatatgcagaagagggaagcagatctgcacaatgaaaacatgttcctgcgggccaaggttgcggaggctgagcgagctctggagcaggaggcggcagaagaccagacgatgatggtgccggcggcggtccgcggggctacgacggagctgaaagcgttgccggcgtcgttcgacgcgagtggctactaccagtaccagcagcatcagcatgtggtggccgccgcctccgctgcctcctcgtcgcagtacgcggagcagccccagggtcagcaggagtaccaccaccagactgccctccacctcggctaccacgttaagatcgattccgccgccgacaaaggcttcctctaggcgctcgcgcgcatgcatgcgtgaagcgtctcatctcataatctgacgtacggacgatgggtgccggacagctaaggtaaggcacattgtcatcgcctgaccatggagtggagtggttgttgctatatgtgcttctatatagagagaaaataaggggtagatccgcgagtacctatgtacgcaagctgtatcaaacaatattgtcatgagatatatagattgactatat

SEQ ID NO: 6266 - DNA, 1231 bp, Zea mays
  Predicted polypeptide sequence is orthologous to G140, G146
ctcacatcctctttcagttccctctctggatctcttcctgaagagaggcactactgccacaccaccacgccacccatgctcaacatgatgaccgatctgagctgcgggccgtcgtccaaggcggcgaaaggagggcagccggcagcgacgacgggctccggcggcgacaggcaggggaggggcaagatcgagatcaagcgcatcgagaacacgacgaaccggcaggtcaccttctgcaagcgccgcaacggcctgctcaagaaggcgtacgagctctcggtgctctgcgacgccgaggtcgcgctcgtcgtcttctccagccgcggccgcctctacgagtacgccaacaacagtgtgaagtccaccattgagaggtacaagaaggccaacagtgacacctccaactctggcacagttgcagaagtcaatgctcagcactaccagcaggagtcctccaagctgcgccaggcgatcgatagcttgcaaaacgcaaacaggaccatagtgggagattcaatccacaccatgggcctcagggagcttaagcagatggagggcaagctggagaaggccataaacaagattagagctagaaagaatgagctcttgtatgctgaagttgaatatatgcaaaaaagggagatggatctgcagactgacaacatgtacctgaggagcaagatcgccgagaataatgaaacggggcagccaccgatgaacatgattggattgccgtcgacgagcgagtacgatcacatggccccgtttgttgactcgagaaactttcttcaggtgaacatgcagcagcagcctcagcactactcccatctatcagctgcaaccaacgaccctccaactcggatgatgaaattaagaatcttcggccaacaatccatgcacgcaagcacgcagtaaatcatgtgtccaattcagataaaaaaatctactctagcgtttgtataattattaataatcgtgactagtaaactgttatatatatagccatgtgtgtgtggcgcctacatatatgtcatgtggctgtacggcgagtttttctttttcacaagcgtttgcagcagcatttggtgttgctcatcgatcaattaatcgcaagaaattaaacttgtcaccactgtgtgtgcattatttgtacgtgttaatgcagttgttgtatctgttaattgtaccctccatcagataaacgcgggtgcgcgtatgcatatttatgtgt

SEQ ID NO: 6267 - DNA, 1117 bp, Zea mays
  Predicted polypeptide sequence is orthologous to G140, G146
gcactagggcagcttcagcctggccggccggcctgctattaaaccactttgcttgcaagtccaagaaactgctagagaggaacaagctgagatctccagcatggggaggggaaggattgagatcaagaggatcgagaacaacacgagccggcaggtcaccttctgcaagcgccggaatgggctcctcaagaaggcgtacgagctctccgtcctctgcgacgccgaggtggcgctcgtcgtcttctccagccgcggacgcctctacgagtacgccaacaacagtgtgaaggctacgatcgagaggtacaagaaggcacacgccgttggctcttcctctggccccccactcttagagcacaatgcccagcaattctaccagcaagaatccgtaaaactgcgcaaccagatccagatgctgcaaaacactaacaggcacttggttggtgactctgtgggaaacttgtcactcaaagagctgaagcagctggagagccgccttgagaaaggcatctctaagatcagggccaggaagagtgagctgctggctgcccagatcaattacatgggcaaaagggagactgagcttcagaatgaccacatgaacctcaggaccaagatcgatgagggagagcaacagctgcagcaggtgactgtggcccagtctgtcgcagcagcagctgccaccgacgtggagctgaatccgttcttggagatggataccaaatgcttcttccctggcggccccttcgcgacactggacatgaagtgcttcttccccggcagcttgcagatgctggaggcacagcagcgccagatgcttgccaccgagctgaacctcggctaccaactggcgccgcctgacactgacgttgccaacaataaccctcagcagttctacccctggatcaatgagaaagccaactgtgaccgatggaagctggctgttgcctctagatgatattggcttccataacctagcttattatggtgtgtattgttgccttttgtgtgtgattctccttgctactgatggagaataaacctaatcgattgggcataatgatcaaatgctacagcacccgtgaggctgtgatcaggaaaaaaaaaaaaaaaaaaa

SEQ ID NO: 6268 - DNA, 782 bp, Zea mays
  Predicted polypeptide sequence is orthologous to G1419, G43
actatataaattatcttttatttattatatattatatttaaaaattgtccattatagtattctcatgcagtcatgctacgccaggacacgtttgcttgcttgcgactgaacgaataaataaagaacgaaagaatatttggagctatactcctctagcatatcaaagaactcagaagactatcatcaggtaagagtaagaccaccgtccctgtcttgctacgacatcaagtcaggcagtcagctgacgtagagctgcggcacggccaggtgcgggtgcggcgacaacggtgagagcggcggcaggctgcagatcgcccccttcagcgactcatcctcccagaagtagtccgcccctccgcttgcgggctcctgaatccgctccttcttcacctccctaaccatgcacctagcgtcctgctcctgcggcgacctcgccctcttgttaccggccacggtcgcgctgggctgaggaggaggagcaggcgtcgcccaccatgcagcggtgcttaacgcgacctcgttggggaagttgaggatggccttggacccgcgcaggcggaacgcggcgcggtcgtaggcacgagcggcctccacggcggtgtcataggtgcccagccacacgcgcgcgcccttccgcgacgggtcccgaatctcggccgcgtacttgccccacggccgctgccgcacgccgcggtaccgccggaaatcgtcctcctcgggttcagggcagcagtgctgctcctgctgaggaatctgcaacggcggcaatggggatggcgatg

SEQ ID NO: 6269 - DNA, 740 bp, Zea mays
  Predicted polypeptide sequence is orthologous to G1419, G43
aaaaaaatattctatcgcctcctttttcttatcgttctggacacacacatgcagctccaaaagctacgtcaaatcctctaaacgagttcaaagccaggtccgtccgtccataactagaaaccgctaacaattattaacgtctttacacctattgatgcttactgaccgatgtccccttagttaacggtgacctccgggaagccgagctgcgggtgtggcgagagcggcgacaggatcccgaacacgccctccagctgctcccacgtccagctcgacggggtcacgggaaacatctcggggccggctccagcgtccgaagaaggaaagcacgtcgtcaccgtcgaggccggggtggtcgttgtcgcgggaaacagcgacgacgccggcgacccggacgcctcggccttgacggacttggctggctcggctccggctccggccccggccggggccgtggcctcggcgtcgtgcatcagcttccgtttgttctgggacgttgccgcggcttgcggcggcggcggcggcggcgcgaggaaatccgcgccgcgggtgcctacctcgttagggaagttgaggatggccttggcgccgcgcatgcggaacgcggcgcggtcgtaggcgcgcgcggcctcgatggcggtgtcgtaggtgccgagccacacgcgggagccccgcttcttggggtcgcggatctccgccgcgaacttgccccacggccgctgccgcacgccgcggtactt

SEQ ID NO: 6270 - DNA, 1808 bp, Zea mays
  Predicted polypeptide sequence is orthologous to G1421, G1750, G440
gggtaccgggccccccctctagtttttttttcttttttttttttttttttcccacgaaacttattttttcccctttcattgcttaacagtaacagctcaatgaacttgtccactacaatgtctttgacaagcattaccaaataacaaagcaaacacttaggcactataccttaaacataatataacctaccaaaattacctctctgcggccgctaatgggggtgtgttcggcaaagaggaaatctcctgggcacgagcagatccaacttgcccggggaaaaaacccaagatatctctcccctttccaagcacactctcaggggcacgtttatgaaaccaaacaaccctaacatatcaagggcacactccctttcaattcacacgcaaaaatcaacggtttgcaggaagtcgtccatgccgcggccgaggtcgcagccgggcatctccgggaagacgtcgttgatgtcgtcgaggtcgaggtcgatctccatctcctcgtccccgaagtccccgagcaggaggtcatgttcgtcgtccaggccgaagtccgcatcggagagatccagggcgtccagcccggcgcggaagtccagcgggtcgatgtcgggcagctgcaggccgcgcagaaggtcctggtagaactctgggtcctccggcagctgcgctgattcggtcgacggcggggcgggcgtcggctctggggactgcgtgttccgcgcttccttgctcggttcaagcacggacgacggcgacgggtgcgcgaatggagcggtcgaggcggacgacgaggaggaagccgtcggggtgctgccgcttgccggagtgtctgctgaggacgcggccacgggcagcccgcggcggcgccgcttctcgtcggcgaagctccgggaggcggacaggtaggccgcggaggccgcaccagcggtgtcgaaggtgccaagccactgcctcttgccggtgaacgggttgcggatctccgccgcccacttgccccacttgcggagcctcactccgcggtagcgctccggcgccccgccgttggtgcacgcggccacagcggccgccgggagaaccggcttggctggggccttgccgatgaaggcctcaaaagagaagcgcttggtccttgatggggtgccgccggcctcctcgtcgtccgagtcggagtccgagtccgtggcgtcggggtcctcaaataggacacggacgcggcgcctcggctggaccggcgccggcagctgctgcgtccgggacttcaagagggcagcagagggtttaaggccaaactcagacatcttcttagcgttgggcttcttcgccagggccttcttgaggagaacctgttgctggttcaacggagacatctctcttctatctcttccgacggggagaactccaaaacttgtcgccaaaattgccaaaactatggggggaaaacttctaaagaaaaacaagaaactctgggtgcaaaaaaaatgacggagacgagcgcaaatcggccgaatccgtcaatctcctctacagaagccgcacggccttatgtggaggaatccggaatacttcaccccgaacccgtccctgagcatcgacgaggatttgttccagccgttgagccccttgcgcatagatcggccagagcaagcgagggcgcggaggatgacggcgacgacggcgatgatgagcgctacgaccaccagatcggaaaaggggcaagaagacatatacgagagttgtctgcttcttcttctccgacgccggcgacgtcgtcgtcgcctccggcctcccttacacgcgcttaaacggggtgc

SEQ ID NO: 6271 - DNA, 864 bp, Zea mays
  Predicted polypeptide sequence is orthologous to G1421, G1750, G440
ccccaatctcccctttcgtcttctcttcccgctcccgtcccgaaattagcccaccgattagcttgcttgccctggcagatcgaagccgtagccctagccgaggagcgcccatggccgctgcgatcgtggcctgaggcggcggggctcttcccatggggtgaggggatggaccctagcctgaaggaggaggtgatgaaggcggtggaggaggcgaggtccgcggcggcgccgcggtgccgggtggtgcggatcatcgtgcacgacgaggacgccaccgactcgtcttccagcgacgacgagggagaggaggcgggggagcgcgccgcggcgcacccggccgcggcgccggcggggagcgtgaagcgcagccgcgtgctgctccagtccgctgggtgcggggcggaggaggacggcgagggggccaggttcacgggcgtgcggcggcggccgtggggccggtgggcggcggagattcgcgacccgctgctccgccgccgcgtctggctcggcactttcgacaccgccgaggaggccgcggcggcctacgtcgcagcgcgcctccgcatccgcgggcccagcaactcgctccctccgcccgagcaccgcccggccttgcccccacgtcccccgccgccacctcagcagcgggagaagaagctgccgctgccgccgccgccgccgcctctccttccgcttccgccgaagaagcagcagtatccgccaccgcctctgcttccgccgaagaagcagctgtatccgccaccgcttcccctcctcccaccaaagaaacagcagcagcatcaccatcacccgtcaccgcctctgcccacgcttccgccgaaaaagcggctgccgtcgccgcct

SEQ ID NO: 6272 - DNA, 819 bp, Zea mays
  Predicted polypeptide sequence is orthologous to G1421, G1750, G440
ccgtcccctgcctggaccctcccgatccgcctctcctcggattccgggtggttcccattccatcgacgtaccccctagtattcactgcttcggtgttgtgggctccgtagatcgacgtggcaccagaactatccgcgctagctgttgatttatgtcgcctgctctgctgccgctccatggttctgagctcacgtcgtcagcatcctcttcttgctcctttctccagcctgggcaggggggcgccagagactgcgggtttcgcttcaggatctcaggatttggatttggggtgaagtactctgggtttctacatttaggccctcgcttcctactttgccgcacctgagatagtaaaagagttcaagaatcccccccaaatcacagtcagtcttgggtctggtttgggtggatttcattacgtttcctccaagttcaaacagccagcaggatttccgagttgagtctgaagatcttcgcttttccggtttccatcagaagttagagagaacccctattctgatttgccagattccatctgtgctgcagttcttgcgcagttcaagagactgccccaactttatccaaaaagtttcctccgtctcatttgtggtcaatctggaagcggtgtgtcaagatgcggccctcggtgcagaaggtccgcattttctgttctgatcctgatgctactgactcatctgatgatgaagatggccagatcatcgcagtgaagaaaatggttatggagatactagtcccagtgacaaactcgaagacatctaatagtctgaagaccctttgtgcgtgtggagcaaagggact

SEQ ID NO: 6273 - DNA, 925 bp, Zea mays
  misc_feature (624)..(624): n is a, c, g, or t
  Predicted polypeptide sequence is orthologous to G1421, G1750, G440
gagtctcgccgccgcaagcttgtgtaaggtgtaaccctaaccctaaaacacttaccttcgcctccagcaccacgcttccatggaggggcgcggaggctaagtatagccaacctctacaccatatccccatggattgagcggattcccaaggcatgggtacaaaccctcacctgcaagagctggccgcttcggcggtggcggcttctgaaccaccaccgcgggcgcgcgtggtgcggatcctagtgcacgatgctgacgccaccgattcgtcctccagcgaggatgaggcaccgccacttcttcctcggcggaggtcgaggggtggtagcagcagcctgagcgtgaggcgccgtgttatggaaccggctggggcaagctcggccgttcggttccgtggcgtccgtcgtaggccgtgggggcgctgggctgcggagatccgcgacccgcacaaccgccgcagactgtggctcggcaccttcgacaccgctgaggaggctgccaacgcctacgacgctgcgaacatccgcttccgcggtgtcagcgccactaccaacttccctgcggcccgctactcgccccctccaaagccagcgaagcctatcatctcgctgactcctgaacccnggaaggtgatcaccttgccaccggtacctgtgaagccaaccttccctgttcaggtgaaggaagtgggtgggagctggggcggcctgatcaagggagctaggtcggaggtcaaggcgtttgcacccaagccagtatggaagatgatccccagggtgcaccagaagttccgggttgtgccgatggctctgggctgcgtgccgtccatgctgcctccatctacgtggaggaggttggcggtggctgatggtcccagtatctgcaattactatcgctagaggtttttattgtctatctccatggc

SEQ ID NO: 6274 - DNA, 540 bp, Zea mays
  Predicted polypeptide sequence is orthologous to G1435
ttttttttttttttttatttaagttaattttatttctcttcaattttctgtatgggactaaaaactcattactttccccttcaccaaaagcttcgaaatttattctctaataaacttgaacaaaagctttggctttaaaaataccgaataccttggaacgggacggacggagtacagtagaagctttggataatttggagggagtagagtatagagtgaggcaggcaatcgcttgttccgttttggatttgtcttccggtcttccccaagaggaaactagattctggagtcgtcgccgaagcgggtgtcatctgtctcctccccctcctccgttgtacaggtagtggtacgcctggccgctgaccatgggcaccatgccgacggcgacgccgtgcaccggtgtgggtgcgaagatgtggtcggacggggacggaccctgcccccgcatccgcttcacgtacaaccggtacttctgcaggtggctggccacgttctcccgcgtcagaccttccacgttcatcagctccatgatggtcttgg

SEQ ID NO: 6275 - DNA, 863 bp, Zea mays
  Predicted polypeptide sequence is orthologous to G1435
ggtgaaaagggaaaagaaacttctctttctttctttatttcttaaaagagatccatttaccgctcacacgaagaactgaattagcaagagatccaaaaccaaaaggatcgatgggattattgagggatccaatccaacagaagggtcatttgtgggcgtggtggtagtgatggtactggtactggaaccctcctcctcccattccgttgtggttgtggtacgcctgtccgccgctggccatggtgccgtacatgggcacctcatgcaccaggctttgcggcaccggcgtggatgcgaagatgtggtcggacggcgacgggccctcgtcggagaggccctgcatccgcttgacgtagaggcggtacttctgcaggtggctggccacgttctcccgcgtcagcccttccacgttcatcagctgcatgatggtcttgggcaccgcgttcttcatccccaggtgcgccaccacgtccacgaaccgcttgtgcagctgcggcgtccacaccagccggggccgcttgctgctgctgctcatgttattgttgccgttcgtcgtcgccgccgccccgccgcccgccgccgacgagtccgccccttcgtcccccctcgctgccggatggaagggcgcgaaggaggagctccctccgctgcccgacgacgacggcggcggcgcgcgacgcagccgggacaccgtggcagccgacgcgcggtgcacgtccagcagcgtccgcccggcctccggcgggatgcggaacgccgctgccagacccgccggcaccagcggctgcgacagcggggtcagctcgtcggcgcccgggagacctgacttccactccatcacggggtcgttctcgccgccgccg

SEQ ID NO: 6276 - DNA, 836 bp, Zea mays
  Predicted polypeptide sequence is orthologous to G1451
ctcatggatcgttacagagcctgcctggctacattcacaggattagtgtttctccaaacaatagccaagtttcagcatgtgtaccgacagcggctgctggtagtttcttctacttgggagttgggtgtcatatacgactggacagaattattagatggtagtacataacctggaaggagagctaatgctgggtctggtgctgcttccacctcgacgccatggactgcaaaaaacataggaagcgcgaccgagcgagcgggtccgtcacaggccagccctaaactaagctcggggcgcgtaacgagctcctgccttctgtttcagaactcgaccgaacccacggacgcgatcccggtgcttaggctcctcgactcctgcctgctaacgtagccgtcgcagctgctacctagcctccgcgccgcggggccgagctcaggagctccaggccctgcttgcccatctgctgcacctcctgcggcgagagtatctttatgcaggacaccgtgctcgcgaattcccaagactgatggacggtcatggtaaattactgccaagggtcgtcgcccacgagaaggacgtcctcctcgcggtcgacgaatacaagctgccagcctgatctcagagggtcttccaactggccctcaaggccaaataggcgccctagttccctacggagctcgtgatagctactaaacctggtgatatcaagcgaccttccgtaggttccagatttgtaaaccttcacaaaggttgctggtggtcggttcacttggtcagaattatccgaacatggcgggacgtaccctgaatcatctaagcagcctgaagaattcagc

SEQ ID NO: 6277 - DNA, 654 bp, Zea mays
  Predicted polypeptide sequence is orthologous to G1451
gtcggcacggcgaattcccaagagaagctggttattatcattccagataaatatgatagaatcccctgctactagtcttttcgcgcttacaaaaacactccaaccagtcgtcagtagatgcctttttggctgaccacgaaaaatatgacgaaatttccattcattatcatgcagatctcttgcaaccagctcttgcactggaggctgttgtgaaaaatccaatggagggaagactttctcagctgctcggcgcggaacagagaatccaccatgggtactcgtatcacttgcagtcaacgtcttgcagaagtaattggttggctgcttgctaccagcacccaattcaattggaagaaaaggatccttttgctcttccgggctcaatggttgcagtgtcatttgggcatacacctcttcagtctctgcatcagcatgcattgtgacattatgaagctggcatattaactgtggaggtaggtttggatagtttgggatttgagcatcaacttctttattagttgatgcagcaacctgctcactatggccctgaggaaagtagacgacccggctcccaaccacaggcagggacacaaggggccctgcgcatgcatgccatagctctgagttcagacacctttgttccccgtcactttc

SEQ ID NO: 6278 - DNA, 1555 bp, Zea mays
  misc_feature (27)..(27): n is a, c, g, or t
  misc_feature (40)..(40): n is a, c, g, or t
  Predicted polypeptide sequence is orthologous to G1451
agcagaagccccagatgcaacaccagncaagaatcacagncagcagcagcaaccacagtgtctgccagtcccccaacatcagcaaatgcaacaacagaatatgaccaactaccagtctatatctaatgcattatcaccgttttctcagctgtcgccagtttctcagtcttcacctatggcgctgcagactatattaccgttctcgcaggcacagagcttcacagacacgaatgtaggttcattgtctccatccaatggtaacaccatgcaaaacacactgaggccgttctcatcagaagcagtttctcacctcagtatgccgaggcccactgcgatacctgtcgcagacccatggtcgtcgaagcgtgtcgcggtggagtctctgcttccttctcggcctcaggtttcatcccagatggaacaattggaccctgcaccagctagtatacctcatagctctgcgttggcaccacttcccggaagagggtgcttggttgaccaagatgtgaactctgatcctcaaaatcatctcttgttcggtgttagtatagactcgcagtcactgctaatgcaagggggcattcctggtctccaaaacgggaatgattcagctgctataccttattccacttccaatttcctcagcccttctcagaatgactttcctctggaccatacactaaattcttcaggctgcttagatgattctgggtacgtcccgccatgttcagataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcaggaattcgtgagcacggtgtcctgcataaagatcctctccccgcaggaggtgcagcagatggggaagcagggcctggagctcctgagctcggcccccgcgcggaggctcggtagcagctgtgacgactacgtcagcaggcaggagtcgagaagcctgagcaccgggatcgcgtccgtcggttcggtcgagttgggatgagcagcaagatagcgcgcacgcagcagcagcagcagcaggttacgcatcctcagcctcagggtaggtaggggactgaagggttggtctgcgacttgatgacccacgagctcctcgttgcgcgcttcgttcgcctccatgcgatggatagaagttcagcgcagaccaagccttagctctgcgagctatgtaccatctaataattctgtccgtgtcgtaccatgtcaactcctaagtagaagaattgaagaaactaccagcagccgctgtctggtatacacgctgaaacattttttttcttgtttggagaaatactaatcatctggatgtcaacaaaaaaaaaaaaaaaaaaaaaaaaaaaaaaaaaaaaaaaaaaaaaaaaaaaaaaaaaaa

SEQ ID NO: 6279 - DNA, 1067 bp, Zea mays
  Predicted polypeptide sequence is orthologous to G1451
aagcaaaagtttatgggctcacagtcaatgtcttttgggggctcggtttcgcttaactcgcccactagcaaagatggttctgttgacaacaaagttggtcgtgatgtgcagaaccagtccctttttagccctcaagtcgactcttcctccctactgtacaatatggtacctaatcttacctcaaatgttgctgataataatatatcagcgtttccctctggatcaacatatctgcaaagtccaatgtatggttgtctggatgactcttctggtttattgcaaaatacaggagagaatgatccgacaactagaacttttgttaaggtttacaagtcaggatcggtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccctgggagtcatttgtgaatagtgtatggtacatcaaaatactttcacctgaggatgtgcataagatgggaaagccaggaaacgatccacgctacctatcttagctacctatcttaaatcgatacatggagctctttctggctcccatgacgattctgcggcacactgcagcactgttcacgacggcctgctctactgtgctcgcatgttcgcccgtgtcatctctactctctagcatgcacaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgtttgagatttgtacttcaaaaaaaaaaaaaaaaa

SEQ ID NO: 6280 - DNA, 1492 bp, Zea mays
  misc_feature (1459)..(1459): n is a, c, g, or t
  misc_feature (1461)..(1461): n is a, c, g, or t
  misc_feature (1472)..(1472): n is a, c, g, or t
  misc_feature (1474)..(1474): n is a, c, g, or t
  Predicted polypeptide sequence is orthologous to G1451
ccacgcgtccggcacagatgacactacaaccactcaacccgcaagaactgaaggacccatatttacctgcagaattaggttcggccaataaacagccaacaaactatttctgcaaaacattaacagcaagtgataccagtacccatggtgggttctccgttccccgtcgagcagctgagaaagtgtttcctccactggatttcacccagcaacccccatgccaggagttgatggcaaaagatcttcatggcaatgagtggaaattccgtcacatctttcgtggccagccaaagcggcatcttctaactacaggttggagtgtctttgtaagtgcaaagagactcgttgctggcgactctgtcctttttatctggaatgacaataaccagcttctgctgggaattcgtcgtgcaaatcggccacaaactgtcatgccatcttcagtcttatcaagcgatagcatgcatatcggtcttcttgctgcagctgctcatgctgcttcgacaaatagccgatttacaattttttacaacccaagggcaagcccttcagagtttgtcataccactcgtaaagtatgttaaggctgtgtatcatacccgcatatctgtggggatgcgattcaggatgctttttgagacagaagagtctagcgttaggagatacatggggacaattaccggaatctgtgatcttgattctgttcggtggccaaattcacactggcgttctgttaaggttggctgggatgagtcaactgctggtgagcgacaaccaagggtgtcactatgggagattgaacccctgacaactttcccaatgtatccatctccttttccgctcaggctcaagcgtccatggccaacaggcttgccttctctgcatggtgggaaggatgatgacctggctaactctctcatgtggcttcgagataccgcaaatcctggttttcagtcgttaaattttggtggacttggtatgagcccttggatgcagccaaggctggatgctaccttacttggtctgcaacctgacatgtatcaggcgatggccacagctgcttttcaggatgcaacaaagcaggcatcgcccacaatgctgcagttccagcagccccagaacatagctggccgggcttccccgcttctttcaagtcagattttgcagcaagcacatcatcaatttcagcagcaaccgtaccttcaaaacatctctgagagcacaatccaagcacagggtcagtctgagttcctcaagcagcagatccaacgcagccagtcattcaatgagcagaagccccagatgcaacaccagcaagaatcacagcagcagcagcaaccacagtgtctgccagttcccccaaacatcagcaaatgcaaccaaccggattatgaccaataaccagtctatatctaatgcattatcacggtttttcagtggtggccaagttttcagtcttnanctatgggggtngnagatatattaccgttttc

SEQ ID NO: 6281 - DNA, 722 bp, Zea mays
  Predicted polypeptide sequence is orthologous to G1451
gccaacagacgccccacctcgctacggagctcgtcgtagctgctgaatctagtgatgtcgagcaaccttccgacggtcccggatttgtaaaccttcacaaaggttgcaaactgttgatttgcctgttcggcattctctgcacatggaagataatccgactcatctaagcagccagcgctgcgtagcggttgattcaaggggaaatcgttatcagaagggctcaggaaattggaggttgagtatggaatagtgcctgaactgttatcattctgaagggctggaatgcccccttgcatcagaagtgaatgtgagtctatgtgaacaccaaacaagaggtgattttgaggatcagagcacccatcttcatccactaggcattctcgtccaggtaatggtgctagtgcagagctctgcggcatgttacacgtcgccatatccaaatgttctatatgtggtgaaacatgaggtcgacaagggttaacagactccactgcaactctcttggatgaccatgggtcagataccgatacaggggcgttcattgccacacatgggaggctcgaagctgcttcggaaggtaatctccccaacatgccatgcattgaagggccagtagatggtgagagagagctaatgtttgtatctgggaagttttgttgatgcgagaatgctggaactgtctgcaatgcggaaggtggggagtgagtggctggggaaagctg

SEQ ID NO: 6282 - DNA, 768 bp, Zea mays
  Predicted polypeptide sequence is orthologous to G1451
ccttcttgccttgcctgcatttagagctacagtagctatcgtacagcatgtccattaccataatgatacatggatcatcatctagctatattaaacgactaggttattcccgatcaacagggcctgagactgagaggatcataacacaggaacgaaacgacttgcggatggcaaatcctgcaaatgctggattgccggttttggttcagagcttcagatcccggccttcgcctcagtcctcttcagtagtccagaggcaccacaggcgcaatgctgccggtgaggttctgcacgtcgtggcctgcagaatagtcgtcacagacactgccctgcagcatcctcgctccaggcgcagacagaaggtcacctccgccgccgcgggccatctgctgcaggtcttgcggcgagaggatctttatgcaccctacgctattcacaaactcctgccacgggtcgtcgccgaggagaagaacatcgttttcccggtcgacgaatacaagctgccagcctgatcttgcagggtcctccagttggccttcgagaccaaataaccgctcgagctcgacacgcaactcgtagtagctgccgaatctggtgatgtcgagcgatctcccgagggaccctgatttgtaaaccttcacaaaggttccaccttgtgatgggtttacaccacaaacatcgtcaagagaattgaaggttcctgattcacccaaacaactggaagttgctatggagttttcaggtagcaaattcgcatcactatatctc

SEQ ID NO: 6283 - DNA, 863 bp, Zea mays
  Predicted polypeptide sequence is orthologous to G1451
caggaaccttcaattctctcgacgatgtgtgtggtgtaaacccatcacaaggtggaacctttgtgaaggtttacaaatcagggtcccctgggagatcgctcgacatcaccaggttcagcagctactacgagttacgtagcgagctcgagcggttatttggtcttgaaggccaactggaggaccctgtaagatcaggctggcagcttgtattcgttgaccgggaaaacgatattcttctcgtcggcgatgacccgtggcaggagtttgtgaatagtgtatggtgcataaagatcctctcgccgcaagacgtgcagcagatggtccgcggcggaggcgaccttctgtctacaactggagtgaggacactgcagggcagtgtctgcgatgattattctgcaggccacgacatgcagaatctcaccggcagcatcgcacctgtggtgcctctggactactgagaccgagatgaagaccagaaactgaagttctgaaccaaaaccggcaattcagcaccgcaggattgccgtccacgagtcttttcggttcctatgatctatcttctctcaagttgtgttggtcagaaataacctagtcgttaatatagctagatccattgtatcattatggtaatggacatgttgtacgatagctgttgtagctacgtgtagccatagcctaagctctaaatggcaggcaagaattggtctatgaaagtatggatgcaggcactcactgtagaggtgacctagccctgtagttctctatatcttctcatatctaaaagctgacggttccatgtggcgcctaaactattgaaccctgtcacctttgtcatatttttttcaccttcattcgccggttgt

SEQ ID NO: 6284 - DNA, 938 bp, Zea mays
  Predicted polypeptide sequence is orthologous to G1474
ccacgcgtccgaaattgctgacctccgtcatcagcatcttctctctctctctctctctgctgagctgcttactcattccagcttcaattttctttgtccgtgatctagctagcttgcatgtctctctagagtcgatctgaatcgatacaattgagactagctactacgtgtttgcagatgcatagctagctagctctcaatcacatgaactcctccagcgccaccgctatggatcaaataggcaagtactggggcatgtggggagcaaggagaagcagcagcagcagcagcacgatccccatctctgcttgggctgcggcgtacggcggcagcagcgagccgtcgtgggaggagcaggccttcgcacgcgacgcggcggaacacctcggcggctgcgtctggccgccgcgctcctactcgtgcaccttctgccagcgcgagttccggtcggcgcaggcactcggtggccacatgaacgtccaccgccgcgaccgagctcttctccggctggggggctcgtcctcccccgaggacgtgcacgccaccaccaacgatcagccacacccgcagcaaggtgctctcctgtacagggcagcagcctctaaccctagcactaccacgccgagtactactgcagctgcaggtactactgctgccggcccagcagcagccataaccatagcaggtgcaggggatggagatgccaacaccaccaccaccactacttacttgtcaagaattatcaaggagagcaagaacaagcgcttcatgcccatgccagatcactctgtcgcggggatgagagaagatcaggcggcggccatagatgatcatcgtcataatgaagatggcgacagctggcggtcagcctcagccgcggaaaagaggaggcgtctggatcatccgttggcaacggcggcggcgcttctgatctttgt

SEQ ID NO: 6285 - DNA, 664 bp, Zea mays
  Predicted polypeptide sequence is orthologous to G1474
gcaagcaaatgaagagtgtgacacgcggatttgttttaccgaggttcggttctcgcaaacctactccccgttgaggaggccacaaaggccgggtctctttcaacccttccctctctcaaacggtccctcggaccgagtgagcttctcttctcaaatcacttgggaatcaaacttcccgcaaggaccaccacacaattggtgtctcttgcctcaattacaagtgagtgtttgatcacaagaaagaatgcgaaagaaaagaagcgatccaagcgcaagagctcaaatgaacactacaaatcactctctctagtcactaaggctttgtgtgaagttgggagaggatttgatctcttttggtgtgctttgcaatgaatgctagctcttgtatagtggttggaagctggaaaacttggatgcaatgaatggtggggtggttggggtatttatagccccaaccaccaaacatgaccgttggtggaggctgtctgtcgtatggtgcatcggatagtccggggcacaccggacatgtccggtgcgccagccacgtcaccaaagccgttggattccgaccgttggagcttctgtcttctgggcccgcctgagtgtccggtgcacaccggacatgtactgttcaatgtccggggtgccagtgcgcgcgtgcctg

SEQ ID NO: 6286 - DNA, 1262 bp, Zea mays
  Predicted polypeptide sequence is orthologous to G148
cccgagccggctcattatatcgtccgtcgcgcagacaacgcaagtttgctagcggccggatcagcagccacagcgcgaagagagcaaccacgctgcacacagaggcgccgtgtgtgagatagagcaagctcgatcgaaggaaggagggaagctagagatcgtacgttcgccatggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccggcataacaaaaactttagaaaggtaccaacattgctgctacaatgctcaagattccaatggcgcactctctgaaactcagagctggtaccaggaaatgtcaaaactgagggcaaaattcgaggccttgcagcgcactcagaggcacttgcttggggaggaacttggcccactgagtgtgaaggagttgcagcagctagagaaacagctcgaatgtgctttgtcacaggcaagacagagaaagacacaacttatgatggagcaagtggaagagctccgcagaaaggagcgacacctgggagaaatgaacaggcaactcaaacacaagcttgaagctgaaggttgtagcaactacagaaccctgcagcatgcagcctggccagctcccggcagcaccatggtggagcatgacggcgccacctatcatgtgcatccaacaactgctcaatcggttgcaatggactgtgaacccactctgcaaatcgggtaccctcctcatcaccagtttctgccttccgaggcagccaataatatcccaaggagcccccctggaggcgagaacaacttcatgctgggatgggttctttgagttgctctgttaatcatccatccatcagatggatgtccaaactaataaaaggcactcagtgctaccatatgcatatccatgcttaagtgcttgatttgccacgacgtggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttatt

SEQ ID NO: 6287 - DNA, 1262 bp, Zea mays
  Predicted polypeptide sequence is orthologous to G148
ctcgtgcgctgatattccgctcctgtccctgtgtcctccccggatggagctagagccggctctgctcatcattatatcgtcgcgcacaaatgcagcacttgtgttcgtgggggtgtgtggcatattagctagcggataagcggccggccgggcagctagcagaagagagcaagctcggacctcggatcggaggaggtcggcatggggaggggacgcgtcgagctgaagcggatcgagaacaagatcaaccgccaggtcaccttctccaagcgccgcaacggcctgctcaagaaggcctacgagctctccgtgctctgcgacgccgaggtcgcgctcatcatcttctccggccgcggcaagctctacgagttcggcagcgccggcgtaactaaaactttagaaaggtatcaacattgctgctacaatgctcaagattccaacaatagtgcactctctgaatctcagagctggtaccaggaaatgtcaaaactgagggcaaaattcgaggccttgcagcgcactcagaggcacttgcttggcgaggaccttgggccactgagtgtgaaggaattgcagcagctagagaaacagctagaatgtgctttgtcacaggcaagacagagaaagacgcaagttatgatggagcaagtggaagagcttcgcagaacggagcgtcacctgggagaaatgaacaggcaactcaaacacaagctcgaagctgaaggctgtagcaactacacaaccttgcagcatgccgcctgctggccagctcccggcggcaccatcgtggagcatgacggcgccacctatcaagtgcatccgcctgcccactcagttgctatggactgtgaacccactctgcaaatcgggtaccctcatcaccagtttccgccccctgaggcagtcaataatatcccaaggagcgccgccacaggcgagaacaacttcatgctgggatgggttctttgagttcttctgttaatccatccatcagatggatccatgttgaaaccaataaaaggcattcagtgctatatatatcatatgcatatccgtgctcaagtgcttgatttgccacgacgttggattgtatcgttctgtgtgtaatagctaatttagaacggcacatctattctatgtggttgtggtgtggcacttatactgtttattcatttggaccatgaatcggggtagtttgtaaaaacacatctatatatgctgccggtgcatagaattaaagttatctgcaccgtaattattat

SEQ ID NO: 6288 - DNA, 795 bp, Zea mays
  Predicted polypeptide sequence is orthologous to G1480
gatagacaacccagtaaagttgtatcttacaagacacaataaattccctagttcgttcaccaactggtgatgacccatcgaaattccgcgccatcatttaaaaatagcgatggcggaatttcaccacgaatgctgctcacatgaatgacgacacgacacaaacgagaagggcggttgcttaacttgcttcaagctgggcgaacgccaccgtcagaagcccagaagcgctgctgtgatgccattcattttcaaggcacgaactttctagaagcttggcacgaccccgtaggccccggcgtccacgaagaagccgtccctggcgtcgtcggagaaggagagccagaacttggcagcagcgtcgatgctgtccgatgtgccggcgcccgaggaggaggaggaggaggtgccggcggcgcgcttgacaaagcggcccttgatcctgggccgcgcctcggcataggccttgcgggacgcgtagcggatggtcttctggaacttgcgcctctcgcgcttctcgcggtacctctgcaccctcgcctcccgctccgccgccgccgcggcgaccacggcggcgccctggacgacgacagtgggcgaccacgtggccgtccatgcggcggcgggcagaccgggctgcgcccacagaggtgcagcgccgtgatggacgacgggcgccacgccgtccggcaggtagccgccgccgcccgtgacacaggccgcgaggtcgacgtcggacagcaggtcgaacaggcccctgccctccgcgccgctgtcgccggtggtggagctcgccga

SEQ ID NO: 6289 - DNA, 720 bp, Zea mays
  Predicted polypeptide sequence is orthologous to G1480
ttttttttttttttttttttttttaagacaacttggtgcgcggtatagattggtgatccattagcagcggctactgcagtttcttactagtagtacaaattatacatcactagtttacgcaagagcttgctcaaaaagagagtacatgggattactactcctccctatacatcgatcgatacaagtacaaggcgcgcgcgcagcggcgtgccatgccggttcaagcgcgcggccggccatgtgcgcgcgtgttgggcccgggcacatcaaaagctcggtacgacgccgtagccgaagtcgagcacatatgacatcggcacggcggcctcggcctcggcctcagcgtcgtcggcgtcggcgtccccgtcgtggtcagcacgcttggcaaaccggcccttgattcgcggccgcgtctcggcgtaggccttccgggacgcgtaccggatggtcttctcgaagcgcctgttcttccttttctcacggtaccgcatcaggcgcgcctccctgctctcccccatcagcggcaccggcctcaccgcagccaagtctccccgctccggcaccacctccacgtccgcggatggcacctgcatacggaaccgatcgagtccgcaacgatacgtcaggacgagcacatggagtgtctaacggatgtgcgtcccgaaagttgggagcttggttggggtcctacgctgtggctctggggagtcccggtgtatg

SEQ ID NO: 6290 - DNA, 803 bp, Zea mays
  Predicted polypeptide sequence is orthologous to G1480
gtctccgcgtacgccttgcgggacgcgtaccggatcgtcttctcgaaccgcctgctcttgcgcttctcccggtaccgcatcagccgcgcctctcgctccaggcccctgctgaccactgccaccatgggcgccatgccagacgccgcgtcgggcacaaccgctgcctccgacgatgacacactgtggttcacggagtgatcggagtagaagagcttggtgccggcgaggtcgagctctggtgacccgctctgctggacgccgatggtcttgatttcgtccatggaacgcgcgaagtcgaggtcgaggtacgggtcagagtccgcgaagaacacctccgtcgtggcgccttctttctgcccgtggtcgggctcggggaggagccacgacgccgcctcgtcctcgttgctcccgtcgtcgtcggttgctttgggcggcgccgccgaggcgaagggcttgggcgcgtcggccagcgcgccgaagaagggcgccacgtggaggcgctcgtggcggcgcgcgagcgggttcgccgagtggatgtcggcgtcgcaggaggcgcagagcgcggcagcgtccgcgcggcacgtgaccgccgccggcgcgtgctcgcagacctcgcagagccagacccgcgcgtggcgcgacccggcgccgtgcgcccgcgcgtcgcacccggcgcacaggaacgccgcgtccgcgcggcagtagaggcgcgccgcctcggcgccgcacgcgtcgcagggccgcgcgcccaggccccagtaagcaggggccccgcccgccgacttctcgtcaccctccatcgc

SEQ ID NO: 6291 - DNA, 873 bp, Zea mays
  Predicted polypeptide sequence is orthologous to G1480
gcacaattgcacaaacgcaagaagctcaacaagacaagaaactgaggcaagaccaagaagaagaggaggaagaagaaaaaggcctagaacaagatgggaggcgaaggcagcacaagcccagcgcctgggggagccgcctgcgcggtctgcggcggcgccgcggtggtgtactgcgtggcggacgctgcggcgctctgcagcccctgcgatgccgctgtccacgccgcaaacctgctggcgtcgcgccatgagcgcgtgcctctttccatggccgccgtgccgtccgcatcaggcgcgtacgacgacctgttcgcgcccgacgacgtcgacgcggcggcgcccgcgcaggcgcaggggctgggcagcccccggaacggcagctcgtcggcgagcttcaccaccagcggcgacagcggcgcggagggcagcagcctgtttgacttcgacctgctgtctggcgtggacctcgcggcctgtgtcacggacggcgtggcgcccctccaccacgacgacgctgcaccgctgtgggcgcagcctggcctggccgtcgcgtgggcgaccgcgtggtctccggcggactccgccgccgccgtagtcgccgcggcggcggagcgggaggcgagggtgcagaggtaccgcgagaagcgcaagaaccgcaggttccacaagaccatccgctacgcgtcccgcaaggcctacgccgaggcgcggccgaggatcaagggccgcttcgtcaagcgcgccgccggcacctcctcctcctcctccttcggcgccggcacacccgacgacggcaacgacgccacgggcgccgctgccaagttctggctctccttctccgacgacgccagggacggcttctacgtggacgcc

SEQ ID NO: 6292 - DNA, 808 bp, Zea mays
  Predicted polypeptide sequence is orthologous to G1480
cagccatttctaacgcttacgcaacccagtccgcccgtgtctctggtgacaccgacacccgtggcatctctctcgtgactcccggagcagaggcatggacaccgcggcggagctggagctggggctggagttggagcagaagccggcggcggggtactggagcgtggtgggcgcgcgcccttgcgacgcgtgcgccgcggagccggcgcggctgcactgccgcgcggacggcgcgttcctgtgccccggctgcgacgcccgggcgcacggcgccgggtcgcgccacgcgcgcgtctggctgtgcgaggtctgcgagcatgcccccgccgccgtcacctgccgcgccgacgccgccgcgctgtgcgccgccacgagcgcctccccgtcgcccctctcttcggcgcgctcgcggacgcgccgcagcccttcccgtccccggccttcgctgccgccgcgggggccgaggccccagctcagggggaagcggtggcggaagactacgggagcagcgaggccgaggcggcgtcgtggctgctccccgagcccgacaacagccacgaggacagcgccgccgacacgttcttcgcggagtcggacgcgtacctcggcgccgacctcgacttcgcccggtgcatggacggcgtcaaggccatcggcgtgccggtcgcgccgcccgagctggacatcggtgccggcagcttttgctacccccgaacactccatgaaccacattttgtcgtcatcctcggaggtggcggtgggaccggacgcgcaggcggccggcctgccggtggtggtggtggtgagc

SEQ ID NO: 6293 - DNA, 873 bp, Zea mays
  Predicted polypeptide sequence is orthologous to G1480
catcacaaacaattcagtttcattcaccagagtatatagtccaacaaagagacatcaaagaaatttcttatgcacagcttttcttattgcaattatttcccaatcaagacacatcaaaagggcagaccaattgctgatggctcggcgcccatatgagtagggtctggaaaagggaaggcaattcttcccccgcaaatgccgagagactgcttcgaacccgcgacctagtgactcagtgagttctcaccactgcaccagacataaccttttcccaatcaagacacatcaaataaaaaaatatactttcgtgaacttatcccgttacaactcaaatagtgcatactgcatacaatcttatcttacaggtaaaaagagaactacagtgcatgttttttacactctcgagacatctacaaaattgcccttcctatcaagaatatttcaagcagcaactacagaaatcttgggccgttcagcttgtgcatcaacaagtcgcatcaaaaaatttccccctcaactagagttgcagaagttttgccaaacttggtggctacttaaggttcagttgctactggctctgattgtcatgatctgggcactggtattgttagcattgcaatgaagtttctccctcaactgctgttttccggcaattttgccatcttggtggcaattagcatttcatttgtttctttagataattgctagctagagtcttgatgactaaaccaaaaggccagaaactccaaaaagtggcatttacaaatccttccttaatcgtacttggcagtgtcccagagatgatgagtcagacaggcaccacagctccggatctcccaaaagaaatcatgagacttaacaacgcttacttcc

SEQ ID NO: 6294 - DNA, 722 bp, Zea mays
  Predicted polypeptide sequence is orthologous to G1488
tgcgcctggagccgctgccccacgcgtcgcacgcggtggggccgaggaccaagggcttgcggcggctccggcgggtgacggcgccgtggagcgtcccgccggtcctgccgccgcccgcgggcggcggcgcgccgcggcgccggtgcacgcactgcgcgtcggaggagacgccgcagcggcggcagggcccggcggggcccagcacgctgtgcaacgcgtgcggcgtgcgcttcaagtccgggcgcctgttccccgagtaccgccccatcctcagccccaccttctccccgctgctgcactccaactcgcaccgccgcgtcatggagatgcgccgccacgtggaggcggaggaggccgcccccgcagccggccgcgccggcgccagggtccgccgcgccgagcgtcgccgcggcgcgcgccgccaagggcgagtgatggcgcagctttcgtttggcgatggaggcgaccggagaccggccatgattacctgacctccgctccttttatctccgtagttttcgttcgcaattctagtttttgttaggactgggtaggattaggaggtcgatgcagcagctgcagacgagagggagggaagagcgtcgtcgtgatcaaatgtcctgtgcaaccgttgcttctgctgtaaacaagactcatggaggtcaccaaactgctctagtccatccgctgtagtctatccgctgtagcctgtagggattgga

SEQ ID NO: 6295 - DNA, 905 bp, Zea mays
  Predicted polypeptide sequence is orthologous to G1488
ctgttctctcaaatcagctggattacacctagtaggctctggctagctagtggaccaagggcttgtcgccgtcgacaagcagtggcgccgacggcccctccagcagccgcgagtccagagagctcggcgcgttgttgttcaggtcacttcccttgcctccgccgccgccgtgtcctgcatctgccgcagcgtcgaccatgtccccaacgcgcagctcgccgctggcaaggctgccgtccaccaccggatgcggcagaggctggtggagcggcgtcggcgggtactcctccttcacctgccaccgctggggaaactggaggacgtccatggctcgcggatgctccgcgggcagagggtggtgctggccctggctcttccgctgccggtggagctgcatcacctggctgtgcttgttggcgtgctccgacggctcgaaggtggggctcgccagcggccggtactccggcagcaaccggccctgcctgtaccgcacgccgcacgcgttgcacagcgtgctgcggcccagcggcccttcccgccactgcggcgtcgacgacgacccgcagtgcaagcactgcttcgccgacttcgggggccgccacggcttcctcgccgaagccgattttttcttcttcttgacgaggtacaccgctggcgctagcggcggcgccgccgcgggtaccgtcctcggaggcggcgggggtctcccccgtttcagaggcttcttcctcaccaggcgcgggagtgtgtggaccgggggccggggcctggcgcacgggcaggcgctggtgacgaggacaggaacggtcctcctcggacggattattggcctgcgacgctgggggaacggcctcttcgccttcctcggcgcggggacggggagcctgaaggccaccagcccgacg

SEQ ID NO: 6296 - DNA, 769 bp, Zea mays
  Predicted polypeptide sequence is orthologous to G1488
acacgaaaaactttgccgaaagatgaacagagatacgcacaaccaaagacgatgaagttgccgagacaggaaagagaaggtccaagaagattactattctctcaaatcggctaggctggaagccggattgcccctagtaggctctggctagtggctagctaatcgatcaagggatcgtcgtcgtcgacaagcagcggcgccgacgggccctccagcaggagcgagtccagagagctcggcgcgttgctcaggccattgccgttgccgccgccgtgtcctgcatcggcgtccgcatctgccgccgcgtcgaccatgcccccaacgcgcagctcgccggcggcgaggctgccggccaccaccgggtgcggtagaggctggtggggcggcgtcggcgggtactcctccttcacgtgccaccgctggggaaactggagcgcggctgtgggtcgcggagggtgcttctccacgggcagagggtgctgctgctggtggtggtggctctggctcccgctcctccgctgccggtgaagctgcagcacctggctgtgcctgttggcgtgctccgacggctcgaaggtggggctcgccagcggccggtactccggcagcagccgcccctgcctgtaccgcacgccgcacgcgttgcacagcgtgctacgccccagcgggccttcccgccactgtggcgtcgacgacgacccgcagtgcaggcactgcttcgcggacttcgggggccgccacggcttcttcgccgaggccaccgagccgg

SEQ ID NO: 6297 - DNA, 880 bp, Zea mays
  Predicted polypeptide sequence is orthologous to G15
gtctcactcaacctgcgcccatgggattggcttaacttctgggacgtactccatccactacggcaactcccccctgcactgcagtttatctcggcgggtatgacgtggaggagaaggccgcgagggcatatgacctggcggcgctcaagtactgggggacgtccacgcacgtgaatttcccggtggaggactacagggaagagctggaggagatgaagaacatgaccagacaggagtacgtcgctcacctgagaaggaaaagcagcggcttctcgcgcggcgcttcgatctaccggggagtcaccaggcatcaccagcacgggcggtggcaggcgcgcatcggccgcgtctcgggcaacaaggacctctacctcggaacgttcagcacccaggaggaggcggcggaggcgtacgacgtggccgcgatcaagttccgcggcctcagcgcggtcaccaacttcgacatcacgcggtacgacgtggacaagatcatggagagcagcacgctgctcccgggcgagcaggtccggcgcaggaaggaaggcgccgacgccgcggtctcggaggccgccgccgcgctggtgcaggccggcaactgcatgacggacacctggaagatccaggcggcgctgccggctgccgcgcgggccgacgagcgcggcgccggccagcagcagcgtcaggacttgctgtcgagcgaggccttctcgctgctccacgacatcgtgtccgtcgacgccgctgctggtacagggacagggggcatgtcgaacgcgtcctcgtcgctggccttcagcgtgagcaactcccgggagcagagcccggaccggggcgggcgcagcctcgccatgctcttcgccaagcccgccgcggcgcccaa

SEQ ID NO: 6298 - DNA, 587 bp, Zea mays
  Predicted polypeptide sequence is orthologous to G1506
gggcatcagtggaccggaaggctttaccaagtctactatgaaaccactcaaaagaccccgtgacacccactttcagagtgacgcagaactagatggtaccatgaggagtcctctaagagttctaaaatccggggctttggctcttcagtttgaaagttcatctttgccaaaatctagctatgccaccgaagattcaacctgcactggaggagcacctaatctattcatgttacccctagaaaagctaccattactggtcccttctcagtatgccgtctctgatcaagacttgctgctggaaatacctctcaacgcacgacacccagaggcagaacttctctgtcaaccatctcagctgatgagctctataaccagcagctccacctctatgggcggggttgctgaaggagaagggtacctggagcaaccatagtctcaggtcacatcagcaagcagcttaggaacagccagtagttgcagtttactttaacctcctggatcgtgtcgcctctctgtgccgatcaccaatggggcctaagtgtccttatttacataacaatgtgcttcgtatgccaacttggcgaaat

SEQ ID NO: 6299 - DNA, 901 bp, Zea mays
  Predicted polypeptide sequence is orthologous to G1506
tctaaaagactggatacagaacgaggaaaacaaacacccgaaaagaaaggaagaagaggagaagaacaccaaacaagcagaactttttttttgagaactccataggctgtggaattgtctccaggaatcccctctgggtttgacgagattcatacagagaaatacttcttgattttccccctttcttttgctcaagaatttacctgtacaggcgaaaccgcttctttgttcccttttttttctgtgtttgttttattgggattttcctctggtccgttcttcttcacctgtgaggtggtgagaagcagagagaatcatggggaagcaaggaccctgccgtcattgtggagtcacaagtactcccctgtggcgaaatgggccaccagataagccggtgctctgcaatgcatgtggctcgagatggagaacaaagggttcattggcaaactacactccaatgcatcgcaaggacgatattgatgacgatgaacccagagttagcaagctgaagccaccgacatcaaagctgaagtcacagaagaaaaaaccaaatcacattataatggagaatgggccattttctggtcagaatttccgaaagatgggggatgtcgaccaaagttatcggtctagttcgggatctgcagtatcatactctgagagttgtgccccatatggtgctgctgatgcaagtgaaatgactggttcagcacagtcgcatgcttgggagtccctagtgccatcaagaaagaggagctgtgtcacccgtccgaagccttcccctgtagaaaagcttgcaaaagatctaaacttcatcatgcatgaagagcagttatattacccttcaggatcatcggaggaagacctactataccatagtgaaactcctgtcgggtccctt

SEQ ID NO: 6300 - DNA, 705 bp, Zea mays
  Predicted polypeptide sequence is orthologous to G1506
ccctgcaataaggtgatatttttttcacacggagataatactttctccacggaccatatgctacagacaaccagcaaaaacccaatccaaaagcatgctacaaatgttagctgaacggacaattcgccaagttggaagatgacgcacattgttatgtaaattagggaatgacggatgcataacgcccattggtgatcagtaaatggaggcgtcaagatccaggaggctaaagtaaactgcaactactggctgttcctaagctccttgctgatgtgacctgagactatggttgcttcaggcacccttctccttcagcaaccccacccatagaggtggagctgcggcttatagagctcatcagctgagatggttgacacagaagttctgcctctgggtgtcgtgcattgagaggtatctccagcagcaagtcttgatcagggtcgacatactgaggagggaccactaataacttttctgggggtaacatgaataaattaagtgctcctccagtgcaggttgaatctttggtggtgtagccagattttggcaaagatgaactttcaaactgagccaaagcaccagattttagacctcttagaggactcctcatggtaccttctagttctgcatcaatctgaaattgggtgtcacggggtcttttgagtggtttcatagtagacttggtaaagccttccggaccactga

SEQ ID NO: 6301 - DNA, 486 bp, Zea mays
  Predicted polypeptide sequence is orthologous to G1506
ttttttttttttttccaaaaagataccccattcaaatataagactgttcaactttactgttaagcgcaaacaatgccaatttcatattggtaggaagagcatgctgaaaataagagtgcatgaaaccaccacaaatattttaagcaagcaccgaagcatcgacaatatattttcttttactactatagactaatcaaaggaacatctttgtatcacatacacaaagagaaagatagtttcggtattctctgataccaggcaccaacaatagcttgtagcccatccgttctcaatcctgattgtgcctcattgccatgcatgactgagatgttattatgtcatagattctgtcaagaaaaggaggatacaaatttcttgtactgacgaatcacctccttcaaatccttgaatgaacttatcttcaaacaacttttgtgtctgggagactgaagaatcaagttttcttttgtacatactttgcctttt

SEQ ID NO: 6302 - DNA, 638 bp, Zea mays
  Predicted polypeptide sequence is orthologous to G1510
tcgcccatcacccacctctgactgtcgtctcgagctaaaacccttgctctccctgcccgcccattttccttaccccttggcattcgctccactgcttctccggcgaattggatcggcgatccatcgtcgtcggatcgcaactcctgactagcttgttgctgcaggatcgttatccgtcgcgcctgctgcttgggtttgttttccctgctcacggaaatggggatggagatagacatggagacgtatcccaatcttaatacttccccctcggccgccactgcctcaggcgacgccaaggcctgcgccaactgccacaccaccaagacgtcgctctggcgcggaggaccggagggccccaagtccctctgcaacgcctgcggcatccgctaccgcaagaggaggcaggcgatcggtctcgacgcagcagcggcggccgccgccaactcacagcaagatctgcagcagccaaagaagaaggccgccgtcgatccgcagcagcaggaccagcatcagctgagaaagaagacaacagcggtcgctaatccacagcaggatcggcatcagccgagaaagagagcagctgcccgctgccaccgatccacagcacaccagcatcaccaagaaagacacggacaaga

SEQ ID NO: 6303 - DNA, 422 bp, Zea mays
  misc_feature (15)..(15): n is a, c, g, or t
  misc_feature (360)..(360): n is a, c, g, or t
  misc_feature (413)..(413): n is a, c, g, or t
  Predicted polypeptide sequence is orthologous to G1510
aaaaaaacggagaanactttccgcccccccacaaaaaaccgcatcctcctcgccggtcgcgcacgggcaaagcagctttggccccagcgacggcagttggcggacaccacagggtggaggctgcggcgtcgtccgcgggggctgtgctggccgtcgccgttgcctcgcagaggttgataggcctgctcgctcttgcggttcaaactgtaaattgtgtagcagaaatatataatgaagaccagcaggaaatatacaagttattatatggaggaatcaaatctgaaaatgtccctgaaattaaggctgggtcagatgatgatgatgacgatgaagacgatggaacatgaagatgaacgatgnatgatggatgatgatgatgatgatgatgagggtggtgaccacgacccatgaanaccgatgat

SEQ ID NO: 6304 - DNA, 815 bp, Zea mays
  Predicted polypeptide sequence is orthologous to G1517
ctgctggttcgatccaaaccctaccaaatcgatggccgacggcggcaactgcgggccgggcggcggcaatgcatcggcgccggtgtgcagtttcgtgaggaaaccacccaagaacatccggaagcgccccgccgcgcccgcggggtctgatgacgacgacgacggcggcggcggcgccctcgccgccgcgcgctccaagaaggggccaccgtcctcaaccgctggcaagctcgttttctccaccgcaggtgcttcctccgaggcgccgcggttccagtacgaatcgtcccggacgatccagtccacggacacccgcgcaactgccacgctcgagacggagacggagtttgaccgcgacgcgcgctccatccgcgagagacagctcaagcaggccgaggagtccctcaagaagaacccctccgctgttgctgcttccgcctccgcctccaccgctggagaggtgtacaaggggatccacggctacacggactacaaggctgggttccgacgggagcacacggtatctagcgagaaggccggcggttcgcatggtccgctccgggcgtccgcgcacattcgcctctcccagcggtttgactaccagcccgacatctgcaaggactacaaggagacggggtactgtggttacggcgattcctgcaaattcatgcacgaccgaggggattacaaatccgggtggcagctcgagaaggaatatgaggaggctgagaaggcccgcaagcgacgaattgccatgggtggtggtggtgagagtgatgatgaggcagcagatgacgaggatgaggaggaggcgc

SEQ ID NO: 6305 - DNA, 781 bp, Zea mays
  Predicted polypeptide sequence is orthologous to G1521
accgacagatagtgtgatggtattattttgtgacatactcgctgtcgccaaacatctatttttatcgtcagatgtttgacgctaaaattgtttcatggtgtagtggttgttagacgtcgatcacttgatgaccatcctttgccttggcacttgtttagtttatccatcttcaggttcatccatcagcatcaccttgtggagaagcccacgcttaacatcatctaggggttgactcaactcgtctttcgcattacgtgatcacttaacgtaccatgactaaaatgattcaactacacgcggatgacaatgaatccgaggtcgagcaatccatcgaacacttggcaaacattgcacgaatctttcttcattacccggttcctatgaatttctctccttggcaccaagttggagacctacggaatggagcaccgcagtatgctatggatcttcgacgtgtccacggttcaagaacatccagcatccactttgaatttctatggttcaagcacatcctcgaccccaaacgaatagcacgtcgggacattaccacccacgccatccatcatatggaggtgaacatgagcgacgaccgacaactcgtaggggcgtcgatgaccagtagctgtgcacggccgagcaccacgcgaggtcgaggcgaagatgaggatgaagaaggacgacagcatcggaccaacatgccgacacagggcgtgatgggaatcatggccaggatttgggcaagctgagcgacggtgctggttatggaattccacgatgaggt

SEQ ID NO: 6306 - DNA, 3968 bp, Zea mays
  misc_feature (52)..(82): n is a, c, g, or t
  misc_feature (877)..(1014): n is a, c, g, or t
  misc_feature (1552)..(1556): n is a, c, g, or t
  misc_feature (1642)..(1663): n is a, c, g, or t
  misc_feature (1794)..(1826): n is a, c, g, or t
  misc_feature (2399)..(2466): n is a, c, g, or t
  misc_feature (2683)..(2687): n is a, c, g, or t
  misc_feature (2889)..(2916): n is a, c, g, or t
  misc_feature (3157)..(3179): n is a, c, g, or t
  misc_feature (3185)..(3186): n is a, c, g, or t
  misc_feature (3218)..(3240): n is a, c, g, or t
  misc_feature (3361)..(3364): n is a, c, g, or t
  misc_feature (3366)..(3370): n is a, c, g, or t
  misc_feature (3404)..(3408): n is a, c, g, or t
  misc_feature (3437)..(3440): n is a, c, g, or t
  misc_feature (3672)..(3692): n is a, c, g, or t
  Predicted polypeptide sequence is orthologous to G1535
tgggaatttctctcatctgatagactgatccctctcctggactgagttctannnnnnnnnnnnnnnnnnnnnnnnnnnnnnnattcgtgacctagctagtatgtacagcagcttcgtctttcaagactgcagaggagcatacaaaggaggaactgaagaatagatggaagccaagtcactgtcgcagtcttctcaccgagctaggaaagcaaatgtggcgagccttcactgttgctgctccgagcattttcatgtgtccgttgatgcttggccatttgcacatcgcgggtgaactgggtccttgattttgcataaggagcttcccttgctgcagctaatcttttagcacggagaatgttctggcgtctcttccaccagcacgcagcgaatacaactaggaatagaatagctaaaagcacgccgaaagccatgccgatctttgcagccacggatagatgagggccacactcacgtaacccaggtattccacatagtccggcattgtccgtgaagttaaatctagctctgtgcagaggccttcctcccaaactggctggaacacgaccagaaagacgattgccattcaggttcagtatctgtaatgatgtcagctcgccgaggctctctggaatagatccattaagctcattgtatgacagatccagtacttgcaccacagagatggtacccagggagattggaatgttcccctttatgctattgccactcaagtttaatctcgtgccgaattcggcacgagtccaggtggccaaggacgaggacatggatcagctggagatggagatggagctcagcggcggctccgggagcggccacctggacggcctgctcagcttcgccgacgtggacgacgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggaagcgctgttcaaggagtgcccgcacccggacgacaagcagcggctgaagctgagccaggagctggggctcaaaccccgccaggtcaagttctggttccagaaccggcgcacccagatgaaggcgcagcaggaccgcgccgacaacgtcctcctccgcgccgagaacgagagcctcaagagcgataactaccgcctgcaggccgccatccgcaacgtagtctgccccaactgcggccacgccgccgtcctcggcgagatgtcgtacgaggagcagcagctccgcatcgagaacgctaggctcaaggacgagctcgaccgcttggcgtgcatcgcgacccggtacggcggcggccgacagccgagcatgtcgtcgtccgcgctggtctgcttatcggcaccgccgccggtgctcatgccgccgctcgacctcgacatgaatgtctactctcgccatttcaccgaccagtccccagtcatgggttgcggcgacctcatccagtccgtcctcgggccgccgtcgcagcagatcaccnnnnncgccgagcaccacgcctccacgccgtcgttcatgggcgccatggcgcctgtccaggagcaggacaggcagctggtgctcgacctcnnnnnnnnnnnnnnnnnnnnnntcgccaagatgtgccgcgcgggcgagtcgctctggctgcggcgccgtggcgcgagctccgaggtcatggtagccgacgagcacgcccggatgttcagctggcctgtcaacggcggccagcaggatagcagnnnnnnnnnnnnnnnnnnnnnnnnnnnnnnnnngggatcaagggacggcaccgtggttatcatgaacagcatcacgctggtggatgccttcctggacgctaacaagtggatggagttgttcccttcgatcctatccaaggcaagaaccattcaggtcataaaccatggatctgcatctggtcatatgggcagtggatctctcctcttgatgcaagcggagttgcagttcccgtctcctttggtgcctgcgcgagaggtggtgttcttcaggtactgcgtgcacaacggcgacgaggggacctggtccatcgtcgacttcccggccgaggggttccagctggaggcactgcaaaccccatctgttgtaaggtgctgtaggcgcccctccggttgcatcatccaggacatgcccaatggctactctagcgtggtgtgggtggagcacacggagattgttggagaggagaagccactgcaccaggtgttcaaggactacgtcgccagcggctctgccttcggcgccacgcgctgggtatccctgctccagcgccaatgcgagcgccttgccagtgagctcgcccgcaacatcgccgacctgggagtgannnnnnnnnnnnnnnnnnnnnnnnnnnnnnnnnnnnnnnnnnnnnnnnnnnnnnnnnnnnnnnnnnnnaacatcagtgcttctgggagccaatcttggacttcactctcagaaactacagaggacacgatcagggtcactactcgcaagaacacggatccggggcagcccagcggtgtcattctaaccgctgtctctacaagctggcttcctttcaaccatcagaaggtcttcgagcttcttgccgatgaacaacagcgttgtcagcttgagattatgtcaagcnnnnnctcacttcacgaagtggcacatattgcaaatggatcacacccaaagaattgcatttctcttcttagaatcaatgctgcaagcaactcctcccagaacgtggagctcatgctgcaggagagcagcacccaccccgagggcgggagcctcgtggtgtttgcgaccgtggacgtggacgccatccaagtgacaatgagcggcgannnnnnnnnnnnnnnnnnnnnnnnnnnnctgggcttcgccatcttcccggccgccaacccttcggctgcagcaaccagcgccgcaggctccggcgacggccaaagcagcccagcaggtaacgccgacgagcccgccagcggctgcctcctcaccgtgggcatgcaggtgctcgctagcgcggtgccctcggctaagctgaacctctcgagcgtgaccgcgatcaacagccacgtctgcaacgccgtccaccagatcacagccgcgctcnnnnnnnnnnnnnnnnnnnnnnnctgaannccggcggctgctgcctccgagtagtaagtagnnnnnnnnnnnnnnnnnnnnnnnagatccatacaccacaacaaaagccaaattgacttccaggtccggttgtttctgctgacagacatcgcaggtgcaagagagggtttgacaggagcccgaaaccaacacacggaaagttccnnnntnnnnnttctctttcccgccatatgcctcttaaaatgacnnnnntacccctgaccgaacgaagagaatggttnnnncattttgatcattttgggaagctagtgcggtgtcatctacagctactggaaaagaaagggtcctgtcaagctctcacttgtgccggccgattctctatcacgcagaaaacaatccggggcagcttggtcatgcaggtgttgctgctggtagctctctctctctcggtctgttcccttgctcagaagtcagaactgtgaagaaggttagcttcgattggtatgcttatttcgnnnnnnnnnnnnnnnnnnnnncgggagatttacctagtagttcgcgcgtaatggtcgggcgtagagccgtgtaactctgtattagaagagactgaggacttgattgtttaggagagcaagagaaaaggtgcgagaggaggagtcaagagcgaaccaaaccagttgtgaccatctgatcccaggctatcagggaagaagggtcttggttcgggaattgacttgttccctctctgcaccgcctgtttgtgctgctactcaagctcgtttgattacgttggtaggttgttttctcgtgcc

SEQ ID NO: 6307 - DNA, 917 bp, Zea mays
  Predicted polypeptide sequence is orthologous to G1538
gctactactcctagtcctagtacaggctacagaggcagagcgagcaaaactgcctgtacatagcaaccatcaacgacgaccgatccaagtagtgagcattagtggatctactacgtacatatatagaaggaaacagctgcagctctctctctcgctgtttcctgcgtgatctgcttgtgtagctactagctagctagcggagcggaaccacccatgggctgcgaggaggaagagaggctgctgttcccgtccttcgtctttcccgagagcttcgcggaggccgccacccccggctccggtggtgagcagaagaaggctcggcagcgtcggaggcgcaagccgcggccggcggagggcggcgagggcgcggacgagcaggccaggaagcggcggctgagcgacgaccaggcgcggttcctggagctcagcttcaggaaggagcgcaagctggagacgccccgcaaggtgcagctggccgccgagctgggcctcgacgccaagcaggtggccgtctggttccagaaccgccgcgcccgccacaagagcaagctcatggaggaggagttctccaagctccgcgccgcgcacgacgccgtcgtcctccacaactgccacctcgagaccgagctgctgaagatgaaggacaggctggcggaggtggaggaggagaagacgaagctcgtcgcggcggcggcggcggcggccggcggcgcagcgggcgcagggagcagcagcccgagctcgtcgtcgttctcgacggtgacgcaccacccggccgcggcgctgcaggtggggcagttcggggtggagccggaggaggccgccgacctcgtctacatgaccgagtacgcctactacagctacatgaacatgatggaactcgcgcccgcctacttcggtggagtcgtctacgacta

SEQ ID NO: 6308 - DNA, 548 bp, Zea mays
  Predicted polypeptide sequence is orthologous to G154, G1797
cccagcagcgtgaagtgaggccagctagccttatcagcctatggcggctcggattggagcggacgggaaggcgatggcacgccgcggccgcgtggagctgcggcggatcgaggaccgggtgagccggcaggtgcgcttctccaagcgccgctcggggctcttcaagaaggccttcgagctctccctgctctgcgacgccgaggtcgccctcatcgtcttctcccccgccggcaagctctacgagtacgcctccaccaggcaaaaggcgtggtgcgtcacttatccattcaaacacaggaatttgttgcaatcacgggattgtagaagaaaactacaagatgtgatgatgctgatgctacataagtcatgctaaaatgtctcgtttattgaagtattgtatctcaaatatattattttttaatttctttatcttgtagtttatatttgagattttattattatatttagtcactgcacactctcgttaaaagagtaacgacctttttggtgaccaaaaaaaaaaaaaaaaaaaaaaagtcgacgcggcc

SEQ ID NO: 6309 - DNA, 585 bp, Zea mays
  Predicted polypeptide sequence is orthologous to G154, G1797
gcacgagctgggcactggtgaatgaacgagagtgacctgacccccgtgcggccgtccgccgtcaccgaccgagcgccgggtcccaccactccccgtccccaacccctcgcgctcgctccagcctccagcaaccgcgctccctgttcctttccttcccaggcggccaggcccagcagcgtgaagtgaggccagctagcctattatcagcctatggcggctcggattggagcggacgggaaggcgatggcacgccgcggccgcgtggagctgcggcggatcgaggaccgggtgagccggcaggtgcgcttctccaagcgccgctcggggctcttcaagaaggccttcgagctctccctgctctgcgacgccgaggtcgccctcatcgtcttctcccccgccggcaagctctacgagtacgcctccaccagcatagaggatacatataaccgctatcagcaattttctggagaaggaaggaatataaatgacgatcgaaatagaaacgataacaaggataaagcttcttcagatttgcagttgatgctgagcaagattgccacctggtctccccagagcaatgctgac

SEQ ID NO: 6310 - DNA, 1341 bp, Zea mays
  Predicted polypeptide sequence is orthologous to G154, G1797
ccacgcgtccggccaaaacccttacgcgcgacgcggccccctcctcttcttctctctcccaccaccgccctccccttgccatttttggtgagtgccccctttcccttccctagaccagatcctcgccccgttttccacttttgcctccaccgcgccggcccaattcggataacaagctccctccgcctcgccgcgtctcctcccagccgcaggagccgccgccatccgatccggaagagggaggaggggggagggaggaggatctgtgtcccgattcgattgcagctctcgtccccggcggtccaggatggtgcggggcaagacgcagatgaagcggatagagaacccggccagtcgccaggtcaccttctccaagcgccgcaacggcctgctcaagaaggcgttcgagctctccgtcctctgcgacgccgaggtcgcgctcgtcgtcttctccccgcgcggcaagctctacgaattcgccagcggaagtgcccagaaaacgattgaacgttatagaacatacacaaaggataatgtcagcaacaagacagcacatcaggacattgagcaagtaaaagctgatgctgagggcctggcaaagaaactggaagcacttgaagcttacaaaagaaaacttttgggtgagaggttggaagaatgctcctttgaagagctgcacagtttggaagtgaaactcgaaaagagcctgcattgcatcaggggaagaaagactgagctgctggaggagcaactccataagctgaaggagaaggagatgaatctgcgcaagagcaacgaagatttacgtgaaaagtgcaagaagcagccgccgccgccgccgcctatgctgatggctcctccgccgcctccagcgccggcagccatcgatcacacggggccgaaggatgtcgggatggacgtggagacggagctgtacataggattgcccggcagagattaccgctcaaacaacaaagacatgactgcacagtagctgtcaggtcaggtcaggtcaggctagccagcagtgcagagaataatcttagatctgtggtgcggagaactggagatgcaagccaagcccaagccaatcaacatgataaggatcatgagtgtcgcgtcgtgttttacaaacctgtccaccgtccgtcaaaggcacatgcgccagaacgtccgtcagagaacacttaccccctcatctccctctattagctagctgctccggcctgctcatgtcgaaaccttctgttcaagtatgttctcctcctgatgaattccctgcccggcatgcattggtgagcttcttctcgagaagaagtgggtggggtggggacactgtcg

SEQ ID NO: 6311 - DNA, 1154 bp, Zea mays
  Predicted polypeptide sequence is orthologous to G154, G1797
gcgccctttcccttcctccccagatccccgtccccgttttccacttttgcctccgccccaattcggataacaaacccctccgcctcgtcgcgtctcctcccagccgagccgatccggtagagagagggagagggagggactgagggaggaggagctgggttccggtcccggccgcccggccggctgcgcgattcgattgcagctctcgtccccgggcggcgtccaggatggtgcggggcaagacgcagatgaagcggatagagaacccgaccagccgccaggtcaccttctccaagcgccgcaacggcctgctcaagaaggcgttcgagctctccgtcctctgcgacgccgaggtcgccctcgtcgtcttctccccgcgcggcaagctctacgaattcgccagcggaagtgcgcagaaaacgattgaacgttatagaacatacacaaaggataatgtcagcaacaagacagtgcagcaggatattgagcgagtaaaagctgatgcggatggcctgtcaaagagactcgaagcacttgaagcttacaaaaggaaacttttgggtgagaggttggaagactgctccattgaagagctgcacagtttggaagtcaagcttgagaagagcctgcattgcatcaggggaagaaagactgagctgctggaggagcaagtccgtaagctgaagcagaaggagatgagtctgcgcaagagcaacgaagatttgcgtgaaaagtgcaagaagcagccgcctgtgccgatggcttcggcgccgcctcgtgcgccggcagtcgacaacgtggaggacggtcaccgggagccgaaggacgacgggatggacgtggagacggagctgtacataggattgcccggcagagactaccgctcaagcaaagacaaggctgcagtggcggtcaggtcaggctagcagctacctcagccacgcacaggcccaatcaacgcaagctagctagctgagaataatcttttagatctctggtagtgtggagatcgagatgcaagccaagcaatgtgatatcgcgttgtgtgttaccaacctgtcagtctgtgtatcatcccgtcccgtccgtcagagtctcagagaacgaacacttcttctccttctccctgtagctagctgctcctgcttgtgtcc

SEQ ID NO: 6312 - DNA, 895 bp, Zea mays
  Predicted polypeptide sequence is orthologous to G154, G1797
cgacgagcgacgagctaaaccccgaccgagtcgctgcttgggtgcccaagatagccctaccgcctcgcctctctcgttccccctcatcgccacgccagtcgcctccactcccagtcatctcccatcaccgacgacgtgtcgaggcgagagaagagggcgagtccaagtctagggttcccgccgcatcgacacgggcatcgcaccgcaccgcgaggggcgggcacggaggaagatggcaccgcgcgggcgcgtggagctgcggcggatcgaggacaaggcgagccggcaggtgcgcttctccaagcgccgcgcggggctgttcaagaaggccttcgagctggccctgctctgcgacgccgaggtcgcgctcctcgtcttttcccccggcggcaagctctatgagtactcctcctccagcatagaagatacatatgaccgctatcatcaatttgcgggagcaggaagaaaagtgaacggacataacaacgataaccgggatgtagctgcttcagatttacagtcgagacttaaggagatcgcaacatggtctaaacaaaacaacgctgaggagtcggatgccaatgaacttgagaaacttgaggaactcctgacaaatgctttgaggaatacgaaagccaaaaagatgttggcaaaagaaaacaatggtggtgccggtgcaagtacaagcagccagatgttgctttactcggcagagcgtgcaaccgacaaatgaaacggggcgtgcatctgttgctaacggggcggtgccggtgccgcatactattgttgtgtagctgaagtttgtcaaggtggctgctggcaaggtagccgaggaagtggagttcataacaggatgcggaaactgtgccgctccttgccgaacttagccccgtta

SEQ ID NO: 6313 - DNA, 904 bp, Zea mays
  Predicted polypeptide sequence is orthologous to G154, G1797
gacgaaacggcaagcgtcgccctctccaccgccaccagtccacctcctcgtcctcctccggtcacgcacgcagctagcttacccgccccgccactataaaaatccacctccaccccaccgcgcgtctacagttccacacacgcgtgcacgggcgggcaagcaccagaaaggaaaggcggaggccgcgcggcgggcgccagctgcagccaagagcccactagtagtagtagtagctagttcaccaccgcctgcttgcctcctttactttgccatatttgctagcgtttcctggattggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagccctagaaaagaccaaacgaatgtttctgggtgaaaatttagaagaatgctccattgaagaactgcataatctggaggttaaactggcgaagagccttcacgtcatcagagggaagaagacacaactgctggagcagcagatatccaagctgaaggagaaggagaggaccctgctccagacaacaaagagttgcgggataagcagcgcaacctccagtctccaccggaggcgccacgggacctgaccgctgtgtcc

SEQ ID NO: 6314 - DNA, 586 bp, Zea mays
  Predicted polypeptide sequence is orthologous to G1543
caacaacgggagcgggaacgggtaacaacatgagggacctggacatgaaccagccggcgagcggcggcgaggaggaggagttcccaatggggagcgtggaggaggaggaggacgagcgcggcggcgccggcgggccgcaccgcgccaagaagctccggctgtccaaggagcagtcccgcctcctggaggagagcttccgcctcaaccacaccctcacaccgaagcaaaaggaggccttggctgtcaagctcaagctgcggcccaggcaggtggaggtctggttccagaaccgcagggctaggacgaagcttaagcagacggagctggagtgcgagtacctgaagcgctgcttcggctcgctgaccgaggagaaccggcggctgcagcgggaggtggaggagctgcgcgcgatgcgggtggccccgcccaccgtgctctccccgcacacccggcagccgctcccggcgtccgcgctcaccatgtgcccgcgctgcgagcgcatcaccgccgcaacggccgcgcgcaccccacgcccggcgcccgccgcgagccccttccacccgcgccgcccggtccgcggcgtttt

SEQ ID NO: 6315 - DNA, 1039 bp, Zea mays
  Predicted polypeptide sequence is orthologous to G156
cttggatcgaccgaccggccggggtggtcgccatgggacgcgggaagatcgagatcaagcggatcgagaactcgacgaaccggcaggtcaccttctccaagcgccggggcgggctgctcaagaaggccaacgagctcgccgtgctgtgcgacgcgcgcgtcggcgtcgtcatcttctccagcaccggcaagatgttcgagtactgcagccctgcctgcagcttgagggagcttattgagcagtatcagcatgctaccaacagccacttcgaggagataaaccatgatcagcaaatactgctggagatgacaaggatgaagaacgagatggagaagctggagacgggcatcaggaggtacaccggcgacgacctctcctccctcaccctcgacgacgtcagcgacctcgagcagcaactcgagtactccgtctccaaagtccgtgcaaggaagcatcagctcctgaaccaacagcttgacaacctgcgtcgcaaggaacaaatcttggaagaccagaacaccttcctgtaccgcatgatcaacgagaaccagcaggccgcgttgaccggcgaggtgaagctgggggagatggcgccgctggcgatgctgcagccaccgccggcgttcgcgcactccgccaccgcctactacggcggggagtcgtcgtcgtcgggcacggcgctgcagctgatgtcggcggcgccgcagctgcacgccgacgacctcgggttccggctacagccgacgcagcccaacctgcaggacccggcggcgccgtgcggcggcctccatggccacggcctgcagctgtgattaactgcgatcaattgggaggactgtcacatgctgcatggaagagggactattattggagcacgcagtttcaaggtcgcaaagctcgtcatgcataatttcgatcatatgttagtttgtcatctgaatagttttatatatgcatgcaatgcaatcaattctctggataataattcaactattgttatgtatctaattaagataggttcgtagactaaaaaaaaaaa

SEQ ID NO: 6316 - DNA, 923 bp, Zea mays
  Predicted polypeptide sequence is orthologous to G156
tgttcttgtaggttgaatagaagagtggaagcaccaagctgtaccaatggggcgtggaaaagtagagctgaagaagattgagaatccaacaaaccgccaagttaccttctccaagaggcggatggggttgttcaagaaggcaaatgagctagccattctttgtgatgcgcaaatcggagtcatcatattctctggcagtggcaggatgtacgagtactccagccctccatggagaatagcaagcgtctttgacaggtacctgaaagcccctagcacccgtttcgaggagatggacatccagcaggagatgactaggatgaaggatgagaggaacagactgaggatgatcatggcgcagtacatggcggaggacctggcatcgttctccgcgcaggatctgagcaaccttgagcagcaaatcgagttctcgctgtacaaagttcgcctcaggaagcaagagctactcgaccagcagctgctcgagatccaccaaagggagatgcatatgccagcagagcagggcggctacctgtgcctcatgaacccggctgcggctattgctagcgggcagcaccagcaggctggcgagatggtgggaattaacccgaggccgttcccgtggtgggacgtgggagccagtggcagtggcagtggcagccagagccagcagcagctgctgcacggccgggacgccgcggagtcgtcgatgacggcgctcgggctgtcgccgcagctgcatgggtacaggctccagccgcggcagcccaacctgcagcaggacgccgacatccatggctggctgtgatttgctttggtcgtgggtgtgcgtcctcaacgagacgagacgacgctgaacgtgcagctcctctgcttgcgacctgttcattctagagtctttgatcatgacctgccccccgtatgaa

SEQ ID NO: 6317 - DNA, 1041 bp, Zea mays
  Predicted polypeptide sequence is orthologous to G1637
ctgtaacaacttgtgtagtacttaacccctcgcacctcatgaatcccaacttcaacagtgtgtggagcgctcccgagatcaatatgatgaactcactcatcactagtcacatcgccaacaacacctacacaaacaacaaccagcatgttgtggcaagtcgtagtgccattgtgaaccacaataactttgggatgccaacggaggtcgttccacccgtggacaacatggacatgatgcaaggctatctaatggctgatacggatgccatgaggcttgttcagggacaacaacatatgccaaatgttgttcctaatcaaaggaggcatgcagtgaagttttggactacagatgagcacaggaatttccttcgtggtctagaagtgtttggccgtggtaaatggaagaacatctccaagtacttcgtccccacaaggacaccagtgcagatctctagccatgcacagaagtatttccgcaggcaggagtgcaccacagagaaacaacgctttagcatcaacgatgttggcctctacgacacacagccatgggtgcggcagaacaactcctctagcagctgggaggcgctcaccttcactgctggccgtgcgtacaataatacaaactactgtgcctttaacagcctcccgtatgccagcagccaggcaagtaacaaccaggtagctacatggattacagaccagcaggcaactgcaagttcttctatagctcctccagcgacggaggagagccagatatataaccgataatatatataatggtcatcagcagctgggagaggctttcttcatatataatcaataggtagatagatatggacaacgtccattgactagtttaatttctatctatatgttttgtatccaatgatgcatgtaaaacctagttggttgttaaaggtcattagtaccatactatatatgggctagaaacagtttcattgaaatttgcccctgagcaatacaatgaaattttaccaatgtgttatttatatattaatgtgtctaaaaaaaaaaaaaaaaa

SEQ ID NO: 6318 - DNA, 805 bp, Zea mays
  misc_feature (790)..(790): n is a, c, g, or t
  Predicted polypeptide sequence is orthologous to G1637
cagccgccacaaacagccagccggccgccaggatttctccttgcgttcctgcatggctgcatggccactaacagactgccggccgccaggagctatccatgcatttctgcatgggcctcatggccgagctatgctcaagtgccgcctctggtttccctttttttttttttaattttcttctccccagccgctgctccactcggccgccagggagcatcacgcttgtttctttctctgattctttgtctgagcagccgctagagcacagagctactggccgaacgtgcccgagtacggccgttcctgcgcgttgcatgctcctatctctctcttttttttttctttctttcactgtttactgattttggagattactaacgcacggttggcttcaatgcaccggagatggccggcctgagccgcctcgcatccccatcccgccgacgtgcgcgtcccttcgggtgggcgcgccgtcgtcggatgggtgctgcgcggtggtcgaggcccagtccgacgagttaagaactgcggcactgttagccgtcgcctgcgaacctctctctccccaggatctatcctcaactcgatccctcaagtgattttgtaacgggatcgagttttggaggtaaagaatcatagatctgggtcccgcgatatttctgttattttctgtgatgattttagtgcatctgtacacttttgattcacgtggtttttgaaaaaaattagggttctaaccctagcttcgttctgtacgacttttttctgatctgttcttgaccgtttattnaaaaaatcacgagta

SEQ ID NO: 6319 - DNA, 920 bp, Zea mays
  misc_feature (746)..(746): n is a, c, g, or t
  Predicted polypeptide sequence is orthologous to G1638
gaagaaagcaaggagagggagccagggaggaaggggaaaaacacgcggagagggtgagcaagaaagaaccgaggcggatcgccttctgttcctcctgccggctccgcgagaggaggcactgctcagtcccgtgattcctacaggggggaagaaagaggtggaacaacgccccggggcagagcagagatgatgcgggagacgtacatggacgtgctgccgccggtggaccacatagccgcacggagcaactggttcccggcggcggcgcgtctgtggacggcggcggagaacaagcagttcgagcgggcgctcgccgggctcgacctctgccgcccggactgggaggaggtggcgcgggccatccccggccggacggtgcgcgaggtcgtcagccacttcaagcacctcgaggtcgacgtccagcagatcgagagcgggcaggttcccttgccggcctacggcggcggggccagctcgttcaccctgcagtgggacggctacggccccggtccgggggacttcaggcacgggtaccgcttcgccggaggctgcgggaggcggcaccacggccgcacgccggagcaggagcggaagaagggcgtgccatggacggaggaggagcacaggttgttcctcctaggcctgaagaaatacggcaagggggactggaggaacatatcgcgcaactttgtccagaccagaacgcctactcaggtggccagccacgcgcagaagtacttcatcanggctcactccggcggcaaggacaagaggaggtccagcatccacgacatcaccacggtcaacctgacggacgaccagccgccctcgccgtcccagtcctccctgatcaccagccagtcgaacgcaccagctccatctccagctccggctcccagcgcggggatatgccaggtccc

SEQ ID NO: 6320 - DNA, 684 bp, Zea mays
  Predicted polypeptide sequence is orthologous to G1638
gtttatagaatcatgttgccaatcaaagtcatagttgtttgtgttgttagcatcgctagtgaaggtgagcgcctcccatccaagagagttactctgcaccattgttggatctatggatgaactggctattatgtgttgacctcttgtccatgtagctacatggccactgctcgtctggctagtatgtgtgagtttgttcaagacaacattttgtctctcaaagtcataatatttgttgttgtaagcagtatgaccaaaggtgagagcctccaaactaaaagagttcttttgcacccgtggatctgtgtcatagaggtcgatatcattgatgctaaatcgttgttttcttggggtgccctctttcctatggaaatacttttgtgcatggctgcagatctgtattggcgtccttgtggggacgaaatacttagatatgttcttccagttaccacgaccatacacttctaggccacgaaggaaattcctgcatacatatatggttcagaatcaacaagttagatgataacatatgtcttgttcataccctcaagattggtgaaaataaaatcccactgaatcatggtattaaacactatacaccactagcttattacttgtatgaaaaataacattaaagatgtgataaacatttcaaaaaacaaagaggaaatgaattacttgtgc

SEQ ID NO: 6321 - DNA, 837 bp, Zea mays
  Predicted polypeptide sequence is orthologous to G1638
cgccgctccgggctgaccaagggctcgccgcctcccgtgtcctccgactccgacagggaaaggcgaaaccttgggtcggctcgctagtggagtgcagggtacgttgatgacggagctgtggatggaggtgctgccgccgccctacttcgcggggcaggcggcgggcgggtggttcctgccggaccggcgggccgggcccggggcgtggacgctggaggagaacaagatgttcgagcgcgcgctggcgagggtcgactgggacgcgccggaccggtgggagcgggtggccgcgttgctgcccggcaggacggcgtccgacgtcgcggcccactacgacgacctggagtgcgatgtcggctgcatcgaggcaggcttcgtgcccttcccctgctacggcagcggcggcggcgcgtcgcagtccgccgggttcacgttcgactgggacgccggcgggctgggctttaagcgctcctgctacgtggtcggcggcggcaagcgcgagcgcgggccggaccaggagcgcaagaagggcgtcccctggacggaggaagagcacaagcagttcttgatgggcctgaagaagtacgggcgaggggactggaggaacatctcgcgcaacttcgtgacgagccggacgccgacgcaggtggccagccacgcgcagaagtacttcatccgcctcaactccggcggcaaggacaagcgccgctccagcatccacgacatcaccaccgtcaacctccccgacgacgacgcgggcggcaccgcctccgcctcgccgccctccgtgctcacctccgcctccgcgccctcgtccaccggcggcggcggcccggt

SEQ ID NO: 6322 - DNA, 129 bp, Zea mays
  Predicted polypeptide sequence is orthologous to G1640
atcaactaccttcgggcggacgtcaagagggggaacatctccaaggaggaagaagacctcatcatcaggctccacaggctcctcggcaacagatggtccctgatcgccagccacctccccggccgaaca

SEQ ID NO: 6323 - DNA, 826 bp, Zea mays
  Predicted polypeptide sequence is orthologous to G1640
atggggaggagggcgtgttgcgcgaaggaaggcgttaagagaggggcgtggacgagcaaggaggacgatgccttggccgcctacgtcaaggcccatggcgaaggcaaatggagggaagtgccccagaaagccggtttgcgtcggtgcggcaagagctgccggctgcggtggctgaactacctccggcccaacatcaggcgcggcaacatctcctacgacgaggaggatctcatcatccgcctccacaggctcctcggcaacaggtggtcgctgattgcaggcaggctgcctggccgaacagaaaatgaaatcaagaactactggaacagcacgctgggccggagggcaggcgccggcgccggcggcagcagggtcgtcgtcgcgccggacaccggctcgcacgccaccccggccgcgacgtcgggcagcagcgagaccggccagaagggcgccgctcctcgcgcggaccccgactcggccgggacgacgacgacctcggcagcggcggtgtgggcgcccaaggccgtgcggtgcacgagcggactcttcttcttccaccgggacacgacgccggcgcacgcgggcgagacggcgacgccaatggccggtggaggtggagttggaggaggaggaggagaagcagggtcgtcggacgactgcagctcggcggcgtcggtatcgcctcgcgtcggaagccacgacgagccgtgcttctccggcgacggtgacggcgactcttggacgacgtgagggccctggcgtcgtttctcgagtccgacgaggactggctccgctgtcagacggccgggcagcttgcgtagacaac

SEQ ID NO: 6324 - DNA, 680 bp, Zea mays
  Predicted polypeptide sequence is orthologous to G1646, G715
tcagcatcctcccccgggatgggcgcggcggtggcgtaccctccggcggccggcgccgcgtactccgccgggcgtacgcgcacgcgcacgcggcgttgggcgcgctgtacccgcctcccccggcgccgggtcccccctcctcgcaccagggcggcgcggcggcggcgcagctgcagctgttctgggcggagcagtaccgcgagatcgaggcgacgacggacttcaagaaccacaacctgccgctggcccgcatcaagaagatcatgaaggcggacgaggacgtgcgcatgatcgccgcggaggcgccggtggtgttcgcccgcgcctgcgagatgttcatcctggagctgacccaccgcggctgggcgcacgcggaggagaacaagcggcgcacgctgcagaagtcggacatcgcggccgccgtggcgcgcaccgaggtcttcgacttcctcgtggacatcgtgccgcgggacgagcccagggacggccgaccccgccgccgccgccatgggggcagcagcgcccgggatcccgcagcaccccgccgccgccgaccccaccaccatgggctactactacgtccagccgcagtaaccgatctgccctgttggtatttggtacccacgttcttgtgttgttgcccttggcaaccaataactcttaagatggcgttccatcgc

SEQ ID NO: 6325 - DNA, 1060 bp, Zea mays
  Predicted polypeptide sequence is orthologous to G1646, G715
gcacgagaagcaccttcctcttcctcttcctccgccccccaatccccctcgtctcacaaccctagctgcccccgaatccatggatcccaacaaatccagcaccccgccgccgcctccagtcatgggtgcccccgttgcctaccctccgccggcgtaccctcccggtgtggccgccggcgccggcgcctacccgccgcagctctacgcgccgccggctgctgccgcggcccagcaggcggcggccgcgcagcagcagcagctgcagatattctgggcggagcagtaccgcgagatcgaggccactaccgacttcaagaatcacaacctcccgctcgcccgcatcaagaagatcatgaaagccgacgaggacgtccgcatgatcgccgccgaggctcccgtggtgttcgcccgggcctgcgagatgttcatcctcgagctcacccatcgcggctgggcgcacgccgaagagaacaagcgccgcacgctccagaaatccgacattgccgctgccatcgcccgcaccgaggtattcgacttccttgtggacatcgttccgcgcgacgacggtaaagacgctgatgcggcggccgccgcagctgccgcggctgccgggatcccgcgccccgccgccggagtaccagccaccgaccctctcgcctactactacgtgcctcagcagtaatgtatcatcatcacgttattgttccgtctatgtgcctgagcaataatgtatcatcattgccttattgttccggggcagttgtgttatttgtgtctgtttagttgctgctgctgttaccgcgtaatagcatatgtgttatctgtgtctgtttagttgctgctgctgttgccgcgtaataaaacttggtcgtttacggggctccctcaagattaagaattgagttgtttgatggtagaatcctggtaaggttgttgtaactggggggcgcctttgtttgggctggtagtgtatgcctaggcctcacttatctgatgctgtaatgcgacaagtattatgtggttgtctggtaattattgtgcaaaaaaaaaaaaaaaaaaa

SEQ ID NO: 6326 - DNA, 672 bp, Zea mays
  misc_feature (17)..(25): n is a, c, g, or t
  Predicted polypeptide sequence is orthologous to G1660
ttttttttttttttttnnnnnnnnntattttaaatctgtggcctagatgacagaataaattagaaatggtacagaaaatcatcacagaaaataacagaaataacgcaaggtctcggatctacgttttatcagctcataactcgatcccgaatattacattagatccatctcatacattcattcacacacaataagggattcgagtaaacggggactagatccgagtttcgaaaggttaaagacggcgccccataatcggccgaccaactctggtgaaggaaaagacctgcccgcgcaaggcgagggaaatagcgccagattcaagaacaagaaataaaaaaaacagaaatagagagagtaactagcggctagatgctagaaagaaataaaaaaaacagaaacaaagaaggagaaggggcgaacggccaaaaggagcagggagaaaaggatagctcggtcggcccaagctcctggcgaccggttcttgggtgagcggtctggaacttagaaacagagattagaaagagcatgaacagagaggagaggcggccggttttggtcgtcgggcaaggttcaaaaggcgatggccgacatatttttgtttttttttgggctagccgagctctcaccggccaccgaccgacgaccgtgcaccctcacatggggacgcac

SEQ ID NO: 6327 - DNA, 912 bp, Zea mays
  Predicted polypeptide sequence is orthologous to G1660
ctccagcggggctcgccattgatggagtacgagcgcatccacgggccgctcccgcgccatcagtccgggggattctctccagctaagctgcgagcaatgcttcgcgggatagagaaacgccagcgcaacaacggcgaggactcgtctccggaggccaacgactccggcgagctcgacgaccggaggagcttggaatgctccacctccaccgagatgtcgagcaacagcggccacaggtcaagaaaccgtgccccggacgacgacagcttcgactcggagagcagctcgtcggggccgccgacggtgaagaggtcggccgcggtggccgcgttgctgccgcccttctctcggccaacgccgtccaagtgggacgacgccgagaagtggatctccagcccgacgtcaaaccgtactggccgtacggggcctaccgctggagctgtgccgaagaagtctgcattggccttccctgactatggaggccgcccgccagccgttgctaaggtggtagcggatgtgcctaccaacgctggaccagatggtctcgcccatcctgatttacttaagcctggacacaatgcttcagtagttgttgacggaacagcacctgcagttaggtctgtctgtatgagagacatgggaacagaaatgactccaattgcgagccaagagccttctcggaccgcgactcctataatcgcatctagtccaacctcctctcggacaccaaccccgcaacgcaccgcagaattcagtgtgagtaatatagatcctaaaaagatcgagatgcctgaagaggaggaggtacagatgagtacgagacaggaaattatggatcttggtgaaagggtagggaagaccactatagccgcatggggcagcaaggaagagaatctgccgcacgtttcacgg

SEQ ID NO: 6328 - DNA, 866 bp, Zea mays
  Predicted polypeptide sequence is orthologous to G1660
acatacgtgtgtatatatatatatatatagttacaacagcttacaagcgactcattctcaacgggcgactcatcttccatgggcacttcatgagcaccagttccagcagccaaacgacggcggcacccggccggtcctcctgatgtgctctgcctgctcagcggtcctcgcggctgcgcggttccgtttcagctccgccgtggcacgcttctcgtctgcgctgtgcctcgccgacgcgagcttggtcatcagcttgtcttgcgcgcgggcacgcatccgctccacctcgacctcgattttcctcatctcagcttctatctgggctttctgatggtcctcccaagcctggatcttgatctcttctcgcttgaatctcgctaaatacttggccttctccgcctcctcccacgcagccgcacggatcgcggttatgttctgcgtcgactggtccatgggcaccggtttcagcgagagcgaggcgtccttctcctcctccttcttgctcgcccatgccgcgatgctggtcttgcctagctgcgtgccaaggagcatgatctccctcctggttttggtctgcagctcctgctcgctcagctccgagctgctgcattctcctccgtggctgatgaaggagccgactgcgctggggccaccgagcgtcctccgtggagtcgttggctgggagcagtttgggctcgtcgccctcaccggcgtcccggtccgggacggctcttggcttgcgatgggcgtcatctctgtgcccatgtccctcatcgacactgaccggaccgttgttggaggagggatgcatgttgctgcgctctgaagcgtggtgatgcatcatggcggtgaaattaacagctgct

SEQ ID NO: 6329 - DNA, 855 bp, Zea mays
  Predicted polypeptide sequence is orthologous to G1660
ccacggcccaccccccaaatcggccaatctccacttcttaagcctccctgttgcctcgcacggcctccgcctcctcgtcgtccggcctcccgcgccaccaccggggcctcgccgccacgaatggagtacgagcgcatccacgagccgctcccgcgccgtcagtccggcggattctccccagctaagctgcgagcgatgcttcgcgggctagagaaacaccagcgcaacagcggcgaggacacgtcgccggaggccaacgactccggcgagctcgacgaccggaggagcttggaatgctccacctccaccgagatgtcgagcaacagcggccacaggtcaaggaaccgggccccggacgacgacagcttcgactcggagagcagctcgtcggggccgcccacggtgaagaggtcggccgcggtggccgctttgctgccgcccttctctcgcccaacgccgtccaagtgggacgacgccgagaagtggatttccagccccacgtccaaccgtactggccgtgccgggcctaccgctggaactatgccaaagaagtccgcattggcatttcctgaacatggagcccgccagccagccgttgctaaggtggtcacggatgtgcctactatcgctggaccattggttaagaattcagatggtcttgcccatcctgatttgcttaaacttgcacacgatgcttcaatagttgatggaccagctcctgcagttaggtctgtctctatgagagacatggggaccgagatgactccaattgccagccaggagccttctcggaccgcgactcctatgattgcatccagtccaacctcctctcggacaccaaactcctcacgcacc

SEQ ID NO: 6330 - DNA, 2605 bp, Zea mays
  Predicted polypeptide sequence is orthologous to G1666
cccaaggttcgtggcatatctgtaggcatctaccccgtcttcgtcgtccgctcctcactagctaccaagaggtcgccattattgccaacatagagtgtacgtggatgtctatatatatgcctacttgcacccatatggcataggcgttcgatccccttagcgcggaggagagctcctccggttcttctctacccttcgcatggaagttcttgcattgcttcgttgcttctctagtttcttccttctacgtctttccagcatacgcatgcccctcgtccgccggttcacgaggcatcgtctgatgatcagtagataataagcaatataatactgatctagaatcgagttgttgtactcttcgcagataggcgcgtgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatctccaactccgtggagctgacatccgaccagctcgtcatgcagaggagcgaccagctccgggagctctacgaggccctcctgtcgggcgagggcgaccgccgcgctgcgcctgcgcggccggccggctctctgtcgccggaggacctcggcgacaccgagtggtactacgtggtctccatgacctacgccttccggccaggccaagggttgcccggcaggagtttcgcgagcgacgagcatgtctggctgtgcaacgcgcacctcgccggcagcaaagccttcccccgcgcgctcctggccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgagctccagcccgtcaggacgagcaaacgagaccggcgaggccgcagcagacgacggcacgtttgcgttcgaggaactcgaccacaataatggcatggacgacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggacagggctaccgctaacgtcgccgccgacgcctcaagggcacccgtctacggctctcgcgcgacgagtttcatggcttggacgaggtcctcgcagcagtcgtcgtgctccgacgacgcggcgcccgcagcagtagtgccggccatcgaggagccgcagagattgctgaagaaagtggtggccggcggcggtgcttgggagagctgtggcggcgcgacgggagcagcacaggaaatgagtggcactggcaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcaccatggacgccggcaccagcaacgtcaccgtcaccgtctcggacaaggacgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaagcggtgaaggggcagctggaaatttggacatcgacgggcatggaaggcttcatgggatcgaagcaaagatgtatttcttgtttctttagataacagacatgaatcggacctttatatcaacaattatatgggcatgaatacttaagactccagcccttaacacgtagaaactcaaaaaagaagagaggaagctaaagactaagcgtaaggtatatttggaagtaaattatttttatagtttctaagcaatctcatggtttataggaatactagagtgtttatggcataaggtgtttggttgcattcataaaacctatattttcaaagtcatagcattctagataccatgatatttttgtaatattggaaactacactccaacgcaaagtttttatgacatggct

SEQ ID NO: 6331 - DNA, 636 bp, Zea mays
  Predicted polypeptide sequence is orthologous to G1760
ttttttttttttttttgactgactaattgttaataataaggatctgtccctatttttttggcaaaaaatgtggcccctagattttgttaatctgctatacatctagctactagagatagcaagttaattaattatacgcaaagcaaattacagatctgttaaagttgaaccaagtctgatcatcggtaagaaattacatacagatatatgtctagctagctagggagagtcacgacgtagatgaatcgtacttggtgttggagaaatcgtagagcctgccggtgctggagaagatgatgaggccaacctccgcgtcgcagaggatagagagctccttcgccttcttcagcagcccgctccgcctcttggagaaggtcacctgcctgctcgtggagttgtctatcctccttatcactatcttccccctccccatccctccttctatctctcagatctagtctaggccggaccggatgggaaggaaggatcacacgggaagacgaagagctcgccggcggccggggggacgagcgatgactggtctgatgggggaattaaaggcggaagctatagcctagctactagaggccggttccattcctagccaccttccaaagagcggaacgggaagtgccg

SEQ ID NO: 6332 - DNA, 571 bp, Zea mays
  Predicted polypeptide sequence is orthologous to G1760
ttttttttttttttttcttgatagtaaacgaagatgagaatacagtaacaaactcataacttatttgtcttagaaaatctccagcatggcaaaaaaaaaaaagacacaagctagcaggactgtactcaggttcccaaaagttacatatatgggcggtttaacaaactcaaagtaactttaccagcttcctttgaagcgaaaggttttgttcttttcgttgtagttgtagtccctactctaaagtagagatcatatggttgtccagtcactctcatttatgttaattaattgaaagcttttccaatcttactagctctggcaaagggaggcagaaagcttgaggcagcaactgcataacttaaaagagcaccatcggtatgaccctcaactaaccggaaagtgaactcttcgcgttcgcttagttccctgggtcggggcgctctcgaagggtggcctagtcggttttcgctcccttcgattttctcttgacccttcttcgaagttctcatgacacgaaggttctatttctaggaggtcgagctcctacccttcttccggagctagggtttct

SEQ ID NO: 6333 - DNA, 1539 bp, Zea mays
  misc_feature (74)..(125): n is a, c, g, or t
  misc_feature (169)..(194): n is a, c, g, or t
  misc_feature (230)..(246): n is a, c, g, or t
  misc_feature (896)..(900): n is a, c, g, or t
  misc_feature (1374)..(1403): n is a, c, g, or t
  Predicted polypeptide sequence is orthologous to G1760
ccgccctgcgccaagaaaagccatcgttcttcccacaaacgcacacatagaagcatcattcccctctcggctannnnnnnnnnnnnnnnnnnnnnnnnnnnnnnnnnnnnnnnnnnnnnnnnnnnaaacctgctgcctttgagctttcttcttcgagtgctcccaccannnnnnnnnnnnnnnnnnnnnnnnnncacgttcggcggcgcgcgcggagaaagatagatccnnnnnnnnnnnnnnnnngtccttgcttccgatcggagggccacaaccacaacctctcgctccttagcgtgcgcgcgcgagccagggtcaagaagagagctagctagctataggccggagatcgatggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagtcgtcgcaaatcccaactcggagcttaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacatnnnnngatctatgagactgaaggaccaagtggagttaatcgggagtcaccgactccattcaactttgcagtagtagaaaccagagatgttccagtgcaacttgaactcagcacactgccacaacaaaataacattgagccatctactgctcctaagctaggattgcaattaattccatgaagaagagtaaaactgccgtcttatgatgctgaaggaaactatttattgtgaagagatgatactcagagaaagacatatttgtggcagggagatttgagatatgaacttataaatgtaatgcaaataattttcagactggaatggggtcgtggaattcagaggatgattgctttctagttgcatttgatgtttgatgagacttttctcatgtgaaacgtttattaaaacttcaaaatggtgcagatgttgctactacccttgttaggcttgtataaatatttgactttgtgtactagcannnnnnnnnnnnnnnnnnnnnnnnnnnnnngtgataggggacaatgatgcgatctaggagtacaaacagagtctagtttccactcagttgagttttatattgctctcaagcgttatcaagggtttagtaggatacagatataattaagatacagtggttaaatcgc

SEQ ID NO: 6334 - DNA, 695 bp, Zea mays
  misc_feature (671)..(672): n is a, c, g, or t
  misc_feature (677)..(677): n is a, c, g, or t
  misc_feature (680)..(681): n is a, c, g, or t
  misc_feature (685)..(685): n is a, c, g, or t
  misc_feature (690)..(690): n is a, c, g, or t
  Predicted polypeptide sequence is orthologous to G1760
tacgcgggggcgtgcataataaaacctaatcatcggcacttcccgttccgctctttggaaggtggctaggaatggaaccggcctctagtagctaggctatagcttccgcctttaattcccccatcagaccagtcatcgctcgtccccccggccgccggcgagctcttcgtcttcccgtgtgatccttccttcccatccggtccggcctagactagatctgagagacagaaggagggatggggagggggaagatagtgataaggaggatagacaactccacgagcaggcaggtgaccttctccaagaggcggagcgggctgctgaagaaggcgaaggagctctctatcctctgcgacgcggaggttggcctcatcatcttctccagcaccggcaggctctacgatttctccaacaccaacatgaaagctgtgatagaccgatatgggaaggcaaaagacgagcagcttggcaagaacgatgcaacttcagaactcatggtacggtgaggaaaatgtacctatttctagctaactagcagttattggtcgtagtacacacgtgccatatgatgtatgttggtcggaccaagatcagaagtttagtccttcattactcacaaataaatgacattcgttgtgtttagctaatcagcttttcaaaatttttgcgannaaaanaannaaanaaaanaaggt

SEQ ID NO: 6335 - DNA, 854 bp, Zea mays
  Predicted polypeptide sequence is orthologous to G1760
gcatcacatcgagccgggagattggaatccagttgagatttcgctcctctcctcccctcccccgccctggtgagcccctccgggcgacgtgtgtcccgttgcctttccttcgctcgacggccacctgttgccctcgcatggctctgcctgctcctgccaagcgtccaagctcccgctcgcccggcggctgcacgccgcagcgtctatccacccagatccgcacgatccccgctaatcgccgcaccccctacctcccatgcaacttctctagctcacccgcatcccggctcggcactgccttctccttgcacttcacttctgtatctagaccacctcatcacaattcgtcgtcagcgtcgcgccgtcgtctcagattgatgcaaggcgtgatgagaagctagaggcagcaactgcatatattgcaagaaaattgggtttcaaaccataccgataattttcttgcaagttgtgcagttgttgtctcaagcttgctgcctccctttgccaaaactacgaggaaaagcacatgttatattatcagtgaacacatcaggataaatcttaactgatatgtgttggtaatacacacatttaattggaattttgcagcatgatatatacagcagctattaggtaggcgttttgggtttttaggtcccgtttggttccattagtcctaagactaaagtttagtccagaaactaaacttaagttctatcctgtttggttttagagactaaatagattctaaacacattaaatgaagtacacaaagcctaaaatgcccctctccttattgcttgcgtgcggtgcagattctctatgcaagggtaattagtgtaaatgatgtcatt

SEQ ID NO: 6336 - DNA, 725 bp, Zea mays
  Predicted polypeptide sequence is orthologous to G1760
tttttttttttttacctagaaaaccaagaggacttataattcagagtacaatttacaatagcatacatggcaagcttatatgaaaagcaaaattaaaatcaacattcttcttaatacataaacaatcgcatctagcagcttaaagtttagctgttaggtcttgcaattcaaccaacgatatccatttcttatcactcggtttagttatcctcactgtatttaaagtcttatggcactttcagtgttctttattaaatcatctggtttactgactctgagttatcctgaagtttggacaaaaatctcaccctacacttggtgtttctgatttgtccctttgcacacttagctcaagattgatcggaagattctctgtattccgagtactgtgtctaacagtagtacttgtttgctcattatttactccttgtccatacacctttctccgtaattcagtgttatgttgatgaagaaggttaactttgttgtatagttccatgctttcctggtgcatgaggcttcccttcctgtttaattcttgaatctgataaaaaataagttggtcctttttcagacgaatatttcttaggctcgtctccagcttattctctaaattctgcaaatctcccacgttcaggccagaaagctgctgacccaacaactgccgatggtgctcttttaagttatgcagttgctgcctcaagctttctgcctcgctttgcctg

SEQ ID NO: 6337 - DNA, 644 bp, Zea mays
  Predicted polypeptide sequence is orthologous to G1767
tcgcggccgcgtcgactcacagtcaggcagtctgcaggcatccatggagtactactacgcctaccagcacagcagcagcggcggcttgagctcaaaggagaagaggccgccgctgaagcgggggcagctcaagcggcagatcgtgaggaccatcagcagcctcgtggtgccgaggcacgccgccgtcgctggcgctgctgctgctgctgggtcgagggagaaggaagatcgcggcagcggattcggcggaggacggagctacgactgacgatggatctctcggagaaggcgtgataagagatacgattcccagcgtcagtttgtgtgttgttatctgtcagtcagaagaaattaccttgttcttatcacgccaactcagggaaaatgggccaagcaagtttttcctccttggctggaactcctgcgatgaattctggcttgactgactaggggatgcgtcgagcatcgatggtctacaaggggaacaggtgcagcaaatatgtcaacattagaacgtttgtgacgataaagtgtcaggaagctatgtaattaaaatcaatcatcatgatgctacattatgtcagttttctgttgaaaaaaaaaaaaaaaaaaaaaaaaaaaaaagggagggggtcgacgcggcc

SEQ ID NO: 6338 - DNA, 765 bp, Zea mays
  Predicted polypeptide sequence is orthologous to G1767
ctttttttttttttttttttttttttatgacaaaaccatgcacgtaaatccctccagagggaagaaagttgttaacattgaattacatgaagaaacacagagaaatgtgacaaaaaaaaagaagcaagaaaatcggaatcatcacgccaaaagcttgtggcgatcgatgatccaaatttgaaatagatgcaagtctaaaacctaaaaccatcgaccatacctcctcctggatcaccttgctgcatacaaccatgtgtgcgtgaactagcaatccctaccactgctccaaaaccctagatgcgttgcgccattcagctcgccatacacatgcacgtgcgcccgatccactgcatggatcattgcatccacgcgccggctaggtatggcggatggcgcccttgcttctcctgtggttcatgatgttccacgtacgcgcgtactcaccgagcttgcatcttgcgtcgacggggatctctatcatggcctccacgcgctcgcccacacgagaggctgttccttccacgccaggaagacgcctgctccggctgccgagtcgtctaaaccggcgtcccgcatcgaccagccttcccgataccgacggagcaacgaccgcacgtcgtcggcgacgtcctcgctgaacgccaccggagagaagccggaagaccgcatgcggcgcgcccatgaagccgccgtctcccgccgctccatggactccgacgccgggcacgagaccaagtctacaatggcacgtccggctcccctctc

SEQ ID NO: 6339 - DNA, 827 bp, Zea mays
  Predicted polypeptide sequence is orthologous to G1767
gccgcctcgccgcagtagcagcttacatggatacgctgtttaggttggttagccttcaagcctccgagcagcagcagcagcaatcggcgtcctacaactcgaggagcaccacgtcgagcggctccaggtcgtcgtcgcaccagaccaacgcatcctacaactactactaccacagcaacagcagcggcggcggcggcgggcagtactactacggtcagcagcacccacaccagcaccagcaccagcagtactacctggagccgtaccagcaagaagaatgcggcaacacccaccacctttacatggatgaagacttctcctcctcgtcctcgtcgaggcagcatttccactcgcacggcgcggtggtgcagccgccgacgtcgtccacggccacgcccacggcgccgacgccctcgctgtccacgtcgtccacggccgcgggggcggcgcacgcgctgttcgaggcggccgacctgtcgttcccgcctgacctcaacctcgacttctcgtccccggcctcgtcgtccggcgggggcgcggcctcgtcggcggcggtcgggggaggtggcgggggaaggtgggcgagccagctgctgctggagtgcgcgcgcgcggtggcgggccgcgacagccagcgcgtgcagcagctgatgtggatgctcaacgagctggcctcgccgtacggggacgtcgagcagaagctggcgtcctacttcctccaggggctcttcgcgcgcctcacggcgtccggaccgcggacgctgcgcacgctcgctgcggcgtccgaccggaacacgtccttcgactccacgcggcgcacggcgctg

SEQ ID NO: 6340 - DNA, 681 bp, Zea mays
  Predicted polypeptide sequence is orthologous to G1772
caacaaacaattcccttcaccatgctgcatacattatatctggaatccgcaacacatgcatggtcaagttacattccaaaatatccccatcttgcttgaggagtagaactagttttatcagaattatgaacattggcttcaaatcacgtcatgaaatgcgacatatagaacttaaaagctactctatatcttgggatcctaacaccagggtaaattttttttgacatggaggtatactctatggtggcaagggggctaagaagaacagtattttttgcctttatgttggtgaggaagcttaagtcagctgtacagttcaaagggatgtgccatcacccatcagataatgaagcttcagatcttgtccaccaattcggctggcacattgagatcaaaaagtgcatcaccaccgccattggcatctacccggtctcgcttgttagatcggtgccccctattatcccccctattaccagaactcgagccatgcaactcatgagttcgtttccccagactaatcgatgctggttggttcctgtgttcatcctcctgactatgttttgttgactgtgaactttgttcagcaggatcccagctaatattgagctctgaggccctgtcaaggcccttagatttgtatggagcgatattgtgaggtgtgcgtagaggatataacaaatc

SEQ ID NO: 6341 - DNA, 425 bp, Zea mays
  Predicted polypeptide sequence is orthologous to G1772
acaagctttttttttttttttttttttttttttgttaggttaggtatattctgataccagctacctggaatgtaattaatctagctatcttgtcactctctgtcagtctccatatgcacatcacatctactgatctacgcatccacacaagcaacgtgcatgggtcatcatccattcattgatgagcagagcaggcacatgaatttcagaacactaatttacaatttaaactaactttacatgaacatatatgatggaagcaaacaagatagaactcgctccaattaatctgcacgcgtgctgctgatccttccaatgatatatcatctgtctctctctcgatctctactgcatcccgatgtggctgttgagtagcagctgctgctggttcaagttcaagaacgggttgttgctgctgtagccgt

SEQ ID NO: 6342 - DNA, 771 bp, Zea mays
  misc_feature (765)..(765): n is a, c, g, or t
  Predicted polypeptide sequence is orthologous to G1777
gtcacaaacctgtggagaagatggtggctgcaacctggttgcatgtatatgtggacaagcattctgctggttatgtgggggtgctacaggtagagatcacacatggtcaactattagtggccacagttgtggcaggttcactgatgatcagactaagaagacagaacaagcaaggcgagacctctatagatatatgcactaccacaatagatacaaggctcacaccgactctcttaagcaggaagcaaagctaaagaatgagatccaggggaagatatccatttcagaaaataaggaatcaaagataaaagattattcttgggtcataaatgggttaaacaggttgttcagatcaaggcgtgttctttcatattcgtatccgtttgcattctacatgtttggtgatgagattttcaaggatgagatgactcctgaggaaagagaactgaagcagaatttatttgaggaccagcaacaacagttagaatttaatgtcgaaagactgtctggtttccttgagaaagattttcaactttttaccgatgatgaggtcatggatacaatgaagcatgttataaatctttccaatgtggttgataggctctgcaaacaatgtatcaatgcattgagaatgatttgttatatcctctacgcacacctcacaacattgctccatacaaatctaagggcattgacagggcctcggagctcaatattagttgggatcctggtgaacaaagtcacagtcaacaaaacatagccagnatgaca

SEQ ID NO: 6343 - DNA, 662 bp, Zea mays
  Predicted polypeptide sequence is orthologous to G1789
caaacctaatcagcaggatctactagctagctagctgttgagagcttgacacaaagaagcgaccgagcggtcgagctagcttccaccatgtcttggagccagagcgagaacgcgcggttcgagcgcgcgctggccacctacgaccgggacacgcccaggcggtgggagctcgtggccgccgcggtgggcggcgggaagaccgccgaggacgccaggcggcactacgccgacctcgtcgacgacgtcggcgacatcgagtccggcggctacggcgccaacgaccaaaacgccaacggcggcgccaacggcagcaacgggaacaacaggggcggcagagccaaccggccccagacatgaggggcgcctgccgcgggagaccgcaccagcacgccggccggacgacgttgcgcgcgtgcatgcaatgattgttcgtcgtgtacgtacgtgagtcctgagatatgtatgtatgttcgtgtgcctgtgtgtaactatatatatatatatgtgtatacatatatatcggcatgcatgcatatgcgcaaagtgcgcacaagtatatatgcgctgttgtggcagaagccgtgtctgatcagtgtgaccgagtgcgaggagctagcacgggcgcatagctgcagcctgctagctagctcctgatggatgtg

SEQ ID NO: 6344 - DNA, 478 bp, Zea mays
  Predicted polypeptide sequence is orthologous to G1789
atatatatgctacagatgctgagattttacatcgcaacacggggggaacggagatcgattgatcaacatcctatagctattgctagtagtaattctaattcacatgcgtgcttgaacagataatccgtccgacccactcgcttggcttgcttcttttgtagccacacgtgcttcttttttttggcgcgaagtgtacgtatgtaggacgtacttgttcagtggttctcatgatgcttgcctgccgcctagatcttcaggtcaggtgcttcagcctgtcgctgtcggcgtcgtcgtagccgccggggcaccctgtacgcggggaaggccaccttgccggcctcgatgtgctccaagtccttcaccagcagctcgtagtagcgcctgacctcgtccgccgacttgccacccacggcgcgcgcgatgttgtgccagcggtccggcgtgtccctgtcgtacaccgccaacgcctgctcgaaca

SEQ ID NO: 6345 - DNA, 544 bp, Zea mays
  Predicted polypeptide sequence is orthologous to G1789
aaatacataatatttatatatacacacaagtggacaagtaggagggagagggaacagaagcattggagatcgatgggtcggtcggtcgatcgcgcgtgactggctagcataggactcatcccatactacaattattactactaaattaacacatgcatatgcatgcatctaatctgattcttgctttcacacaccacttgcatgcacttgcagcatggaccattgcatgcatactgatactgtcccattaatcctatatacacacatgtttgcatcttctggatcatcgatcgttcgtcctatatgttcaattgacctcctagatcttcagctgtttcagcctgtcggcggccccgtagccggcggggtagcggtaggcggggaagggcaccttgccggactcgatgtggccgacgtcctcctccagcagctcgtagtagcgcctgacgtcgtccgcggacttcccgccgccgacggcgcaggcgatgttgtgccagcggtcgggcgtgtccttgtcgtacaccgccagcgcctgctcgaacag

SEQ ID NO: 6346 - DNA, 650 bp, Zea mays
  Predicted polypeptide sequence is orthologous to G1789
gcataaatacatgacttttaggctttacaccctccataactttagttcaaggggaccaatgaatacatgtggttatcaatcttatgtacactaggatcctacaaccacaggtagacagacataaacttgatcataaactatactatacacatattgacatatacacactggttcatcattttattctccaaccagagctggatttcctttggttccttcttggatccgtagagctttgttttctgcctctttgagcctccaacatttttttaacctcgggtccagaatccctgtgtcttgtgcttggggtacggcacattgcctgactcaatcatcttgacgtcgtaatcaagattttcatagtggcagcgcacttcctcggcagacttgatgcctcccatggcgctggacaccttgtcccaccggttgggtgtgccctcgccatagtaggcgagtgcctcttcaaacatcttgttctctttctggctccactgtgacatggagttgggagaggagctccacgaggcagacatatttgaagtatcctctgttggtgcgctaaggcttactgtatctagtgtctagactgaagtatttcgctcttcagaagctcttatggttttccccgcgtacctcggccgcgaccacgc

SEQ ID NO: 6347 - DNA, 472 bp, Zea mays
  misc_feature (33)..(33): n is a, c, g, or t
  Predicted polypeptide sequence is orthologous to G1789
tcggggggggcaccacgtctgtggaggaggtgngccgccgctaccagcagctcgccgtggacgtcgcgcagatcgagtccggcgaagtgcccttccactactggtacgccgccgccccgccgctgcatccaggcaccaacaacaacaacagtacctacgtgcccaacttggcccagaaaatggaatagattctgcaatcgctcgctccaaggatcagggcctttggactcgaccggccggcagcaagttgtaacaagcatttggccccgggattttgtttatttgtagtggttttctcgtagttaaaatatcgctactttatgcacgatatatatattctgctgtccatcttctttcgttgttctcaagtgacctgaaacatttctactgcaacatatttatgagaacaaacgctgcatgctcagaacgtagacattccaagaaaaaaaaaaaaaaaaaaaaaaaaaaaaaa

SEQ ID NO: 6348 - DNA, 779 bp, Zea mays
  Predicted polypeptide sequence is orthologous to G1789
ctttgagcctacagcaaaggaggacggcaacgtgaacagcaagcagttcacgtttgccaagtgcctataaatagtagccaccctatagcagcaacgagatcaaaacagcagagcttgcaagagctaaaaacgacttcagtccagccatccaacaagaagatcagtctacacataaaaccagagatgtctgggtccaggagctcttcgtctcacaacgttaccattgattccgagtggagcaaaaaggagaacaagctgttcgaggaggccctagcctgctacggcgcgggcacacccgaccgctggcacaaggtggcccgtgccatgggtggcatcaagacagccgacgaggttcgccgccatcacgagatccttaatgaggatgtcacgctcatcgaatccggcagagttccattccccaactacaacacgcagggagcttggaactaaggagtgaaggatgatgtgaagaaccaccagacaggaactactgctacgcatgaaatagatatcttagccattgaagtaaatgtgctgatatattgtgttaagaagtttatgattgctcaggtaataaataagaggagctagagaatacacataagtgtgttatgtgtaaatagctatatataggctgtgagcaaatcatcagttatgctatagaaaccagggaaccctatctgcccatagtgtgtactgtgaaattatagtcccctccctatggatgaatacttgtatagtaaagtgtggtgtaaaactcttgtaccagttttgtaaat

SEQ ID NO: 6349 - DNA, 574 bp, Zea mays
  Predicted polypeptide sequence is orthologous to G1789
atttcactttcaccgtagcatatatagcacgcaaacgctaccaggtagcagaatacagcaaaccggcctgacgacgacgtacacttggatggaatggaagccacgaaatagcataggtagggggtgtttcttatgtggacctattgctgctctaggctctagagataaggctctctccaagatcacatccacttcactgcggctggttggggtgcctcgtcatcctcttgtcaccgttgtccctgccccaagaactgctgctgctgcttccactgccaccagcaccagcaccagcagggctgctggactgggatcctcggccgccttcttcggtttcgatgtgcttcacgtccgtcttcaggtacttgtagtgcctcttcacgtcctcggctgtcttgccgcagccgactgcccgcgcaacgttgtgccagcggtctggtgtgtccttgtcatatactgccagcgcacgctcgaagagattgttttgactctcggtccaggacgaacccattgttttatcttcactcagcaagagaagacacctagctaggagagatgcagggcaagcaatggc

SEQ ID NO: 6350 - DNA, 750 bp, Zea mays
  Predicted polypeptide sequence is orthologous to G1804
gcaaaagatacactgacatgcatacggcatagtatggcccctgtcaaacaaacatggacgaaaacacagagctttgtgtttaattactactatcttacagttgctttattgtttggacaacccaggctcatgaacagcagcaggccaacgcggaagctctcgcccatgccccatatcgtccctcgcaaacgtttgtgtcgaccacatgggatactgttactaacggtgctgctaccgacaggtacaggatttttttcccatacaagcaactaagcaagcggactggaactgcacaattcgagacactcgtcaatcgtcacaattcaccacatggcgctgcccgagcggcgcatcccgcgaccgcccttcttggggctcacattctcccttgcctgctccaccatcttctccaccagcttctttttcttcgatagcagaatcgtcttctgctctgctctgaggcgatcgttctcctctttgaggtggatcacttcaacttccagctccaccgtatacgcctgcttcctggcgcgtgaccgggccgcggactcacggttcttgatcatccgccgctgccggcgctccacggtcttctcggtgcacgcgtcctcgggggagtcgcgcttccgcgcgctgccgccgccaccgccgccgccgtatttccggaccgtccctgccccttcggtgccaatgcagctcatcatctccgcctgcgtcatcgcgctcaccccgtccgacgaacccgggctc

SEQ ID NO: 6351 - DNA, 1173 bp, Zea mays
  Predicted polypeptide sequence is orthologous to G1821
ccacgcgtccgccaccacaccacgagcgcgcgataaccctagctagcttcaggtagtagcgagagccaatggactccagcagcttcctccctgccgccggcgcggagaatggctcggcggcgggcggcgccaacaatggcggcgctgctcagcagcatgcggcgccggcgatccgcgagcaggaccggctgatgccgatcgcgaacgtgatccgcatcatgcggcgcgtgctgccggcgcacgccaagatctcggacgacgccaaggagacgatccaggagtgcgtgtcggagtacatcagcttcatcacgggggaggccaacgagcggtgccagcgggagcagcgcaagaccatcaccgccgaggacgtgctgtgggccatgagccgcctcggcttcgacgactacgtcgagccgctcggcgcctacctccaccgctaccgcgagttcgagggcgacgcgcgcggcgtcgggctcgtcccgggggccgccccatcgcgcggcggcgaccaccacccgcactccatgtcgccagcggcgatgctcaagtcccgcgggccagtctccggagccgccatgctaccgcaccaccaccaccaccacgacatgcagatgcacgccgccatgtacgggggaacggccgtgcccccgccggccgggcctcctcaccacggcgggttcctcatgccacacccacagggtagtagccactacctgccttacgcgtacgagcccacgtacggcggtgagcacgccatggctgcatactatggaggcgccgcgtacgcgcccggcaacggcgggagcggcgacggcagtggcagtggcggcggtggcgggagcgcgtcgcacacaccgcagggcagcggcggcttggagcacccgcacccgttcgcgtacaagtagctagttcgtacgtcgttcgacttgagcaagccatcgatctgctgatctgaacgtacgctgtattgtacacgcatgcacgtacgtatcggcggctagctctcctgtttaagttgtactgtgattctgtcccggccggctagcaacttagtatcttccttcagtctctagtttcttagcagtcgtagaagtgttcaatgcttgccagtgtgttgttttagggccggggtaaaccatccgatgagattatttcaaaaaaaaaaaaaaaaaa

SEQ ID NO: 6352 - DNA, 1081 bp, Zea mays
  Predicted polypeptide sequence is orthologous to G1821
ccacgcgtccgcatgaataatccccaaaaccctaaagccagtgctccttgcaccttgccaccggagcttcccaaagaagcagtggcgaccgacgaagcaccgccgccaatgggcaacaacaacaacacggaatcggcgacggcgacgatggtccgggagcaggaccggctgatgcccgtggccaacgtgtcccgcatcatgcgccaagtgctgcctccgtacgccaagatctccgacgacgccaaggaggtgatccaggagtgcgtgtcggagttcatcagcttcgtcactggcgaggcgaacgagcggtgccacaccgagcgccgcaagaccgtcacctccgaggacatcgtgtgggccatgagccgcctcggcttcgacgactacgtcgcgcccctcggcgccttcctccagcgcatgcgcgacgacagcgaccacggcggtgaagagcgcggcggccctgcagggcgtggtggctcgcgccgcggctcgtcgtccttgccgctccactgcccgcagcagatgcaccacctgcacccagccgtctgccggcgtccgcaccagagcgtgtcgcctgctgcaggatacgccgtccggcccgttccccgcccgatgccagcccgtgggtaccgcatgcagggcggagaccaccgcagcgtgggcggcgtggctccctgcagctacggaggggcgctcgtccaggccggtggaacccaacacgttgttggattccacgacgacgaggcaagctcttcgagtgaaaatccgccgccggaggggcgtgccgctggctcgaactagcctagcttctcagttccccgtgtacaataagaggggcggtcgcggcgccgcgccgcgcccttgggttgggccgggcgctatgctgcagtttggtttgtaaactaacgagcctagggtagctggtgcacgcgcgccacctcgccggacgtcgccgtcgtcgtcggcatggacttaaccggcgggccctgttgttatttctcaagtttgtagccaacgcactgttcggtgcgttccataatttaatttaccatgttgctctcgaaaaaaaaaaaaaaaaaaa

SEQ ID NO: 6353 - DNA, 1544 bp, Zea mays
  misc_feature (283)..(283): n is a, c, g, or t
  Predicted polypeptide sequence is orthologous to G1850
gcacgagggcgaggcgggtcgccctcgccatattagcgcctccctcctcctcctcctgctcctgcgcgcccctgctcgtaatcctaaccgccctggtttctctacacgctacgggaccggtaacttctagaacccaccaccttccatccttccttcctttcctctctctctgtctctcctcgcgcccacggtgcccgccagccagatccgcgcgttcaccggcgccatggccgccgagcatgccaccgccgcggtgggtgagccgcctcccgccacgtcgcanccggcggagggcgtgacggcggcggcgggccagaggtccgtgcccacgccgttcctcagcaagacgtaccagctggtggacgacccggcggtggacgacatcatctcgtggaacgacgacgggtctgccttcatcgtgtggcgcccggcggagttcgcgcgcgatctgttgcccaagtacttcaagcacaacaacttctccagcttcgtgcgccagctcaacacctacgggttcaggaagatcgtgccggacaggtgggagttcgcgaacgactgcttccgccgaggggagaagcggctgctctgcgacatacaccgccggaaggtgtcgccggccacgggggcggtcacggtggccgccgccgccgctgcggccatcccgatggcgctgcccgtgggctctccggtgtactccggcgaggagcaggtgctgtcaagctcgtccccggcgctcccgtcgctgcagcagcacccgccggcgccgtccgggtcgggctccggcggggtggtctcgggcgacgtgggcgaggagaacgagcggttgcggcgggagaacgcgcggctggcgcgcgagctcggacagatgaagaagctctgcaacaacatcctcctcctcatgtccaagtacgccgccactcagcagccggacgccgccaaggaggcggccgccgggaactgcaccggcgagtcgtcggatgccgccgcggcgcctccgctcccttcgatcctggagctcctaccctcgtgccgcgccgaccccgcgcccgctgcagccggaacggatcacgaggatgacgaaaaggcgggcgctaggctgttcggcgtctccatcgggcggaaacgaatgcgggacgagagcgaccaccacgccggcgtctgcgcagcggaggtgaaagccgagccggtggacgcgcgtcccgaccagcagcggcagcgcaacgccacggagccgcagtcgtggcccatttaccggcccaggcctgtgtaccacccgctccgggcctgcaacggctcgggcagcgctgggagcgaccacgacgggtccaacgactcgaggtgacgggagcaatcgtcgatctgccctcagtaaattagtattacacttactaatggtactaggtaactatattacaggttaaactaggatgtgagctctaaatctctaattatgtggggatttactgaccgatcctatgtaaaaatctccaagtgtttatgtagttgatctcatattactgcaaaaaaaaaaaaaaaaaaaaaaa

SEQ ID NO: 6354 - DNA, 906 bp, Zea mays
  Predicted polypeptide sequence is orthologous to G1850
gcacgcggtcccatggctctgccggtgcggccggcctcaccgtcgctctctaccgacgagcatgtcctctcctctaactccggatccgccgaggaccacccgcaggctgccgcttccggctccgtcagcgcgtcggcgtccggcgacacgggggaggaaaacgagcgcctccggcgggagaacgcgcggctgacccgcgagctcgggcagatgaagaagctctgcaacaacatcttgctcctcatgaccaagtacgcctcctcccagcagctagacgcctctgcagcgctctcctctgtcgtcaactgctccggcgagtcatcggaggccgtacccgcgcctccgcccctccccccggcgatcctcgaactaatgcccgcgtgcccgggtcttgccaccgcggccgcgggcctcgtcgccgaagcggatcctgaccaggcctcgaggctgttcggcgtctctatcggcatgaagcggatgcgcgacgacgacgacaccggcgaggaacaggcggaccacggcgccgcagcggatgtgaagacggaggcgtcggatccgcagcatcgcatggagccgtcgccggagtcgccggaccagcatccgtggcccatataccggcctacgcccgtgtaccattcgatgcggccctgcaacgggccggaccagggcgccgggtccgaccaagacgggtccaactccaggtgattgggcccaccgcaccttgtagaagcttctagttctaattaatcaattgccatatcggcaactaattattatcctagagaaacataataatactatattttcttctgtttttccttggctagttggggattggaagcttctctcccttgttgtaatgggtgcttataaatcagcggtaaaatccaaaaaaaaaaaaaaaaa

SEQ ID NO: 6355 - DNA, 860 bp, Zea mays
  Predicted polypeptide sequence is orthologous to G1855
ggccttttccccccttctggagcttggggggaggcactctgcaccttcgtcttcgtcttggcgtcctccagcgctctgccttcctgagctggcttcttgtccgcaggatccatggcgaaggactacccagcttctccgaaagctcagcagctccaggaatccaagaagcagcgcctgacatacatcctcgtcgtaagcgcgctctgcatcgccttctacgtccttggcgcatggcagaacaccacgcttccaaagcccataggcaactcggcgatcacccgggttggctgcgatcccactgccgccacggcacagtcctctggctctgtgccgtcgtttgggccaggctccggcgaggtgcttgacttcgacgcacaccaccggctcaccatcaacaacacggacggcgatggggaactgcagcagttcccggcgtgccctctcaacttcagtgagtacacgccgtgtgaggaccgtaggcgcgggcgccggttcgaccgaaacatgctagtgtatcgggagcgccactgtcctggcaaggacgagcaggtccgatgcctcatcccagcaccgcctgggtacaggacccccttcaagtggcctcgtagcagggactacgcctatttcaacaacatcccccacaaggagctcagcattgagaaggcggtgcagaactggatccaggttgagggcgacaagttcaagttccccggtggtggcactatgttcccgcgtggtgctgatgcctacatagatgacatcaataagctcatctcgttatcagatgggaagatcagggacgctgttgacacaggttgcgggggtgctagttggggagcttacttgctggagagaaacat

SEQ ID NO: 6356 - DNA, 711 bp, Zea mays
  Predicted polypeptide sequence is orthologous to G1855
cacaccaagcatcatgttattagattgcaatatcacaccaaatatatgagtgaacatcttatacaccattgcaatgtgtcacatacgctacgtggctaatgatgtttgataccaattccagctacatggttcacatgcctcctatatacagatatcctgaagttaggataaaaaaatggcaatgaagacagaactgacaggcaagtcatgcctacattttcgcaaacaaaaaacagtaacaaggcgacgattattgtttttgcacgagcttcccggtccagtaagtcttgacagccactaggatcttgtcagtgttgaatggaccggactcatggtccatgatttggctcttccacctcatgcctccagtgatagcttgtaccttcaccaacacctctacgttgtccctgatgatcacagtcccctcaggccttagaattcggtccatctccagtaggatgtacgttatgtcacacctgtcctggtaactgctgaaaactttatcagcatggatgaggtcgtaggtcctcgggtacgttgagaaagcctcacaccaatcatggtacgtgccaataaaccctcgttcgtaaataacacccagggtgtcatgggccaagcctgaaggcacaacattcatcacccaaagagggtacttcatcaatgcagctgcaaagccacctatccccgcattcatgtccatcacattcctgt

SEQ ID NO: 6357 - DNA, 821 bp, Zea mays
  Predicted polypeptide sequence is orthologous to G1855
ttcttctgctgcggcggcggaggctctttcagttccatccatcttctccctcgtggctctccttcctctctcccgtagtcccgccgaccccccgcgccggccaaggaaatcaagcgaaaacgccagattttgattgttccacatcttctttcatctctgaggggtttcccgtcttcctcgcctgctctaatggctaaagaacaggatggatcccccaaggtgcgccacccagaattccaaaggatgcgcgtaactctcaccataggtgtcattggcctctgtgtcacagcatacattcttggtgcttggcaaggtacctcgaacggcattagttcccccttaataagtaccagaacccagtgcaaagatcccgtgcgatcatctggtgctcgcctggatttccaagcccaccaccaggtgggcttcaatgaatcggcgcttgctgtggagaaattcccaccttgccagctcaagtacagtgagtataccccttgccaagatccaaggaaagctaggaagttcccaaagaaaatgatgcagtacagggagcggcactgcccaaagaaagaagacatgctccggtgcttgatccctgcgcctccaaactatagcaaccccttccagtggccaaaaagtcgcgactatgcttggttcaataacattcctcatcgggagctcagtattgagaaggctgttcagaactggattcatgtcgagggagacctgcttagattccctggaggtggcactatgttcccacatggtgccgatgcttatattgatgacataaatgcccttgtaccattaaatgaaggcaacat

SEQ ID NO: 6358 - DNA, 683 bp, Zea mays
  Predicted polypeptide sequence is orthologous to G1855
caaatgaaaactaaataaatacctgttactattatggtcaccccaatatacgattaacaatgcctgcccggtgccatcgcattacaaactaaaacctagttcaacccctcgtgaaacagggccaggaacctacgcaagaccagcgaaaccttcccctgctacaaaaccgcttcctgtatctcaactagaggaccaaccaacccccccccccccccgtctcaaaactctcccttaccttcccatctgattgtagctagctacaaagaactagagaaaaggtgaaaagggacatacatactacactgagacgcaaaacgctgacgccatccctctcgaccggtagtaaaagtgtaaaacaggcttggttcacgctttcaagtgagctcggtgtcactcgtgtgctagtgctcctcctcggcttcggcggtccagtacgtcttgaccgccatgaggaccttctccgggttgaaggggccgtcctcgtggtccatgatgcggctctcccaccgcatccgcttggttattgcctggaccttcgtgagcacgtcgactgtgtcgcggatgatagctgtgccctcgggccttaatattctgtccatctccaagaggatgccagttatatcgcacctgtcttggtagatgctaaacagattgtcagcatgcaggaggtcatatgttcttgg

SEQ ID NO: 6359 - DNA, 803 bp, Zea mays
  Predicted polypeptide sequence is orthologous to G1863, G2334
ggtggacgtgccgctcgcagtacttgtggcccggcaccacgtcgcgggagcaccgccacttcttgccgtccgtgcgccggcaccgcccgggctccggctccatgctgctgcggtagtcgaagcacaggctccccaggcccatcactgcaacacgttcattcgatacggcaagacagtacaaacgcaaaaacaaatagaaatcggccgggggcggctgaagctgttgtcggtgcttagtgcttacgcgaggggaagcgctgcgggccgaaggaggacgcggcgacgctcttccagatagggagcacaaggtgcgccggcaccggcgcgcccgctgcgaagtagcggtagatgagcacctggtgctccagttcctgctgctgcatgaacgtcagcgctgacggcctcttgggcgtcgccgttgccggggacgcatccgcgtctcgctcgccgcccccgccgagccccaggcccagcccgagaaccagaggcgacgaggccgccactccggcgctcgtgtcggcgcaggagagacggggcagcttcgccggcggctgcggcgagtcggtctccttgtcctcggcggccattttggagactccgctgttgcgcttcctgtggcggtttggactctacggagggagcgcgcgggcagcttctcgatagaagggaagaagagacagcattcgttctcgacagaggaagtgtgaagtggtgggtatatttatgcgtgacggctcccgccgtctggtcgctcggtaaacttgtgtctgcggccggcggagcacggaggcgaaggaggagca

SEQ ID NO: 6360 - DNA, 809 bp, Zea mays
  Predicted polypeptide sequence is orthologous to G1888
cgaagattgtatagtagatagggggtagatgaccggcgaaacggccggcggcgacacgtatggcgcgtttggcctctgcggctctgtacaaatggcggcccaagacaggaccagacttcttcgcaaaatgttcgtggcgctctcaggaacgccttagtcaaagctttgcacgctatagaagacttgtattttagcttttgaatattttcagctaattttaggagctgtgcattcaaacacgcgttagtcaaaggttcgcctcagttaaaggtttcttcatgcacgccgcagaagactagaatcttgcagcagtatttgcatggcaccgaaccgacggctgggatgatagaactgaaccgacctgatagaggccatccgagcaggcgccgacgtcgccagcggacgcgtcgtcaatgaggaagtcctcgacgtgccacccgggcagcgtcttggtcaggtactcggagatgctgctcccgtcgctggcggtcgccgtggtcgcgccgccggcgccgctgccgctgctgcaggattcgtcgttgcaggggccgcggctgttctcctgctcctcctcttcggatgggcccgcagagtccaccggcgctgacgagaggcgcacgccggtgagcaggaaccggctgtgccgcctcgtcatgtcgctggcgctgtgcaccggcgcgtcgcactcccggcacaggatcgccctgtcctccttgcagaacaagaagcccctccgctcctgcacgcagccgatgccagacaggcagcgccgctactcggttagcaagcaccaaagcaccgtccgagcc

SEQ ID NO: 6361 - DNA, 516 bp, Zea mays
  Predicted polypeptide sequence is orthologous to G1888
ttttttttttttttttttagttgagaggattcaaactcatatttcacctctgcatggatgcaaaataaaaaaaacacctgctttgacgcatcttgtcctatgtgtgtttagagtgtggcacggtcgcatctctaccgaatgaaataaagtacagtgtagtagatgatatgatggtgacggttgtcttcattcatgctgccttaaggacttgctgttgcggctgcgcccgcggcttcccacttctagcggattcggagcgtgttcagcacccttcatccggaacatagcatgtaggttttgcataagttgatcctcatagagtaaaatctttttcagggcccatgatcactcccgagatcagtcagatgaaagccttagtcttgcacgccatagtagcatgtctttctggtatctgcatgaagttcaaaaaactgaagactggtacaagcagtttacggatagggaagaagctgagtcattagcatctgaacggcttctgcgcagcaacctggtgcc

SEQ ID NO: 6362 - DNA, 614 bp, Zea mays
  Predicted polypeptide sequence is orthologous to G1888
ctcgtccaccaggaagtcctcgacgtgccacccgggcagcgtcttggtgaggtactcggagatgctgctgctgtcgctcccgtggctggtggcgggcgccgacgacggaagaggaggaggatgtgcggctgcgtcgccggcgctgcagcagaagctgccgctgctgttctcgtcgtcctcctcctcctcatcctccggcgccgggcacgcggcggcgggctcggcggagaggcggacgcccgtgagcaggaaccgggcgtggcgcatggtcaggtcgctggccgtgtgcaccgacacgtcgcagtcgcggcacaggatggcgcggtcctccttgcagaacaggagcccccgcttgtcctggcagatgtcgcagagcggcggcggcggcggtggcgccgggctgagcagcgagaagcggcggtgcttgccggcgagcttgttggcgcggtgcacgcggcggtcgcacgcgtcgcacagcgccgcctcgtcggcgcagcagaacacctcggccgcctcggccgcgcacacgtcgcactgcaccttcatctcggccactccactctgcttttccctcaagcgatgatcgcgcgcgctctggcggctcagctcagggc

SEQ ID NO: 6363 - DNA, 856 bp, Zea mays
  Predicted polypeptide sequence is orthologous to G1888
gtcctcttctctgttcctctccagcccccttttcaacctttgacgctgtagcttgagagcgagcttagtgcctaccatattctcctcctgagcgactgagcgctggtctccgataggctcgccatgcaggtgctctgcgacgtctgcggcggcgcgccggccgccgtgctcttctgcactgacgaggccgcgctctgctccgcctgcgaccgccgcgtccaccgcgccgacaagcgccgccgcatcccgctcgtccagccctgcggcgacgactccgccgccgccgccgccgcgccgctctgcgacgtctgcaaggagcggaggggcctcgtgttctgcgtggaggaccgcgccatcctgtgccccgactgcgacgaccccatccacagcgccaacgacctcaccgccaagcacacccgcttcctcctcgtcggggccaagctctccgccgcgctcgtcgaccaggcgcccccctcccctgacgacgacgacgacgacgtcgccgagcccgacgctgtccccgccgcctgcgcggccaaggcctcgtctcttgagtccggcggcggcagcagcatctccgactacctcaccaacatctgcccgggctggcgcgtcgacgatcttctcttggacgactcgtcgttctcagcgccatctaagaccggctacagcgacggccacgatcaggtgccgtccgtggatgccgacctcttcgacgtggtggccagcggccggccaggcaagcgcgtcggcggcgcagcgctgggcttcgacaaggccccggcctccgttgtggtcgtcccgacgcaggggtgcgtgacggagaagacttgggacagcgacagcgacgtgttcg

SEQ ID NO: 6364 - DNA, 868 bp, Zea mays
  Predicted polypeptide sequence is orthologous to G190
ccccactccatccatccaaatcagctttgcctagcttattattccttaccgacaaacaaaactgacacggatccgcacagagcaacgaactcgcccagtccggctgctgctgctgcacaacggactcgatctcacggccccgccggctcgcagccatgcagacgcagtcccgcctggccatgagcggcggcggcggcagcggcggcagcagcagcagctcggcctcggaggacgagcacgaggcggtgatccgcgagctgacgcgggggcacgagctgacggcgcagctgcgggccgaggccctacgcgcgctgcgcgggcagggccaggccgaggccaccgcggcattcatcctgcaggaggtgtcccgcgccttcaccgtctgcctctccatcatgagctcgcccgcccgcgccccgccgccgacgatggaaatgcccgcgcctgccctggccccgcgacggggccgggacgacagcatcccaagagagcaacggaggacgtcctcgccgcacagcgacgggtaccagtggaggaagtacggccagaagaggatcactaagtcgccgtttccgaggtgctactacaagtgcagcttccaccgcgagcgcagctgccgggccaccaagcaggtgcagcagtgcagcgacggcgacggccacccgccccagtacgtcgtcatgtacttcaacgagcacacgtgcgacacggcggcctgggagccccgcggcggcggcggcggcttcctcgggggtgcggctggacgacctgtccaggtccaggctgcaggcggtactaggccagggccagcagggcgctcgcgcgctgctgctggacgaacgcggcgtccaggaggagcacgagcgcc

SEQ ID NO: 6365 - DNA, 848 bp, Zea mays
  Predicted polypeptide sequence is orthologous to G1944
acgaaaagaaaatgaagaaggaagtagaagaggtggagggccacggttatggcgccgccactcccatgacgccgccgccgtcgtcgctcggtcttccttccccctcggtctcgacattgacctccgccgctgccgctagggttttggcgcggccaatgcccgcctcggtcccaagcttgcgggcgccttcccccttcgtgcgggccatgcgcacccgcgttgatccgccgccgccacagccgctcacggcccctcctcttcttcgtcctcgtccggtgctaccgccgccgccgataccagagaagcagcggcgggggcgcccgcgcaactgcgaccgactcctcccgccgccgccgggcttccaccttgctccgtccgcacgggcaccgctgcctgcccgcggccaaccttcatctagggggcatccctttcgcggtcaattcggtgggctccagttgcacgtgctcaaaatacatgtgggagaggatatcgtatcaaagattgtgcaggtctcgaaaataactgggaaggctgtctgtgttctctcagtgtttggggccgttcaggattgctatctgctccactctgctgtcatcttaaatcacaagggtcctttagaaatcattcatgtgtttggatccattttgacatctgatagtcctggatttgggtgcttatctgcgactcttgcttgtggtgattgttctcttgtcggtggcattgcagttggacctctcatagctgcaacaccggtgcaggcaattgttgggagcttccacaatgatgctttccaggcaaacaagaaacctaagctcgttgcatgttaccccagttctcatgttaccgct

SEQ ID NO: 6366 - DNA, 861 bp, Zea mays
  misc_feature (2)..(2): n is a, c, g, or t
  misc_feature (11)..(11): n is a, c, g, or t
  misc_feature (858)..(858): n is a, c, g, or t
  Predicted polypeptide sequence is orthologous to G1950
tnctggtccgnattcccggccgaccccgcgtccgcgtcgacttttccggcggcgaggagaggcgaccgccggagaagagctcttccgcgccgccgagtccggcgacgccgccgcgttcgcctccctcgcccccgccgacctctccctgcgcaacgaggacggccgctccctcctccacgtcgccgccgctgccggccatccccaggtggtgctcgcgcttgcccagtgcggtggtgacgccgcggctagcgtgctgaatgcgcaggacgaggaggggtgggcgccgatccactccgccgcgagctccggcaactctcaaatcgtcgacatcctgcttgagcgaggtgctgatgctaacctggttactgatggtggccgaactgctcttcattatgctgcgagtaaagggaggcttaacatagctgaaaaactaatagcccatggtgctaatgtcaacaagaaagacaagtttggctgcacacctttgcatagagctgcaagcactggaaacgcggagctgtgtgaattcctcattgaggaaggtgctgaagttgatgctgttgacaggacaggacaaacacctcttacgcatgctgttatatgcgagaataaaggggttgctcttctgctaattagacatggtgctgatgttgatgttgaggacaaggaaggctacactgcccttggccgagcatcgaacagcttcagacctgcactcatcgatgcagccaaggcaatgctcgaaagatgatctggtgctctggtcaaaaacgatgggaagtgtgatacgagaaactgtgctgagtcgaggtgtaaagcttgttctggtgtgtaaacacggggctctctacagatcanatt

SEQ ID NO: 6367 - DNA, 848 bp, Zea mays
  Predicted polypeptide sequence is orthologous to G1950
caaccttcaagcatcgccatggctgcgtcgacaagtgcaggccttgggctgttcgatgctccgccaaggacagtgtagccttcctcttgtcctcagcatcagcatcagcaccatgtctaatcaacagaagagcaacctggaacacaattgtaggagcaaaactagtaataatctctatcggtccgcatttggaatccgtccgtattgtggagttgtcccggtgtacgagcttcgccgctgatggcgctcgcgcgtctcgctcacgctttggtttagggttattacgatttacgagcgcgtttatcgattctaatcgttttggagaggacgaacagacggtttctgaatctggtggtggagaacctgaacgccgacttgtgttctctgctccgcctgaatctggcctgcggtcctgccatctcttctgttcatcagcagctgcagcctgcagctgaggccgcaatggcgcggtcagaagcagcaatatcctgacgaacgcggagagacaggccaacagaagtatttcagagttcggattcttgtgggggaaaaggcaattgacaattcactaattcacttacgcaaaagatggcagcaatatactattacagtgcacactgtacagtcaccatgacgcggccggcacagctaggagcctaggatggtccctccctcctgctcatcagtgctcactctaggtggtcatgcggccgtagcgacatgaacatggccgcgtagtgtctgagccgccggtccccgtcgtcgggcccgccccaccacggcggcgccgccaggtccgccgacgtccgggccctgtacctgcgccacgcgagctggatgttgacggc

SEQ ID NO: 6368 - DNA, 716 bp, Zea mays
  Predicted polypeptide sequence is orthologous to G1957
ttttttttttttttttttcgaaaaacatgactaattaagattcaacaaggcatgcacgccacctatggtgtaataaggtccctgatcagtagatcaccatcgttcatcgtctctctgcgcactctacgccgccgctgctactaggtgtcgccgtcgacatactccacttcggcgggagcaggtgccggtgccggtgcatcgtcgccgctgcactcaacattgaacccgaagagcctgaagctcctcgcccccgagggtgccactgccacctcgatgtcatggccggcgatggtggcggacgccaccgttgcacccccattattcatggccgcggttccgataactatcggcctcggccacgccggcacggtggcagcgtcgccgaagctgatatcgacgtcgcggcgccggcgctggcagtggcggtactcgatgaagtatcggccgccgccgctgcgggagaaggtgacggtgtcccccgcggcaagtcgtgcggcgcggacgaagcggctccaccccttggtcatgacatagctctggctgctcccccagtaggagtagcggaactgccacagcgccccgccgcggtcctggaagcacagctgcgtcgacccggcgccggccgccgggaagaaccgctccgcgtgctgctttggcaccaccagccggttgagcttgcctacgtcgctcggggtcagcaccttgtcgaacatgtg

SEQ ID NO: 6369 - DNA, 836 bp, Zea mays
  Predicted polypeptide sequence is orthologous to G1957
cggccggggagcaagtagtagtagtagtaggctgctgctgtagagatagatcgtacgagtacggagtaggagaacgacgaccacgcggcttctccggctgccatgccttcacaagtcaaggttcaaggagcacctcgctttcccggaagagtaggatgaggaggaggacgcctgctgcgtcggcggcgcactagtcctccacccgccgacgttctcctcctctgagccggcggcggcggcgcagtcgaggttcaccccgaacaggcgcacccgcttcgaggctgacgacgccacggcggggggcggcggctcggcgtgctgccctggcgttggcggtaaccgtaccggcacggagtccagcatcaccgtcgtggagggctgctggtgcggcctgtagaagagaagttgcctggtgccggccccgtaggcgtcgtagccgacgtggcggcggcgggtgtcaaggtagagcggggagggcgagggcggcaggtggtggagcaccgtcgtcgtcgtcgtcgtcgtcgtcctggcggcaccgaccccagctgctgggtagtggtggtggtgcgcgtgcgccgccgccgcccacggcgcgtaggggacgacggcggaggggagagggaggcggtggtggtggtactggtggtgcacgacgggcgggtcgggtcggcgccgccagtcgatgaagagcctgccgcgcgccgcctcgccgacgccgcggccgaaggagacggtgtccccggcgtcgaggcgcttctccttgacgaagcggctccagcccttggtcatcacgtagctctggctgctgttccagtaggagtagcggaagccgcagg

SEQ ID NO: 6370 - DNA, 647 bp, Zea mays
  Predicted polypeptide sequence is orthologous to G1957
cacatcaacttcacagtttgttctctatcggacccacaaattaaaacatataggtacagatgacacacacatacatacacacacatctctctctgtctgttgtctctcgttccagctccttggcagcttgatgcttcctgcaaacctcccacgcatgcccggccccctgctaccaaatcccctacagaaagtagggttttctggaagccatggaaaaaaaaataaaaattaaaaaaaaaaaaacggaacagcaaaaaggcagcagctttcttctgggggcgggaatggaaggaaaattgcccggaaaacaagggatctctctccacttccttccttcctttttttttccccccgggaacaggtcaattcaatcctgtcacttcgtgtgcaagtaaaactagggggctgctgctgctgctaacaactacaactgctactactttggctgtttggattctgcaggcataatcttaaatctcctcgtcatgctggaatggactgccccagttgttgtaagcgaaggggctttggtgcatgtacccgaacatcgccgttggtgtctccggctccggccccgggccgcagtcgaggtttacgccgaacaaccggagccgccgcgacggtggcggcggtgccaaaactgcact

SEQ ID NO: 6371 - DNA, 694 bp, Zea mays
  Predicted polypeptide sequence is orthologous to G1957
ggggaaaacactgatcgatcctagtgtttatatgtgtatcttctcaaaccaactcatcaaaaaagcgaagagcagccaaaaacaaggaaatcaaaacatcaagtcctaacttctataatcaaaggttataatgtattaataaaaaaaaaaagagaagaaggtaaaatatgagaagaaccgaaacaagcagaaagaaagaatcgttgaactttcctttgatttttgcctttaggtcacagatcgagatccaaagctgaacgcgcctccctcttggaggaagacgacgacgacggaaacgacgccgcggaggactccccgccatggcgaggcaattctagtagccttaaagttggagtcctttgctgccacccgggcatctgcaatgacaatgcatcgccctgatggctagcctcgccgccgccatctgggttgttgtccaggttgacgccgaacagccgcacgcgcttcgcggcggtcgtcgggctctcgatgaccggcaccgagtcaagaaggaccggccgtgacgcggcggtgacgccggcggcgctcggttgcaccgtgtagtgatgcagcggcagcgagaacgggcgcggctggggcggcggcgcgtgatgaggaggcatcctggccgagccgaaaaacaggagctgcctccccacggtcggcgcggggtaggtcgtcgtcatgctgcgga

SEQ ID NO: 6372 - DNA, 1967 bp, Zea mays
  Predicted polypeptide sequence is orthologous to G2
ggcacgagctcccactgcactgctgctccgctgccgctaccctttccctctcccttctcgtcctcggtcctccccaacccatggccacggccaccaccacccactgccccttctcccaccacgctatttatcgcggctgcacgactcctgcccatcaggcgccatagagacgcgtgggaccgaagccgccgatcaagcgctgctcggggcggagcagcggccggcggtggtgagtgctggcagacaggccggcaggtcaggcagagtgaccagctggtgagtcgaagcttgagcggggagctggactttgggggttccggcgggctccggagcggagatggtgctggatctcaatgtagcgtcgccggcggactcgggcacgtcgagctcgtccgtcctcaactccgcggacggcggcttccggttcggcctgctcgggagccccgtcgacgacgacgactgctccggtgagatggcgcctggcgcgtccacggggttcatgacgcggcagctcttcccgtccccgaccccgccggccgagccggagccggagccggtggcggcgccggtgccggtgtggcagccgcagcgcgccgaggatctcggcatggcccagaagccggtggcgccagcgaagaataccaggcgcgggcctaggtcgcggagctcgcagtacaggggcgtcaccttctacaggaggacgggccgctgggaatcgcacatctgggattgcgggaagcaagtctacctaggtggttttgacactgcgcacgcagccgcgagggcatacgatcgagctgcgatcaagttccgcggcctcgacgctgacatcaacttcagtctgagcgactacgaggatgatttgaagcagatgaggaattggaccaaggaggagttcgtgcacatactccggcgccagagcacggggttcgcgaggggaagctccaagtaccgtggcgtgacgctgcacaagtgcggccgctgggaagctaggatggggcaacttcttggcaagaagtacatctatcttgggctctttgacagcgaagttgaggcggcaagggcttatgacagggctgcccttcgcttcaatgggagggaagctgttactaactttgagcctagctcctacaatgcaggagataataacctgcgtgacaccgaaaccgaggcaattgatgatggtgatgccattgatttggatttgcggatttcacagcctaatgtgcaagaccccaaaagggacaataccttagctggcctccagccaacatgtgattcccctgaatcttcaaatacgatggcttctcagccaatgagctcatcatccccttggcccgggtatcaccaaaacccagcagtgtcatttcaccatcagcgcttgtactcgtcagcttgtcatggcttctttccgaaccaccaggtccaggaaaggccggtggagcgaaggcctgagctgggcgcccagccattcccctcatgggcatggcaagcgcagggctcccctcacgtgccgttgcaccactctgcagcatcatcaggattctctaccgccgccggggccaacggcggcatgcccctgccgtctcacccgccggcgcagttcccgactactacaaacccgttcttcttcccctagaccgcttttgacatgacagcttgctgttccggctcagctctcggcgtctgggatggcagctggtcttgcgtgtggcgtctagcagctctggtgatggaagaaagtgattgtgttttgtgtgtgtgtgtgtgagagagagagagagccataataagaagcgacatggctggtctccctctggtatgcgcctgttaggatatgggatatctccatgcatggattgtttccgagacagtagtagtattttgttgtagtcgaccatgcgtgtacatcagtataactggatctttgaagagctgagattttatgactcaacaagcattgacat

SEQ ID NO: 6373 - DNA, 2284 bp, Zea mays
  Predicted polypeptide sequence is orthologous to G2
ggatctttcgctttccttaccccgttagcgttcctgcttgatacactacgactgcagattctttggcagaccgctaccaagtgcaagtgtgcaacgcacacacatcactcacagtctcacggtgtctctgtgcgcgcgcgtgggacacaggagggagagagacacagagaagggggcgggacgatcagctctagctcagctggtatcgtctaaactgcataaaaggggagggaaaaaaagttgcaatgatgcatcccggcgcatagatagagagagagagagaagagagagccccgactcgagagccaagaacgccgtgtgttgtgtttgtgtgcatctatctccgtacacgcacgctcgtacgcaccagctagcacgaccgccatggccgccaccaggagagccttcttccacagcgccgtcgacggcattgcgcgcgccgggccgggggaggccgagcggctgccggcgccgccgcaggtcgggcgaccggtggaaggcgccagcagcatggtcttgggcttccccgtgccgcggcccacgatgccggaccgccggccggccgccgtcacccagcagttctttccgcccactactacggccgcgcagcaggcgacgatggaggagcaatgccacgtgcccgccggtagcgcggcggagcagtgggtccggtcgtcggcgtccaggaagagccggcgcggcccgcggtcacggagctcgcagtaccgcggcgtcaccttctaccgccgcaccggccgctgggagtcccacatctgggactgtgggaaacaggtgtacttgggtggattcgacacggcgcaggccgctgcgagggcctacgaccaagccgcgatcaagttccgcggcctgaacgcggacatcaacttcaccctggacgactacaaggacgagatgaagaagatgaaggacttgagcaaggaggagttcgtgttggtgctccggcggcagggcgccggcttcgtcaggggcagctccaggttccggggagtcacccagcacaagtgcggcaagtgggaggccaggatcggccagctcatgggcaagaagtatgtgtacctgggcctgtatgacacagagacggaggctgcccaggcatatgacaaggctgccatcaagtgctacggcaaggaggcggtgaccaacttcgatgcccagagctacgacaaggagctccagtcgcagccctgggacggcgagctggatctcgagctcagtctgggctgcgccagcagcgatccgtccacggtcgccgtcgaggcgttcagccccgcgacgagcagcagtagccgcaagcagaggacgatgacgctgacgctcggtctgccggaggaggaggagacgggcgccggctaccctcaccctgctgccggcatgttcgggcgcccggctgatggccacgtccacgtagcaccgccgccacaccggcaatggcagcagcagcagcagggacagcacgcagctccagatgcggcgcctgagcgacgagcggcagagccagcagatcggcagcggtggggccggggcgcgcgctggcccatcgccagcgccagcggcattaactgggcctgggcgccgccgtacgccaccgcccgcgccggcaccgacgacgacgacgccagcagcgccgccgctgcagcatcatcaggattcccactgtggcagctgggtgcggcgtcgtccaggtccagctggcccagctgctgagcctttcctgtcgtcccgcgccaccaacagtgacgctgctgggccacgtactgacggcgactggtgacctgctggaaccgccgccggcctgtttcccttttctaggtaaaagcagtggcagaggggcgagctagcgacagcgtgcctcgtcatccatcgtccctgcgccgtggctggcggggtgggaaaaagtctgagcagttttgagcgtccggaggagctcgagatttcctccctcgaatagtcacttggggtggccactagttattatttctttccttccccctcgttgattctgctacccattatagcctctgtatctagctacatgcatgatgctgctctagcgctgttggacgttgatggcacggtgtacggatatggacagggttcgtgtgaccccatgtccactgctaggcctgtttccaaatggagtatttctgcagtaccatggcttatagaaatgccgagtattttaaaccattaggtgcttggttactttcccaaaaactaggttttcaaagctatggtataatgaataccacggtatatatttttc

SEQ ID NO: 6374 - DNA, 684 bp, Zea mays
  Predicted polypeptide sequence is orthologous to G2
ccacgcgtccgaacgcttcttttctttttcttttttttatagcatgcagtgatgattcaaccttagttgtgcctttcctcctaatcctatatatgtaggatttagtactggttgactatataagtatatatgtattgttcagtaaaagtatacataggttagctgcatgtttatgtatgtagctggttgtttcaatcagaagataaaaaaaaagggaagtagtggctagggaattcctccggtgggaacgccgtgcttgggtgcaggtacatataccttgggctattcgacagcgaagtagaggctgcaagagcctacgacaaggccgccatcaaatgcaatggcagagaggccgtgacgaacttcgagccgagcacgtatcacggggagctgccgactgaagttgctgatgtcgatctgaacctgagcatatctcagccgagcccccaaagagacaagaacagctgcctaggtctgcagctccaccacggaccattcgagggctccgaactgaagaaaaccaagatcgacgatgctccctctgagctaccgggccgccctcgtcagctgtctcctctcgtggctgagcatccgccggcctggcctgcgcagccgcctcaccccttcttcgtcttcacaaaccatgagatgagtgcatcaggagatctccacaggaggcctgca

SEQ ID NO: 6375 - DNA, 820 bp, Zea mays
  Predicted polypeptide sequence is orthologous to G20
cccgttctacgcttggcttggctgcgctgcgctgcgcacaccgaacccctcgccgtcgcggctcgcctcggctccgccccgaccgaccgatcgatccggccggcggtgggcgccatggcctcccccaaccccgaggccgcggggctgcaggccgtggctgtggcgggggcaggggagggcggctcgtcctcgtcgctcagcgccgttgcgggagcggctgcgttgtccggggagctggtgcccaggagggcgttggcgctgcgcaaggagcgcgtgtgcacggccaaggagcgcatcagccgcatgcctccctgtgcggcggggaagcggagctccatctaccgcggggtcacccggcataggtggacaggtcgatatgaggctcacctttgggacaaaagcacgtggaatcagaatcagaacaaaaagggcaaacaggtatatctaggtgcatatgatgatgaagaggctgcagcaagggcctatgaccttgctgcattaaaatactggggagctggaacacaaataaatttcccagtatctgactatgcaagagaccttgaagagatgcagatgatatccaaggaggattatctcgtgtctcttaggagaaagagcagtgccttctacagggggttaccaaaatatcgtgggcttcttaggcaacttcataattccagatgggatacatctttgggactcggcaatgactacatgagccttagttgtggcaaggatatcatgttggatgggaaatttgcaggaagctttggtctagagaggaaaattgatcttacaaaatacatccggtggtggctac

SEQ ID NO: 6376 - DNA, 129 bp, Zea mays
  Predicted polypeptide sequence is orthologous to G2007
actaactaccttcgccctgacctcaagcgtggcctactcagcactgccgaggagcagctcgtcattgacctccatgccatgctcggaaacagatggtccaagatcgctgccaagttacctgggagaaca

SEQ ID NO: 6377 - DNA, 1417 bp, Zea mays
  Predicted polypeptide sequence is orthologous to G2007
gatagccgcaaccgtgagaggctggtagcccgtagccggcatccctcgccctcgacccatttgaacagggcctcgagctttgcctctgctgctgctcgcttgatccgtctcttgccgtggtacgcgtgctcgatcggcggatcgtcggcggcggcggcgggaagctctccgacccgcggccgggatgggtcggcagccgtgctgcgacaagttgggggtgaagcgggggccgtggacggcggaggaggaccgcaagctcatcaacttcatcctcaccaacggccattgctgctggcgcgcggtgcccaagctcgccggcctgctgcgctgcggcaagagctgccgcctgcgctggaccaactacctccgcccggacctcaagcgcgggctcctcacggacgccgaggagcaggtcgtcatcgacctccacgccaagctcggcaacagatggtcgaagattgctgccaagctaccgggcaggactgacaacgagatcaagaaccactggaacacgcacattaagaagaagctgatcaagatgggcatcgatccagtcacgcacgaacccctcgaccggaagacaaccagcagcggcccggctacaacctctcagtcaaccaagtctgacgaggcgaccaaggagcagagcccgcagaacgacgacgccgtgataagggacgtgccggccgatggttgcagcccgacggaatcgagcacgaacaccgtgagcaccggcggaagcagcagcagtggtggcggcggccatgaccaagacccgctggtgaagtggcttttggaagaggagcctgccaccggcgacgaggcgtggctgaacttcactggcagtgtcgacgtggacgagttcagcagcattgccgccggtccggagttgttgccgtgggatggcgcgaccgactggctgctcgactaccaagattttggattgggggactcgagcttggtcgatggctacatggtcaacaacaacagctcaaacggagcaaagttctagctagctagccgaagatgtcatctcatctgcttgtgttgctttgctgccagtgaacgtagatacgtaagtaataaaagcattggtatcgaggttgtcaaaggtggatgaccacatcgcaggaagatcatgaagagtccttgcacgcactcctgtatctcgaaccaactaacggctgggatgcaattgagaaggggaggagcacaggccaatcaatctcaaagagataaaactggttcttgaagatctcgaagaaagatgtgtttcttcacaatcacaaagagaggttgtagaagttcttgctgttgtatacatggttgcgtatatattgctaaattgtaccttgttaggccattttgttcgcaaattgcacgagtcactaattagtcagcaaaaaaaaaaaaaaaa

SEQ ID NO: 6378 - DNA, 879 bp, Zea mays
  Predicted polypeptide sequence is orthologous to G2007
cgctgccatgggacccacggaatccaacctcacccgccggctgccgctcggctgccctccggcctccgggcatcgccatcggagtgtgcaggaaccaggaggaggccggtagagtccgtgcacccgggtcccactcccctgaggccgtccgtggctccgtgcaagatggggattgcgcaagggtgcgaggtcaccatccccgcgcctggtcatcagtagtttggtggctcacagcatatataaaatgcaatataagcataccgatagccttgttaactcagtggttaatctagtacaagttgccagctgatagtaaattgatcaatggggagacagccgtgctgtgacaaggagggggtgaagcgagggccatggacagcggaggaggacaagaagctcattagcttcatcctgacacatggccggtgctgctggcgggcagtgcctaaacttgcagggctgcttcgttgtggcaagagctgccgtctgcggtggactaactatcttcgccctgacctcaagcgtggcctcctcagcactgccgaggagcagcttgtcattgacctccatgccaagctcggaaatagatggtcccagatcgctgccaagttacctggaagaacagacaatgagatcaagaaccactggaacacgcacatcaagaagaagcttatcaagatgggcatcaacccggccacgcactagcctctagccaactccaaggcagctccctcacactccacaggtacagacgaatccgctaaatccagcgacaccagagaggagctgagccctggaagatgacaccatcatagggaggttccgctgtccaccgattcatcggagcagtccagctggccagagccaggcagcaacgtc

SEQ ID NO: 6379 - DNA, 878 bp, Zea mays
  misc_feature (123)..(127): n is a, c, g, or t
  misc_feature (319)..(340): n is a, c, g, or t
  misc_feature (354)..(358): n is a, c, g, or t
  misc_feature (403)..(440): n is a, c, g, or t
  misc_feature (443)..(447): n is a, c, g, or t
  misc_feature (562)..(606): n is a, c, g, or t
  Predicted polypeptide sequence is orthologous to G2057
aaccaaagactcctgtccccatccgcttaattatcaggctaacaacaacaacatccgctggctggcactgctctgccgcttatagctcctccctgaaccccaggaggaagcacactagctaannnnnatcgatccgtgcagagcgccagcgagaacaacagcaaaattaagatgcaaaagcttgagaactactacagcaactagaacatcaactaaacctactgtaacaacgcagcaaacggacaagcagcaagagatctagtgaagaagccaatgtgctgcgttctcacatgcctaatttctaagaagagaagctccnnnnnnnnnnnnnnnnnnnnnntcgttcttggagcnnnnnccagtgacgtacacaaagcagcgagagatgtagagaaaccgaccnnnnnnnnnnnnnnnnnnnnnnnnnnnnnnnnnnnnnntcnnnnngagtgcttcgctcccaaccttgctcctccattttgctgcagccatccgttgtcgtaggaagcagcagcaaagtaactacctgggcggtgcatgttgaggagctagctgacggtgnnnnnnnnnnnnnnnnnnnnnnnnnnnnnnnnnnnnnnnnnnnnntcgtgatggtggttggtggcatgttgggcgcgcggagtaatctgcgctccactgctctgccgtcgtcagtggtgagaagccgaggacacggacgacgagcggcggcttgtcgccattgccgccgttgtgctcctcgtcgccctgcatcctggtggggatgcggatcccggagaagccgacgccgggcgagaacccgatggccgacacagcggggctgagcccgccgtgctgcatcgggttgtcggcttcgacgctctccggccatcctcgct

SEQ ID NO: 6380 - DNA, 755 bp, Zea mays
  misc_feature (1)..(2): n is a, c, g, or t
  misc_feature (22)..(23): n is a, c, g, or t
  misc_feature (45)..(46): n is a, c, g, or t
  misc_feature (52)..(53): n is a, c, g, or t
  misc_feature (60)..(60): n is a, c, g, or t
  misc_feature (72)..(74): n is a, c, g, or t
  misc_feature (76)..(76): n is a, c, g, or t
  misc_feature (79)..(79): n is a, c, g, or t
  misc_feature (83)..(83): n is a, c, g, or t
  misc_feature (134)..(134): n is a, c, g, or t
  misc_feature (137)..(137): n is a, c, g, or t
  misc_feature (140)..(140): n is a, c, g, or t
  misc_feature (143)..(143): n is a, c, g, or t
  misc_feature (146)..(146): n is a, c, g, or t
  Predicted polypeptide sequence is orthologous to G2071
nngatggaccctgcagcacggnnggaacttcggacgcgggggggnnggagannattacanaaagaagggcannntngangagnaggagggaacctcgcatcagcgcgatagagccctaacaaggaggaggaggnggnggnagnggnggatccgctggcgcggcgagggggcggcatgtcgcttacgctggaggagctgcagagctcgctctgcgagccggggcgcaacttcgggtccatgaacatggacgagttcatggccaacatatggaacgccgaggagttccaggccgccaccgccaccgccaccggcggctgcatcaagcaggagggcacgcagcgggagccgatgatgcccgtggcgaatggaacaggtgagaggggaggattggttcggcaggccaacgcggcggcgcaggccgtggtgcagccccagatggggagcggcggtggcggcggcggcgtcgccgccagcgggcggcagcaggtgacgctggccgacatgacgctggaggacttcctggtgaaggctggcgtcgtgcgaggagccttcgccggccacggccacgcggtcgtcggcatggccccaatcccagccgggcggatgggcatccagcagcagcacgcggctcccacgatgtcgtaccaagtggcagcgccggcgcccaacgccgtgtacccggttatggggaacggcacgggggaccacaaacggtaccccagggccatcgcgggggggccggcgactcagtgcgt

SEQ ID NO: 6381 - DNA, 818 bp, Zea mays
  Predicted polypeptide sequence is orthologous to G2071
gtggaagttggccaatccattcagagaattttgaaatcatttaaccagcttaaaaatgctaccacacgtagccccagttgtaggaaaatacaatcaatcacatccacatccgtcctggacttaatcatttatcaatttctctacaactttacttcacatacaaggtattgcttgagtcaaatatatgggcatgatagactgatagtttgaacgcagaactctctggacatcagtagctgccaaccagacaataatattgtatcatgccaacaagtcacatgaccacaagtttagagatctttcattttcttcaataataattgttgaggtttcaaaccgtgcattgccaatcaagtcaacaaaggaggaaaattgatatgcatgatcatagggctatagtatattcatgatgtgatgctgttagggttgactgtaatatacttcatgacaagggaatctacacattatagaattccttttgtagaaaacaacttcctacacatcaacaaagttcgctgctagtactaaattgaaagagtctagtctatagcttgtaaccagagcaaaagtatcttcttcaaaatgggaagcaattacctcattcttttgcttctccagcatttcgacctgtttttttgcaactcatcgttcaactctttaagttttgccacctcagcttccaactccatcatatacgcctgtttcctcccacgcgacctcgcggccaactcccggttcttgatcatccggcgttgcctcctctcaaccaccttcctcacagcttgggggcttccttcccctcaaaccagcacaaaaaa

SEQ ID NO: 6382 - DNA, 862 bp, Zea mays
  Predicted polypeptide sequence is orthologous to G2071
ggatcttttaaaatcattcattctctgcacaagctctggaagatggcaaaacctaaacaactctgcacaagctctggagtctggatgtgccagcaagatgcaaaacctaggcaactctgcacaagctctggaggatgactgaagccacaactcttgcgaccggcttcactccattttgttctctactacgtacataatttacatgtcagttttcgactccaccaatacggtactccagtactacgtaagcggcagaagggagctaacagtacaatcatttagattatgttcatgttcatgggttcatcgctacactataggagagaaattatctacagatcccaaacgcccctgcaggtacgtagcaagtgcaagtcatgtgctgttctaggcaatcgtcaccagggggccgtcaacgttcttcgcaagcacagccgtttcttccgtccgaatggatccttcaacatttctgatacctcgttgttctgcatttccataatttctgcctgtttcctctccagttcctgattctgctctctgagtttctgaacttcggcttctaactccattgtataagcctgtttgcgcgctcgggacctcgcggcggactccctgttcttgatcatcctccgccgccgcctctccaccactttctccactccgcctccatgccttctcccccgaatcattctttcaaacgaaaaagtttgcggctccgtcagcgacgacaggtcgctgtatcccttcccgacagaatcaagctggctcaccgctgtttgcacagccatggcgctgcctcccatgcctgccgccctgggcggtatcaggggcagatccaccatgccgaccggtgcaaacccta

SEQ ID NO: 6383 - DNA, 830 bp, Zea mays
  Predicted polypeptide sequence is orthologous to G2071
gattgagcccgcgcacgagcccatcgctttcgctttggcgtcttcgagaacccgcaagcaacctatatagcccgccgcgaattccgcctggcttcctcgtcgcccgcctcgtcgtcgcgccgcagtgagaggagggggaggcgatggatctcaacgaatgcgagaggagggggccggcggggccggatccgctgtcgaggcaggggtcgatctactcgctcacgttcgacgagttccagaacacgctcggcgggatggggggagggcttggcaaggacttcggctccatgaacatggacgagctgctgcggagcatctggaccgccgaggagagccaggccatggcgtcggcttcggcctcggcctcggcctcggtgtccgcgctgggggcagccgtcgacggcggggcggcgctgcagagacaggggtctctcgcgctgccgcgcactctcagcgtcaagacggtggacgaggtctggcgggacttcgtgcgggaggcgccgcccgggacggctggcggcgaggagccgcagcccaaccgacagccgactctcggggagatgacgctggaggagttcctggtcagggccggggtcgtccgtgacaaccctgccgcggcagctgctgctgtccctgcgcagccggttgctccacggccgattcaggcggtcagtaatggcgcctccatctttttcggcaactttgggggcgccaatgacgccggggctggagcgatggtgtttgcgccggtggggatcggggatcaggccatgggcaacgggttgatgcctggggtggctgggatggcaggtggtgcggtcaccgtgagt

SEQ ID NO: 6384 - DNA, 1388 bp, Zea mays
  Predicted polypeptide sequence is orthologous to G21
ccagagtaccagacaccactgcgcatcagtgcaaagaggtagctaccctatctgccatggctcaagagctccacgaaacgtcctcttgctctgccaccaccacctcgtcgtgcaccacatcctgctgctcgtccactgtcacagactcgtcctcttcgcccccgtcaccggcggcggccaatgccgcgcccgcgacacggaagcggcaggcgttggaggccgaggccgaggccgaggcgggcggtgaggaggaggaggaggaggaggaaggctgtgctggtaataaggcggcgccggccaagaagcgaccgcggggcagcgaggggaagcacccgacgttccgcggcgtgcggatgcgggcgtggggcaagtgggtgtcggagatccgcgagccgcgcaagaagtcgcgcatatggctcggcacgttccccaccgccgagatggccgcgcgcgcccacgacgtcgcggcgctcgccatcaagggccgcgccgcgcacctcaacttcccggacctcgccggcgcgctcccgcgcgccgcgtccgcggcgcccaaggacgtccaggcagccgccgcattggccgctgcgttcacgtcgccgtcatcggagcccggcgccggcgcgcacgaggagcccgctgccaaggacggcgccgcgcccgaggaggcagccgccgacgcacaggcaccagtaccagtagcactaccaccgccggcggcctctcggccagggacgccgtcgagcggcgtggaggacgagcggcagctgttcgacctgccggacctgctcctcgacatccgggacgggttcgggcgcttcccgccgatgtgggccccgctcactgacgtggaggaggtggtcaatgcggagctgcgcctcgaggagccgctgctttgggagtagcggtcagagatgctcgttgcctgcattgcaaacgaggtctaaacaatagtagcagtggtatcccatttcttctcgttttgcttctcgccctctcctttttttctctctttcttgcttactttggggggaaaacagctagttctttttttcttcttcttcttcttcttttattaaattgagttttaataagtataaacatatataaacgagagagagatataagctgtgtacttaaaagtgtaagacgagtacctatcagttcattattacgtatctactagtggtaccagtagtgatcatgttgtcccggccgtgtgtgaattccagcggtagttgttgaccttgctagatttttatagttgcttgtgttgtgtgctgtaccaaaattccccagggaaaaagggcaggaagcaaacgaatgtaacgggaacacaagcagcatctaatctctattactgctgacaacgaaaaaaaaaaaaaaaaaaa

SEQ ID NO: 6385 - DNA, 470 bp, Zea mays
  misc_feature (280)..(284): n is a, c, g, or t
  misc_feature (325)..(329): n is a, c, g, or t
  misc_feature (375)..(375): n is a, c, g, or t
  misc_feature (395)..(395): n is a, c, g, or t
  Predicted polypeptide sequence is orthologous to G21
ccagtctgaactcaacatgaccattattcataaaaccatgatctgaattgaacatggtccatccaaataaatatttcaagttacattcacaactaaatggcagaaaatactacagcctatccaaataaatattacaagtgtcatttcacaactaaatatcagtagtatcagctattcgtcatcactgtcaacatcatttgtagcaccttcttcggcttcgctgcaatactccaaaattgtatcgtcatcatcttcttcttcactatcactcccatacacnnnnnggccattttcttgtaccaattgagcaatttcagcagcttcnnnnntaagaccttgttcatcatctctcgttcaaaggcttctcatatatanttatcggaaactgcttgtcngactagcattctcttcacaacactcattttcttgatatgcaggagcattatgttgggcaacatcattttcactca

SEQ ID NO: 6386 - DNA, 1085 bp, Zea mays; identical to SEQ ID NO: 1835
  Predicted polypeptide sequence is orthologous to G2107

SEQ ID NO: 6387 - DNA, 700 bp, Zea mays
  Predicted polypeptide sequence is orthologous to G2107
agtactaatgccttcattgttggtctttttattattctcccagcacccaaaaagggagggaaatagcgctcgcccttgcgtggcgcgttccccgcgtgtgccagtgccagtacagagtttctgaattcaaattcgaactcgctcccggcacccccactttcttcccagtccagtagtagctccatagcgtggtctctcctctcccaacctcctgcgctggagacagactctacagctcagtagctccagagcgtcatgtcgctggcgccgtcgtcgtcgtcgccgtccacgatgctatgccatccgccggcgccggcgccgctttgccagcagtcgctgctcccgctcaccatcccgtcgtcgtagcaatacgagtggtcgaactccatgccgccgccgtacatcgccgccgcggcggcggcggcggcggcgacgtcgtccgcctgcgagggcgcgaccacgtcagcggcaacggcggcagtctcatcctgctgcgaggcggcgtcggcgagctggatggcggcgcggcggatgtcgtcgggggtggcgagcgtggcggggtcgacctggagcaggcgcgccgagtcggcgaagttgaggcacgcggcgcggccccgcagggccagcgcggccacgtcgtgcgcgcgcgcggcggcctcgggggtggcgaaggtgccgagccagatgcgcgacttcttgt

SEQ ID NO: 6388 - DNA, 991 bp, Zea mays
  Predicted polypeptide sequence is orthologous to G2116
gcacgagctcgtctccgccgcgccccaagcaccgccacagcagctccgtcgatggctcgggcttcttcttctcacccggcgccggcggtggcgcggggaaggatgccgccgcgtcgctggctgaggtcttggaggccaagaagtccatgactcccgagcaactggccgagctcgccgccatcgaccccaagcgcgccaagagaattctagctaacagacaatcagcagctagatcaaaagaaagaaaggctcgttatatgacagaccttgagcggaaggtccaaactcttcagactgaagccaccaccctgtcagctcaacttacactatttcagagggacacgaccggactttctacagaaaatgcagagcttaagataaggttacaggccatggagcaacaagctcaactccgtgatgctctgaatgatgcactaaagcaggagttggagaggcttaaacatgctactggtgagatgaccaattccagcgaggcatataacatgagattccaacatgttccatacaactcttccttcttcccgctttcccagcaaaatgcatccccacaccttggtagcacccagctgccactgccgttccacccaccccatcccaacgtgccaaaccaccagatggtgtcccaccgaaacactctcccggacataatgcagcaagagtctctcggacggctgcagggtttggacattgggaaggggccactggttgtgaagttagagagcagctcgatctctgcaagtgaaagcagcagcaccttctaacgaggcctacaagtgaaaacccaccgtttcagtaggttccattgttcatagtagcctgacatccttgtgctgcttcctgctctgtaagcccatttgttatttaattcattcaattagttgaaattatacgctgtcgcactggctgatcaatcatgttgtagaatggtccatgaacccttcaattctgtttgttttgggttcgtttcctg

SEQ ID NO: 6389 - DNA, 1149 bp, Zea mays
  Predicted polypeptide sequence is orthologous to G2116
gcacgacgttcttctccaccttcatggacatcgagaagatctcatcttccgggccctccgaccgcgaccgcgccgccgagacgtcgtctcccccgcgccccaagcaccgccacagcagctccgtcgacggctcgggtctcttcttctcgcccggcattggcggcggcgcgggcaaggatgctgcggcgtcgctggccgaggtcatggaggccaagaaggccatgactcccgagcagctggccgagctcgccgccatcgaccccaagcgcgccaagagaattctagctaacaggcaatcagctgctagatcgaaagaaagaaaggctcgttatataacagaacttgagcgtaaggtccaaactcttcagactgaagccaccaccctttcagctcaactcacactatttcagagggacacgactggactttctgcagaaaatgcagagcttaagataaggttgcatgccatggagcaacaggctcaactccgcgatgctctgaatgatgcactaaagcaggagctggagaggcttaagcttgttactggtgagatgaccaattccagtgagacatataacatgagatttcagcatattccatacaactcttccttctttccgctttcccagcaaaatgcatctccacaccctggtaccacccagttgccaccaccgttccacccaccccatcccaatgtgccaaaccaccagatgctgtcccacccaaacactctcccagacataatgcagcaagagtctcttggacggctgcagggtttggacattggaaaggggccactggttgtcaagtcagagagcagctcgatctctgctagtgaaagcagcagcaccttctaacgaggcctaccaatgagaatctgccgtttcaatacgtcccattgttcataatagcctgacatccttgtgctgcttcctgctctgtaagcttatttgttatttaattcattcaattagttgaaattgttccttgtcgcactggcagatcgatccatgttgtagaatgatccaggaacccttctagtctgtttatgttttgggaccatttcatgtttatgtgttcggtattagggcatttggattttggagtgaaattctgtgatgataaaaaaaaaggggggcccggtaccca

SEQ ID NO: 6390 - DNA, 1091 bp, Zea mays
  Predicted polypeptide sequence is orthologous to G2141
ccacgcgtccgcaaggcagtgatgctggacgaaatcataaactacgtgcagtccctgcaacggcaagtcgagttcctgtccatgaaactggccaccgtgaacccgcagctggacttcaacagcctgcccaacctcctcctccctaaagacgtgagggggacacgcacgcataacatgatcgctcgcttcgcattactacgtttggttcctagctcacacgagtcatattccattcctgtctgtctgtctgtgatcagatacaccagccctgtgggccgccgcatttcccgctggagacctcaggcgctccgctgccgtacctgagccagcctcaccatgggagccctctaggctgctgcatggacacccaggggggctctatgcacccgctcgacgcggcgttctgccggccgatgaaccctcagcatcctttcctcaacggtgctagcgacgcggcgtctcaggtcgggactttctggcaagacgaccttcaaagcgtggttcacatggacatcggccaaagccaggagatcgctcccacctcttccaacagctacaacggttcattgcagacagtccacatgaaaatggagctttgaggcatggccggggaaaaagaaagaaagaaaaccccagtccgaagctcgacgccgtcgtcccccctgtacatacggagaagagaggacacagctcgcaccggaagcagcgggctcttggggggtccaatccaacctaacgacgttggcccctagcagtgtttcagcctctaattttccccacccccgcccaatggtgtgacgattctttctttgaacaagatgcggaagaccgccgcgccggcagctgctcgcaccatccccgtcgcctgtttcgtttcagctttagcaagatcccgccggcgcggtgcgtcccagactctcccccagtatattccttcccgatcagagaccccccgcacgtaatgtcatttgtattgccgtcatatttgtagctgatatatatatagtgtatatttaagatcgccatttctcgtcaaaaaaaaaaaaaaaaagaaagaaaaaaactcgagggggggcccggtacccaattcg

SEQ ID NO: 6391 - DNA, 780 bp, Zea mays
  Predicted polypeptide sequence is orthologous to G2141
cttagcagcaggctcttgcgtccgtcttgcccttttgcttccgcctcctgcccttaaaatctttcaccaccccctcccgtcgcggtcaaattggcgatcctcgtttggggagggccaagaaaccagagctctctctccgatgcccaccaacgtcaggtgattgaggaacgttggtgtttctggataattggagatgtactcaggccagcaatctgatcaaggtcctagtgcaaatagtggcagagaattctccgaggcaaattggaattcttacacaatgcatcaaaagatagcttatagtggacaacatgggtttggaccttacggcatgggcttagaagataggctggggttgtatcaatcttcatctggtacattaagtcatgacatccaaatgagtgatgagcatagcggaggtgtgaagaagaggaaaggagtggaggactgtgtcacattgttgcctaatgcaggtgatcaacaaacagaaggttcatctcagccagaaaggaattcaatggaggaggggaacagaaagatttcgcccaaaatacaaagcaaggaagattcttctgatggtgatggtactaaagaggactatgttcatatccgggcaaagcgaggtcaagccactaacagccacagcctcgcagaaagactgaggagaaaaaagataagtgagagaatgaagcttcttcaagatcttgttcctggatgcagtaagatcactggcaaggcagtcatgctcgatgagattatcaactatgtacagtcattgcaacg

SEQ ID NO: 6392 - DNA, 881 bp, Zea mays
  Predicted polypeptide sequence is orthologous to G2141
aaaaaaaagcattggaaactactaacaaaacaaggctcctcgcgttgcatcacatcctgcagcagctcatttggtcgctgtgccaagtgccaacacgcagcccactgttactgcactgcgcgccatgccatgaatgcacgcgaccgccgaaacagacagaatttccagccatctatccaggcaacgccacaggccagcgccacgagcttttcctcagttccttctgaacacgataaaaaaacctgaccgatgcagcagcacaggcacagccgtgggtcgacgcggttcaaggcgtcgcgctgagcaggcgctgctgctcccggcaccagcaggcagctatacgcggccccctgcgcgcccgcacgttcgccgatcagatactcctcagatggaagaagccctttttttgcatcttttactagtatgtgcagctgggcatgttcagtcacatttgaaacccgtcctgcgacggcccgatgctcaggtcctgggacgacgggtacgccatctgctgctgcgcgacgtcactgaatgccccattcaatgcgtggggcggcatctgagacccgtcctttgcgcttaactgtgcctgcatgattctcctgaacacgtccggattggccatgccggcagcgccgccctggatcaggcctggctgcgagagctgcagctgtgggtgcatcatttccggggagaatccaagggaagacgaaggaacgccagggaagcggagaagatctttcgatagaagcccttctatgttgaggtcgagccttgggtttaccgttgcgagcttcattgataaaaactcgacttgtctttgcagggactggacatagttgaagatctcgtcaagcatcaccgccttcccagtgactttg

SEQ ID NO: 6393 - DNA, 853 bp, Zea mays
  Predicted polypeptide sequence is orthologous to G2144
cccgtgtcctcctcccctcgttccctcgtcccggacgcctccgccgcgccgatgcgccccgcctcgccgccgcaggagctccccgccgccgggggcgagatccaggcggcgctggcccctgccaatgcctccaccgcgggcgcccgcggaggcggaggctccttcacggcgctgctgggactccccacctcgcaggccatggagctgctcctcccccgcacgacgccccccgccctagccacagcgcccgcgccaaccttcccctccgacccgcacctcgtggaccgcgccgcgcgcttatccacgttcgcgcccccgtccccgtccccatcctccacgtccccggcccggcccctccccgccgccgctaacgccggcaagcgcaaggccgaccccgtcgaccgtgcctccaaggggaaggcggcgaagaaggggaagacggcggaggagaagctcgcgggcggcgacggcgacgacgagaagccggcgtacgtgcacgtgcgggccaggcggggccaggccacggacagccacagcctcgccgagcgggcgagacgcgagaagatcaatgcgaggatggagctgctcaaggagctggtccccggctgcagtaaggtatcaggaacagcattggtgctagatgagatcatcaatcatgttcagtctctccaaaggcaagttgagtacttgtcaatgaggctcgcagctgtaaacccaagggtcgattttggtgggctagacagctttctgaccacagagtgtggaaggatagcaggcttcaactgcaagaacggaatcgacttggagcaggtaacctggccagaaatgggtgttcatggagcaaggcagctga

SEQ ID NO: 6394 - DNA, 289 bp, Zea mays
  Predicted polypeptide sequence is orthologous to G2147
ctgcgtcgacttctaccgcaactcaaaggaataggataggattaggagggggaggggggtctataacaccaccggttccattatattggccaagacgggagaaggtcgtcaatgcaattgcacccagcgtctgtctcgcccacaggaatgtaggccaggccgatattctattttaaacattttccagtagcctagtaaggacttgttcggttagttctcaaaacatgtggattgagtgagattaggtgagtttgaatctcaaaaaaaaaaaaaaaaaaaaaaaaaaaaa

SEQ ID NO: 6395 - DNA, 727 bp, Zea mays
  Predicted polypeptide sequence is orthologous to G2150
aggtaccggtccggaattcccgggtcgacccacgcgtccgcgtgaaggttaccgggaaggccgtgatgctggacgagatcataaactacgtacagtcgctgcagtgccaggtggagttcctgtcgatgaagctgtcgacggtcgacccgcgccgggagctcgacgtgggctgcttcgtcgtccccaaagacgacgtaacgatgcaggccaacaggctgtgcgcgcccgcgacgtcgtcgtcgagctcagccttctgctacgccgcgcggagtgttgttacgaacgccaaaggattcgagacgccgctgcccttggcgaaccatggcgtcgcggcggacgacaggccacttgagcggcggactcgagacgcaggtccccaggcggggagcttgtgggaagaggacgatctgcagagcctggtcctgatgggattccggggccgttgatcgttgacgctctgattaggctaggccgctagggacgacagttcgtttccaccgaccgccaaccaaagcgagagttgcagggccacgtaacagcagggttgggctccaatcattgggaactctccatgattgtacacagacaggacgcttacacgctaatttccagctcggcggaggccaagaaacgaaacaaaaaaaaaaggcgaaaagaagatgtttttttctcgcattccccctcacgaatttgcagtttaatcgatgtaagataactcaatgtaatt

SEQ ID NO: 6396 - DNA, 808 bp, Zea mays
  Predicted polypeptide sequence is orthologous to G2150
gccctcttcccacaagctcctcccccccatctgaaattcacggcaggtttctcacctcttcgcccttgacgcgtcacgcgtccacagttttggagtggatcgatcgcacagctagcgatacgatcgagatggacgaacttggcaaataagcttgctgtacgtacgtacgtacctggggactcgcgttctcatcagcaggtccttcgagtggccgccgctccgcggtgccggcgtggttcacggtggccgccgacgaaggaggagccatttcgaaggctttggcgtccgacgcagcaacgcccagccgcgcggcggtgccgggagctgggggcgtggtggtgtagcagaacgccgggctcgagccctcgagcgcgtggtaggctgctggcagtggcagtggctgctgtgccatggagatggaggacgtcgcggcggcgcacatcttgttggcctgcaatccgttacgcatatagttctcaagaaatgggcaacgcgatcaaaaaggaagatcatccactacttcatttcatttcgagtggtggtggtgaggaggagtaggaggaggaggaaattacgtacgtcgtctctggggacgaagctgtcgtccgcgccgagttcgaggcgcgggttgacggtcgacagcttcatcgacaagaactgtcgcgaaatcaagaaccgtcttgctcagattcagaagctacagctcgtactttgttttacaagagagttctttaatgtctgatacagaggagacagactctacgcacctctactttgcgttgcagcgactgcacgtagtttatgatct

SEQ ID NO: 6397 - DNA, 3188 bp, Zea mays
  Predicted polypeptide sequence is orthologous to G217
gcggagtccgccgctccgttggacttagggtcgccggaccccctccagggctagcggcggaggaagtcggaaaccgattacccctcccctccccttaccgggggagggagaaactagcggaggaggcgaatcaggtcagagtggggcacgatgaggatcatgatcaagggaggcgtgtggaagaacacggaggacgagattctgaaggcggccgtgatgaagtacggcaagaaccagtgggcgcgcatctcgtcgctgctcgtccgcaagtccgccaagcagtgcaaggcccgctggtacgagtggctcgatccgtccatcaagaagaccgagtggacaagggaggaggatgagaaattacttcatcttgctaaactcatgcctactcagtggaggacaattgcacctattgtaggtcgaacaccatctcagtgtcttgaacgttatgaaaagctgcttgacgccgcatgtgcaaaggatgaaaattatgaggctaatgatgatcctaggaagctgcggcctggcgagattgacccaaaccctgagtcaaagcccgcacgtcctgatcctgttgatatggatgaagatgaaaaagaaatgctttctgaggctagggcccgcttagctaacactaggggtaaaaaggccaaacggaaggcaagggagaaacaacttgaagaagcaagaaggcttgcttcactacaaaaaaggagagaattgaaggcagctggtattgatacacgccacagaaaaagaaagagaaaggggattgactacaatgctgagattccatttgaaaagagaccaccttcaggtttttatgatactgttggtgaggacagaccacctgaacatgtacagtttccaacaaccattgaggggcttgaagggaagagaagagcagatatagaggcacaattaagaaaacaggatattgccaggaacaagatcctgcagcgacaggatgcccctgctgctataatgcaagcgaataaactaaatgatccagaagctgtcacaaagaggtcaaagctaatgctgccgcctcctcaaatttctgaccacgagctagaggagatagcaaagatgggcagtgctggtgatcctgctttagctgatgagcttggtgaaggaagcactgccacaagaaccttgcttgccagctattctcagactccaaggcttggtatgacaccattgcgaactccgcagcgaactccagctgggaagggtgatgcaatcatgatggaggcagaaaatcttgcacgtctcagagaatcacaaacgcctctattaggaggtgataacccagagcttcatccatcagatttctctggtgttacaccacgcaagaaggagatacagactccaaatccaatggcaacacctttagcaagccctggccctggtatcactccaaggattagtatgacaccatccagagaggggcacagctttggtttaacaccgaaagcaactcctcttcgtgatgaacttaacataaatgaagtggaaatgcaggacaacactaaacttgagcttcgtaggcaagccgaactgaggaaaagcctgcgatctggttttgcttctattccacaaccaaagaatgagtaccagatagtcatgccacctattacggaagatgagaaagaagaagctgaagagaaaattgaagaggacatgtcagacagactggcacgagaaagggctgaggaacaagctaggcatgaggcattgctcagaaagagatccaaagtgttgcagaggagtctgcctaggccaccggctgtttcagtagagattatccggcaatctcttattagaagtggagaaagcagaagcagaagcacctttatgcctcctacatcacttgaacaagctgatgaactaataaatgaggaactccttaggcttcttgagcatgataatgcaaaatatcctcttgatgaaaaaactcaaaaagagaaaaagaaaggaagcaagcgtcagcaaaatggaggacctcttgtccctgaaattgatgattttgatgaagatgaactaaaagaggctagctctatggttgaagaggagattcaataccttcgagtggccatgggtcatgaaaatgaatcttttgaggacttcgtgaaagcacatgatgcatgccaagacgaccttatgttttttcctaccagcaatagctatggtttagctagtgtggctggaaatgctgataagatttctgctttgcaaaatgagtttgaaactgtgaagaagcgaatggatgatgaagctaagaaggcttctcggcttgagctgaagattaagcttctgacacaaggatatcagatacgggctggaaaactgtggtcacaggtccaagatacattcaagcagatggacactgccgcaacagagctcgaatgcttccaagagctgcagaaacaggaacatctcgctgcttcatatcgaatccaaaatttgtctgaagaagtgagtaaacagaaggcactagaaaggaccctccagagccgctacggcgagctggtttctggtttccagaggatccaagaacaggtcgaggagcacaagaggcaactcaaggtacaagaggcggtagaagccgaaagtcacgctcaggaagaggaagctgcggcatcaaatcatgctgctgctgaggaagaggatgaaaggaaggaagatgatgaaaggaaggaagaggatggaagcaagtctctcagctctgaagagaaaccacagcagacaagtacggctaccgatgaagaacctgcaggaagcaaaggaaccaccgaggatcagatggacgtggacagcgggaatggagagggtggagttgtaggccctgtcccaccagcaccagacactgaagggggtaatgacgaagtatcggttcaagagatcagtgaagcccagcccttgccttgaagacggcgctcctttcccttaaagctccgctttcttctcccgcacctggcgatcttcacgatgttgttgttgcacagcaggtccggactgagtatttcctatttagttctatttttagtgcactataatatcacaagcgaagctacaattggttgtgagctatattggcatatccttccctttgttgtattcccttgaacaatgaatcataacaactgtttaccatttttctaaaggatcgactgcttatgtactcatgc

SEQ ID NO: 6398 - DNA, 298 bp, Zea mays
  Predicted polypeptide sequence is orthologous to G222
acccgacgccgatcggcgccttcgccgcaggcacccagttcttcccttataaccctagaacctagctcactactactagtatctacatattagctagctttgctgcttccattattatggctatcgatcgatcctagtagtagcttaattccttgatggttccatttacttcctccaagttccaaattaaagatgatgatgatgagcatgaactaagttgtcgtcattgtcgtcgtcctcgggattagcaaacaaattcgagacaaacgcgaagataattttattgttactagttctt

SEQ ID NO: 6399 - DNA, 841 bp, Zea mays
  Predicted polypeptide sequence is orthologous to G222
gcggcgccggcggctctgcatgcgcgcgccctgcggaaactgatccatgatctgatcccacggcaccagcagcaacggccgaccgccgggccggccggccggcgcgcacgcacggtgggcgcgcgcgcggtgccaaataaagagcttagagccgccggccgggatctatggggcgcgaggcggcagccacgaggccgcccaagctgcggaggggcctgtggtcgccggaggaggacgagaagctgtacaatcacatcatccgatatggcgtcggctgctggagctcagtcccaaagctcgctggcttggagagatgcggcaagagctgcaggctgagatggatcaactacctgcggcctgacctcaagaggggcagcttctcccagcaggaggaggatctcatcgtcagcctccacaagatactaggcaacaggtggtcccagatcgcgtcgcagctgccggggaggacggacaacgagatcaaaaacttctggaactcgtgcatcaagaagaagctccggcagcagggcatcgaccccgccacccacaagccgctcaacgacgacgacaacgctgctgctgctgctgctgcggacaacgacgccgccgtggcgccgcaccaccatcgtcgtcatcaggacgaccactgcggcgccgccaatattgataataataataataacaacaacaacaacaacaatcggcagctcccctcagccgacgaccactgcttcgccatgagcagcgacgaccctctcgcgccacactccccgaccgtcagcttcgacccactgtccgtcaccaacgtccccacgggcatgcaacagggctcctacggctc

SEQ ID NO: 6400 - DNA, 1037 bp, Zea mays
  misc_feature (618)..(618): n is a, c, g, or t
  misc_feature (810)..(810): n is a, c, g, or t
  Predicted polypeptide sequence is orthologous to G2226
cccgggctgcaggtcgagacggagtcggtggtgcagcggctcccctgcggccacctcttccaccgcgcatgcctcgagacctggatcgactacgaccacgccacctgcccgctgtgccgccaccgcctcctgccccccgccgctgccgccgacgaggtgccccggattgcctgattagcgccctaggaattgagagtaggcgtagcactctgcacctcgcagcagcagtgtctctgtacaggttttttttttcttttcctttttgttcgggggagagagaggacagaacggagattgaaggaagaaaatggtggcaacaaagctgttcccctttcgtttcaaaaaaaaaaaattatatattgtacaccgacttgagcaaaactcaaaattgtctttgggcttgtgctggggtggacgcaaaaaccactatcttgctgtgaataagggattctataatagtggcacgactagattaccctttcgtatgtggttgctttatttgtgattgtacacgcattgatgtttttaaaagaatttttgggggggaaagtaagaaaagataatcaaaggggtcactttaataagctcttttgtttggctttgattaaaaaacatcanaaaagtctggtggacagcggcgttgggtcttttttagtgccggaaattttctttatccactccaaaccgaaggagagtggatttttggaaaccaagtttattaaaatttttattgttatgaccatttttttttataggtccccacgggatttgtttaatatggggcggtgcgtggtttttaattatacaaanaagggggtgcacgcccaaaaactggtagttctccacaaatttctcgaaacctcaagtatgtgtccgaacctccttctttttattggaatccattctgggtcacaattttgggggtggcgtgggttttatggaaacgtctttctgactggaaatattttgaccgtgttaaaggacagacctttctggtttgtaaaacccaatctccttaataaaaaaacttggtattt

SEQ ID NO: 6401 - DNA, 924 bp, Zea mays
  Predicted polypeptide sequence is orthologous to G2239
gccgtctccgcccaaaccctagccccggcacccgggggacgacgccatgtacgccgccgccgtgttggcagcggtctctgcggtatccgtcgttgcggcgcagtccccggagccgcgcgacaaccaaacggtcgccgacgtgatgagcatctctatattcatggccgtattcttccccgtcttcgtcgtgcttcttgccttcgcctgcctccacttgttccgggcccccgacgacgacgacccccaggctccggacgcggcgtcggcaccggagtggccccgcggagggggcagccgcaagggagggctcgatgccgccgcgatcgctgcgctgccgctagtgttcttccgagaggtgagacagcaccggatcgtggacgggcgcgaggacgcgctcgagtgctcggtctgcctcctcgagttcgacgacgacgacgccctccgcctcctcccgacgtgcccgcacgcgttccacccggagtgcatcggcctctggctcgagaggcacgccacctgcccgctttgccgcgccagcgtcctcgacgacgcgccaccagccccggcagcgcagctggagcttcatacggcgccaccgctgacgccggactcgtcgcccgttcacgcggctatcgtgctaatcggcggcgccggcgcaagcgaggtaggcgaagaagaggaccggactacgatccagcgcctcgcgaggaaccgccgcgcggcggggcggcaggcgctgccgcggtccaactcgacgggccacagcgccagcgacggcgggatggagcggttcgcgctgcggctcccggagcacgtgcgccttgagctcctcatgtcccacaggctgaggcacgtgacgagcgcggtagcatccgtgcgcgtcatggagggtagcgcccacgacaccagtacggtgggcgggagcgt

SEQ ID NO: 6402 - DNA, 771 bp, Zea mays
  Predicted polypeptide sequence is orthologous to G2251
ccatacatatcactctccgctccgccattgttgctccttattagtagttcgtcccgcgtcccttgacagttctatctatccccaccacaaataagagaccacctctctgccttcttctcggaggtcggagaagagctctctgcttcattcggccggtccaactccaccgaccgatccaatccaacccactgaccatggggttcccgccggtgtgctgctgcgcccccatccccaagccggtcgtcgccttctgcaacctgctcggcgccatcaaggacgccgtcctgctgacgctcgccgccgtgggcttcccgcacgacgccgcgcgcggctcggcggacgcccaccagcccgaggaggtgaagacccggctccccgccgtggagtacgcccagctcctggccgagcagcagccgtcgcccgccacccacgcggcctgcatcgtttgcctggacacgctggaggcggcggacgaggtgcggcggctgggcaactgcgcgcacgccttccaccgggcctgcatcgaccgttggatcgacctaggccggacgacgtgcccgctgtgccgctccgacctcctgcccagcccccggggccgggccgggctgctcgggctgggccggctcgccagccgtctcacgcgcgttcgcgtttggtgaggaccgtctcggaggccacttttaccttttcggtggccaggccgcggtcgcagcccatcccggtggggccggaacggcgcggacacgttagcgaccgcgaccgggccgcccg

SEQ ID NO: 6403 - DNA, 710 bp, Zea mays
  Predicted polypeptide sequence is orthologous to G2251
tttttttttttttttggaaaaaaaactgattacgtagtatgggtaaacatctctagactacactacagcaatgtgatctgaactctgaaaccctccaatacaagcgcgtcgccgtcttcagagacagcagcaggatgagatggccaccaaggtcactcaagggatacatcagccgaccaagaaggatccagaattaggttctgctgatcatcatccgcgggccgcggcgagcaaaagcagggtccatgattgaatgccaagtccactcagaatccttggcgtccttttttttgttacgttctcggcatcaccaacaacaaattatggacctggaccaccgtggaaccgaagatcccctttccgttacgctccccctccccaaaaggctaatcacttcgatacaggcgctgaagctacagcaaagaacacacgcatcgtacacacacacactagacaacacctgatggatggatccatgaccatggcgcgcctcaaagtgggaattattgcgcctaaaacagaacgctgtggtggctggcgaccagttgatgacgcagagggccacactgcaggccgtggtcctgcgaatcgtccatcctgtaaacagccggcaccacggaggtccggttcggtggcaggttcccagcgccgtgctggtgctgcttggcctcggccgccgccgccgacgagaagggcccgcctatcaccgc

SEQ ID NO: 6404 - DNA, 878 bp, Zea mays
  misc_feature (736)..(736): n is a, c, g, or t
  misc_feature (811)..(812): n is a, c, g, or t
  Predicted polypeptide sequence is orthologous to G227, G242
gtcatagaagcggcgtccggatgatgaattacaccctgggcctgctagcagcagtagtgttgctgtagaggtgaagaaggggtcttggacccccgaggaggacgccctgctgaccaggctggtggagcagcacgggccccaccgctggagcctcatcagcgccccaatccctggccgctccggcaagtcctgccgactccgctggtgcaaccagctcagccccgacgtgcaccaccgccctttcacgccgcacgaggacgcgctcatcctcgccgctcacgcccgctacggcaacaagtgggccaccatcgcgcgcctccttcccggccgcaccgacaactccatcaagaaccactggaactccaacctccggaggtgcaggcgccgagcggcggcggcggcggtggcctcccgaccgcaggtgcaggacagcgacgacgctcctgctgctgctgctgctcatgatgatcagccggcggctgtggttgctgctggtggtttaggtggtggcaacagcagcagcggtctgccgcctgcagcagcaggggccgcaactgccgaggccgagccgtctctgtccctcagccttggcctcccgctgccagcagcagaaccagctgaagccgcggctgacgacgagagccgcaacagccagggccaggcatcgccgttactggaggaaggagaaggaaacgcgcagctgttggcagtggtgcgccggatggtcagggaggangtgcaacgccagacgggacagctcgcctactcgctcatgggcgcagcagcagccagaagcaagggacaccaccgnntatctgtgtgtgatccattgtgcatgctgctgctgctgctgctttctggatttccctcctttctcc

SEQ ID NO: 6405 - DNA, 877 bp, Zea mays
  Predicted polypeptide sequence is orthologous to G227, G242
ctcgtcgtctcgtcttctctaccaccaccaccactgctcgttttacagaaaccggaaggaaccaaacgcctttccgccccgggccgccgctacccaagcccagcaaccaccactcgttgtcgtcgactactaggcggcaagcaggcgtcctttttttttggtcctcgtcgtcgtccggactccggacaggacaggacatgggcgcggaggcggcggagcgcgacagaatcaggggcccgtggagccccgaggaggacgaggcgctgcggcggctggtggagcggcacggcgcgcgcaactggacggcgatcgggcgcggcgtgccgggccggtcgggcaagtcgtgccgcctgcggtggtgcaaccagctgtcgccaagggtggcgcgccgccccttcacggccgacgaggacgcggccatcgcccgcgcccacgcccgcctcggcaaccgctgggccgccatcgcgcgcctgctccccggccgcaccgacaacgccgtcaagaaccactggaactgctccctcaagcgcaagctcgccggcggcgccgtcgcgtccggttcggcggtttccgctgaagacgccgccgaggccgaggcgcgccggggcaagatgatgatgagcatctcgccgcccgacagcccctcggggtcggggtcggggtccgaccgtagcgacctcagcagccacggcgccgggtccgggtccgggtccgggtccggccagatttaccgccccgtggccgcgcgctccggcgggttcgagccggcggactgcgccatgagccgtccgcaggaggaggacccgctcaccgccctcagcctctcgctttccggcacggaacagcggtttcacaccacagcggcgccgccgacagc

SEQ ID NO: 6406 - DNA, 811 bp, Zea mays
  Predicted polypeptide sequence is orthologous to G227, G242
cccgactccacctctctccgatcgtctcatcttcttccttctcttccaccacatccttggcatctcatccggatcgaccagtacacgccccagtagtactaaagaaccagtttctgagtaaaacatggcggcgtcgccttccccgtccggcagcggcggcggcaaggccggcgtggaccggatcaagggcccctggagccccgaggaggacgaggccctgcagcgcctcgtgcgccgccacggcgcgcgcaactggtccctcatcagccgctccgtcccgggccggtccggcaagtcgtgccgcctccggtggtgcaaccagctgtcgccgcgggtggagcaccgccccttcacgcccgacgaggacgacgccatcctccgcgcgcacgccaggttcggcaacaagtgggccaccatcgcgcgcctcctctccggacgcacggacaacgccatcaagaaccactggaactccacgctcaagcgcgagcgcgagcgcaagcgcgagtactacgccgatgcgcgccccggccccggcgaccagcgctcgctcaagcgcaccagcagcgacgggccccccggaagcccgtccgggtccgacctcagcgactccagccaccagagccttcccaccgtgatgccgtcagccgcttctaccgccgtcacctcccagcagcagctacaacacgtgtactaccgccccgtgccgcgcgcgggcggcgtggtcctgctcccggtggcgccgccttctccgcaggctcctccagcaacctccttgtcgttgtccctctccctgccagggctggaccagcag

SEQ ID NO: 6407 - DNA, 826 bp, Zea mays
  Predicted polypeptide sequence is orthologous to G227, G242
ctgcagctggaacggcaagctcggttgggcttgtggtggcggcatctgaggtggagcaggctgctgctgctgtatctgaagaggaggttgaggcggtgccggtgccggcgtcagaaccgcttgggatgcttcgggcttctggccgtccagcccgggcagggagagggacagtgataaggaggtcgccggaggctgtggcggcggcggcggcgcaagaggcgccaccggtagcatgaccacgccgcccgcgcgcggcacggggcggtacacgtgctgctgctgctggtgggaggtgacggcggcagcagaagcggctgacggcatgacggagggaaggctgtggttgctagagtcgctgaggtcggacccggatgggcttccggggctgaagcagagccctgggtggccgtcgctgcttgtgcgcttcagcgggcgctcgtcgtcagcgtcagcaacaacagcgtcgctggcggcgtagtacttgcgctttagcgtggagttccagtggttcttgatggcgttgtcggtgcggccggagaggaggcgcgcgatggtggcccacttgttgccgaacctggcgtgcgcgcggaggatggtgtcgtcctcctcggccgtgaagggccggtgctccacctgcggcgacagctggttgcaccaccggaggcggcacgacttgccggagcggcccgggatggaccggctgatgagggaccagttgcgggcgccgtggcgggccaccaggcgctgcagggcctcgtcctcctcggggctccaggggcccttgatccggtccacgtccgacttgccgccgcttgcacggcaggac

SEQ ID NO: 6408 - DNA, 912 bp, Zea mays
  Predicted polypeptide sequence is orthologous to G227, G242
ctcctccactacccacccgcctgcccgcccgccttctcctccaccactgccccgccgctaaccaaccactcgtgcgccacaagtctcccgtcgtggaatagggcaaaggccaggcatctcgcttctgtcctctgtcgaggggatcggacccgatcggagaaagaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaggtggagcgccggcccttcacggcggaggaggacgcggccatcgtccgcgcccacgcccgcctcggcaaccgctgggccgccatcgcgcgcctcctccccggccgcaccgacaacgccgtcaagaaccactggaactgctcgctcaagcgcaagctcgccgccgcgtccgccccggcgggttcctccgacgtcgaggcgcgcccgaccaagcgcgtcagcctctcgcccgacagcccgtcggggtcggggtcggggtcagggtcagggtccgggtccgggtccgggtccgaccgtagcgacctgagccacggcgccggccaggtttaccgcccagtggcgcggtccggcgggttcgagccggcggactgcgcgatgagccgtccgctggaggaagaggaggaggaaaaggaggacccgctcacctccctcagcctctcgcttccaggcacggaccagcggttccaccacgaccgcgcccacagccagttccaggagctcccggcgtcgccgccctcgccctccccgcctccgccgccggttctctcggcgtacccgttcagccccgtgt

SEQ ID NO: 6409 - DNA, 1802 bp, Zea mays
  Predicted polypeptide sequence is orthologous to G229
agccagcacagcacacacactggaaagtgcaagctgtagtgagacctgcgcgactgccagcgtgtatccgcgcggcaaggagcgtagcgccggtcgtcggcccgcacggccaccaactcccttggacgcacgcgcgaccagctgctaaccgtgcgcaagtagtagtgcgacttcgccgccggccgggatcgctagctcgatcgatcggcgggaccacatacgactccggtgtggccagcggcggccgggccggggaacgcacgtgctgcgagcgagcgagggcagacgctagctgttgccgggagctagccggcgcgcgatggggaggacgccgtgctgcgagaaggtggggctcaagcgagggaggtggacggcggaagaggaccagttacttgccaactacattgcggagcacggcgaggggtcctggaggtcgctgcccaagaatgcaggcctgctccggtgcggcaagagctgccggctccggtggatcaactaccttcgggcggacgtcaagagggggaacatctccaaggaggaagaagacatcatcatcaagctccacgccaccctcggcaacaggtggtccctgatcgccagccacctccccggccgaacagacaacgagatcaagaactactggaactcgcacctcagccggcagatccacacgtaccgccggaaatacaccgccgggcctgacgacaccgccatcgccatcgacatgagcaagctgcagagcgccgacaggcggcgcggcggcaggaccccgggccggccgccgaaggctagcgccagcaggaccaagcaggcggacgccgatcagcccggcggcgaggcgaaaggcccggccgcggcggcgtcgagcccgcggcacagcgacgtggtgaacccgggcccgaaccagcccaacagcagcagcggcagcacgggcacggccgaggaggaggggcccagcagcgaggacgcgagcgggccgtgggtgctggagccgatagagctcggggacctagtctggggggaggccgacagcgagatggacgccctgatgcctatcgggcccggcggcacgactcggctgccctcgaagggcttggcgcggtcggctgcgaggcccaggtggacgacctgttcgacatggactgggatggcttcgcggcccatctgtggggcgggccggagcaggacgagcacagcgcgcagctgcggcaggccgccgagccgctggaagttgctgctgctgctgctgctgcgacggcggcccgcaccccggacgatcgcgagctggaggcgttcgagacttggctcctgtccgactcgttctgacggctccggtcaccggaccgatcagacagaccaaataattgggtcacgtgtgctcgctcgctcgctgccgtcgcgtgggtcttggttcagatggccaaataattgggaaaaaaattctacggccagggccgtaaagccaccaccgtgcgctcctgatgtcgatgcctgccgcgtggagctcttgcgtatctaacgctcccacgacaatcacccttccagacggctcgaattacatacgacaggatcggctccgctctactccgttctgttcgcttctgctttaggtgcgtgcctagcagatggtgaggcggcgtcgcgcggccctcccgacggctcgccggccgcgctacggggcctgctgcagcagcccctcctccacgcctgtaaaagagctttgtatttacctgtttgtttgtgcttttgtgcaatggaataaacaatgatattatactgaataaacatgaatgttctgagac

SEQ ID NO: 6410 - DNA, 240 bp, Zea mays
  Predicted polypeptide sequence is orthologous to G229
cgttgctgtcgcgccgcgttagcaaccagccgcgtctgccacaggtcgtggctcgcttctcccctgcttttccgcgtccccgcagcgccgacgacgactgggtgcgcagcgcggcgccgccgttctacgccgggcgcccaagtcctcgacgggaccttctctggcgacgagcgccccaccaggccctaagctcatatgagcacggagcatcaatgcaagctaataaacccgacagcaacg

SEQ ID NO: 6411 - DNA, 1038 bp, Zea mays
  Predicted polypeptide sequence is orthologous to G229
atggggagggcgccgtgctgcgagaaggtggggctgaagaaggggaggtggaccaaggaggaggacgaggtcctggcgaggtacatcaaggagcacggggaaggatcgtggaggtcactgcccaagaatgccgggctgctgcggtgcgggaagagctgcaggctgcggtggatcaactacctgcgggcgggtctcaagagggggaacatctcggaggaggaggaggacatgatcatcaagctccacgccacgcttggcaacaggtggtccctgatcgccggtcacttgcccggtcgaacagacaacgagatcaaaaactactggaactcgcacctgagcaggcgggcggccgacttccgcgacggcgtcgtcgtcgacatcgacctcagcaagctgcccggcggcgggaaacggcgcggcggccgggccagccggggcgccgtcgtggccgcggccaaggagaagaaggccaaggagaaggacgacaggggcaatagcaaggtcgcagaagcggagcagcagctcagggacacggaggacgacgacggcggcagcgtctccacgccgaggcctcagtctgatgactgcggcaccgcccagagcgaagaggagcaagcgcaggccagcgccagcggcctgacatccgatgggcatgggcccgaggaggaggaggaggaggacccgctggctctgagcgaggagatggtgagtgcgcttctggccccggaaagcccaaagctggaggtgggccccgatggctcgtgcatggacagctacagtggccctccgtcaggggaaagcggctgtgggtccagtgggccttctggcgacgtggcccaggacctggacctagacgacgacaaggccatcatggactgggacttgatggggctggacatctcgaccgccggtgacatgtgggaccagctggtgtgggactacgacgaaacgttggtcacggaaccggaaggaggggaggaagggcaccagcagcaggacgatgtcatgtcagacctcttcttcctggacaatctctag

SEQ ID NO: 6412 - DNA, 717 bp, Zea mays
  Predicted polypeptide sequence is orthologous to G2290
tttttttttttttttttttttttttgagagaggagcagctctcgctggatttactacctggtcgctacaacacagtctgcttgcaacctgcaatacaaccaacagtctctttccgactgcgcaaactacacacaggacctaaccaaatcctgacaccgaaacccaaatcaagcagctactggtcctgaacgaccaactctaaccagtacgcgtggtcactgtaaggcctacgactcctacgataatacaacatggatacagtttgatgcacactacgcatctcgtacgtggaaacggccagtcattgctatagctctagttaacctagctagggatcatgtgttgccccctttaattcgctataacacaatatcccctacgtcgctcttccttctctcgttgcgcttcgcagcacccttctctgtcctcgtcgaacgttgggtgcccttcgcttcgccggttgctctggtgtcgtacctgggcctttctcgaccgaatcaacgtctacagcagcggctgcagactcgactggttgggtgcttgcgggtggcacagcactgctcgagttggtgtagctagggttatcgtttcctgaagattctagcccggagttggcatttgattggtccacgagaccgtttactaatgttttcttggtcgtcgacccgttctttttgttctgggttggggggcccgcatcatttggtatggattctg

SEQ ID NO: 6413 - DNA, 859 bp, Zea mays
  Predicted polypeptide sequence is orthologous to G2290
gctaggaggtcgatctgatcgcatcggccggggtctgccgccctgcccatggccggcgccgccggtgacaggtcggaggaggacgtcggcgccgactggccgttcggtggcgtcgacgccttcacggagtactcatcctttttcgcggagcccggctggccgggcggcctagccggggaactcatcccggtgctggatctgcccgaggcagcagcaccgctgcccgcccaactgtccacggagccatcggaggagcctgcgcccgccaggtcgggggacgccggcgcgtcgtcgagctcgagcggggacggcgccgcgccggggaacggcgacggcgacgacgatcggaaggcggcgccggccgccgaggcagcgggtaggaaaccggcggcgaagaaggggcagaagcgggcgcggcagccgcggttcgcgttcatgaccaagaccgagctcgatcacctcgacgacggctatagatggaggaagtatggccagaaagctgtcaagaacagccctttcccaaggagttactacaggtgcaccaacagcaaatgcacagtgaagaagcgcgtggagaggtcctccgacgacccctccgtggtcatcaccacctacgagggccagcactgccacagcatcggtccattccagcgcggcggcggcggaggcgcagccgcggcgcggtaccacagcgcggcggccgtcgcgctggcggagcaaatgtattcgtcgtcgacgacgtcgtcgttcatcccagcagcgcggcagcagctcttcagcttgccgccgttgcacccgcagagctccccgccgtcctcggagacgacgccgccgccggtcgttagctcggtgactacta

SEQ ID NO: 6414 - DNA, 377 bp, Zea mays
  Predicted polypeptide sequence is orthologous to G2291
tgactgtgtttttttttttttgtattccctgcgtttagtcagctgagttcaaccatggtcacgcgctctgcaaagaccggcttcgccggcgacggaagcacgtccagccatgaccagcgctctgcaaagagaagtatgggtggctgatcgcaactcgcaagagaactgagaagcgatggccatcaagattgacagaagaagtcgtcaaccggcttcattggtcatcctccacaacgaaagaaagaaagcagaggatggtcagattgaaagaaaaaaaaacatgtgtgatggctgttgcacacccatatgtggccgtacctgtgctcgccgatccgaagcaacacgacgaaaaaaaaaaaaaaaaaaaaaaaaaaaaa

SEQ ID NO: 6415 - DNA, 364 bp, Zea mays
  Predicted polypeptide sequence is orthologous to G2291
cggccattatggcctcggcttggttttaaacgttagtaattgctacgaagtagcataatttatttggagcgcattctgtttttattgatgcctgactttagcaagcactccatatcttcatctatcttttttataagtttgacttcatgtgacttattttagaagcgtgagctcacaaactttctcttatttggtctctgtatgggggaattatattattttataatctctgttcgttcagtcagtcattgcgaactctcttctaatcgctcactttattgaccgtgttgtaccaacacatattgcacgaagtaaacaataacatcggttaccccaaaaaaaaaaaaaaaaaaaaaaaaaaaaa

SEQ ID NO: 6416 - DNA, 129 bp, Zea mays
  Predicted polypeptide sequence is orthologous to G2343
atcaactacctcaggccggacatccgccgaggccggttcacggcggaggaggagaagctcatcatcagcctgcacgccattgttggcaacaggtgggcccacattgccagccacttgcccgggcggacg

SEQ ID NO: 6417 - DNA, 1239 bp, Zea mays
  misc_feature (6)..(97): n is a, c, g, or t
  misc_feature (101)..(123): n is a, c, g, or t
  misc_feature (967)..(986): n is a, c, g, or t
  misc_feature (1007)..(1011): n is a, c, g, or t
  Predicted polypeptide sequence is orthologous to G2344, G929
gcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgnnnnnnnnnnnnnnnnnnnnnnncgtcggacagtttaagtgtggcttcattgcatgagtagttgcagttagcgtggcttttctccgtgcttgctcctggtcgtgctttgccttgcaaaggaaggaatcatgacatctgttgttcacagtgtttcaggtgaccacagggctgaggatcaaaatcaacagaagaagcaagctgaacctggggaccagcaagaagccccagttactagttcagatagccaaccaacagtaggcacaccatcaacagattatgtggcaccctatgcccctcatgacatgagccatgcaatgggtcaatacgcttatccaaatattgacccatactatggaagcctttatgcagcagcttacggtggacagccattgatgcatccaccgttagttggaatgcatccggctggcttacctttgcctaccgatgcaattgaagagcctgtgtatgtaaatgcaaagcaatacaatgccatattaagacggcgtcaatctcgggctaaagctgaatcagaacgaaagcttatcaaggggcgtaagccctatctccatgagtcacgtcatcagcatgccttgaaaagggccaggggagctggaggtcggtttctcaactcaaagtcagatgacaaggaagagaactccgactcgagtcacaaagagaatcagaacggagttgcgccccacaggagcggccaaccgtcaacccctccgtctcccaacggtgcatcgtcagctaatcagggcaggcagtcgtgaatgatggatgattcaaaactcacagctgaagagatttcagcccctgagctagatatggcagcagttttgtacagaaaacgctagcaacatggtnnnnnnnnnnnnnnnnnnnnttgtaggacatgttccatagnnnnngcatagacgagtctacaggttttggagccttggtttggtcctctgtgtattcacctttctgtacaatcttagtagcgttgtgtaccttcccctggaaggaaggatagcttcagttagcgcttcagaaagtcaagtgtgtagcatattggcttattgtttgctttgcttggacaatggagatttgggagtggagttcataaccctgctgaataaatactcttagctggc

SEQ ID NO: 6418 - DNA, 1326 bp, Zea mays
  Predicted polypeptide sequence is orthologous to G2394
ccacgcgtccggcacaacccttgctgccgtcctggtcgccacacggccacaccaacccaacacctcttcttcctccgctctcagcttaccccaccacaggcgagggaggcgactccttcctcgcggctgcccgctccggccccgatcgcatctcctttgcacgccacggcccgcggcccgcgcgcagtgtccatcggcacggccgtcctccgtgtgtgggggcgcatctggtgctagcttgccgggctagggtttggcttggcctcgtctaccgccccgtctcgtctgataggcacaggttccgtgcacgcgatcgtcgtctctccatccgttgtgactgcttgccgtcccccgcttgcttcgtcctgctacgggagggccactgctgccatcgcgtccaccgacgaatttccccacagagcattagagcaattatcttggagttgcagatctgtacctgaagattcatattgaaatctggaagcttctgctgttgagtacagagaaatatttcttgccttttgaggaagactgcagagcccctaaatgtgaaacttgtttcttttcttgtctactcctgaatgctgacgaactcagcctctcacgttacttagctgaaggtcgtactggtacagacaccgaggatggagcaagcaacaggtgtaagtggtcctgaacacataattgatattccaagggaaattggtcctcctgcttcggtttctcgtagtgctggtagagagaaccatgaagaatcgaatcctgtggacaggccttcaacaagagctctagtacctgccttgcaggcaccatcagcaataggtgctgtacctattacagggcatacttcaggcactaggagaaatgacaactatgttcgtcggcacagaagcccattgaattctggactgtggatttcaattgaagttattgttaactttagccagattgttgctgccattgttgttctttgtgtgtcaagaaaggaacacccacaagctccattacttgagtgggtcataggttacactgttggttgttttgcaacgttaccccatctctattggcgctatatacaccgtaatattgtaaatggtgagcatgagtcatcacatacacctcaagggtccgctcataacaactcaaatgaagcgactcatgctgcaagtgcatcagaacgccgcagaaatgctgcccgaaatgctgtgcttgctaatcctaggatcaatgcgctgtttgaccacttcaagatggccctggattgtttctttgctgtctggtttgttgttggaaacgtgtggatatttggtggccgtcttctgctgc

SEQ ID NO: 6419 - DNA, 1181 bp, Zea mays
  Predicted polypeptide sequence is orthologous to G2394
gcacgaggcaactgtggggaaaacactgatgctgtaactgctttggagctccttgggtaaaacctccatcttctcacattttgttccatttgagtttgctccagcagtccagctccatgtaccaacttgcgttttggtggaatccagtttatcacaaactgtgaatcagttcatgaattctggtgacagtgagtaataccttgtactagtctgtccttgactccttgtattcttttgaaactgtgattagtaccctgttatttcacattattggtgcttctaatcatgagtacatttaacgatagatgttcatcaatatttctgcacattaccactagctaaaatgtgaaagatattaagaggttcttggatgtcatctagtagtggctactgccatttctcactattcttttctgacctagtagtaatttggtattttgtctgtgcacatgataattagggactaatattgcaaaatgggacagcttgtttgcatgtttcaactccatttcaaagcattgatatttattcagcaactgatcactcttttagagtagtcaatgttgtattctggattttctacttgatcatttgttagtgagctcactcatagcagatcttacctttagttaatactccattccaaattataagttgttctggctttttagatacatagcttttgctacgcacctaaatacatattatgcctagatatatagtaaaagttgtgtatctagaaaagccagaatgacatattttggaacagggggagtagtatagattcaatcacatagtttttccctcttccatagcatgttaaatgtaacatctaataatattgatgcaggtgtgctgcatctgtcttacgaagtatggagatgatgatgagcttcgtgagcttccttgcacacacttctttcatgttcaatgtgtagataaatggcttaagataaatgcggtgtgcccactctgcaaaacagagattgggggtgtggttcgatctttctttggcttgccatttggccgccgccgtgtcgataggatagcggcaagaggtgtagctagctcaagattcagtgtatagaacaatgctgtttttccgcataaagagctctgctctgttgcaatggtttaaaaaaaaaaaaaaaaaaaaaaactcgagggggggcccggtaccc

SEQ ID NO: 6420 - DNA, 828 bp, Zea mays
  misc_feature (728)..(728): n is a, c, g, or t
  Predicted polypeptide sequence is orthologous to G2394
tccacttcttcctcttggtctggttcgggcagagcatccgcacctgctcggccgattaccccggcgttttctgttccctttcaccccgcgtgcgggcgctatccttcccgtggcgacgtctgggtgaccgctgccgcagccctacactaggttcctaggtattcgccgggcccttccccggcgacgagcacccaccatcttaggctacctctgtggggatcttctgtgaagcaagagaagttacctagcacacaactcaaagttcagtagattattgaggatcaacatttcagccatctgtatgttagttaatatgatggccgatggtaacatctggttagaaagatagaaactcattattgcgctacatatggtagtgcccattcgacataagaactaagctggacattggtagatccaagttattaatggcgcacacttcctgtgatggtgtacatcatgttataagtgtagcacatggggaaactgcatcaacatcaaccagtcatcaagatatgtgcagtgactcggatgaaccacatcaggaagataggctatcaacaagcacacaaaccctgtcatcagagtcttcgccatcaatatcaccaactgcttatagcaccagaaatttatcttttcctagaagagatagtatatatggtcatggaagaagtccatggaattctggtttatggatctcgtttgaaattgtcatgtacattgctcangttgtagctgctattgtcatcctcatcttttcaagacatgaacatccccatgctcctttgttcgcatggataattggatatacacttggctgcattgcta

SEQ ID NO: 6421 - DNA, 911 bp, Zea mays
  Predicted polypeptide sequence is orthologous to G2394
ggaaagaggaggaagaattcgagtccaagtcttggagctctcgctttaggcggccagggtggaactgccccttgcccgtggttggtgaggcgattcgtggtcgggagcttccgtttctcttcggaggtgaagtggatctgacctactgtaggggaaagagcaaagtacattatcttgtacaaatgtgcattacgctacctttatcataaaccaaatcatctctgtttctgggaacagcaaccagtaatttcccatgcaacctcttggttgatggatgttcttcctgttgggtcagaaagagaaagtcaaacagatagtcaccctttactcatggagcatgcgattggcatcccaaggcatgatgttgcttctacttcgacacctcatcgagacaataatgatggcatggatcaactgccccgtgattcagaaagttcttctggaacaactgatgcatcttactctccgaatgctcctctagcaaggagagatgataatcgccttcggcgtcagcaaagtctaaattctggcttctggatatcaattgaactagctgtaaatcttagccagattatagctgctatctgtgttctgtctgtgtcaaagaatgaacatcctcatgctccattgtttgagtgggtcattggttatacaataggctgcattgcaactcttcctcatctatactggcgctatctccagcgcaaccagctggccactgtgctagggtcaaatcagaactacgttccagacaacagctttgagagtagttcttttactgggatttcgccccctcctgtgtctgaagctggtgttgtaactgtatcaaatggagtcttgagaaacaatgtggttatcacaaatccaagggccctagcttttgctgatcacttcaagatggcgctggactg

SEQ ID NO: 6422 - DNA, 864 bp, Zea mays
  misc_feature (823)..(823): n is a, c, g, or t
  Predicted polypeptide sequence is orthologous to G2394
cgccgaggacgaggaccccccgacaacttacccggggggcagctacatttatacaaagtcgacgacggcaagaggataaacgagtcgaggagaaaggaacaaccttaaccggagcccccgttcccgctaggtagattaaaagttatctcaggtgcttcactaggaaaaaatgaagtaccttagttaagttttgtaacaaggatatttgatcagtgcatgtcaaaggagggtatcaaaccaacgtgtcatatgactgtctagcttatgaatgttgctcctgttttatcacccctgaaggccaagcacacaatcatcctttattgatggctcacactggaaacttgagccagcgtgatcacacaatcgatataccaatgagtgatggtatgaccgcatcaacatctcaccaggatgatcatagtggctcggatgagctgcatcgcagcagaggtccttcgaatgaagtttcaccaagcccagatacatcttccggtacaaacgatgtatctaactctcacaatgcatcctcagcaagaatagatcgaggccaccgtcaacagaaccctttgaattctggcttctggatctcaatcgaacttattgtaaatcttagtcagattgtagcagctgttgttgttctgtcagtatcaaggaacgagcacccacaggctccattgtttacatggcttcttggctatacaataggttgtattgctattcttccgcatctttactggcgttatcttcaccgcaatcgcctagacatggagcaggagatgccaccccaaaggtcgccaggaatgaacatatccgagattaattnctatgctgtcgtttcatctcctcatgcatcagaagctgtgg

SEQ ID NO: 6423 - DNA, 791 bp, Zea mays
  Predicted polypeptide sequence is orthologous to G2394
cacggattgatgtgctcttttctatatatcatggatagatatatttgtatgtgcacttacagtcacccggtcattattgcatcgatgttacagacacccgtgtgcataagtacatctctcgaacagaatggaactgtaccttgcaggcatgtaccaaggacctagcatatatatacatgaacctatgcaatgtacaaggtaaaccattacaggagctgcagcggtgccaccagctgatcaggtaacattttctatacaaggagacaatcaccaggcaaatcctgacagcaaggaggttagcaacatagcatcaaccaccaacacagtggggtcatcttaggtggccaccactaccagcatccatggttcctaagcgaaaatgtttcggccaagaacaatgttgaacacactgctctgcactgaggcaggaaatactatattggtaagatgaaacaaaaccatcaggaaaaaagaggacttgttggaccatatagtgtgtaactttcctacttgtagtttgttatatgattgtcagtttaattagaccgcatcaaagagcccctccgtcatcttcatgctcattggaaaggccaagagagcagacaacaactaccgttgtgactccacgtcgttgtctactctattgttgttgttgtcgggatccacagagccactctctggattacttgttgcttttgatccccctatctcagccttgcatagagggcacaacgcgtttatctggagccatttatctatgcattccatgtggaaaacatgtgcacagggga

SEQ ID NO: 6424 - DNA, 828 bp, Zea mays
  Predicted polypeptide sequence is orthologous to G2394
ctaaatgcgtgatgtgtctgctcggatccaatccgcgattggtttttgtcatggctcactcgcgtgttgctcgcgtcctggccttgccaaaccctctccgccgcggatctgcgcgacccggtaatgtccgtcgtgatctgctgccgccatcaacgccctactcccctcctagatcccgtgatctgctacgaagctgccatcaatgccctcctcccccttcgctcagctccccctcgcgccttcgatccgctaccgtgacccgctgcgaggcggccatcaacgcccatgtcctccttcgcgcagctaccttcccaggatctcgggcgctccttcgtcgccatactttttggttcagcgggacgcccagcccgtagatcgttgccctcaagaagtaatagtccatacaatacctggactcggcgcatgaggcctaagcttttgctgatcacttcaagatggctctggactgtttcttcgctgtatggtttgttgtgggaaatgtgtgggtgttcgatggacattcttccgcccatgacgcacccaacctgtacaggtgtcggtgagaggtattcaagttggaattggaattgtaggttatagtccactagaagaggttttttttgtgcagtggagcaaaactagctgactcgctgtcagagcaagacttccgcaaggggaactcaaactattacctatatgtgcataatacatggttcaactatccttgcttttaaacatctccttgatctttgatacattttttggattttgctcaagtatttgacatatacaagggtcccatccccgatgcttggagcaaactgcttg

SEQ ID NO: 6425 - DNA, 800 bp, Zea mays
  Predicted polypeptide sequence is orthologous to G2394
gacaacaacgacacatttttcagtcaggcgattacttgctggatcatgtaaggactcgttggtccatgacataatctctttctctctctcactatataatttacaaggtgctcttctggaagccacacacacgcccaaggcaagttgctgtctcactatacatcatggaagccgttgtgattcaatgtcgtttcctaccctcctgtggctgtcgcggcgcccaaagccaatggctggaggagcggtcctcgggacgacgtcgatctcagctttgcagagtgggcacagcgcatttatcttgagccatttgtcgacacagtccttgtggaagaagtgcccgcaagggagcaaccggagatcatcgttatccacgtacctcgccaagcagatacagcaaacggcgtcttcagcagaaacagcgcgttccttgtccgttccaggagcaaagactccaccgccaccttcgtttgcctccccgttacgaggcttctttgacctgaacctgtatgtgcccagggcgttgatcgcatccgaagtagcacctctgttttcgtccagatcttcccggaagcccatcagggagattatgcagggtaagcagcagcatatcagcgcgcagaggatgaagggcatcgcatagccaatgcagctgaaagtgaggaaggctatgcacaacctgtacaggttgggtgcgtcatgggcggaagaatgtccaccaaacacccacacatttcccacaacaaaccatacagcgaagaagcagtccagcgccatcttgaaatgatcagcaaaagcttggg

SEQ ID NO: 6426 - DNA, 775 bp, Zea mays
  misc_feature (24)..(24): n is a, c, g, or t
  misc_feature (618)..(618): n is a, c, g, or t
  misc_feature (636)..(636): n is a, c, g, or t
  misc_feature (657)..(657): n is a, c, g, or t
  misc_feature (735)..(735): n is a, c, g, or t
  misc_feature (745)..(745): n is a, c, g, or t
  Predicted polypeptide sequence is orthologous to G241
gcgagctcgggaacaggtggtcangcgatcgccgcgcagctgccggggcgcaccgacaacgagatcaagaacgtgtggcacacccacatcaagaagcgcctggggggcgacgacggcggcggcaccggcggacggcaggagaagaaggcgcgcaaaagcaggaccaggaccgccggcgccaccaagagaccagccgccgacgtggacagcagcgagcggcagccggcgtcgccggggcagtcgagcagcgtgagcagcggcgtcacgttctccgccgcggccgtgtcgtcgtcgcccgacaacgcggccgccaccagccgccaggaggagcagctgcaggtcggcggcgccggcaaggcggagatggagatggagatggagatggagagcttcagctccgccgagttcccggccatcgacgacagcttctggtcgtcggcggacgtcacggacctgggcctttgcgccatggacggggatgagctgggcatcgccggcccgccctcgtcgtccaccagggaccaggacatggagttctggctcaagatgctgctggaggccggcgacatgagggacttgagcgtcttgtaactagaatgcagaaatcaaacttattangggcctggttacatgcangcaggattagactagacatcnattttctttttctttattttctcctgcatcttgttccccattttccgtgaccagaaatcttggcaacgtactcatcgncggtgaatcnccttcaaaaaaaaaaaaaaaaaaaaaaaaa

SEQ ID NO: 6427 - DNA, 129 bp, Zea mays
  Predicted polypeptide sequence is orthologous to G241
atcaactacctgcgccccgacatcaagcgcggcaacttcagccgggaggaggaggacgccatcatacagctccaccaaatgctcggcaacagatggtcgacaatcgctgccaggctgccggggaggacg

SEQ ID NO: 6428 - DNA, 129 bp, Zea mays
  Predicted polypeptide sequence is orthologous to G241
atcaactacctgcgccccgacatcaagcgcggcaacttcacccgcgaggaggaggacgcagtcatccaactccaccaaatgctcggcaacagatggtcggcaatcgctgccaggctgccggggaggaca

SEQ ID NO: 6429 - DNA, 784 bp, Zea mays
  Predicted polypeptide sequence is orthologous to G241
gcacgaccaggacactgctcccgtccccgaaagacaaacaggcaagcagcaaagacacgcctccctgcctgcactccccacacgcccacacctccaacagacaaagacaatctagcaagcacacacagcatcaggaggaggagatcgagtacgggtttgaagcagagaatggggagggctccgtgctgcgagaagatggggctcaagagggggccatggacgccggaggaggacaagatcctggtcgcgcacatccagagcttcggccacagcaactggcgcgcgctgcccaagcaagccgggctgctgcggtgcggcaagagctgccggctccggtggatcaactacctgcgcccggacatcaagcgcggcaacttcagcaaggaggaggaggacgccatcatcaccctccacgagcagctcggcaacaggtggtccgccatcgccgccaggctgcccgggcggacggacaacgagatcaagaacgtctggcacacgcacctcaagaagcggctggagcccaccaccaagcagctggagcaggagcagcacggggcgcatgcaggtggtggcgccgccaggaagcgcagcaggcccaagcgcgcgggtgccaggaagacgacgacggccgccgtcgccccggccaccaccgcgccggcgtcgcctgaacggtcggcggcctcgtcgtcggtgaccgagtcgacggagcaggagcagggaaacacggggacgagctcgcccgggtcccccaaggaggagagcttcacctcgtcctcggaggccg

SEQ ID NO: 6430 - DNA, 806 bp, Zea mays
  Predicted polypeptide sequence is orthologous to G241
tgcaaatctgccccggcggcgacggcgaccctccctcccactcgctttccccgctccctcctggcctgcccataaatagccccccgccgaggacacgggacacagcccgtccccgtcgtgcttcaattcgccactctcctggcccctgctgccgtcgccggcttctacagctactagcagctcggaggaccgggagcagctcccaacacccgcggagccagccagccgcttgcgcttggacccccgatcgatcgtctcgtcgccgcctgcccgggcggccgatggggagggcgccgtgctgcgagaaggaggggctgcggcggggcgcgtggagcgccgaggaggaccagcgcctggtggcctacgtccggcagaacggccaccccaactggcgcgcgctgccacgccaggccggcctgctccgctgcggcaagagctgccgcctccgctggatcaactacctccgccccgacatcaagcgcggcaacttcacccccgacgaggaggccctcatcgtccgcctccaccgcgagctcggcaacaggtggtcagcgatcgcggcgcagctgccggggcgcaccgacaacgagatcaagaacgtgtggcacacccacatcaagaagcgcctggaggacggccacggggaggagaagaaggcgcgcaaaggcaagcccgccgccaagaaggccgccgacgccgtgggccgcagcagcgagcacgggccgttcctgaccgcgtcgccggggctgtcgagcagcggcgtcacgttctccgccgcggcggactccgccgcggccgtgtcgtcg

SEQ ID NO: 6431 - DNA, 1001 bp, Zea mays
  Predicted polypeptide sequence is orthologous to G2457
gcacgagcacacagctagcagacagccagacacgcgctgctttctgatctctccccggatcggaggctcctcccaacataccaccctgccagccgcgccgccacgtccacgccggccggccaccaagcaagcatggatatggtttcgcagtccgagcacctgtgctacgtccgctgcacctactgcaacaccgtgctcgcggttggggttccatgcaagaggctgatggacacggtgactgtcaagtgcggccactgcaacaacctctcctacctcagtccacggccccccatggtgcagccgctctcgccgactgatcaccctttggggccattccagtgtcagggaccctgcaacgactgcaggaggaaccaaccgctgccgctggcttcgccgtcatcaactgagctaagcccgagaatgcccttcgtagtcaagcccccggagaagaaacaccgcctcccatctgcttataatcgcttcatgagggaggagattcagcgcatcaaagctgcgaagccagatatccctcacagggaggccttcagcatggctgccaagaattgggcaaagtgtgacccgcgctgctcgacggctgcctctaccgaaacttctaacagcgctcctgctgagcctagagttgtgcccactccccagttaactgagccacgctttgacctggaggatagggccaaggggcaagtcattgagagcttcgacatcttcaagcatattgagcgcagcatctagaggtcgttcgatgccgctgttgtagcccagtatcgatcgagtaccatcagctatatgtataacctatcccgtatcgccgtcgtcgcctcgcaatcatgcatccccatcctgtacttttacccccgtacgtgttactgttgctgttattctcgttatggttggattgtacgcaccatttaattatgaacagctgctacctatatatataatatttgccttcttttttgttcctaaaaaaaaaaaaaaaaaaa

SEQ ID NO: 6432 - DNA, 893 bp, Zea mays
  Predicted polypeptide sequence is orthologous to G2457
ctcccctttctttgtctgcctgtgcttattagtatctcgcctcaccacgcagctagctagcagacagccagacacgcgctgctttcagatatctcaccggaccgtcgtcgtcggcccctccgagaacataccaccgcgcccgccgccgcgcgcgccaccacgtccacgtacgccggccggccaccaagcaagcatggatacggtttcacagtccgagcacctgtgctacgtccgctgcacctactgcaacaccgtgctcgcggttggggttccatgcaagaggctcatggacacggtgactgtcaagtgcggccactgcaacaacctctcctacctcagtccacggccccccatggtgcagccgctctcgccgactgatcatcccttggggccattccagtgtcagggaccctgcagtgagtgcaggaggaaccaaccgctgccgctggcctcgccgacatcgactgacctcaccccgagaatgcccttcgttgtcaagcccccggagaagaaacatcgcctcccatctgcttacaatcgcttcatgagggaggagattcagcgcatcaaagctgcgaagccagatatccctcacagggaggccttcagcatggctgccaagaattgggcgaagtgtgacccgcgctgctcgacgactgcctctactgccacttctaacagcgctcctgagcctgctagagtcgtcgtgcccactcctcatgtaactgagccacgctttgatctggaggatagggccaaggagcatgtcattgagagcttcgacatcttcaagcagattgagcgcaacatctagatgtctccatttcgagtaccatcagctctatatataacctatgcatgcatatgcatccccatcttgtactttttacccc

SEQ ID NO: 6433 - DNA, 616 bp, Zea mays
  Predicted polypeptide sequence is orthologous to G2457
aagggcaaaaaaggatttattaagccgccttcccggttaatttaaaccagggagggggccccccaggccagaagaaaaaaaattcaggggattggatgaggcttcccttcccacccaggcatcaaaaaaaaccttcacaagggttttttttgcccccattaaaaagggaagggaaaaaacgtattggtatatatccctcccccccttcattccccactaaaactttttaatttacccatcacagaaaatttaaaatttggggggaattattaattcttccccccccggccggccagttgaagaaaaaaagggctgatccctcgatcgaccgggatcaataaaaaaaaaccttggatttttttcggagcccccgcccccgccgcgacagccccgcccacaaacttattcttgccccccccccggccggagtttaagccaaaagggaggttcggaaaaggggcccagttcttggcggcggggctgaaggcttccctggggctaaggggggggttgttccccttgatcctgcaaatctcttccttgatgaatctgttaaacgccaacggaacccgctgccccttctcaggagccggacaaaggttgttcagggtctgtt

SEQ ID NO: 6434 - DNA, 740 bp, Zea mays
  Predicted polypeptide sequence is orthologous to G2535, G961
ctcctagctcttctctttcctcatcatcgtcttcctcccctcacatcctctggcctctggtcctccaccgtcctgctagccagagctgctcttgtacgcgcagctggcctctgtgcatatcaccagcacaccgcgcaggggaaggaaattaacaagagaaaaggcaaggagagcaggcaggcaaggaagctgcagaagccaaggaaggagaaggaggatcatcaatgagcatctcggtgaacgggcagtcgtgcgtgccgccggggttccgcttccaccccacggaggaggagctgctcaactactacctccgcaagaaggtggcctcccaggagatcgacctcgacgtcatccgcgacgtcgacctcaacaagctcgagccatgggacatccaaggtacgtacgtacgcacggccggtccggtccgatccggtaccactgccttcttcaacttcaagttcaagcacgcgcgcgcgcagtagcagagcagctcgtggtcgtggatcagatcggatcggagctggtgcacgaccatgagagcacggacatgaacatgaacagaccttgttgtgaatgcaactgccttagctagctaccaagcaagtactctcgttcgtacagcagcatgtatagcttatgttcgttgatcgacaaaactagctagcaaacaatcaaacgcgatcgaattcatcgcgcgctaactactggctaacaactgctactactactaaagccgctag

SEQ ID NO: 6435 - DNA, 504 bp, Zea mays
  Predicted polypeptide sequence is orthologous to G255, G664
ggggcggtcgccctgctgcgagaaggcgcacaccaacaggggcgcgtggaccaaggaggaggacgagcgcctggtggcctacatccgcgcgcacggcgaagggtgctggcggtcgctgcccaaggcggcgggcctgctgcggtgcggcaagagctgccggctgcggtggatcaactacctccggcccgacctgaagcgcggcaacttcaccgccgacgaggacgacctcatcgtcaagctgcacagcctcctcgggaacaagtggtcgctcatcgccgcgcggctcccggggcggacggacaacgagatcaagaactactggaacacgcacgtccggcggaagctgctgggcaggggcatcgaccccgtcacgcaccgccccatcgccgccgacgccgtgaccgtgaccaccgtctcgttccagcccagccccagcgccgccgccgcagcagcagcagaagccgaggcgacggccgccaaggcgcccagatgccccgacctcaa

SEQ ID NO: 6436 - DNA, 961 bp, Zea mays
  Predicted polypeptide sequence is orthologous to G255, G664
ctgctgctagctagctggacaccgagagagaaagagagagagagcgagagatgggcaggagggcgtgctgcgccaaggaaggggtgaagagaggggcgtggacggccaaggaagacgataccttggccgcctacgtcaaggcccacggcgaaggcaaatggagggaggtgccccagaaagccggtttgcgtcggtgcggcaagagctgccggctgcggtggctgaactacctccggcccaacatcaagcgcggcaacatctcctacgacgaggaggatctcatcgtccggctccacaagctcctcggcaacaggtggtcgctgattgcaggcaggctgccgggccgaacagacaatgaaatcaagaactactggaacagcacgctgggccggagggccggcgccggcgccggcggcagcagggtcgtcttcgcgccggacaccggctcgcacgccactccggcggcggcggggagccacgagatgaccggcggccagaagggcgccgctcctcgcgcggacctcggctcgcccggctccgcagcagtagtgtgggcgcccaaggcggcgcggtgcacgggcgggctcttcttccaccgggacacgccgcacgcgggcgagacggagacgccgacgccaatgatgatggccggtggtggaggaggagaagcacggtcgtcggacgactgcagctcggcggcgtcggtatctcccctcgtaggaagcagccagcacgacccgtgcttctccggcgacggcgacggcgactggatggacgacgtgagggccctggcgtcgtttctcgagtccgacgaggagtggctccgctgtcacacggccgagcagcttgtgtagacaacaagtacacgtacggagtacaattatatatagccatgcgtatgtatacttttttcccttctccaatccaaacagaaatacgtatgcgtatgaaatagtatcgg

SEQ ID NO: 6437 - DNA, 927 bp, Zea mays
  misc_feature (430)..(434): n is a, c, g, or t
  misc_feature (651)..(692): n is a, c, g, or t
  misc_feature (821)..(870): n is a, c, g, or t
  Predicted polypeptide sequence is orthologous to G255, G664
ccacgcgtccggtgccctataaaatccagccccgcttggcttcacccacccttgggctcgcagtcgcagcaacgatggggaggtcgccgtgctgcgagaaggcgcacacgaacaagggcgcgtggaccaaggaggaggacgaccgtctggtggcgtacatcaaggcgcacggcgaggggtgctggcgctcccttcccaaggccgccggacttgtgcgctgcggcaagagctgccgcctccggtggatcaactacctgcgccccgacctcaagcgcggcaacttcacggaggaggaggacgagctcatcatcaagctccacagcctcctcggcaacaagtggtccctgatcgccggaaggctgccgggcaggacggacaacgagatcaagaactactggaacacgcacatccggcggaagctgctgagcannnnnatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccnnnnnnnnnnnnnnnnnnnnnnnnnnnnnnnnnnnnnnnnnnaccgccatgctcgacttcagaagactcgagatgaaatgagagcttccatccatctctgtctgtctctctctgtaacttcacccctgataacacgcagtagtagtagtcaccaactgatttgtcgcaacnnnnnnnnnnnnnnnnnnnnnnnnnnnnnnnnnnnnnnnnnnnnnnnnnntgtaaattagcatcaccatgggcaattaataatacttgttgctgctgcaaattgccc

SEQ ID NO: 6438 - DNA, 1372 bp, Zea mays; identical to SEQ ID NO: 1985
  Predicted polypeptide sequence is orthologous to G255, G664

SEQ ID NO: 6439 - DNA, 129 bp, Zea mays
  Predicted polypeptide sequence is orthologous to G255, G664
atcaactacctgcgccccgacctcaagcgcggcaacttcacccaggaggaggacgacgtcatcatcaagctccaccaggtcctcggaaacaagtggtcgctgatcgccgcccagctgccggggcggacg

SEQ ID NO: 6440 - DNA, 914 bp, Zea mays
  misc_feature (4)..(6): n is a, c, g, or t
  misc_feature (28)..(28): n is a, c, g, or t
  misc_feature (50)..(50): n is a, c, g, or t
  misc_feature (53)..(55): n is a, c, g, or t
  misc_feature (59)..(61): n is a, c, g, or t
  misc_feature (80)..(80): n is a, c, g, or t
  misc_feature (89)..(89): n is a, c, g, or t
  Predicted polypeptide sequence is orthologous to G255, G664
ggtnnnggatggtagcctgcagtacggnccggaaatcttcctcagccgcncgnnngagnnngatatcccacaaaaacggngggagaggnagggagccatggggaggtcgccgtgctgcgattttgccacaccaacaagggcgcgtggaccaaggaggaggacgagcggctggtggcgtacatccggtcgcacggggaagggtgctgtcggtcgctgcccagcgcggcgggtctgctgcgctgcggcaagagctgcaggctgcggtggatgaactacctccggccggacctcaagcgcgggaacttcaccgacgacgaggacgagctcatcatccgcctgcacgccctcctcggcaacaagtggtctctgatcgccgggcagctgccgggccggacggacaacgagatcaagaactactggaacacgcacatcaaacgcaagctcctggcccgaggcatcgacccgcacgagcaccaccgcccggatgcgctgcaacacggggcagcaacaagcactcgacgcggaccccgccgcgaaaccgaacccaaaaccggaggagtcgtccaaagacggcgggagcgacaactgcaagtggaagaggaagcggcagcatcgtgggtggaaccgcggggccccaacactgaaccccacctggccgttaggcagaagggaagcgccatctgtggggagcccgacgtgcctggggcgccagaactggaaagcgggactgctagtaggaatgctgatggatagagcgagagagaagtcgcagaaagttctactaggcagagccaaacagggttcgggcgcagagagagggacacagtacgtcgagaacaggcgctgagaaaagggagggaagaagaacgcccgcagaactgtccaaggagaacaggaaaaaaagaggagctcgc

SEQ ID NO: 6441 - DNA, 737 bp, Zea mays
  Predicted polypeptide sequence is orthologous to G255, G664
tggcgggcccacggacaggtcgaggttgaggtcggggcaccgcggctcctccacgctggcgccgccgccgctgctggcgctggcgctgctccggccgccgtcgtcggatgactccgccggcgccggcttcacggcgagctcgacgggggctgcgcctgcgcggtgcagcagcgcccggtgcgcgaccacgccgggtggcgcggcggcgtcggcgccggcgccgagcgggcggtgcgtcttcgggtcgatgccgcgggcgaggagcttgcgcttgatgtgcgtgttccagtagttcttgatctcgttgtccgtccggccaggcagctgcccggcgatgagggaccacctgcggggggtaagagaagagagcaggttcgttgtggcgttaggcgatcatcgaagcgcccggccgggagcattattgttgtattaaccgtatcgactaggaataggaacagcgacgacgagagctaatagagtaatagctagacagaaggacgccggcagcccggcacacgctcactgacttgttgcccaggaggctgtgcaggcggatgatgagctcgtcctcgtcgtcggtgaagttgccgcgcttgaggtccgggcggaggtagttcatccagcgcagcctgcagctcttgccgcagcgcagcagccccgccgccttgggcagcgagcgccagcacccctcctcgtgcgcccggacgtacgccaccagccgctcgtcctcctccttg

SEQ ID NO: 6442 - DNA, 849 bp, Zea mays
  Predicted polypeptide sequence is orthologous to G255, G664
ctgttgtccacgaaaggctcgcactcgcgccggtcgttcgctgcagcacacaacgcaatcgccactgtcgtcgctcgtcagtccaccgactccaccgccaccggcagaaccagaacacatcgagcggcatcggagcgcgaatctgtgcggcggcgtcgcctctgccgggcgggtgggcggcatggggaggtccccgtgctgcgagcaggcgcacaccaacaagggcgcgtggaccaaggaggaggaccagcgcctcatcgcctacatcaaggcccacggcgagggctgctggaggtcgctaccaaaagccgcagggctgctgcggtgcgggaagagctgccggctgcggtggatcaactacctgcgcccggacctcaagcgcggcaacttcagcgaggaggaggacgagctgatcatcaagttccacgagctgttcggcaacaagtggtcgctcatcgccgggaggctgccgggcaggacggacaacgagataaaaaactactggaacacgcacatcaagcggaagctgctcgcccgcggcatggacccgcagacccaccgcccgctggccgcagcgccagcaggagggccgcagcagcagcattgccattaccagatggagccacagaagcgggcggcggcggcggaccattccgaggccgccgttgccaccaactcgccggaggccagcagccgcagcagcgacgacgacgaggcgccggcgctggcgccaccgccgcggcggcggcagcgccacctcgacatcgacctgaacctgtccatcagcctcgcggcctaccagccgccgggagggaaccggcagcgccatcgagccactgacggcgacga

SEQ ID NO: 6443 - DNA, 1401 bp, Zea mays
  Predicted polypeptide sequence is orthologous to G2550
ggcacgagcggatagatgtggttagttgctctactgtttatgataactttctgccgtttaggatgtctgtgggtaccagttcataaataggcgtgcgtgccgtggaccttggtgttgctacttgctaccaatggtcatggcgaagcagcaccatgacaaggggttgccgaagcaagctcgcaatgagcccgcgccgttccggctcgagcagtgttgccgctgcgacgatgcccaccgtcaggccgacgacgagtccatggatgctgctgggtctgctggcccgctgcacctgactctcggcccgctcggctcggccgccggcccccgctgctcgtgcggtgtcgcgccggcgccggcgccggcgctggcggcgcccgcaacggtggccgtcctccgcgggtcccggtacatgcggccggcgcaggagctgctgggcgaggttgtgcgcgtggccgacctggcggctgccgacgacgaagacgaggaccaggcgacggagcggctcgagggcggcggtcaccgggcagcgcgtcgggcggccgggaaggccgggaacgacggcgacggcgtccaggccaagctcctctacctgctcagcgagctggagagcaggcgggagcgctacttcggcgagctggagcgcgtggtgtcgtcgttcgagccggcgctgggcggcggcgcggcggcggcctacacgaccctgatggcgcgggccatgggccgccacttcggcaacctgcgccgcgccatactgcgcaggctcaggctccaagccgccgccgcggcgaggaggtctctgcggcgcggcggcgaggaccaggacgacgacgacgacgacgacggcgacagcgacggcgaggtgaccgaggagctggtggacaggttggctcggcggacgaagctggccgcggcggcgcgggcggagcaagcgtggcggccgctgcgtggtctgccggatggctccgtggccgtgctccgggcgtggctcttcgaccatttcctccacccgtaccccaacgacggcgagaagctgaggctggcggtgaccaccggcttgagcaggcgccagatatccaactggttcatcaacgcgcgcgtgcggctgtggaagcccatgatcgaggagatgtacaaggacgagttctccgacggttccgccgtctccagctacgacgacgccagcgccagcggcgcctcctcatcctcctgagtcttgaccacctcgccctcgagaaagtttatctagctaattcatcactcggttgattggtcctgttgctttgggattatattaatttatttatatccatgcttaatcatgtgcctctcttgtatttttttttagaaaaggacatactccttcaaaatctagcgacttttcgaaaaaaaaaaaaaaaaaaa

SEQ ID NO: 6444 - DNA, 522 bp, Zea mays
  Predicted polypeptide sequence is orthologous to G2552
tttttttttttttttaactagatgtagagtttgtagttatttacccgtccctggttatgagaaaacaatttaaatctggagaagggctgcttcactcagagttttgtatgctaaacacgccctaaacctagacgaaggaaaagtcccacttttacatgtactcgtggtttaggttgaggcctcctttggagttccaaaggaaaaaagaagaaattttaaaggattaaaaccctataaaaagtttcctatatggtcctttggaataaaggattgagttgctacaaattttatagaatttagcattgtagtgagattttggaggattttcaatatgaggtctaacctcttgaaaaatttcctatataattgaaggtgacatgcaactatattcttacattttttttatctcttgttttactaatactctattccaaaggaggtacgatgttttacccgttcctaaggaatgcccggtgttatccatgtttgtttataaggccttcgtgctaggtggcatgcata

SEQ ID NO: 6445 - DNA, 761 bp, Zea mays
  Predicted polypeptide sequence is orthologous to G2575
gaaaaaaaaaacgaaagattaaagagaggtcaagcattaacaaggaccaaactaagtactatcatctcttatctctgctagcttccttcctcattagctcgatcgcttgtggtggtggtgactggtgacgacgactattagctgatcgaattcagggcagctggacgttgctgccgttgctgtggacgacgaaggacaacgacgacgatgacgacggcagcatgtcctgtagaagcccgaagtcgtcctgcgccataaagtgctgcatcgtctggagcgagggaggaggaggaggcgacgaggtagtggtcgtggtgacggtggtggtggtgggcgccgtcgtcgtcgtcgcgcctgccaccgtgcccaccggaccgctcatgcagcagggggacggcgcgaggcctgtcgccgccggcggcacggcggcgtggttgcgcggaggcaggcagagacccagcatgtcgatgacgccgccgccgtcgcctgtccgcccgacgaacggcaagcacatcgtctgcgggggtggcggcggcggcgggaaggcgccgacgatgttgtggtggtggtggtggtgcagctgcgcggcgaggaggtgggtgctgctgccacggagcgtggacgggatggggtgcgtgtgcttgccttcgtacgtggtgatcaccaccgccgggtcctggtgcgaccgctccacccgcttcttcacggggcacctctgcgtcgtgcaccggtagtagctcctggggtatgggctgttcttg

SEQ ID NO: 6446 - DNA, 1523 bp, Zea mays
  Predicted polypeptide sequence is orthologous to G2579
aattcggcacgacacaactacactactccaaaacgaccctcaagcaggaaggccggccacccagcactcaagctagatagctcatcacagccacagcagctagagcctagtagctcactcgcgctcgtgccatgatgaatacccgagcctgtggtagcagcggcagtggcggcaggaacgaccagaccatgatgggcttctccgagcatccgaagccggcggcgtcggggcaggcgcagccgtccccgccgtcgtcgccgagcgagcgtccgccagcaggccgcgggcgccggcgcgcgcaggagcccgggcggttcctcggcgttcggcgccggccgtggggccggtacgcggcggagatacgcgaccccacgaccaaggagcggcattggctgggcacgttcgacaccgcgcaggaggcggcgctcgcctacgaccgcgcggcgctgtccatgaagggcgcgcaggcgcgcaccaacttcgtctacacgcacgccgcgtacaactacccgcccttcctggcgccgttccaccacccgtcgtcggtgcagcagcagcattacggcgccgcgccgcacgttggctcgtacggccaccaccactaccaccaccagggctcggcagcagctgtcggcgcgtcgtcgggcgagtgctcgtcgacgatggcgacggcggtgccgcccgtggagcgcgccgacggcacgctgctgctggaccgcggcggcggcgggcaccaccaccaccccgagttcctgttcgcgagcgcggacgacaactccgggtacctgagcagcgtggtcccagagagctgcctccggccgcggagcagcgcggcggcggtggaggacctgcggcggtactcggacgcggacgcctacgggatgggcgtggggctccgggaggacgtggacgacctcgcgcagatggtggccgggttctggggcggcggcgccggcgacgcggaccagctgtgcggcggagggttcccgtcgggcggagccggggacagcatggccgtggcgtcgtcgcaggggtcgtccgacggctactcgcccttcagcttcctctcccactgatgacaaatgagctagctgccgcgcgcgcatggattgcattgcatctgctgcgcacgtaatgtagatcgatcgatcgatcgatcaccagttagcctagctagctagtttgcttatcatgcatggtgatcgatcggtcctgatcatcggttcttccgatccctgctgtttaattcctttcgagagagtacgttgggtcgaccagtgtgagagtgagcagtatagtagtgttagcatttagcatcagaagtagagggaggagcgatcgagagagaagaagagagagtacgtagctgcgtgccctagcttcttcatgtgtactccgtcttcgttctagtacgtcctacaagacctacgtactctcgatctgtagctttaaccatccaactttattattaagatcatcaactcggtcgaacgcttgctcttataaaaaaaaaaaaaaaaaaa

SEQ ID NO: 6447 - DNA, 623 bp, Zea mays
  Predicted polypeptide sequence is orthologous to G258
cactgctgcagcaagaagaaggtgaagcgtgggctgtggtcgccggaggaggacaagaagcttgtcaagtacatcaccgcccacggccacagctgctggagcgccgttcccaagcatgccgggctgcagcgctgcggcaagagctgccgcctccgggggatcaactacctccggccggacctgaagcgcgaaaccttctccgaccacgaggagcgcaccatcatcgacgtccaccgcatcctcggaaaccgatgggcgcatatcgccaagcacctgcccgggcgcacggataacgaggtcaagaacttctggaactcgtgcatcaagaaaaagctcatcgcgcagggcctcgaccccaagacccacaacctcctgccggcctccaagactctcctccacggcaacggggcaaaccctagcagcaacaatcctgcccacttcaactcaaacggctgcgctgctgtcgtctccgtcgccacgacgcccttcaccatcatctccccgaccaaggccgccgcctacggcaccgtcaccgccacgccgccgccggagacgatggcgccggcaacgtacgacgtccctaataattaccctgacggcatgctcatgaggcatgatcaggc

SEQ ID NO: 6448 - DNA, 604 bp, Zea mays
  misc_feature (217)..(217): n is a, c, g, or t
  Predicted polypeptide sequence is orthologous to G2604
actctcgagtttttttttttttttttttttaaaacaacataggtttatatatgtgtctcattcgattttacagacaggtcgacgaggttaagccctagctatatatccaaaaactctcatttattccgcgggctcgccagatccatcgaaggaacgcagaagtggacgggtggggtggagatggtgaggaggaaccaaaaaagaaaagaaaacaaangaaaagaaagtgaaagaatcgcttcagggaagaactctatacatgtgcactcaaagcatccttttcataggtggtctcacagcactttcagggacactatcagctcagctgctgggcttctgctctgcaccaggtgaggttccaaccgatgtcacaaaactgcagaccgcgcacttcacggaccgagccccgtactggtacatgagcagcatgcggcagttcccgcagttcacatgcgcgacttgatttgcttccatagccaggttcacagtgtggcagcaagaacactgcacgctcgtcgcgccgcgtatgtacatgaggagggtgggatcctccgatactagctgcgccatctcagttcctggagccggcacggcgggacgggct

SEQ ID NO: 6449 - DNA, 1046 bp, Zea mays
  misc_feature (25)..(61): n is a, c, g, or t
  misc_feature (133)..(137): n is a, c, g, or t
  misc_feature (191)..(260): n is a, c, g, or t
  misc_feature (947)..(949): n is a, c, g, or t
  misc_feature (976)..(1005): n is a, c, g, or t
  misc_feature (1040)..(1044): n is a, c, g, or t
  Predicted polypeptide sequence is orthologous to G2604
tcgggcccgcggtccgtctagaagnnnnnnnnnnnnnnnnnnnnnnnnnnnnnnnnnnnnngggaggtttatatatgtgtctcattcgattttacagacaagtcgacgaggttaagccctagctatatatccnnnnnctctcatttattccgcgggctcgccagatccatcgaaggaacgcagaagtggannnnnnnnnnnnnnnnnnnnnnnnnnnnnnnnnnnnnnnnnnnnnnnnnnnnnnnnnnnnnnnnnnnnnncgcttcagggaagaactctatacatgtgcactcaaagcatccttttcataggtggtctcacagcactttcagggacactatcagctcagctgctgggcttctgctctgcaccaggtgaggttccaaccgatgtcacaaaactgcagaccgcgcacttcacggaccgagccccgtactggtacatgagcagcatgcggcagttcccgcagttcacatgcgcgacttgatttgcttccatagccaggttcacagtgtggcagcaagaacactgcacgctcgtcgcgccgcgtatgtacatgaggagggtgtggcatcctccgcatactagctgcgccatctcagttcctggagccggcacggcggtgacggtgctgcagacggcgcagcagaccgacgtcgcaccagctgggtacatgaggaggttccggcacccggtgcagacgagctggctctgggccccattgggcggcgtgaatggcgccggaggagctgggtacggagcaagcggaaccggcattgccgtgccggcggctgccttatctgacgacgcacgcagctcggggaggcctcgcagattccggcggcgttcaggcggcagagaccagctgcttcgccccgcatgaaaccctagtagcaacacagcacgtgcaggagacgctaagaacagttcttgagttaccacatctnnnaagaacagttcttgagttccacatctnnnnnnnnnnnnnnnnnnnnnnnnnnnnnntgccgaatcggcacgacgtcgatccgaacagcccnnnnnat

SEQ ID NO: 6450 - DNA, 586 bp, Zea mays
  Predicted polypeptide sequence is orthologous to G2604
atcgtaatgcgcaaactttcaactgccttttaatttttaaaccgctggtctgtacatcgagcgggtcgatcaggtgcaggcgttggtgctcgtcaagcttggacagcgctgctgagtgctgagtgaccacttacaacaattgcaccatatgaacttataacaagtacagtacattgaaccacgacgagtactctagttgaccataattgagatcgaataagcagggtcaggcattatggtttctgtctacaagtttatctttgtaccttgcatcacaaccttccagtggaaaactgcaatgcaaaggacttctgcagcgcataatttgctttgcttatcttatcctgctctcatcattcgtatttcgggcgaaggggtcgcagccgaaacgtggtggcaggagccgcagatgctgtggacgccgccgcaaacgagaaagaggcgaggggactggcgaggcgagggaggcgcaacgcccgccgcagctcggcaacacggagagcggaaggccgaatcggctcttgggctcatagaagccagtgacaatagatgatgggccatgcggccatgcccagcccaacacaat

SEQ ID NO: 6451 - DNA, 2364 bp, Zea mays
  misc_feature (69)..(106): n is a, c, g, or t
  misc_feature (140)..(163): n is a, c, g, or t
  misc_feature (386)..(390): n is a, c, g, or t
  misc_feature (509)..(515): n is a, c, g, or t
  misc_feature (534)..(539): n is a, c, g, or t
  misc_feature (708)..(712): n is a, c, g, or t
  misc_feature (999)..(1003): n is a, c, g, or t
  misc_feature (1209)..(1213): n is a, c, g, or t
  misc_feature (1895)..(1929): n is a, c, g, or t
  misc_feature (1945)..(1949): n is a, c, g, or t
  misc_feature (1953)..(1957): n is a, c, g, or t
  misc_feature (2040)..(2049): n is a, c, g, or t
  misc_feature (2085)..(2100): n is a, c, g, or t
  misc_feature (2136)..(2144): n is a, c, g, or t
  misc_feature (2208)..(2245): n is a, c, g, or t
  Predicted polypeptide sequence is orthologous to G261
gcccacgcagcaatctggtcttctggaaatctccatcaatccgattccgaacggcagaaaattttcccnnnnnnnnnnnnnnnnnnnnnnnnnnnnnnnnnnnnnncctgagccacctcccatgcgccgcgccgcagccnnnnnnnnnnnnnnnnnnnnnnnnggtctggagagggatggagggcgcgtcctcgctgccgcccttcctgagcaagacgtacgagatggtggacgacccggccacggacgccgtggtggcgtggacgccgctggggaccagcttcgtcgtcgcgaaccaggccgagttctggagggatctgctccccaagtacttcaagcacaacaacttctccagcttcgtgcggcaactgaacacctacgtaagnnnnnaccgcacagcacgatcattcattttcttcgccccatctccctctctgtccacctgtggttttgatcaatcggggtgcgtggcggcgtgctactgtcagctatgctgttgcccctttgcnnnnnnnctccacaagttggcatttnnnnnncgaatcttgttagccttgtagtagaacaattgtttagggtatcgtcttcggtcgaatgaactgtttccttgttatagcatagcgtgttgacaacttggtggcgataactttaaattacatgtgtccactatatatctagtatatatgctcaattatcttgttgagatgnnnnnccttttctaaatccaactagagttagtgtaccttttgacaaatgaagtgctgctaacggtaaacactgttgaattggcatctttgttgacacccaaattaaatccaatagaaaccataatgatttcggatggttacttttgatttatgagccttgatgggtcaaatttctgtgatgttgtgttaatcgttttcctgcttcttcttatgtagggctttaagaaaattgatcctgaacaatgggagtttgcaaatgatgatttcattaggggacaacagcaccgactgnnnnntatacacaggcgtaagcctatattcagccattcatcgcatactcagggttctggaccattaccagataccgaaaggagggattatgaggaggaaatcgaaaggcttaagtgtgacaatgcagctctgacctcagagcttgaaaagaatgcacagaagaaacttgttacagagaaacgaatgcaggatctagaagataagttgatcnnnnnggaggatcggcagaagaatctgatggcgtatgtcagggatattgtacaggcaccaggatctttctctagctttgtgcagcaacctgatcatcacggaaagaaaaggagactaccagtacctatctctctctaccaagattctaatgctaaggggaaccaggttgtgcatgggagcttcatcaccaacccaccagcttgcagggaatcatttgacaagacggaatcttcattgaactcgttggagaatttccttcgggaagcgagtgaagcgttcaatatttcatatgatgatggcctccctggccttcatctgctgtcgttatcacagagctccattcgtccggagaaagtgatccccatgtgccatcacctgtctcaagaatgcatacatcttcggctggtgcgggagattcgctctcttcccgcgatttaacagagtcaactagctgcgctgagagccctcgcctccctcagatccaaccctgtacagattcacgaactaaggtgtctgagatcgatgtcaatcgggagcctgctgtcacagaaactggtccgacaagggaccaacctgccgaggagcctccccacgtagcagctggggtgaacgatggcttctggcagcagttcctcaccgagcagcccggtcctgatgtacaccaggaggcccaatcagaaaggagannnnnnnnnnnnnnnnnnnnnnnnnnnnnnnnnnnaggggaccgagaaaannnnnggtnnnnnaagaagaatgttgagcagatgagagagaagctggggcgtctcacctcggtggagaaaacctgactgtatttcttgtagctggnnnnnnnnnngttagcacagaaacacatataggacgctggtgcctnnnnnnnnnnnnnnnnttgcagtgtatcatatatcttcgccaccagatatgnnnnnnnnnatcgacctcgtagtcgtacttcttccacctgtacttttgccgtgtttacagtgagacttagttnnnnnnnnnnnnnnnnnnnnnnnnnnnnnnnnnnnnnnactagtcgctatacttctgttaggagttctgcattcgtacttggttagtagacacttcctggtactgttgtccaacgacgtggttatatatgtagatgatgataatattcacttcgttg

SEQ ID NO: 6452 - DNA, 748 bp, Zea mays
  Predicted polypeptide sequence is orthologous to G261
gcaaataactgaatctgtgctctagctcaacagcacgaggacatacgtaatgtacatgggtcagcatatgattttactttttacagtaggaaatgctagaaaagacttagctagcctaaactataatgtacagcggcaacaccgatggtgtggtatcagtaattctcgggtgcataagaagctgaatcaagctgccccatctgctcagtgatctgatcaacattgtcctggagacgaggacagcagcggtctacggcagtcttcacatcctcttttgcttctattgcctcgcttttaccctcggcggcgtctgtgagaaaccgctcccagaatacatcgttcactttggccggcacatgggaacctccagtttcactggtggtatcatcttgcgaggtgtcgccggttgtggtgtcagagttcatatcgactccagcagctgtcctatgggcatgttcatggagctgtgccatcggcagcatcgggctctgggcgtagtagctcgggggttctgccaacggagaagacgactggtcttgccctgaggtcgaagcgaaggggttctggcaagctgatggctgcagatcgatctcggtatccattggtgccgagagcatctcgcctagagccagagcagggctgggttcagcaacaccagcggcgtacaacatgccttgagcagcagacgtatgcgctgttgccctctgcaagaaactctccagcgacaccagggccagctccatcttct

SEQ ID NO: 6453 - DNA, 611 bp, Zea mays
  Predicted polypeptide sequence is orthologous to G2632
ttttttttttttttttttccgagggatttatatgatttggtgcagttaatcagagccacatagagctaggtcacaggaaacttaggttgtgtatagcaatcggacacaagctcagttttccacttacaagttacaacacagcagctacacaagtgtgcacgagatggatgggctgcgcatatgctgtgttttggagctacggatccggtctcagatgcacgtgcctgtggacagaaaccgctgctctaggatgccagccagaccgctacctcttcaagcctcgttgtgtcgtcgtagctgtatcaagtcatcaggagggacacggtcactcttcttcgtgtttaggaagcgtccaccgttccctctcgccctcctcgtcatcgcgtgctgatgacggggactcgtgaagatacggctttcttgctttgaccagcgctttctctcaagctcggccttggcacgtgactgccgccgtcttagaatgccgcggtactgcttggcgttcacatagacaggctcctcggacacacatcttgacttccatagggagcaacaacgcctgcgtagtaagggtctgagtactgctatgctgcatgatattgatatgctgc

SEQ ID NO: 6454 - DNA, 872 bp, Zea mays
  Predicted polypeptide sequence is orthologous to G2632
cgacgacctctgcgcagagcgtgctgcgattggccggccttcctgggatcctccccgcgcccgacacccggaaacgcgcgcgcgcgcgagggagagacagagtgaggaaacgagggaaggagacgacgcgctcgcctattggccgccggctccgctccttcgcgcccagtgcgacggccacggcctgagcggcgctgccagcaaggcggctagtatgagcagcatggagtcgcggccgggccgaacgaacctggtggagcccatagggcacggcgccgcgctgccgtccggcggccaggcagtgcagccgtggtggacgagctccggggctgtgctcggtgcagtctcgccagccgtcgtggcggtggcgcccgggagcgggacggggattagcctgtcgagcagcccggcaggtggtagtggtggtggcggcgcggctaaaggagccgcgagtgacgagagcagcgaggattcacggagatctggggaaccaaaagatggaagcgctagtcaagaaaagaaccatgccacatcgcagatacccgctctggcgccagagtatttggcaccatactcgcagctggaactgaaccaatcaattgcttctgcagcatatcagtacccagatccttactatgcaggcatggttgctccctatggaagtcatgctgtggctcattttcagctacctggactaactcaatctcgaatgccattacctcttgaagtatccgaggagcctgtttatgtaaatgccaagcagtaccatggtatcttaagacgacggcagtcccgtgctaaggctgaacttgagaaaaaggtggtcaaagccagaaagccatactttcacgagtctcgtcatcagcacgcga

SEQ ID NO: 6455 - DNA, 826 bp, Zea mays
  Predicted polypeptide sequence is orthologous to G2639, G2640
gcaccagtcggcggcggcagctgccgagccccatcccccgatccctgcacctcaaaccaccgctctgcccagatccacccagctactgcggtgagcccgtggggacggtgggggacggtggcggtggcgacggagcggttccctcgggaggtgagctcggaggcgttattccactgcgtccgcctaggcccggtccacgagactggcaccgaggtggcgtaccagaccagcgtcaaaatcgccggccacgtcttcaagggcatcctgcacgacgtcggcccggacccatcatcgtcggtcgctgcgagcgacgactacttccgccacgccaccgacgggtcctccccgggcacggtgggcgaaggcagcgtcgcgggggcgggcccgtctcgtcattggctgtggtcatggacccgtacccgacgccaacgcccgaaccgtacgacggctcacatttcttccacggccatccgaggtacgttgaaaataaatattggatctcaaaaatggcattctagatctatctaccatttcgcttacacattatggctatctcacattcatgggttgcaagatatggacgacatgattttctccatattaggaaagctggaagagccttttgaactcacttttttttgctaacaatggtgttatggtgaaacatagttttgcgtgtatgtaccaacaactaaaatataaatacgacattatcatagttgagtacaggaataattattcttatatcttattgtaaaatctaaaacagttctcctgtagatggttagcttgcattttacgctacaattacctcagatcaaaaaaa

SEQ ID NO: 6456 - DNA, 880 bp, Zea mays
  Predicted polypeptide sequence is orthologous to G2639, G2640
cgacgagcagccgtctgtagagggggagggaccgagggagagatcagggcgtcaggccgttgtctctcagcttcaccttcaccttgccgggcacggcgaacggcacggcggcctatggatttggccacatggcggggttccctctaggtggaggaggccacagccgcgacgcccccgcgtcgtccgtcccgccggtgcacccctccgacgcagcgtccttcctctacgccgcgcgcgcgggagcgggcctgcagctatggcagcagcacgagcagcaacagcagcacccgttctacacctccaacatcatccgcttctccgatgacccgaccggcgccccgccctcgctcacgggcgccgcgtcgtcgtcgtcttcgcgcggcacgaggggcggcgcgggaagcggcggcggaggcggcggcggggtcagctgccaggactgcggcaaccaggccaagaaggactgcgtgcaccagcgctgccgcacctgctgcaagagccgcggcttcacctgcagcacccacgtcaagtccacctgggtccctgccgccaagagacgcgagcgccagcagcagctcgccgtgctagcggcctccgccgccgccacaaccgccggcgccggcccatcccgcgacccgaccaagcgccctcgcgcgcgcctctccgtcgccacccccgccacgtcctcgggggatcagcagatggtcacggtcgcggagaggttcccacgggaggtgagctcggaggcggtgttccggtgcgtgcgcctggggccggtcgaccaggccgaggcggaggtcgcgtaccagaccaccgtcagcatcggcggccacgtgttcaagggcatccttcacgacgttggccctcacagcttggctgc

SEQ ID NO: 6457 - DNA, 731 bp, Zea mays
  Predicted polypeptide sequence is orthologous to G2639
aaaaacagcttatccagcggtctatactctgtactttccaaattccaattcgtaccatttgaagtgttttcgtatttctgcaaccgacacaaatggacgagtttgtacaaataaacaaagaacgactactgagcaaaacactcccagagcaaacaacaacatacccacgccagggttcacacgtgctcatcatcctgctggcggctggcacgatccagcgggagcacaaccaagccacggaacagaagaagcaggccggcgaggtcgacacaggcgatatattccttctcatcttcgcctccaaaaaagcgcaggattcccatccagctttgtcaacatcgcttttccttattcccttcccgcgggatcgcgtgcgcgctcgccgtcatttttaagccccaactttctgcgccttatgtagaacagatagtagccaaactcagaggactccatacagatgcacagcccatcggattcgtctacccactttccgtttccctcttttcagttgctgccaggattggtccaggcttgagtgtttgttctaacgattcgaaattctctcctcacttgtcttccttataaaaccagactctagcagttatcggcctccaattaagcttaatactgaatgccctttctgctcttcagtgattggttgcaccatggcaatggacaaaccacttgaaggaaatggatcaccagctagccacttaaaccttacacataaa

SEQ ID NO: 6458 - DNA, 851 bp, Zea mays
  Predicted polypeptide sequence is orthologous to G264
gggatccaccaaccttcacccactcgcagcaggcagcaggcggcagcagcagcacgcgctgccgcagcaccagtcatggaggtcgccggcgcccgcgagcccggtagcggaggaggaggaggtggcggcggtggcggaccagccccgttcctgctgaagacgtacgagatggtggacgacccgtcgagcgacgcggtggtgtcatggagcgacgcatccgacgggagcttcgtcgtctggaaccagcccgagttcgccgcgcggatgctgcctacctacttcaagcacaacaacttctccagcttcatccgccagctcaacacatacggtcttcgcaaaatagacccagagcgctgggaatttgctaatgagtactttgtcaagggacagaagcacctgctgaagaatatccacaggaggaaacccatccacagccatagccatcagccaggtgccctgcctgacaatgagcgtgcgttatttgaggatgagattgacaggctttcacgagagaaagctgccctccaggctgacctctggaaattcaatcagcagcagtcaggtgctgtgaaccagttagaagatcttgagcggcgagtgcttgacatggagcagcgacagacgaagatgctcagcttcttgcagcaggctaggaagaatcctcagtttgtcaggaagctcgttaagatggcagaggaatccccaatctttgcggacgcgtttcacaagaagcgaaggctacctgggcttgaatgcatcacggatgctaccgaaactgccactagctttttcgatgaccatagcagtagttccaggcaagaaatgggtaaccttctgaatcagcacttctc

SEQ ID NO: 6459 - DNA, 812 bp, Zea mays
  Predicted polypeptide sequence is orthologous to G264
aaccacaacagaacagcaattccgtagtcgcattgctctgtctccggtatgtatactgggataatatgtacagggcattcttgcgatgctgtttacacacaatcctagacagaccttcgtgccattccaatttccagcaaaaactcaaggtcatgctaaaaaaactcaaggtcagagtttcagctgccccatatctctcgtgtcacttccagtgccctcgtcgtacgcatgcgtgtggtctggatccctcctcagggtgaagcttgcttcctcggcttcggggcagcccggcctctcggtaaggaactgctcccagaacttgtcgttcaccaccacctggggacctgtatgttcttcagggggagcttggctgccccgatgcggcctacccgttgcatctgctgcggccccagcgtgacctgaagcctccttctggttctgggtagcatcatggcatctgtcaggcatgccgtcgtccttctccatggtgggtgtggtcacctccggtgggccatccttctcatccacagtgttcacgtttgcatcggggatttggcttctgaccacatccattggacatgatgcaaggctgaggttgaggtggcatggcaagaacccgtcgtcatttgcagctgttgtaaagctcacactcttcgagggacagatggatgttccagtgtcagagagctccatcatctgtggcaccagtggaaggcactccatgcctgttctctcgtaatctggatgcttcccaagagggctcccgttatcttcatgtgagctttgggtgctcaaggtgatgaggttgcttt

SEQ ID NO: 6460 - DNA, 896 bp, Zea mays
  Predicted polypeptide sequence is orthologous to G2650
cggggggaaataattcggcatgcatgaaatgagatcgatggcgcattggccacagtgcgtgctggtgagcagcatgtggaattatttccccccggcccctgcacgagtctagagtctagacactagactgtcttgttcagttctgacttattatctgatgatgatccgttgttattaggtgtgtgtgtgatcatgagtggataataagagatgataagcggcaacctcaccaatgaagacctgggggccgggcgcaccaaggccgaggggccgacgaccgcggccagggccgtcgcgaagagtcccgtgctgccgagctcccggcactggccgccgtcgacggagtccaggatcgtgcgcgtgtcgcgggtcttcggcggcaaggaccggcacagcaaggtgaggacggtcaaggggctgcgcgaccggcgcgtgcggctgtccgtgccgacggcgatacagctctacgacctccaggaccggctgggcctcagccagccgagcaaggtggtggactggctgctcgacgccgcgcagcacgagatcgacaagctgcctccgcttcagttcccaccgcaggcagcgcaggacctcgtcgcccatctgccgccgccatccatggtggcgcccttcgcagccgaccgggccgaggccgacggcgacaaacgccactgccacgccggcgtcaaagggctcatgggcctcaacaattccatccgcctcgtcaacgccaccatgccgctggctcacggcttgtactacacgcccggcgagtcttggaccggtaccaatgccgatgatgccgcccgccatgatcatcagacggtggctcacggccactcgcccttctcatctctgctgtctcttgctgctccggggcctcagctcgtcttcta

SEQ ID NO: 6461 - DNA, 845 bp, Zea mays
  misc_feature (594)..(594): n is a, c, g, or t
  Predicted polypeptide sequence is orthologous to G2650
ggcgaggtgtccgaacttctcgtcgtgcaccatcagcggcatgttgtggggcgtcaggtgcccaaccatgaggtcctgcggcgggaactgcagcggcggcagcttgtcgatctcgtggcgcgcggcgttgagcagccagtcgacgaccttgctaggctggttgaggccgaggcggtcctgcaggtcgtagagctggatcgccgtcggcacggagaggcgcacccgccggtcgcgcaggcccttgacggtcttcaccttgctgtggcggtccttgccgccgaagacgcgggagacgcgcacgatgcgcgactccgtctgcgccgaccattgccgcgacgtcgccacggcggcggcgtgcctgctgttccgggctagctcctcctcgacgtccgccgcctgctggtggttgccgccccttatcatcgtcttgttagcccgacggcgcccgccatctcgcggtgtccctgctggctagctgcgtgtcggtgtatcatccactgcaactggtcagcctctctcagattattaacggcatgcatgctaattgtagcatcgtacgcagtaatgaatgcaaacataacagattcgcatganatggggtggggcgccatgattgagagcacactgtgcatgcaagcacggcagagggtctaccggttcatgtgtgcaactgttccattggggaatagggaaagcgctgcagctttattcgctctccatggaacagcaagatagcggtatgaaacagtgcaggtgagcgccagcgagctctggatcggtggctggcagcggctggcagcggcactagatgcacatacacatgatgcgctgcgccgctgtgcaag

SEQ ID NO: 6462 - DNA, 906 bp, Zea mays
  Predicted polypeptide sequence is orthologous to G2650
ctttgctttgctccctctcatctcatcttcccttcccttctccagctaacactacagctttctagggctcacaccgcagcaccgatccagcgccgtccggtcgtcgatccacatcaccattattccatccccctgataacgatcgagccccagccctccctcgctctccgggctgagctagccggacgaattcgggcgtgcggcttcgagctctcgcttatatcagcgccgcgcgcgccggccggcggccggaggagccactatcatccccggcgtttgattcggccagagcagcggccatggtcgaatatatttgatctctctcgatctgatctgagctgagccggctggtggcccgggaaggacgaagtgtgtcgccacctataatttgatgatgtttgtgtcatcatgatcggtggctagcagaataagagatgataagcggcaacctcaacaatgaagagctggggggcggcgggtgcaccaaggccgaggggccgggcgcggccggcggcgccggcgccgtcgtcgcaaagagtcccgtgctgtcgagctcccggcactggccgccgtcgacggagtcgaggatcgtgcgcgtgtcgcgggtcttcggcggcaaggaccggcacagcaaggtgaggacggtcaaggggctgcgcgaccggcgcgtgcggctgtccgtgccgacggcgatccagctctacgacctccaggaccggctgggcctcagccagccgagcaaggtggtggactggctgctcgacgccgcgcaggacgagatcgacaagctgcctccgctccagttcccgccgcaagggcaggacctcgtcgcccatctcccgccgtccatgttggcgcccttcgccaacgttgcagccgaccgggcccgcgccgccgctgcccgcc

SEQ ID NO: 6463 - DNA, 694 bp, Zea mays
  misc_feature (671)..(671): n is a, c, g, or t
  Predicted polypeptide sequence is orthologous to G2655
gattcaaagacaggcaacacattggcaatggttgtgcttccactgctaattattttgcaatctaataagaacatattacaccacaacctttgcatacaaaaatccataaatgcttagaagaaacatacctaagccccagcctacataaaaacatatcactgtaagcacaggtagtccccatcgatcgtcgtcgcagaaaggaaatagaagtagcaggaatactcgtttcctcatggcactactcttcaagaaaagtccgaccaacatcaccgacttgataatcgcttctctgctgggtcttcttttcatcatggcatcaatgtccccatccttccaagtgcatgtgaagggcgacgatggccatcagcacgagggatccctagagctcgcgcagcaactgaggacgacgacgtgcatcgcggttaagggaggcatttgtttccaaaagaagtgccagggtatctgcgaatccaatggcttcaatgctgcaactgccttctgctataaaccgcctggtcttcatctcccgcagagctgctgcccatgatcgttagttagcctaatgcagcgtacgcatgcatcgatccgtatgctctatacgcacataaactgaataagatgtgcggctttactaataataatatattacaatgcatgtggagtattccagntgacttgatttgaaggagggtag

SEQ ID NO: 6464 - DNA, 819 bp, Zea mays
  Predicted polypeptide sequence is orthologous to G2655
ccgtcaccggccgggaggcgatcccatgggagagacgacctaacttttctcggattctagctcgggtctgcactctgcacgctgctgctgctggtttcttgagaggcgagaccctgaagggatggcactggaggccgtggtgctttcccagcaaggcagtcgctttgggtgtggtgccatggcagcaggagggccttggagtggcctgttttttagtggaatggagggcgtggtcgagatcggtagtggcgctggcggcggccgggacgtggccgggtgctcgccgccacagctcctgcaggagccggctgcccgcgcgctgcctgtggcgtcgtccgtggggagcgcgagtggcggcgccggtcaggatgccccggcggcacttgctgtgaccgcgacagcggcggccggaaccggaagaaggaagcggcgaaggatgaggccactgaagaacgaggaggaagtggagagccagcgcatggtccacattgccgtggagcgcaaccggcgcaagcagatgaacgagtacctcgccgcgctccgctccctcatgccgcccgcctacacgcaacggggcgatcaggcgtccatcgtcggcggcgcgatcaacttcgtcaaggagctggagcagctgctccagtcgctggaggcgcagcagaggcgttcctcccggcggcagggccccgcgtgcgccgtcgatccggacgacgcagggccgttcgcggacttcttcaccttcccgcagtactcaatgtgcgctgccgcggcggccccatcagagaaccccgggcgcgacgccgacgccgagcaggaggcgtc

SEQ ID NO: 6465 - DNA, 579 bp, Zea mays
  Predicted polypeptide sequence is orthologous to G2655
aaaacagtactactaaaacatgtttaattgcaaaaaactgagctgggccaaccgaaacatgtttaattgcacccaaacgacgtatggagcgcggggaaaccccgcgggacaggggcgccaattgcgacttgccagtgcgttttccaaaattaagatcgaattggggggggtgcaacaacaaaacatgacccctgctaaaacaaacttgcccctaccccacccggctaaaaggggacggctggcgcgcccctcggaaatcttgccgaatatgtccttcaccgcggcggcgatgtcctcaaccgacaacagccggcactggtcctccatcttgaggctgaaaaaaaacaaaaccagctgggcgggggggggggtcacgttgagggggagcacggggaggccgaggcactgcaaccccaccaccatcctcagcaggtgcctgggccgccgcggcgggaccaccttcacgctcgcgtggctctccgccacggccacctcgatgtcggccacccccccccccgcccccgccgcgcaggcgccgccgccggaaccagcaccctcaccaaagccagcgaccacacc

SEQ ID NO: 6466 - DNA, 879 bp, Zea mays
  Predicted polypeptide sequence is orthologous to G2655
cacggccatcgtggcgagggcaaccaagctgagcgctactcgcagtcgcagttgttgcctgcccagcatgcagctctaactcaccccgtgcagcagacgccgagtcgtggcaggtagctaggaaggagggcaggagggaagggcaggccatggcgctggaagcggtggtgttcccgaaggagcacctagcgggcactgccaaggcgcgctcggcgtcgtcactggcctgcggcttccgcaccgaggaggtcgaggacaacggcggtgtggttctgcaaggagaggccagcgatgcgcccggtgccggcgcggccaccacgtgggagtgctgggacgcggcgctctgcccgtgctccactccacctgctggtgccgtggaggagtgctgggacgacgtgcggcaccggctctccgcgtcccctccgctgccgccggcgccctccgccgccgtcgcagcgccatcgtccgggcacggcaaggcagctgccgcggcgcggcggagacggcggcaacgcccgaaggcggtgaagaacacggaggaggtggagagccagcggcgcaaccacattgccgtggagcgcaaccggcggcggcagatgaacgagtacctctccgtgctccgctccgccttgccgccctcctacccgcagcgggtacgtacgcacgcacacgatctcctccatggctgccgctccccggcagtatcctagccgcaagagctttgcaggtcatgtcaccaatgccatgcatgtgcacgaacggcttggcattccaccgtgctgctgattgccgctgccggccccgcccagcttttactgtaacggatgtcaaatcttgctgcccccctccctctggcccctggccatccgctggagctgc

SEQ ID NO: 6467 - DNA, 868 bp, Zea mays
  Predicted polypeptide sequence is orthologous to G2655
cggtcaccgtggcgagggcagccccgccgagcgttagtcacagttgttgcctgcctaccatgcggctctaactcgatccgtgcagcagacgccgagtcgcggcaaggagtagctaggaactaggaaggaggaggcagggaaaggccaggccatggcgctcgaagctgtggtgttcccgaaggagcacccggggtgtacggcggtcaaggcgcgcccggcgtcgctgggctgcggcttccacaccgaggagctcgaggtcgaggacaagggcggcgtggttctgcaaggagaggccgccgacgcgctgccgccgcccggtggtgccgccaccacgtgggactgggacgcggtgctctgcccgtgctccactgcaccagctgcaggcgccgtggaggagtgctgggacgtgcagcagcagcagcatcagctcctgtccgtgtccccgccgccctcgtccgccgtcgcagcgtcgtcgtctgggcgccgcaaggctgccgcgtcggaggcggcgcggcgacggcggcgacgccccaaggcggtgaggaacacggacgagatggagagccagcgccgcaaccacattgccgtggagcgcaaccggcggcggcagatgaacgagtacctctccgtgctccgctccgccatgccgccttcctacacgcagcggggtgaccaggcgtcgatcgtggctggtgccatcaacttcgtcaaggagctggagcagctgctgcagtcgctggaggcgcagaagcggtgcaccgagccaccggcgccggcgccgttcgccggcttcttcatcttccctcagtactccaccaccgccgcgacgggtggtggcggttggctctagtagcgacagcgctggctc

SEQ ID NO: 6468 - DNA, 704 bp, Zea mays
  Predicted polypeptide sequence is orthologous to G2655
ttttttttttttttttctgtcaataatctacacaagtgctctcactccagaagggaggtggtgcttagattacagcctaagatttctcatagcatattctttgcgaccacggccggattgggacagtattgctgcatcatggcaggctcaggtgtctgtgcctagcaagggggcgcaatcacagtcatcacatgcacaggcaatggattccattggcaggatggcagtgtgcctgccggacatgcaggtggtgcagagtttcacatggcggcggtctcctcctcctcctcctcctgctgctgccgctgtatgctgccgagaatctcgtgcacggcggtggcaatgtcctcgacagagcccatcttggagtcatcctccaccttgaggctgaaggtgtagaggaccatggcgtcgacggcggcggtgacgttgaggtggagcggcgggacgcgcagctggtgcagcccggcgacgagcttcaggagctgcttgggccggcggcgcgccagcaccttgaggctggcgtggccttccaccatcgtcacctcgatgtccgcggccgcgacgtcgtggccgcggcatttctctccgccgctgctgctcgtggtgcttgaggcggtggagtactgcgggaagctgaagaagccggcgaacgggggggagcagctggcgccgcctgctgctggccgccgctcccggctctg

SEQ ID NO: 6469 - DNA, 502 bp, Zea mays
  Predicted polypeptide sequence is orthologous to G2655
ttttttttttttttttttttttttggtagtagtacgtaagactggtccaatcggtacatggtttacttgcacgcaaacatatggagatggtagtggtaccgcctgcctgacagtggcgcgagcgagctgccacgctagcttgccagtgttatccgtgtactaggatcaaatcgacgtacgtcacaacaatacatggcactcgctaacatattaggctaagcggctaatcatcagtggcctggccccccgcgggcgcactcgtcggaaatatcggcgagtatctcgttcaccgcggcggcgatgtcgtcgaccgacggcgacagccggcactcgtcctccatcttgaggctgaaggagtacaaggccaggtggtcggcggtggtggtcacgttgaggtggagcacggtgaggccgaagcactgcagcgccaccaccatcctcagcagctgccgcggccgccgcgccgcgagcaccttcacgttggcgtggctctccaccaggg

SEQ ID NO: 6470 - DNA, 958 bp, Zea mays
  Predicted polypeptide sequence is orthologous to G2661
caaagccaacagaactgcacagtgtagtagttgcacataggcgtccgcgcgtcgtcctagctatggatccatatcactaccaaaccatgtatgacccacgcggcttccccatcatccacccgcagccttacctccagcacccggtggccggcgccctcggtgacagcagggtgcgcggcggcggcagtggcgcgcggcggcgtcctggcgccaagctctccacggacccgcagagcgttgcggcgcgcgagcggcggcaccgcatcagcgaccgcttccgcgtgctccgcagcctcgtccccggcggcagcaagatggacactgtgtccatgctcgagcaggccatccactacgtcaagttcctcaagacgcagatcagcctgcatcaggccgcgctgatgcagcacgaggaaggatgccatgctgagctcgccgcctattccgcggtggcggtggttggtgacaacgaggtgacactcgcgtcccatggtcgtaccggcgcatgcgacgagatgatgcagctccaggtggcggcggaggaagctttgagttatggtgttgatgcccatcagccgtacgggctcgatcccaggcagctgagtggtgggcacgagctgccaccgctgcctgcttcttgcatcttcctcgaggagcctgcagacgcatgctactctgtgtgtgacctcgacgacggggacaccggtctgcccggctcttactagagtagtagtagaagtttcttaaggtagcatcccgtgtgtgttggtgtctgctagacgctagtacgtctaattagcaaagtttagctagtactcgatcaattgtctgtctagttcgctcagagttaaagtatatgatgatgcatctgcatatatgggctctgtaattctgttatccgctgatcgcagatgatacaccgtatgtaatcacatgtatgtatgttgcctaaaaaaaaaaa

SEQ ID NO: 6471 - DNA, 760 bp, Zea mays
  Predicted polypeptide sequence is orthologous to G268
aaaacggtctcttcgtatttcccccacttttgtagggtttccatgacaatgtttcaacaaaagaaattggcacatgtcagaaactacacagatcatcattttacaaatggatgatcaatcaaatagttacaaattagtccttgacctaccctatctacagcacaaatgtcagtcccgacagcagctcttttcagttgcaaaagtacctaaaattacccctgcttgtcttcacctgatcgcctaacgcgccataggcttgtcgcacatcaaaaccttcctactggcgtacgcgccttcggcagtgtcacgtatagtaccacgccaccccatggcattcgttatttctttgatctcctgtataacttctttccggtcacgaatatatgctttaccacctggtctgagtatccggtccatctccagcaagatgctagagatattacacctgttctgctcctttgagaaaagaccagatgcatgaagtagatcgtacgtcctagggtatgtatcaaagggttcacaccagtcatgagctactccaagaagcccccgatcaaaaattacaggtagtgtatttggctcactaataggaacaacattcatcacccaccaatccagtttctggcggatcaaagcagctgcaaaccctccaaatccagccctcatgtccattacattccggactttgaacttcctccacttaaagatacggatataaccgtcaattatgtcgtcccaaaattttgtttctgctttgaaa

SEQ ID NO: 6472 - DNA, 858 bp, Zea mays
  Predicted polypeptide sequence is orthologous to G268
tccccttccgatcccatcccttccgcatcgtccccgaacgacgcagacggacgcaaggcacggcgccgacatctccccgtggcccgagggcccagacatgaaggccctgggcgcgcacgccgccgacctgctccgaggcccgcacctactccgcgccgccgtcttcgctttcgccgttgcgctcgccttcctcgttggctaccactggcccaacgcctccccgcgccttgtcttcttctcgtccgatgcctcctcgtcgtcgcccaggtcgtcctcccgctctccttccgtcgtgctctcccctaactctaacgtctccttcgacccatccctgatccctacccccagcaccccgcctgcttcttctactcccaatgcctggtccccgcccgcactaccaccgccgacatcggcgccgccgcctcccctcccccctcctccaccaccagcgcgcctcggcatcgtcggcgaggacggcgctatgcaggacgacttcgacatcggcaacgtcggcgccaacgacactgatctggccaccgacgagaccgcgccgcaggagcctagcgacgtgggcgccagcggtggaccacctagggtgcggattgagaggttcccggtctgccccgagagcatgagggagtacataccctgcctcgacaacgaggatgatatcaagcggctgccctcgacggagcgcggggagcggtttgagcggcactgccctgccaaggacaagggtctcagctgcctcgtgccggcgcccaacgggtacaaggcgcccatcccctggcctcggagcagagacgaggtctggtttagcaacgtgcctcacacaagattgattgatgacaaaggagg

SEQ ID NO: 6473 - DNA, 652 bp, Zea mays
  Predicted polypeptide sequence is orthologous to G274
gtaccaaaacaaatgtcagtttgaagatatactcctggaaatggacagaatcttacacccggagggtgcagtcataattcgtgacaaggttgatgttcttgtaaaagtggagaaaatagccaatgccatgaggtggaagacaagattggctgatcatgagggtggccctcttgtacctgagaagatactcttcgcggtcaagcaatactggaccgttgcaaaaacaagcagctaacattattcgtattttatttttttctccagtcacaggtaacttggtccctggatgtgtttattggggggaaaatctgccggtttgaaaatcatcatcccatgtttgttactgaaaatagaaaacaagcttacaatcaccctggaggatggtaagttatgcgggacctagttgtgaacttgtggtttgcttattccactgttgcagagatgcagaagacatgccaaaaggatcaattgaccttgcactagtgactcatatctgatcggacagatgcagctgcttataattggaaccctgcagcagtccagggaagttatgaactagcagtggacttacagttttgtataggatactcatttacctctacacgccccctcttttttttttggtggatccccagaatcccatcaaatggat

SEQ ID NO: 6474 - DNA, 838 bp, Zea mays
  Predicted polypeptide sequence is orthologous to G274
cagcagtgtgaacaagtatctgcttactggtagatacaggaacattatggacatgaatgcacagtacgggggattcgctgcagcaatagagtccccgaaatcttgggtgatgaatgttgtgccgaccatcgcgaagatgcccaccctgggggctgtgtatgagcgaggatgatcggcatatatcatgactggtgtgaggctttctctacttatccaaggacgtatgatcttatccacgctagcggtcttttcaccttgtataaaaacaagtgcagcatggaagatgttctcctggagatggaccgcatcttgaggcccgaaggcgccgtcataatacgggacgacgtagacgtcctgaccaaggtgaacagcctcgctctgggtatgaggtgggacacgaagatggttgatcacgaggatggccccctcgtgcgcgagaagatcttgtatgccgtgaagcaatactgggttggtggtaagcagacggctgtagcttgaagcaagcacgtttcatgaggctctaacatgaggaattctgcaaccaaaccttacccgacgaacaagaattagcttaaatgatcaacccttgtagggggtagcactgaagcagccagaatgccgtgctcgctgggtgatcactgcaaccacatcatcttctttggtcgtgtactcttttcaaaagcttgtatcttggaaaattctttacggtcctcgtatagattccggtgtaacgttttagtagactagctttatgtagcgagaatacatgttttcttttggacacctcaggtctttttttgtactcccgatgatccctgagaaaaggctcctacgggtc

SEQ ID NO: 6475 - DNA, 896 bp, Zea mays
  Predicted polypeptide sequence is orthologous to G274
tttctgtcggcggcgactgggcggccgtcgctgccgtcctacgccagctgcccaggtcttcctcgcgcccttcgccggcggcaaccaccgccagggtaagccagccatcagccatggctttgaaggcgagctccagcgacaaccggaccaggagcacggtatccctgtgcatagtgattggcatgtgctgcttcttctacatcctcggggcgtggcagaagagcgggttcggcaagggggacagcatcgcgctggaggtcaccaagcgcaccgactgcaccgtcgtgccgaaccttagcttcgacacccaccattctaaagccagtggcaactctagcagcctggtttctccgtcgaagaagttcaagccgtgccctgatctctacacggactacaccccctgccaagaccagaacagggcgatgaagttccctagggagaacatgaattacagagagcggcattgcccggcgcagaaggagaagctgcactgtttggttccacccccaaaaggctatgtggctccgttcccgtggccgaagagccgggactatgtccctttcgcgaattgcccatataagagcttgacagtcgagaaagccatccagaactgggtccaatatgagggtaatgtattcagattccctggtggagggacgcaattcccgcagggagcagacaagtatattgatcagcttgcatcagtcgttccgatcgccaatggaactgtcaggactgcacttgacactgggtgcggggtggctagctggggagcttatttgttgaagaggaatgtcttggccatgtcgtttgccccgagagattcacacgaggcacaagtgcagtttgctctggagagaggtgtccctgctgttattgccgtcttggtacaataa

SEQ ID NO: 6476 - DNA, 650 bp, Zea mays
  Predicted polypeptide sequence is orthologous to G274
gctggtctcggtagctttgctgctgcactagaatctccaaaagtatgggtcatgaatgtcattccaacaattgcaaatacttccactttaggtgtaatctacgagcgtggattaataggaatgtatcatgactggtgtgaaggattttctacttatccaaggacatatgacctcatacattctaatgatatcttcagcttgtaccaaaacaagtgccaatttgaagatatactcctggaaatggacagaatcttacgcccagagggtgcaatcataattcgtgacaaggttgatgttcttgtaaaagtggagaagatagccaatgccatgaggtggaagacaagattggctgatcatgagggtggccctcatgtacctgagaagatactcttcgcggtcaagcaatactggactgctgaaaaaacaagcagctaacgttgttcattttcatttttttctccagtcacagctaacttgccccctggctgtgtttattggaaaaatttctgtcgattatacagccccatgtttgttactgaaaatataaaacaacccccttgagggggagtaaattatgtgggatttagctgtgaacttgggatttgattattccactggtgccgagacccagaagacatgccaaaaggatc

SEQ ID NO: 6477 - DNA, 732 bp, Zea mays
  Predicted polypeptide sequence is orthologous to G274
gccttggcaaatcgccaacagttcacttaacgctctgattactatatatgcacagcaaaaatccaggtatgtcccgatcatctaagggtctttagtactgtacgtatgcagtatgaacaaaatctattaaccgacaaaacagcatcaggggatcgcatcagggaaagaggctggcatccagcatcaacatggttctgtacctatcagctgttctgttcctcgctgccaacccaatattctttcactgaaatcagaatcttctcgggaacgtgcgggccatcctcatgatctagtaacttggacttccaccgcattcctgccaccatacttctaaccttgttcagtacatcggcattgtcccgcagtatgactgcaccctctggccgtaaaatcctatccatctccagaagaatgtcttctgcatcacacttgttctgatataaactgaagatgtcattgccatgtatcaggtcgtatgtcctagggtatgttgagaaggcttcgcaccaatcatggtatataccaatcagacctcgctcatatatgataccaagagtgttcctttctgatatagagggcacaacgttcattacccaggaactggaagaatgaagagttgcagcaaaacttccaaggcctgcattcatgtccataatattcctgtaccttgaagaacctatcagcttgttcaccctcttataagtattaacatgcttcttccacaacttatta

SEQ ID NO: 6478 - DNA, 2643 bp, Zea mays
  Predicted polypeptide sequence is orthologous to G2754
ggccgcgggaattcgattgtcacagaacagttggctgctcacaatggggacactttcaatgtccgacgccagccctatccctgccaagaactgggatgcttcccctgtcaagctcgaggctcaaggtggtgacgccatcctcggcatgaaggaggaagagcgactactggagctcgtgaaggatgagcaggctgatggaatcttggattcattaccaattgacctggaggccaagaatggcgatgcatcactcataactgaagccatgaaaaaggaggaggagcagcttgaagacacccggatcaaggtgcaggaagaagaggaagccaggaagagggaagaggctgctagacttgcttttgatcctgagacacagtataacaagttagatgagctgctgacaaagacacaactcttttcggagtttctacttgagaacatggatcggattgccgatgaaagtgttgaaactcaagctgaacagccacaggtagaagagaagaagaaagggcgcggccggaagaggaaagcaaagccacagtacaatgataagaaggctaagacggcagtggctgccatgctcacaagatctcgcgaagaacgtcttgcggaagattctactctctcagaagaagaaaggtgggaaaaggagcaggctaatcttgtgccgttattgactggtggaaagttgaagtcatatcagataaagggtgtcaagtggcttatatcattgtggcagaatgggctgaatggaatactggctgatcaaatgggccttgggaaaaccatccagacaattggatttcttgctcatctgaaagggaaaggcatgcatggtccatacttaataatcgctcctctgtccactctctcaaactgggtgaatgaaatctcaaggtttactccatctctggttagtatcatataccatggaggtaaggctgcccgggcagagatccgaaggaaatttatgcccacaaatgttggccctgattttccgatagtagtgacttcatatgagatggccatgtttgatgctaaatttcttgctgcctataagtggaagtatgttgttgtggatgaggggcatcgtctgaaaaatgctaagtgtctattattgaagcagctgaagcgcataccaatggataataagctccttttgactggaacacccttgcagaataatcttgcagagctctggtcactattgaacttcattttgcctgatatattctcgtcacatcaagagtttgagtcatggtttgatttttctggtggaaatgaagaaactgatgagaagaaaaggctgcatgttgtttcaaagcttcacgctatcttgcgtccattccttctaaggcgtatgaaggaggatgtggaacagatgcttccacgaaagaaagagataatcatatatgccaacatgactgagcaacagaagcaaatccagcatcacctgatcgaaaaaacatttgacaactacttgcacgaggaatcagatattatattgaaaagacctggcattagggcaaggttgcataatctaatgattcagctgaggaagaattgcaaccatcctgatcttttggaatctccagttgattcaactggtttatatccacctgttgagaagctcctggaacagtgtggtaaattccaactttttgacaggttgctaaatttcctgatggcgcaaaagcacaaggttcttgtattctcgcagtggacaaaggtgctggacattattgaatattaccttgattcaaaaggccatgctgtttgccgaatcgatggtaatgtgaaactggaagaaaggaggaggcagatagcagaattcaatgacgtgaatagcagcatgcgtatcttcctcctgagcacaagggctggtgggcttggcatcaaccttactgctgctgacacctgtatcctctacgacagcgactggaaccctcagatggatttgcaggccatggaccgatgccaccggatcggccaaacacgcccagtgcatgtgtataggctggctacgtcacactccgttgaggggcggatgatcaagagagcctttgggaagctgaagctggagcacgtggtgatcggcaagggacagttcgagcaagacagagctaagccgagcgccttagatgaaggtgagctgctggcgcttctcaaggacgagcagaccgaggaggacaggatcgtccagaccgacatcagcaacgaggacctccagaggctgatggaccggagcgacctgatgggcccgccgcctggcgctggcggcgcaaacgcggcctcgcctcttgtaccgctgaaagggccgggctgggaggtggtggtgccggccaagagtggcggcggcatgctgtcgtcgctcaccagctgagccgtcgtggctgcggggatctgttgtgcttttggttggtcgcacgcactcagttttggtttgcccccccactggtgctggtggttttggtggcagccgttgcgctgctcaggcgatggctgttgaactggggcgttgcccctgcagaagtagcttttagtttaggatcagcaacaaaacaagcaggactctaggccatgtgtggtcgactcttcgtacggaggccgttgcgttagattacgtgggtgggttatggggcg

SEQ ID NO: 6479 - DNA, 688 bp, Zea mays
  misc_feature (284)..(288): n is a, c, g, or t
  misc_feature (367)..(371): n is a, c, g, or t
  misc_feature (393)..(413): n is a, c, g, or t
  Predicted polypeptide sequence is orthologous to G2754
cgggaaggaaccggcttttgtcacggcacgggcgtttgcaacatcacaagacagccgaacaagagagcgtcagcacccatgtagacggaggaccgcattgtatcacggacgacgcgatactaactttacaaagcaaccggcgtgtgtccatgctgccgtcgggtctggttcaaccaaccgtcccatcacccacccacgtaatctaacgcaacgaccaccgtacggagactcgaccacacatggcctagagtcctcctgcttgttttgttgctgatcctaaactnnnnngctacttctgcaggggcaacgccccagttcaacagccatcgcctgagcagcgcaacagctgccaccaaaaccaccagtnnnnnccaaaccaaaactgagtgcgtnnnnnnnnnnnnnnnnnnnnnccccgcagcaacgacggctcagctggtgagcgacgacagcatgccgccgccactcttggccggcaccaccacctcccagcccggacctttcagcggtacaagaggcggacgggcgttagcgtcgccaggcggcgggcccatgaggtcgctccggtccatcagcctctggaggtcctcgtcgctgatgtcggtctggacgatcctgtcctcctcggtctgctcggccttgagaagcgccagcagctcaccttcatctaaggcgctcgggttagcct

SEQ ID NO: 6480 - DNA, 966 bp, Zea mays
  Predicted polypeptide sequence is orthologous to G2754
acccacgcgtccgatgtctttattctgaagcacacgggctggcggacttggtatcaaccttacttatgctgatacatgtatcctttatgacagtgactggaatcctcagatggatcagcaggccatggatcgatgccaccggattggtcaaacacgcccagtgcatgtatataggctggctacctcatattctgttgaggagcggatcatcaagaaagcttttgggaagttaaagctagagcatgtggtgataggcaagggacagtttgaacaagaaagagcaaagcctaacgctttagaggagggggagctgctggcgctgcttagggacgagcaggacgaggaagatcggatgatccagaccgacatcagcgacgaagacctcttgaagctgatggaccggagcgacctgtccggaccacctggtgctgccgatgccgctccactgatcccgctgaaaggccctggctgggaggtcgtggtcccaaccaagagcggtggcggtatgctctcgtcgctcaccagctgagcgatgccggcaccatgtttggggtgcccattttgctagtcactcatcatgtggacgatggggcgcttgttggccggtcgccgatcaggcggatattttgcatgtatgcccccctacaaactgttgatctgggtgttgagcctgcaacagtagggttaggttatttcctcccgtgtccgtgccagtgacacgcaagtcggattgagttatgctgtgaacttctgatgagtcgctgcaagctgcctttctgacttgagctttttgctgcttctgttgctgcgttctatgatgtagtaacagtagctgatggtttacaccaaagcggagatggatgccctctatgatgtagtccttgctatataacttgaacactgatgtgattttctgtagtgtcaactgccaaaaaaaaaaaaaaaaaaaaaaaaaaaaaaaaaaaa

SEQ ID NO: 6481 - DNA, 401 bp, Zea mays
  Predicted polypeptide sequence is orthologous to G2766
cctcacacagggctcaaatagtattaaaaagggaaataatagacgattacatcatgatgtccaagacatccacatagtctttacagtagatcaaagtgcgaaaacgaaacgtagataaacgcggccttcacaggcagccgactgggggttgccgctaacccacgcctagaactcgtcgtaatcttggaactcctggaagtctccttccacagcttcatcttctcctgagcagtggttgcaatgcggacaacctccaccaaacaaatgctcagggtcttcaactttgtggaactcgaagagtttgatctcttggtcaccgaagcttgactgtcgatccctcgaagctcgggaacgaatcgcaatctaaaaccgccatgtgcagggacatctgcttctgcgtc

SEQ ID NO: 6482 - DNA, 868 bp, Zea mays
  misc_feature (811)..(811): n is a, c, g, or t
  Predicted polypeptide sequence is orthologous to G2766
gaattcattgtgttgggccggccgacatcggggagagcatcgtgggcgccggcgggtgcaacagctccagcgacgccgcgcagtcctcctcctacctctccaggaccttctccgtcggctcctgggacgacaccaactccatcatgttctcgtccgcccccagcaagaagcccaaggtggaccccgccgacgacatggtcgccagcttcagcaccattgacccgcagttcggcctttccaactcgtccctggagctgcccggcatggacgactacctgcagctgcagcaggactccgtcgcctgcagagtgcgtgcgaagcgtggctgcgcgactcacccgcggagcattgccgagagggaaagaaggacgaggatcagcaagaggctgaagaagctgcaagacctcgtgcccaacatggacaagcaaacgaatacgtcggacatgttggaccttgctgtggattacatcaaagagctcaaggaccaagtcgagaagctaaaacacgaccaagcaaactgttgttgcctaggcaacaagagctgctgctgatgctggagaagcagacggaggagggtttttacgccgtaacaatgtaacatgtggagcggcttccatgactcagcttcctcttttcttggttgttccacggactagcgaccctgccggtgccaacggcttgaagactaggagataacaagtaggacgatgttgtaatttagctaccacgacgcggtggctctggcttgcgtgtaaagaagtcctccctttcaacgcgactgggattgttgttgctggtaaaattgttgtangaatatcatctgcgctccatttttcatcgagctcaaaaaaaaaaaaaaaaaatgcgt

SEQ ID NO: 6483 - DNA, 753 bp, Zea mays
  Predicted polypeptide sequence is orthologous to G2766
ctacaacacgcctccccagtcaacacagctcagctcagctcggctagcgagctcctcgctcggctctactagctagtgtgttgggacttgggagctaggcggggttgattgcgattgggggaggcgggagtaggtgatgtacggcgcgccgttgcccaaggacctgaacctgccagcagccctgccgcagccgaccaggacgccaccgcagcagcagatgggctccccgggactgctgcggtacaggtcagcgccgagcacgctgctcggcgaggtgatgtgtggtggtgatcaggacttccccgcggctggcggcgcagggcacggaccaccggaccacgccgccgcggacaacgtcctcgcgcgctttctcgccgggcaccactccgagacccgcgactgcaagcctccccgccccgccgccgccgctcacttcatggacgaagctgccgtcgcgtccatggccgcctcacagcagcagcagctcatgtaccagtcgcagcaggagcagcagatggccgccatggaggggctgtaccgcaacgtcagctccggcggcacggagcacggtgcagccgttggcgctggtaacaacagcctgatccgccagagcagctcccccgccggcttcctcaaccacttgaacatggacaacgggtacgggagcatgctccgggtgggcatgggcggcggcgggttcaggaacggcgtcagcgacgcgcggctcagggggcaactgagcttctcgtcccg

SEQ ID NO: 6484 - DNA, 755 bp, Zea mays
  Predicted polypeptide sequence is orthologous to G2789
gtgaaattagagtaaaaggaaatttagcagcagactgacatgcagttccaagcacactgcgagctactagggggaagggaaattaaattacactgctacggtacgagccgggggtgtctatgactaattaagcatcgatccatgacatgagaattcgtcgatacacgccacagcagcaagtagaaggggaagaagaagaaggcaagcgaaaggggaaggaggagggattgagtcttagcagcagctgcatcgttacttgtcgtcgtcgatccgccgatggcgatgaagcagcaagcgttggttccccttccatgtccggatcgaccgagtccggtacggcgacggattcgatcgatcagtacggggcgacgcggccggcgccgcctcctgggttggcccagccgtaggcgtcagcggggagagggaggccgttgatgaggccgtgggggagctggtcggcgagcgggtgttgtccgggcaatggcagcggcgggggcggcggggacgaggactgcccgccggcgccggcagctccgggcatgccctgcggaataggaggaggagggggcaggtgctgctgctgctgcggcaggtcgtcgtcgtcgagcgggaggcgctcgtaggcggcgttgccgaagcaggcggcgacgatgacgacggggccggacgcgaggagcggcccggccacggacccgcccaccacctggccctgcccgccggagaggtagacggtgaggcccgtggcggcgggcggc

SEQ ID NO: 6485 - DNA, 856 bp, Zea mays
  Predicted polypeptide sequence is orthologous to G2790
acaaagcacaacacaacaattgtgtatatatagaataatgagaaaaggcaacctcaacatacgatgcggacgagaaaagagcaattgatgatagactgatacccaccaccagtaccacagtccacgctccttttcttttctttttttccctcctttgtattgcacaaatcagtgagcgtgcagtcgataaagacacactttcgggaccttctttgatcatggaggccacaaggcaagagctagggttctaggaaaagttggaaccccttttataccagtcaaaaaacaacagacactattttacaactaaccccaaacaagaaccaatttttttccaagaaaacaaatgtcttcatctcctttaatatgcaccactactgtgtgatccacgaaatcaccatgcagttcgtttgactttaattcgtatcaacttctactactttttatctagagtgaattgtagctacagtagtccgaacaactagacccgtgtaacaaaaaagcaagggacgtcacgaaattacatggaaatagaagtatgaaaggctggagatcgaagctcaagattgactagttcacgtgttttgagcgtacgatctctcttcacgcttacgcaatttgcgcctcggatcatgcgcaccttttttttctagagaaaaaaaaatactcttcaacaacaacaaaacaaaaaccgagatgatactcttttcacaggacgtagtgctactgctgcacgactcctccgatctaccctccaagggcttgttcggttattttcaatccatatggattggaggggattgatatggattgagagagattttgacttgctagggattaaaccccttcaatcccc

SEQ ID NO: 6486 - DNA, 864 bp, Zea mays
  Predicted polypeptide sequence is orthologous to G2791
ccctcaaaagatccttcacgratcaatgataataaaagtgaggtcctgttagccatcctctkatgtacaaaactcamccaaattcagctgttaatggtgttggtgtgaaaccacgagtaagggctcgtcgtggacaagcaactgatcctcatagtattgctgamcgcktcgcagagagaaaatttcagataggatgaaaaatctgcaggatcttgtcccaaattccaataaggcagacaaggcatccatgctggatgaaattattgattatgtgaagtttcttcagcttcaggtcaaggtcttgagcatgagtagggtaggagctccaggagcagttcttccccttctcacagaatctaagactgagggttaccacggccaacctctgccacaaggattactggacgcactagactcggaagacagcttcgtcttcgaggaagaggtcgtgaagctaatggagaccagcatcaccagcgcaatgcagtaccttcagagcaaggggctctgcctgatgccagtcgcccttgttccgccatatccacccagaaaggtgtgtccgctgctgcagtcccacctgaacggtgagataaagacacgctcctcccccatgagcacgaggaaacagccgcagatgacagaactcagacggctgaagaatgcagcaatgcaaagcccgtagagtacagcataggaagttaaggcctgtttggtttgatgcctaacttgccacactttgcctaacttttctgcctaagtttagttcttcaattcaaacgactaaccttaggcaaagtgtgacacatttagccasgaaccaaacagcytyttagtctgtgaccagagcgcatgacctcgtctact

SEQ ID NO: 6487 - DNA, 1382 bp, Zea mays
  Predicted polypeptide sequence is orthologous to G2791
ccacgcgtccggctttgtgttccacattccaaaatgcttcttcattcatggaaccagtaaatctagaagctttcagttttcaaggggcacaaagtgattctgttttgaacaaaacaacacatccaaatgggaatatctcagtatttgacagtgctgccttggcatcactacatgatagcaaagagtttatcagtggtaggctcccctcatttgctagtgtccaggaaacaaacgtagctgctagtggtttcaagactcagaagcaggagcaaaatgcagtgtgcaacgttcctatccctacgttcactgcacgtaatcaaattgcagttgctgcaatgcccggatcactgatccctcaaaagattccttcatggatcaatgaaaacaaaagtgagggtcctgttagccatccttctgatgtacaaatccaaccaaattctgttggaaatggtgttggtgtgaagccacgagtaagggctcgtcgtggacaggcaactgatcctcatagcattgctgaacgacttcgcagagaaaaaatttcagataggatgaaaaatctacaagatcttgtcccgaattctaataaggcagacaaggcatccatgctggatgaaatcattgatcatgtgaaatttcttcagcttcaggtcaaggtgttaagcatgagtaggctaggagctccaggagcagttcttccccttctcgcagaatctcagactgagggttaccgcggtcaacttctgtcagctccaaccaacgcacaaggattactggacacggaagaatcggaagacaccttcgccttcgaggaagaggttgtgaagctaatggaaaccagcatcacaagcgcaatgcagtaccttcagaacaagggactctgcctgatgccagttgcccttgcttccgccatatccacccagaagggcgtctccgccgcgtcaatccctcccgaacagtgaaataaagacatgctgctgctcccatgagtacgaggaaacaactgcagaagacagaaaactcaagatggctgaagaatgcagcaaagcccgtatagagtacagggtaggaagttagtctgaccagtgttcatgacctcatctactaatttgcttttcagaatcagctttttggtatctattgcgcataagttggtttttccttttcccttgctctctctctctctctctccctggggccgtatccgggtgctccgtggatagttgcgtttcagaaacttgaactgtatctggatgatctatctggtttctcttttgtgcatagaaaaaactgtaaaatcttctggttcaaaaaaaaaaaaataaaaaatatcctcgagcgggctctcctcccccccaatccccaattccccattgtcttcgtcc

SEQ ID NO: 6488 - DNA, 819 bp, Zea mays
  Predicted polypeptide sequence is orthologous to G2791
caataatacatagtgaaatagacaatttgataagatttaattgttgccagaacttttagcccaattcatttcatttttcacttggacatgttgatctttcacacgcaacctctcaagacaagatcattgccttcaccgcttaccgccggcaccggcatccttgacggtgctggaatcatcaccacaattcaccagtggcggcgacgcagggctgccgccgtcgtgcaggggacctctagcgtctcccattgcgcccatggaggggcgggataggagggacggccacgtggcggaggagatggcggaggcgagagagatgggcatcaggcagagccccttgccctgcaggtactgcatggcggtgcccatgtcctcctccatcaacctggccacctgctgctccgtcacctgcaggctgccaccaccgccgttctcgccgttggcggcgttcccttttccgctgtcgctcgtgccatctccactcccgttgccctctgatgcgatgccggcaactagagtgccgacggctgtcgctccgcctagccggctcatgctgagaaccttgacttggagctggaggaacttcacgtagtcaatgatctcgtcaagcatcgatgccttgtcggtcttgttggcgttagggaccagctcctgcaacgccttcatcctctccgctatcctctccctccgtagacgttcggcgatgctgtgagggtcagtggcttgccccctcttggctcgctgccgctgctgccgcgggggggcacctccgcccgacgccgcttcgggggccggcgccggcccgccacccccgaagct

SEQ ID NO: 6489 - DNA, 911 bp, Zea mays
  Predicted polypeptide sequence is orthologous to G2791
ccttcgagccaccaacccgggatgcagcccactacgcgggaaatgcaggccatggccgccgccggccagcagatctccctcgacgacctccgcgcggcagcaggcggcgtgcacgacgacttcctggaccagatgctcggaggcctgccgccgtcggcatggccggagctgtcgtccgcggcgggagggaaggcgccggatggcggcgcgcaggcggagcagatgcagcaccagccgcagcacttgggtgggggtgggggcctgtacgacgactccgccttgctggcgtcgcggctccggcagcaccaaatcagcggcggcggcggcggggaggccgtgaagcagatggtgctgcagcagctggccgatctgaggcaggaacaccatgtgttgctgcagggcatgggccgctcgacctcgacgggcggcagcagagacggcggcctgctcctcccgctctctctcggcagtggcggatcgggcggcgacgtgcaggcgctactcaaagctgtagccgactccgccggaggagaagccgcaggcgtcttcggcggttccttcgccggatcgctccaccaccaccagcagcagcagcagcattttcaatcacatccgcagcagcaaacggcgccgttgccggggcagggcttcggtggaggcgcgggcgcgtccggcggcgtgtcgcagccgcaggccggcgctgcgtgcggaggcgccgccgcgccgcccaggcagcgggtacgggctcggcgcggccaggccaccgacccccacagcatcgcggagcggctccggagagagaggatcgcggagaggatgaaggcgcttcaggagctggtgcccaacgccaacaagacggacaaagcgtcgatgctggacgagatcgtcgactacgttcagttccttcagct

SEQ ID NO: 6490 - DNA, 728 bp, Zea mays
  Predicted polypeptide sequence is orthologous to G2791
gcgaatcgataatacatgggattaatattaaacaaggaaaaaaaaacaatggttacactgggaataaaatgcgaaaagggggaaggtcggagggccagctgcagtgccgagagcccgtgggtgggcccgccaaagagcccactttgtcagctccgagtgtcatgtcatggttgcgccgttagtgtcacggcggccgttgccttcacgttcacgagcggatcacggcttccacacggacgcggcgtccttgggatgatgccgctgctgctgctgcgagtgcgaaccctcgccatcagtcccacccccggcgccgttgggcgccatggccgactgcgccgtgagcacggacatgctgggtgaggccggcacggcgtcggctccggctccggcgccgccgttcatggcgtggggcggcaaccgcataacggccatgtggtgcgcggcggcggcggcgaccccgaggcccggtcctcccaccggaggtcgcatgtggcacgtcgcggaggatatggcggaggcgagggagaccggcatgaggcacaggcccttcccttgcaggtactgcatggcggtgcccatgtcctcctccatcagcttcgccacctgctgctccgtcaccgccagcccatcatcgctcccggccgcgaccgccacgccgcctcgaccctccgaggacatgtcggccaccagcggggcgacggcagcggcaccacctagcccgctcatgc

SEQ ID NO: 6491 - DNA, 1112 bp, Zea mays
  misc_feature (303)..(308): n is a, c, g, or t
  misc_feature (387)..(442): n is a, c, g, or t
  misc_feature (451)..(480): n is a, c, g, or t
  misc_feature (489)..(520): n is a, c, g, or t
  misc_feature (568)..(598): n is a, c, g, or t
  misc_feature (610)..(655): n is a, c, g, or t
  misc_feature (663)..(700): n is a, c, g, or t
  misc_feature (874)..(900): n is a, c, g, or t
  misc_feature (943)..(963): n is a, c, g, or t
  Predicted polypeptide sequence is orthologous to G280
ggagcgaggctcctcctcgtttcctatctatcctgatccaaatccgccctactcgcttcatatatcctggcacgagggaaaacaattcattccgcgccgcatctgggaaggtctcgtcttgctcgcctccgtccgtcgccgcaccctgcgtcgtcgccatggccaccgacgaagccaccaagccgtccccgatcccaccctatcccgagatgatcctggcggcgatcgagggtctagacgacaagagcgggtcgaacaagtccgccatctccaagtacatcgagggcaagtacggctcgctgnnnnnngcgcacgcatcgctgctgaccgcgcacctggcgcgcatgaaggagtccggagagctcgtcttcctcaagaacaactacnnnnnnnnnnnnnnnnnnnnnnnnnnnnnnnnnnnnnnnnnnnnnnnnnnnnnnnnggcgcgggnnnnnnnnnnnnnnnnnnnnnnnnnnnnnncgccgtcgnnnnnnnnnnnnnnnnnnnnnnnnnnnnnnnnggccaagagcccgctggaagccgccgtgaagcaggccaccgcggggannnnnnnnnnnnnnnnnnnnnnnnnnnnnnnggccaagaccgnnnnnnnnnnnnnnnnnnnnnnnnnnnnnnnnnnnnnnnnnnnnnncgacgggnnnnnnnnnnnnnnnnnnnnnnnnnnnnnnnnnnnnnnggtacgccccgccgtgcccagcgagacggccgcggcttgaccccgcttcttggggataatagttcgtcccgccgcgagatgggatggttagggcgtagcaattcgtcccgctgcagctgcggctgcagctgccgtgttaatgttggtaggcttggtctccatgcttcatctaannnnnnnnnnnnnnnnnnnnnnnnnnnctcaattaattaatggagtaattaggaggattcgatgtgctgnnnnnnnnnnnnnnnnnnnnncagttcagtttcaccgtgtgtctctggtgttatgtgctggatctgttgtaagctaagctagggagcttgagtgctgtgttggtcgattaattattataagctgctaatgtggatgtgtacaattaattagaggatggtgatgatgttcg

SEQ ID NO: 6492 - DNA, 524 bp, Zea mays
  Predicted polypeptide sequence is orthologous to G280
cacacacacactctctctcttcgcagacacaaccaaaagaccaaggtggaaaaatagtaaagaaacggagcgaggctcctccgcatttcttatctatcctgatccaaaccctccgagggggaaacaattcattccgcacggcatccgggaaggtctgcgtcgtcgccatggccaccgaggaagtcgccaagccgtccccgatcccgccctaccccgagatgatcctggcggcgatcgaggacttaggcgacaagagcgggtcgaacaagtcggccatctccaggtacatcgagggcaagtacgacggcgacctgccgcccgcgcacgcgtcgctgctggccgcgcacctggcgcgcatgaaggagtcgggtgagctggtcttcgtcaagaacaactacttccgcgccgacgcgcccgacgcgccgccgaagcgcgggcgcgggcggcccccgaaggcgcgggaccccggcgcgccggtgtcgccgccatcggggcgcgggcgcgggcgcccgcccaagcccaag

SEQ ID NO: 6493 - DNA, 887 bp, Zea mays
  misc_feature (14)..(14): n is a, c, g, or t
  misc_feature (807)..(807): n is a, c, g, or t
  Predicted polypeptide sequence is orthologous to G280
ccagttccgtccgnattcccggctcgaccccgcgtccggttgcacatatgactgagggtcggcatgaagctctgcctgcacaagctgtagaccaaactgggcctgtgcaaaatgaagttgaagctatgattttgcaatcccttgctactactcctttgatggagaagaggagtcgtgggcgacctagaaagaggccattggaaactgaaactgcagaaacccaagttgctgcatcggtggagaagcgagggcgtgggaggccaagaaagaagaatccatcggcagggtggtctgcaggaaccagggatactgcattaaaggggattaagagagggcctgggaggccaaggaaggccaggccttttgaaactgagtctgtgaaaactgcacttgaggtgtctagggatttgacagaagatgggcctcaaaaggatggggatcttgtgtcagggaagaaagcagatactcatggtgtggtttggtagtgtcaactgaggaggtagccattgctcccatggatgctgggtgcgcagacgccaagggttgatctgatggatgtgggcaccaagagtcactagtgctctgatggtgcgaacaagaacaaaaaagaaataatgatagtacctgaaaggctaaacagaacatgcagctaataagtgtgttcatggatataattaatagccatactgcaagtattgctatatgtttgcaccagtttgattactcgtatgtttttgagcagttccattggaaactgcgtttgatgggtttcacttttggggggtggatttaatatctaaccacatnctcttctttgtcaaggactatacattttgtattttgtgcttgactggaactagccatcataggtcatttgtttccagttc

SEQ ID NO: 6494 - DNA, 873 bp, Zea mays
  Predicted polypeptide sequence is orthologous to G280
cgtggccttaactttacggcttcaccgaccgaaaacccccatttcctcttctccaaaccccactcaccgcaacgagccgccggatccatggccggcaaagacggctccgtcccttccccgcctcctccccggctcccatcctaccctgagatgatcgtggaggcaatccgggcgctgggactcgagaacggctgcaacagactgcgatctcggactacatcaagggcagctacggctccaacctccctgcccagcacaacgccgtcctcacgggccacctcgcccgcatgaaggctaccggtgagctcgccttcctcaggaacaactatctcctccccaacgaggacgaagcctccccgctgagcaccggtgggcacaagggccccgccgccgccgaggagtctactggcgtgttggacgttggtgacgatgtgttgcttgcttcccctctcgtcatcgacgctgacgccgtcgacattgacgtgcctgctccagctcccgttgtcaccgctgatgtcgacgacattgacgtgcttgctccagctcccgttgtcagcgctgatgtcaaccctgttcataccaagcggggacgcggacggcccccgaagcccaaggaccccgttgctgagggctacggtggtaagcccgctacagctcccgtcgccgccgctgccgtgcctgtcaagcgcgggcgcggacgtccgccgaaacccaagaaccccgtcgccgaggactcagctcccactgcgtcttccgtcgtcaccactgatggcaatgccgtgcctgtgaagcgtgggcgcggacgccccccaaagctcaaggaccccatcaatgtggccactgaccaagccaccagcggcatgctcagcccca

SEQ ID NO: 6495 - DNA, 766 bp, Zea mays
  Predicted polypeptide sequence is orthologous to G2802
gggctaaaaaaggaaggaattatgaccttcttactaagtttatttcttcgtgatgcgtattagcatgaactaaccaaaggaaaatcagcatcaatttagaaaataaaagaaattaaaagggttaatgtacatgcaaacaatgccactagtttttacaattggaaaacaggtagtacgaataaaaaaactgtgataaaccgtaaactgattatagttatacttgattgaggtgctctaatacatctaacggtccacacatgatcccttcaatgtcagcacacacagtacctttcctcccatcggtctttcccccttctcttttcgttggccattttgtctcttctatcttggagagctcacactgtaaactagttttatcctcatttctttattgagggagatctacagagatatgttttttttctctgttctttccccactattgtaggtgtacattctccaagaaagcaacgctgcatattcaagcagacaaaaaccattccagtgaaagtggttgcggttagtgttccttcagcattcacatcatcgccactatttaccaggtccctgttgctactacccatgatgatcttggttgtcaggtggccagtacgggtaaggccattctgtctcttgggggtgagcaatggaagcatctccttttgtgcttgtggacgacgtgcagcccattatcagttcttccaagccggcagatctgcggtcaagcttttgttgtggctgtgactgttggtgctgttgctgaaat

SEQ ID NO: 6496 - DNA, 546 bp, Zea mays
  Predicted polypeptide sequence is orthologous to G2802
ggaggagctagctagctagctagctaggggcgggcacacacacgcgcgcgcggtgatgggcgccgagatccgccgccggtcctcatcgccctctatagtccgtccccccttcctctccctcttcgattgtcctctccttttcttctactgtcatctatttttattgcgagggggaaaaatgatttgatggtcaccgatcgatccgtccatggagggtgttggttatgtgttgatcgccatgctgttctggaaaattattcttccgtctacgaggacgacgatcgacgagaagcgtggaaaaagagagagagaaggaagacgaaaagaatagtgcgatgataacgttgttgttgttgtttgtagcggtggtggtggctggtggaagcgatatggttcggttcggttcggtgtgctcttgtcctgctgcgaatcacaaattcctgttgaatttttttacatatctttgtataaaacgaaattgaaaatatttatatgccatgacagctataatactacccaaaaaaaaaaaaaaaaaaaaaaaaaaaa

SEQ ID NO: 6497 - DNA, 690 bp, Zea mays
  Predicted polypeptide sequence is orthologous to G2826, G2838, G362
cgcctcacaagctacggcgagctactaggcgaagtagaattattcctggggccgcgcggcagctagctcctagctcgcagccggccatggcgaagccgcaggaggtccgcagcgtcgactccttctcgcagctaccgttcatccggccggcgccggcgccgagggacgccaccatccgtctgtttggccgcgagttccccagcgaccacaaccagcagcagcaggacgccgcgtccgactcccccgacgctgccaacaacggcagcacggtcacgtgcgagagcaacggcgcggccaagagcggcgccgcggccgagaggaagttcgagtgccactactgctgccgcaacttcccgacgtcgcaggcgctgggcgggcaccagaacgcgcacaagcgcgagcggcagcacgccaagcgcgcccacctccaggcctccctcgccatgcaccgctacgtgcccggacacatgtacggcctcttcaactactacccccacccccaccccatcggcggcggcgcccgctttgaccaccccgcgccgccgccgccgccgctgcagcactacccgatgtggacgactagcgccagccccgcggggccctacggcggcggcccgggctccatgtcgcagccaatcaacggtagcccggtgcccgcggggctctggagggtgccgccgcccccccgcg

SEQ ID NO: 6498 - DNA, 939 bp, Zea mays
  Predicted polypeptide sequence is orthologous to G2826, G2838, G362
ccgccacacccacatcacatccctccctcctagtcctagctacaacgaccagcgatatagtaaggtgacacttacccggcctgctccacacagtgccccaagcaaaaacctatcgctcctatacatctggcagttgtgccactcctttgagcaacacatcacaccctccctgctgcgggccggatcggagctgcagctgcccttgcttatattccctggtctctcctctccattgcttccttcagctcctcgctctcctcagtccttaccatccatcgatcgcgaaggaagggtgctgaggaggctttcccatgcaccctcgttccctactagccacacaccagctatgagacaccccggctacttccttcttggtacgtactggtggcggtactgaaaactactccgcagagatacacgagaagacgtatagttctgtacctagccaagccaagctacctccctcgctcgctccacacctgcctgcatgggcggcggcggcgaaggcagagacagcggcggcggcggcggcgcggcgagctttcgggaggcggctcgtgacttcagcaacgtcgcgtccttctccgagcttccgttcctgcagcgctccgccgccccgccccgtggaagcccccacaactccggcatccgcatcttcggcatcgacgtcccgcactccccaccggagagaaactctaataaagatgccacggccgctactactactaccgccgccgcttccgccacgcagagcagcggcggcggcggggccaccaccgacagcagcagcagcagcagccgcaagttcgagtgccactactgctgcaggaacttcccgacgtcgcaggcgctcgggggccaccagaatgcgcacaaacgcgagcggcagcacgccaagcgcgtgcagatgcagtccgcgatggccgccgccgcagccgc

SEQ ID NO: 6499 - DNA, 758 bp, Zea mays
  misc_feature (728)..(728): n is a, c, g, or t
  Predicted polypeptide sequence is orthologous to G2930
ttttttttttttttttataatgaacctagttttagattatatttgaaatttattgattcaaaatttttagcatcctttcagtaccattaaatgggtacaaaacaaagaaaacagaaaaagaaaagaaaaaacgaattctgttaacactgtagctttaggggatcgaatttaggggacgttgctggagacacataagatatagaggacagaatcttttagagtgtcttataaagtacagggaatattcctttaggggacgaaatttaggggacgctgctggagacagcctaaggcgagacaaacgcctaagcctactcctcctccgagggagtgtgtacactctcgccactcagccgagggattcgccctcccacaaagacaaatggtcaaacatgataggtgccaaaaggaacaaaagacccgtctatttcataagcaacggagacggagggagtagtttctaagcaaaaaacaaaaggcccaaagccatggaatggaaacgaaacggaggtcgacagcaagacatacctcacctaccacttttaccacccagcttgaagatcatcctggcgcctacacagtaagacgtgacgtagaattgcaacaagtatccagttccatcgtctcatatccagaatctggtggtatacttgtgcaccgtaaattcttgcgattcttacggtcatacagctagaactggagtacagtacaattgatgagctcaacanttgtcgccgagcgcttcctcaccgatctgt

SEQ ID NO: 6500 - DNA, 1245 bp, Zea mays
  Predicted polypeptide sequence is orthologous to G2982
gcacgaggcgacagcacgttcctccgcttgaataatctcgacatcaacggcgacgacgcgccgtcgtcgcaggctcctacgagcaagaagaaaaggagaggcacacgggcagtgggtcctgataaaggtaaccggggactgcgccagtttagtatgaaagtttgtgagaaagttgaaagtaaagggagaacaacatataatgaggtggcagatgaacttgttgctgagtttacagaccccaacaataatattgaggcaccagatcctgataaccctaacgcgcaacaatatgatgagaaaaatatacgacgaagagtttatgatgctttgaatgttctgatggctatggacattatatctaaagataaaaaggagatccagtggaagggcttgccgcgtactagtataagtgacattgaagaaatgaagacggagcttgtgggactgaaaggtaggattgaaaagaaaagtgcttatctacaggagctacaagaccaatatgtaggtctgcaaaacctgattcaacgaaatgaacagtcatatggttcaggaaacacgccttctggtggagtggctttgccatttatcctagttcagacccgacctcatgctaccgtggaagttgagatatcagaagatatgcagctggtgcattttgacttcaatagcaccccattcgagctgcacgacgactcatacgtcctaaaagaaatgcgattctgtggaagagaacaacatgacagcactcaagagtcgatatcaaatggaggtgagagctcaagcgtgtcaaatatttattggcaacacgtacagcatgtggaaaggccaaacaatggcacaggtaggttaccgagctcaccgcctattccagggatcttgaaagggcgtgcgaagcacgagcactaacgctagggtgttggttcactttccttttcgtctgagcagttggttttattgcatttctccgttgtgtaaagggccctgtaaattattaggcaagcgggagcgtagcttgatctaatttagctctgcaccagattggtagaacgacgggtgctctaagtagttgtgtaactataactatccttgaatcggtttctttagtatggttgagagaagggttgacatgtaattttgtagagccttgtaaaattaaaattgttgatttctatcagggtgaaatttctgggcacaaaaaaaaaaaaaaaaaaaaaaaaaaaaaaaaaaaaaaaaaaaaaaaaaaaa

SEQ ID NO: 6501 - DNA, 862 bp, Zea mays
  Predicted polypeptide sequence is orthologous to G2982
caaaaaaaaatccggtcgatcctagctcgcgatgttctccggcaccggaccctccggcggggcagcccactctacgtccaccggtggtgggggtggctcgccttccgacaggggcggccccgcgccctcggcctcggcgtcggtctccacgccagccagcgagagcaccgtcgcccgccgcctaaacggacttgacccccacggcgacgacgctccatcgtcgcagccagccacgagcaagaagaaaaagagaggggcacgagcagttggtcctgacaaaaatggccgtggattgcgtcaatttagcatgagagtatgtgagaaagtcgaaagcaaagggagaacaacctacaatgaggtggcagacgaactggttgctgagttttcagatcccaatattaatattgactctccagatcctgataattcgtctgcgcaacaatatgatgagaaaaatatccgaagaagagtttatgatgcgctgaatgtcctaatggctatggaaattatatctaaagataaaaaggaaatacagtggagaggtctgcccaagacaagtatgaatgatattgaagaactgaagacagaggtcaatggactgaaaggtcggattgacaagaaaaatgcatatctgcaggatttacaagatcaatatgcatgtctgcaaaacttggttcggcgaaatgagcagctatatgggtcaggagatgcaccttccggtggagtggccttgccatttatactagttcagacacgtccctcatgcaactgtagaagtggagatatcagaagatatgcagcacgtgcattttgatttcaataccactccatttgagttgcaggatgattcatttgtactgaa

SEQ ID NO: 6502 - DNA, 887 bp, Zea mays
  Predicted polypeptide sequence is orthologous to G2989, G2990
gtcgtcccatgctaaaagcccagggttaggagctagaggtaatctctctcccgtctctccccagtgggcgtgggggcgccgcatggaagccatggacgtcaagtacaagcccgtcatgttccccaacggcgccggcctcaagaagccgaagccggcggcggccgtggcgctggccggggagccgctgtaccgggagtgcctcaagaaccacgccgcgagcctgggcgggcacgccgtcgacggttgcggcgagttcatgccctcgccgggggccaaccccgccgacccgacgtcgctcaagtgcgcggcgtgcgggtgccaccgcaacttccaccgccggacgctggagggttcccctccgccgcccgcgcccgcgccgctggcgctcccgcctccgccgagcgtgatgcacggccagccgcaccgcgcccgggaggagacgcccgaggaccgccacccgggggtcgtcgacgccgacgactccgattccgactcggaaggctcggagtacgacgaggagcggtcggtgtccccgccgccgccgccgcaccacctgctgccggcgccggtggcgcagcagcccccgccaccgtcctacttcccgacggcgccgcacatggtgctctcgctaggttccggcgtgcccgggcccgcggtggcggtatccccggcgcagaggctggccccgacccagctgacgccgtccagcgcgccgccccacgccgggggcgcgatgcccatgcccaggaagcggttccgcaccaagttcaccgccgagcagaagcagcggatgcaggagctgtcggagcggctcgggtggcggctgcagaagcgcgacgaggccatcgtcgacgagtggtgccgcgacatcggcgtcggcaagggcg

SEQ ID NO: 6503 - DNA, 824 bp, Zea mays
  Predicted polypeptide sequence is orthologous to G2989, G2990
gtagttttctccactcgtcctcgtcctttgtccctgtccttcggggacaaaaacaaccaaggcggcgcaagcggtaatcttccgtggtgggggcgtgctctgctgcaagcagtggtgacgccgcttggagggagggcgggcgggcgggaaaggatggaggcggtggtggacctcaagtacctgccggttttcccgaacggcggcgtggccgcggccaagaagaagacgaggctcggggccgctgcggttgccggcggccagacgggggtgtactacagggaatgcctcaagaaccacgcggcgagcctgggtggccacgcgctggacgggtgcggcgagttcatgccgtcgccggaggccgacccggcggacccgagttcgctcaggtgcgccgcgtgcggatgccaccgcaacttccaccgccggctacccgagctgtccccgccgccgcctctcctcgctttgccgccgcctccaccgccactggcgccggcgccggcgccggctgtcgcgtcgcatgccatgcgtgacagccgcacgatgcgcggcgaggaggcgccagacgaccgcctgccagccgccttcgacgacgacaccgaggagtcggacgagggctcagatttcgaagaggaccgtcccctaacgccgctgccggcgccgggcatggtgccgctgccgcccggctaccgccaggtcgcgccacacatgctcctcgcgctgagcaccagcgcgccgggcgcccaaactcccgcggcggggcccaggccgcccgcctccctggtcccgatgccggcgcccggtgctgctgctgctgctgcggcggc

SEQ ID NO: 6504 - DNA, 577 bp, Zea mays
  Predicted polypeptide sequence is orthologous to G2989, G2990
ttttttttttttttttttttgaatgatcacagtgacactgacacagcattaattagcatagccgtgataacaatgaatatctcatcataaacaatcaatcatcaacacatcgaagcaaaaggacccaaaggaattagcagcaaaaggagatgttaatcctcgatcgcagccaagggcgaggcaatgccgtgccgtgccattgccgccgcgcatgccacgtacgtaacgcggggcgcggctacagcctacatgcacatctcgctgcccctcacctcctcgtcgtcctcgacgtcggcgcccatcatcgccgtggacatgctcccgcctcctccaacaacgccgccgccgccgccgccacgcgtcgtggacgacgacgtcgtctgagcggctccggcagcgccagcgctggcgccctcgccctggctgccgccaccaccggacttgtggttgtgcatccataccttgaagacctgcctggtgaccccgatctcccggcagaagcggcccacctcgtcgtcccccagcgcgcggccgggctcccgcttgggcatccgccagccgagccgctccgccaacc

SEQ ID NO: 6505 - DNA, 856 bp, Zea mays
  Predicted polypeptide sequence is orthologous to G2989, G2990
gcaaagtcaggagggaaagaaagaaatccttttcctacacctaaagagaccaccaaaccctgcgagccaaaaaaaaaaaagccatggagtacaagagatcatcgcatgcgcaagaggaagaagaggacgaggaggaggaggaagaagaagacgacgagaacgaggaagaagaggaggatgaggaggaggccagaggccttcgctacaccacggcggcggtggcacccgtaggcgctccacagcagcagcaggtgcacgcccaagctcttggcctcggctgctcacacccctcccagctgatggattctgccgccttctcgaggccgctcttgcctcccaactcatctctggtgatgcagccaccgctgcctccaccaggcttcccgccggctcaccgccaacaaccgccgcatgcgcagctccatccgaggaaagcggagagggagagggacagagccgcgggagcgcagccccatgtccggcgccaccaccaagaaccagccaagaatggcgttctcggcggtggcgccgcgccaacgtcggcaccctctacgctcggcctcgtgcccgtggtggaagcggcccagctgtggaggtaccgggagtgcctgcggaaccacgcggcgcggcttggcgcgcacgtgctcgacggctgctgcgagttcatgccgtccgggggcgacggggccgccgcgctggcctgcgccgcctgcggctgccaccgcagcttccacagacgcgaggcggtccccggcggcggcgtggcggtatcgccctcggcggcggtaactcccacccccaccgccggcgccaactcctcccgcgccattccgctgctgctggcccccgcgcacat

SEQ ID NO: 6506 - DNA, 801 bp, Zea mays
  Predicted polypeptide sequence is orthologous to G2990
ctgcccagcgccccagttcctggctggccggctggctgtggcctgtggctgtgcctggtctcctcttcctcggtggtggcggtggcggtggacggtggtgctgctggtggtgttgcgctgcttgttcggttgttcctcactttcacttcctttttcctccacggctcccgtcacctaagcagcagctgcagcagcatatcccccgcacaccactcgcttcttcgccatcacccggtggctagctcttgcagcagctcatctcatctctacctctggctggcagtttatttctctcctccctatcagcataagctcagctcagctcagctcagcccagctccctgctgatctgcggcatttgacctgcctcccgtgcttgaagcttgatttgttcgtttctgtgcgcggtggtgcccgggcaataactccccttggtgcctggttggctcgttgccaccctccccgcggcagagcggcctataggatgagagggacgggggaggaacccaacaaaccggccgcgacactgtcctgaccgtggaagacacgcacacagagctccagctctgcactgcactggccgacggggaaacggtggagctcgcgcggtgttccattcatggattgggatctcaagatgccggtctcctgggacctgcccgacctggagcacgacgccatgccgccgccgccgcccgtctccgcgccttccaccgcggcggcgtcgggcattgccgccgcagctgccgcgcctttctccgcgacggcgccgagccgggcggagtgctccgtcgacctcaa

SEQ ID NO: 6507 - DNA, 548 bp, Zea mays
  Predicted polypeptide sequence is orthologous to G2992
gtcttggacggatggagtaaatcagtatgatgtacaagtcaatgatgatagtcatagtgagtccgcgatgagtttcccactgctgtgcatctagcccttagcacgatcgtaatgcatcatataagatgataaaatttttgtaaacaacaaggaaagaggtgaatgcactgagatttgcctaggataaaacactatgttaatgttgttagatgatactcgcttgatgaccatctcccctcctggcactcgatcagatcatccatcttaggttcatccaccagcatcactttgagatcaattcagttcttgtcctccacatcacgtgatcaactagtgtaccataactaaatcagactgcggaaacgacgacgatttcgattcaaccattacgtcgagcaccaggtgtgcgatgcgctggagcttattttcttcttctccacccaaccatcccatgagttgctcataatgacaacaaatctgtcagcaaggaggctcaaactcgatcagagaacaaggcgagtccagtaaccctggtgccgaattcctgc

SEQ ID NO: 6508 - DNA, 904 bp, Zea mays
  Predicted polypeptide sequence is orthologous to G2993
gtctctctctctttccttcagtgccttctgcctgtgttgagagtcccaagaagcactgagaattttgttgcatctacccttgagagtgaggggagctaggagctctctgggcgccattggccttttcttgctcgctctctcatcatggtttccattgtgccgctgcagagaacagaagcgtcagcagcaccagcaagaagcatcttctctctggagcggcgcctccgagaagaggacgacggatcgggaccaggaggcatggatctatctggcacgcagggcgagctcgcgatcccaatgcacgccaacgtcgcgtcgccctacggagccggcgtcggcggccatgtcctgcagctgcaccgtgaccacggcagcaacaacggccagtctccggcgccgccgctgccaccaccgcctgccgcggcggaggagacggagagctcggcgaagaagcgcggtccggcagccggggccggcggcggcgggggcagctccacggtgaagtaccgggagtgcctcaagaatcacgcggcggccatcggcgggaacgccaccgacgggtgtggcgagttcatgccaagcggcgaggagggctcgttggaggcgctcaagtgctccgcctgcggctgccaccgcaatttccaccgcaaggaggtggacgacgaggacgacgacatgtacggcgccgccgaaggcttcagcggcctcggtctcggcctcggcctcgggcacggccacggccaccgtgccgcctgccgcctcctggcccccgccatggcgcacccgcaccacaagagcggcggcggggggctcctgatctccggggccgacccctacgccgtctacgcgtcggcgcgcgcgctccctccggcgctgccgccgccgccagggcacgcccaccacc

SEQ ID NO: 6509 - DNA, 710 bp, Zea mays
  Predicted polypeptide sequence is orthologous to G2996
gagattaggtcacataatcatattaatccctcctaacttctgctgcatgatgagtcaacttcttaacaaccgggatgtcactgaaattacaagggaggaagaaggataaagaaaggagctaataagctaatgacatcgtctgatcctcccgcattactctgcgactactcggtactcactcatgcatatcatgctgctgctcctgctgcggcggcggcggcgggtggtggtgatggtggatgtggtgcggcggaggtggaggtgggtggtggttgtggtggcgatgctgctgcggcggcggcgggggctgggcctgggcctgggcctgggaggatgggggcgagggcgggaccttggcgaggtgcttgttgttgtgcatccacaccttgaggacgcgccgggagacgccgacctgggcgcaaaaaacgtccacggcgtcggcgtcgggcttgtggatgcgccagccgacgcggtgcgcgaactcgcgcatgcggtccttctgctccgccgtgaacttggtccggaaacgcttcttgctcggcgccgggggagcggaagccgaccccgctagggccaccacctgcgcgtgtggcggcggcggcggcggcgcggccgggtgcgcgggcgcgtggcctcgcagctcctcgctcgacgactcggtcagcgcggcgggcgcggacgccggggacgccgggacctgcggcgggcgc

SEQ ID NO: 6510 - DNA, 782 bp, Zea mays
  Predicted polypeptide sequence is orthologous to G2996
aaagccaaaccaacagtagacagatggcatttttatatggaacaacatgatatcctagacgaagacaaagcacaacggatccacccggtcattatccaagtacagttcaggaacaaattgctacactaacagtctactagtaccataagcgctaatcctgaatcattacatcatcagatcccaaaaccccacgattttttaagatccttctttgggctccaccattaacaaagaccagcagcagccttctcactagcgcttccatattcgatagtcccatgcatcccaccattgctcgctccattagggttggttaattagacacgaagctctacaaataaccatggctgattagcactaacttgactaggacgactgcggcgagccgccactcgccgtggaaggttggacacggaagtagtcggcagcgttgccgttgatgttggagtcagcgaggacaggcgtggccggggaggcggctggcgctggggcggaaaggtgcacagcggcggctggtgctggggcggcgtgggaggaagggcagacgggggcagcgtcgatgaacggatggtggatggccgtggcagcagacgctgaggcgctgcggcgcgcgctgtggccaccgacgaagttgtgcttgttgttgtgcatccaaaccttgaagacgcccttggtgacgccgatctcctggcagcactcgtcgaccacggcctcgtcgcgcttctgcagccgccaacccaaccgctccgacagagcctgcatcctctgcttctgttccgggc

SEQ ID NO: 6511 - DNA, 535 bp, Zea mays
  Predicted polypeptide sequence is orthologous to G2998
ttttttttttttttttcctttttttttttttttttttaaaccaaacgaaggcacaggtagtagattactaaacaataatcagttatttacatgtacaactaaattaaatgaatgtatgaatgaatgaatgaatcaactggccaatatgccaacgaattagtactgggagtctacaacaacaatgtgcaggctttttattgacgacagaaacgcaaagaattgctctactactgtactagctagtataggtagtctactctaaagtacaaagcccggcggcgatgggctggcctttcgatctttccggccgtgcacgggcagcagaactaactctacacaaaaagctggaggaggacgggcggcggggctttttgctgatgccgtgcttgggggccacgccgccgccgccgccgcccagggacagcgcgagggaaagcggcacggcgccggcgtctctctggtgcttcatgtacgtatgtcggtggtggggaatgagtgtctgagggggtgaaagcttgcgatcgtgctcaaaatg

SEQ ID NO: 6512 - DNA, 461 bp, Zea mays
  Predicted polypeptide sequence is orthologous to G2998
cgtgctgcggctgctgcctcctctacacgccgacgccgagaaggctatggcgtcgcggcaccgtcgtccgtactgccgcccgtagaggaggacgaggatcggcggcggcattggctcgccggtggccgccaccagtggctgctcaacaagaagccccgggggaaggcgccgccctccgcccccagcaaacgcaccaactgatctcaacacttcatcttgcatcatacattcatacacgatgttttccctctttttttctctctctctcttcttttatttccctttctctatacccttatggcctcatccaattcttggacgcctgcgcgtgtgtccggtagatggcacactgatgcctgtagtttatctattctattcattcttttgggtttgagcttgactaaggtctaaaaacatagaatgttggactgtgttcagcaaaaaaaaaaaaaaaaaaaaaa

SEQ ID NO: 6513 - DNA, 872 bp, Zea mays
  Predicted polypeptide sequence is orthologous to G2998, G2999
ctagctcgtagtctacactgcctctaaaccttgacatttcctttgtattcccctttccaatttgcagtagtttgtaggtagaccgcaaggtggttttttcttgcagcaatggcggccaaggtttgacaaggcatgacgtcctgattaagccccctcgcggcagccacaagatttgttgcagcgtgagacaggagctgcggctgcggaggaagtgagcaaaagcatggatctttccggcacgcagggcgagctgccgatggcaacaatgcacgccggcgggtcgccgtacctggggctgcaccacgggcacccacagcagcacaaccatggcgcgaacggccggcacatgtcgccgccggatgtggtggcggaggaggccaagaaccggcagctggcggtggtgcccgtgggcacaggaggcggaggcggggcaggggtgaggtaccgcgagtgcctgaagaaccacgcggctgccatcggcgggagcgcgacggacgggtgcggcgagttcatgcccgcgggcgaggaggggtcgctggacgcgctccggtgctcggcgtgcgggtgccaccgcaacttccaccgcaaggagccgccgggcggcgacgggcggcagctgtacgggcaccaccaccaccacccgctgagcccgctggccgcggtgcacccccaccatcaccgggggctgctggtggcggcgcttcccccggcgccgacgcgcatggtgatgccgctgagcgccgccatgcaccatcaccagcagccgccgcagcagcaccacagctcggcgtcagcggactccgacgacgcacacgtgccaggggtgcgcggggggggaggtgcagcagcagcagcaggcaccggcacggaag

SEQ ID NO: 6514 - DNA, 861 bp, Zea mays
  Predicted polypeptide sequence is orthologous to G2998, G2999
gccctcgactcgcctcgccgcagggggtcacggtcacgccgcctccctccgctgccggcctgctcagcctccctccgccggtcctttcccacggtccacacgcgatcaaaagcgcaaaagccaaccccgacgaaacgacgagacggatacgagtgatagactgatagctaacgctacccacagcagcaactataccagccagcggaccccgacgccgccccaagcccccagcaggctgcagcccctgcgacatagtgggggagcgggtcttcttgagcggcgtcgctctcacgtacggcgtcgggtactcgtcgcggcggcagggagctaggggcaggcatgcgctgatggaattcaggggccaggaggaggaggagcagcccgtctcggaggagatgggcgccagctccgcgccgtcgtccgcccccacccccgccccggggaaccaggaccacgccgccgaggcgaggtaccacgagtgcctgcggaaccacgcggcggcgctgggcggccacgtcgtcgacggctgcggggagttcatgcccggggacggcgacagtctcaagtgcgccgcatgcggctgccaccgcagcttccaccgcaaggacgacgcgcgccgccgccaccaccaactcatgctcccggcgaccgcgacgtcctctcgcgtcccgctgctcctgcctccgccccacccgcactacgcgccgccgccgttcccgtaccacggcacgcccagcggcggcggcggcggcaccgccaccgagtcgtccagcgaggagcgcggcccgccgtccggggccgccgccgtgcaggcgcagggccacgtccggcggaagcgggtccggaccaagttcacgccgg

SEQ ID NO: 6515 - DNA, 586 bp, Zea mays
  Predicted polypeptide sequence is orthologous to G3032
ttttttttttttttttgatggaatcaaacgtgcttagcgcaaacggtgatacccgtagagaatgaacctacacgcaaacacacacacaaaggaaacaaacatagcgctaagtaacgtagattaccattaaaattaattatcacgaagctacgtaaacctgtgaagatctcccgctatacacagatcatcagcagcgcgtcatgatgaactccaaaaacaacgacggcgacgacgcagagcgcggaaacacgctacacggaccggggacaaaggtgatgtgcgtacggagggagtgaaccagagggcggcgttgggcgctcacggatttgaagctgctggccatggcgaagttaaagccagacaaggagcagatggcgcagacccagttgtgagccggaggagctggagactggcagctcggcggaggtggactcacggccatggatggagcagcggcacggtccgtcgtcgaggtgagcggaggttggtggctggggctggggcgcgatggccagaacgacggtgaagagctcggctattgaggaagcgatcgcgaaggagataagctctgggaggtgctgggtcg

SEQ ID NO: 6516 - DNA, 805 bp, Zea mays
  Predicted polypeptide sequence is orthologous to G3032
cagctcttctctgtttcctggacgtgcgcagggagctgagctccttctcccatggcgcctccacacttccagccgccctcctctgcccagcagccgagcgcccagctcctcccctcggcagccatggcgtcctccccttcctcccgccctctgctgtccacggcgagctacagcagggagccgagctccaagctcccacggcgctcgagctccactcctccctgttcgtcttcaacccaagtcggcgccctctcgctggctgtcctctccgtcgcgcccctactggccgtgcccctcacgctggcacacaggcgcccaggcaagcttccccatggcgctcgactccctgttccatggtgccctgtggtcgcccccttcttccccttgtggctgcgctcctctgctccctccatggcgccccctgctccttcctcgacgcgctgtaggtgctcgacaaatgcgcagctccatttctcccatggccgtggcctgcttttcccggcgccctgcgcagcatctccctcccccaagtccctgcgcgcgcacagcagcagctcgccccaccttccctcgctgcgcagcccctcggcgaaacgccgctgttcctgcagccccgacaccttccctggcttcctcactgctagcgctgcgcgcgtgccacgtgttcggcgatctgtccaagtggggtgttgagcagtgagcagcaagccgtcaacgcccgccgtgtgctcgctgttttgcgcagcccatccgcgacgccgtcgaaaaaaccgtgctagccgtcaatcgccattcgtcgcgcacg

SEQ ID NO: 6517 - DNA, 985 bp, Zea mays
  misc_feature (7)..(15): n is a, c, g, or t
  misc_feature (36)..(41): n is a, c, g, or t
  misc_feature (181)..(209): n is a, c, g, or t
  misc_feature (276)..(307): n is a, c, g, or t
  misc_feature (340)..(344): n is a, c, g, or t
  misc_feature (404)..(437): n is a, c, g, or t
  misc_feature (451)..(455): n is a, c, g, or t
  misc_feature (934)..(959): n is a, c, g, or t
  Predicted polypeptide sequence is orthologous to G3055
tggagannnnnnnnnggcagtggtggcggctcgcannnnnncagggcattcaagggccgtcactgcaagaagttctacactgaagagggctgcccctatggtgacacatgcaccttcctgcatgatgagcagtctaaggcacgggagagcgtggccatcagtctctcgcccaccgttggtnnnnnnnnnnnnnnnnnnnnnnnnnnnnncggagtgatggtgcagaagccgtccaactggaagacaaggatctgtaacaagtgggagatgactggnnnnnnnnnnnnnnnnnnnnnnnnnnnnnnnnctcatggttctaccgaacttcacaagtacggannnnncctcgtggacatcgacggcagggacatcttgtccactcctgattcgaagcaagccggtgnnnnnnnnnnnnnnnnnnnnnnnnnnnnnnnnnngtccacttcgttgnnnnntcatgcagacgtgtaccatctcggcatccagtcgcagcgctcggccatcgccagccagaggtctggacagctgcaaaggcccatccagaaatggaagggccctgacaagatcagcaggatctatggagactggatagatgagaacgaatagaagaaggatcttctacggtgggccgaagggaagctgttacttggtatccgtccgactccacatcagctggtggaagctttacctggcttagaagatctcgttagcgctgcaaaaccagagtcaagatcatctttgcaagacctgtattggggagataaactgctggaacatagtgccgctttcttccgttgaactcagtagcattgctatgcttgtgtaatttgtgtgttggatggaggagcataatagcatatagcgagtcatggtgcaccctgtacagggtggctgagctgcatcctgaaggctggttgttcaggtgcgtccgtgnnnnnnnnnnnnnnnnnnnnnnnnnnctattattattgggccggatatttct

SEQ ID NO: 6518 - DNA, 1246 bp, Zea mays
  Predicted polypeptide sequence is orthologous to G3060
gcacgaggcaaagcctcccccccacacctctctcctccatccgccgcccccgcgggaccgaaaccctagctagggttctgcccgccgccgccgccgccgccttcgatcctgacgcggccaggcttcccgcaacaccgccatggacacggggcgcaagcggaccgcaccggagggcgccaacggcgcgggcggccccaagcgcgcgagagaatcggagacaactggtgtaggaagcaaatccaagccgtgcaccaaatttttcagcactgcgggttgcccctttggtgcaagttgccattttctccataacttcccgggtggctaccaggctgtttcaaagatgaccaacttgggtggaccacctgttccggctccaccaggaagaatgcctatgggacctggtggtcctgatgggccaccttcacctgctgtgaagactcgcatgtgtaacaagtacaacactgccgaaggatgtaaatgggggagcaagtgccactttgctcatggagagagggagcttggaaagcccctgcagatggacaacccgatgggacctcctccaatggggccagggcccaacgggcacttcatgccaccgccaatgcctttcccagacatggttcctccctccacattcggtgcttccgccacagccaagatcagcgtcgatgcatcccttgctggtgccatcattgggaagggtggtaccaacacaaagcatatatcccgagtgactggggccaagttagccatccgggacaacgaggctgatcccaaccataaaaacatcgagctcgagggaacatttgaccagatcaagcacgctagcgcaatggtcacagagttgattgtccgcatcagtggtaagccgcctccacaagccaagaacaacccaggtagggggcctggttctcatgccgggggtcctggaagcaacttcaaaaccaaattgtgcgagaacttcaacaaaggctcctgcacctttggagacaggtgccacttcgcccatggcgaaggtgagctgcgcaaacctgctgctgcttgacaggcatgcttattgtggcctgtggtgattaatctgcctgtatggctgaataacaccatgaccaaggacagtggcgccagcgccatggtgaagtgtgctgagccacatgctgcctgagagagagcatttccctgtggctcgtatttgatcttaatgctgtaacaaactctcctcgatggagattaagcaatggacgtttat

SEQ ID NO: 6519 - DNA, 734 bp, Zea mays
  Predicted polypeptide sequence is orthologous to G3060
cgtcgctctcttctccaactcgaagatgtcggccgccaccgccctgcttcatcgaggcccaagacccaatctccgtttttgataaagaaaccaaacagcaacctagcagtcttccttcacttctctgctcccgacctcgtagcgaatcagatcggggggctagggttccggtgcgcctctacagccggacgcgaggctaggctgggcatggagggaatcgtcacggcctgaaagaggtcctggccggagacgacgaacggggctgcagccgccgggaagcgctacaaagtttggacgcctctctggccggtggcataatcgacaagggtggggtcaacactaagcagagttacaagcgtcaagctatccatccgcgaccacgagtctaaccacaacctaaagaacatcgagctggaaggcaattttgaccagatcaagcaagccagcgacttgttgcgtgatctcatcgcaaccatcagcgcaagcatgccagcgaaaaatccatcttctgctgtggcgccagcaggaggaggccgaggcagtggtccggggggcacgagcagcaactacaagacgaagctgtgcgagaacttcttgaagctatgcgagaacttccaacacgactatgtatgagatattatctcttattatgactggatgagatgtgtcttatggctatagatgagacttttgtggtgtaattgatgagactatagatttaaatattgttatgt

SEQ ID NO: 6520 - DNA, 375 bp, Zea mays
  Predicted polypeptide sequence is orthologous to G3067
tttttttttttttttttgagaagaaggttggttggttaatttaccagcactaacaatgagacggggtttaattaagcagtactagtaggctagggtttgcagatgaccacgaagcacgggagcagcgccctcgggttcagcaggtacagctcctcgatgttggagtaggggccgaccttgccggcgagcgagtcgaagcccatcgtctgccccgcgaactccttgaggttgtccagcggcttgggcacgcggccggcgatcaccctgcacaccagcagcgccctgcgcgtggtgccactgacactgccagcgccagccccgtcggcgcccggcagcctcgatggactcgaaagcgcggccgctggtggacgtggt

SEQ ID NO: 6521 - DNA, 862 bp, Zea mays
  Predicted polypeptide sequence is orthologous to G3067
tggtggacgtggtgaacacgcccacgccgcccttgccctccttcctggcggagaagccgtgccggatgatgcggcacacggcgcacttgtcggaggcgcagaggctggaagagccggagccgccgccgagcgcgcacgagagcgtggcgccgtggaagcgcagcagctcgttgccgtcggcgaggcagcgcgggtgcttcttggctagcttgctcgccttgagcttcacggcctcgcggtactcctcgaagcgggacagcgtccgctgcgtgttgtgcaccttgaacacgcgctcgatccggacgcagctgctctccgacttgagcaggctcgtccggcagatgatctccacgatcttccgcgacgagtccccttccaccagctccgtcactgcgtgtttggagaggtggtgcgcctccagcgcctcccacttgctgaactgctcgccgcacttgtggcagctgagcccaccggagcccttgctggcgccgtttttagcggtttcgtcgcatgacgcgcggtggccgttcaccactgagccattcctctcgagcatcacgttcggcgacctcggcggcgtgcagcgcacgctgccccgcacggagccgctgtacggcagtccgtgtccggcccacgctgggcccggcgtgccagggcggagcgtgccgacgaacgacgacacgacgccgccgtcgcccccgccgtcggcgtcgttcgcggcgccggtccccaccccgacggccgccagccccccgcagccgccgaagccggtgatcttgagctcgcagcgggagttggtgctgagcacgacctcgtgtgcaatggggttgaggaactcgctgctgccgatggaccgcgggct

SEQ ID NO: 6522 - DNA, 880 bp, Zea mays
  Predicted polypeptide sequence is orthologous to G3067
tggtggacgtggtgaacacgcccacgccggtcttgccctccttcctgccggagaagccgtgccggatgatgcggcacacggcgcacttgtcggaggcgcagaggcgggacgaaccgccgccgccgccgccgccgccgccgagcgcgcacgagagcgtggtgccgtggaagcgcagcagctcgttgccgtcggcgaggcagcgcgggtgcttcttgggcagcttgctcgccctcagcttcacggcctcgcggtactcctcgaagcgggacagcgtccgctgcgtgttgtgcaccttgaacacccgctcgatccggacgcagctgctctccgactttagcaggctcgtccggcagatgatctccacgatcttccgcgacgagtccccttccaccagctccgtcacagcactgaagatggagcactgaagatgaaaaagctgaccaacgatactgacgttgccacaacgacggagcggtagaggcgagacaacacatgagtatttgggtccgaatgggtcgtgtatttggccggactgggtggtagtttataagctctctctagtattgtaagaaggtatcgaacaattaatgaacagacaaagacactagttctcagcctcgccttcctccctgctttcctcgtttccaagtcttcttccccaatcctcactccttcctgctctcttctagaagcttcccactaccgacgctaacatttggtatcagactaggactcgatggaggccacgatgcagagtattctggacgcactagcgcgcacggaggcacgcttgaccgatgcgctggctggtcgctgcggcgagcagtccgcacgcgagcgcgcttcctccttcgacgggatcgtgcctcagtaccgcgac

SEQ ID NO: 6523 - DNA, 1147 bp, Zea mays
  misc_feature (4)..(28): n is a, c, g, or t
  misc_feature (38)..(65): n is a, c, g, or t
  misc_feature (151)..(155): n is a, c, g, or t
  misc_feature (232)..(236): n is a, c, g, or t
  misc_feature (759)..(765): n is a, c, g, or t
  Predicted polypeptide sequence is orthologous to G3074
ccannnnnnnnnnnnnnnnnnnnnnnnnaatcccgggnnnnnnnnnnnnnnnnnnnnnnnnnnnnagagtagactacgacagcgtccgtcgaaccggagggtcggaggcggaggaagaagctcggcacccgattccccgcggctcgaatcnnnnngataatgcaagcagatgaggatgttggaaagattgcactagcagttcctgttttagtttcgaggtctcttgaattgnnnnnacaagatttaattgaccgtacttatgaaattactcttcaaagtggagcaaagacactgaattccttccacctgaagcaatgtgtgaagaggtacagttcttttgatttcctaactgaagttgtcagcaaggtaccagatcttggtggtgctgattcatgtggagatgaaagagtgttacctagaagaagaaagtcaaatggcagtgacccagaaaatgatgaatcaagatctagtaaaatggccataagaaatgcaaacatcagccccagaggacgtgggaggggtcgaggcagaggacgaggtcggccaccaaccaagagaaaggaggttggttatgtacaatttgaagatgagagcagcatgtttgctgaacaaggtgagcccttgccaggagaggaaacagttcaagagatcaatggcaacgagaccatgcctcaaagcacgcaacctccagtagaggctccgccaacagcccttgcacaagctacaacaagttctaaggcggaagaagcgaacaccgannnnnnntcagattggcctatgccagatgccattggaagcatcggtgtcgtgccatctggttttggacatctgacagtgcaggttgaagatgaggactacgacaatgaggattagtcagggtcatcttctcattgtatgcactaacaggactgttctggtgttgtaaaatgtaaatatagtttgaaatagttgccgcagtttacctgtgattgtctgtcgttttatgcggttatgtagtcctgtgtaactttcgttctccaataattgcttggtagttgccttttcacatgattgaagcgttttgtcatatttaacccagtatgtttgagcaggggtcgactatttctaagtattttgactttattcaactagtatttgagcagtcctg

SEQ ID NO: 6524 - DNA, 769 bp, Zea mays
  misc_feature (641)..(641): n is a, c, g, or t
  misc_feature (657)..(657): n is a, c, g, or t
  misc_feature (660)..(660): n is a, c, g, or t
  misc_feature (708)..(708): n is a, c, g, or t
  misc_feature (711)..(711): n is a, c, g, or t
  misc_feature (750)..(750): n is a, c, g, or t
  Predicted polypeptide sequence is orthologous to G3074
ggggaggaggtgttctattacacaaaagaggcaaaaaacaaaagccggtaacggaaaccctaatccccccaaatcccgaatccctctcgaatttctatttaatgttcctgttcttcccctccgatccgatgtccccaactgcgctcccgtcggcgatcaaacaccggatcgcggcactcgccgccgttgaggaggaggtttccggcgctgcttccagcgccttgccgtcagcaccatgaggaagaagctggacacgcgtttccccgctcctcggattaaaaagatcatgcaaacagatgaagacgtcggcaagattgctcaagctgtacctgttctagtgtccaaagcattggagctatttctgcaagatttatgtgataggacatatgatattacaattcggaagggggtcaagactgtgggttcttcccatttgaaacaatgcatacaaacgtacaacgtctatgacttcttgagggaagtagtcagcaaagttccagacattggtccttctgatgttattgctgatgataagcttggcaaaaggaggaaagccgaagaagatggaagtgaggaagaattgaagaggacaagaaatgagacagaaagctatacaagcaatggcagaggccgtgggagangtcgtgggagaagtcnccntggtgtacgtggagcttggcgggaggtggtcacaagtcctgagcaatncanggaggagaatcaatctagcaaggtagccagcctaaaggnggaggtagcaaatgaggtc

SEQ ID NO: 6525 - DNA, 779 bp, Zea mays
  Predicted polypeptide sequence is orthologous to G3075
tctaaataaatcctttcacgaaacatttgaatccactcttatctatggactaatacaggtctcggggtaataaatcataaattggacagaaaccacagggtacggtgcatcagctgttctgcaatctagtctagcataatcggttacgagttgttgctcgtcattgccttcaaagcatcttcggctgcaactctctgcggtacaaaatctgaaaggaactttaaagtcttctggctggaaacagctgttgaaagattatcgtaaataatggatttcttacgatccttcgcggcattgtgataagcatcctctgcaaacttccccaagaagaactctgaagccttattgatgaggaagacagcctcactggaagggcggatggtggggtcctcggcccgcatcagctgccgcacccgcgccatggagaagctgcacacacccatgtttgccgcagccgccttctggtccttcagcttcttcttcacgggcgtagatgcgcgcgccgccccatccgcgggcgctctcttggggctcttggcctcctttgcttgctcgtcgtcgccgcgcttcctcttggtgggagtgggcttctcgcgcttggcttgcttcttcttcgtgggcgaggtcgcgccgccgcgggcttccgcgctttgccggctggctgctgctgctgcttcttcggcgcggctttctccgctttgccgggtgactgctgcttcttcttcggcgtgggcttctccgctttgccgggtgactgctgcttcttcttcggcgtgggc

SEQ ID NO: 6526 - DNA, 2490 bp, Zea mays
  Predicted polypeptide sequence is orthologous to G309
ttcggcacgagccgctgctactactagttgccttcctcgcttccccgtctcgccccagccgcttcccccctcccctaccctttccttccccactcgcacttcccaaccctggatccaaatcccaagctatcccagaaccgaaaccgaggcgcgcaagccattattagctggctagctaggcctgtagctccgaaatcatgaagcgcgagtaccaagacgccggcgggagtggcggcgacatgggctcctccaaggacaagatgatggcggcggcggcgggagcaggggaacaggaggaggaggacgtggatgagctgctggccgcgctcgggtacaaggtgcgttcgtcggatatggcggacgtcgcgcagaagctggagcagctcgagatggccatggggatgggcggcgtgggcggcgccggcgctaccgctgatgacgggttcgtgtcgcacctcgccacggacaccgtgcactacaatccctccgacctgtcgtcctgggtcgagagcatgctgtccgagctcaacgcgccctcagcgccgctcccgaccgcgacgccggccccaaggctcgcgtccacatcgtccaccgtcacaagtggcgccgccgccggtgctggctacttcgatctcccgccccgccgtggactcgtccagcagtacctacgctctgaagccgatcccctccgccggtggcggcgccgtcggccgacccgtccacggactcggcgcgggagcccaagcggatgaggactggcggcggcagcacgtcgtcctcctcttcctcgtcgtcatccatggatggcggtcgcactaggagctccgtggtcgaagctgcgccgccggcgacgcaagcatccgcggcggccaacgggcccgcggtgccagtggtggtggtggacacgcaggaggccgggatccggctcgtgcacgcgctgctggcgtgcgcggaggccgtgcagcaggagaacttctctgcggcggaggcgctggtcaagcagatccccatgctggcctcgtcgcagggcggtgccatgcgcaaggtcgccgcctacttcggcgaggcgcttgcccgccgcgtgtatcgcttccgcccgccaccggacagctccctcctcgacgccgccttcgccgacctcttgcacgcgcacttctacgagtcctgcccctacctgaagttcgcccacttcaccgcgaaccaggccatcctcgaggccttcgccggctgccgccgcgtccacgtcgtcgacttcggcatcaagcaggggatgcagtggccggctcttctccaggccctcgccctccgccctggcggccccccgtcgttccggctcaccggcgtcgggccgccgcagcccgacgagaccgacgccttgcagcaggtgggctggaaacttgcccagttcgcgcacactatccgcgtggacttccagtaccgtggcctcgtcgcggccacgctcgccgacctggagccgttcatgctgcaaccggagggcgatgacacggatgacgagcccgaggtgatcgccgtgaactccgtgttcgagctgcaccggcttcttgcgcagcccggtgccctcgagaaggtcctgggcacggtgcgcgcggtgcggccgaggatcgtgaccgtggtcgagcaggaggccaaccacaactccggcacgttcctcgaccgcttcaccgagtcgctgcactactactccaccatgttcgattctctcgagggcgccggcgccggctccggccagtccaccgacgcctccccggccgcggccggcggcacggaccaggtcatgtcggaggtgtacctcggccggcagatctgcaacgtggtggcgtgcgagggcgcggagcgcacggagcgccacgagacgttgggccagtggcgcagccgcttcggcggctccgggttcgcgcccgtgcacctgggctccaatgcctacaagcaggcgagcacgctgctggcgctcttcgccggcggcgacgggtacaggttggaggagaaggacgggtgcctgaccctggggtggcatacgcgcccgctcatcgccacctcggcgtggcgcgtcgccgccgccgccgctccgtgatcagggaggggtggttggggcttctggacgccgatcaaggcacacgtacgtcccctggcatggcgcaccctccctcgagctcgccggcacgggtgaagctagacgtcattgagcgctgaatcgcagttagcgaccgggccaaggttctcgccggcgtgatgagatggaacactttgactcccgcggccggatcggcctgtgttcgttcttgtttccgatctcccttctctttcccgttgcttcgatcccgtcaagtatggtagaccgtagcctattgttatgtttaaatgtcaattattatgtgtaattcctccaagcgccgatatccaataaggacgaaccggattttcgttagctcgacctcgaatgagaattttgtatacaatgcatcctcgtgc

SEQ ID NO: 6527 - DNA, 1484 bp, Zea mays
  Predicted polypeptide sequence is orthologous to G309
ccctctcaccccttttctctaccacatctaccaatgataccatgtacaaccttaacccagcgttgtatgcatccctcgtgccaccaataaggaaacctgcaaccccgaccacactagaggtagggaggcaatgcaaggaggacgaggatgcatccattcgtccggtgcacctgcttatcacttgcaccagtgccattgagactggtgactactcgatcgcacaaggaaacttgtctgaggcacgcaagattcttggggaaatcccaacttcgaccgggattggccgtgttgggaaacacttcatcgacgcactagttcaacgcctcttcccggcatatccgcacgcagcaccaccttctccatctccttctacatcgatcgatctgcacaacaatttttatgatgcaggtccctacctaaagttcgcctactccactgccaaccaagcaatcctcaaagcaatcaaaggatacaaccatgtacacataattgacttttccctgatgcaaggtctccagtggccggcactcatggatgtcttctccgcccgtgagggtgggccaccaaagctccgaatcacaggcattggcccgaacccaataggtggccgtgacgagctccatgaagtgggaattcgcctcgccaagtatgcacactcggtgggtatcgacttcactttccagggagtctgtgtcgatcaacttgataggttgtgcgactggatgcttctcaaaccaatcaaaggagaggcagttgccataaactccatcctacaactccatcgcctcctcgttgacccagatgcaaacccagtggtgcccgcaccaatagatatcctcctcaaattggtcatcaagataaaccccatgatcttcacggtggttgagcatgaggcagatcacaacagaccaccactactagagaggttcactaatgccctcttccactatgcgaccatgtttgactctttggaggccatgcatcgttgtaccagtggtagagacatcaccgactcactcacagaggtgtaccttcgaggtgagatttttgacattgtctgcggcgagggcagtgcacgcaccgaacgtcatgagttgtttggtcactggagggagaggctcacccatgctgggctaactcaagtgtggttcgaccccgatgaggttgacacgctaaaagaccagttgatccatgtgacatccttatctggctctgggttcaacatcctagtgtgtgatggcagccttgcactagcgtggcataatcgcccgttatatgtggcaacagcttggtgtgtgacaggaggaaatgctgccagttccatgggtggcaacatctggaagggtacaaatgatagtagaagaaaggaaaaccgtaatggacccatggagtagcaaaaagaataaccatgtcatgagcaaatcgatcaactaataaaatgcactgatgacatgcatggtgatctaaaaaaaaaaaaaaaaaaa

SEQ ID NO: 6528 - DNA, 915 bp, Zea mays
  Predicted polypeptide sequence is orthologous to G309
ccgtgccagcccagtgtcaggcacccctcggcctcctccacgcagtgtccttccccggagaagagcccaaccagcatcctcgcctgccgcagcgcgttggcccccagcggcacggcggccagccccgtgcgacccagcctgtcacgccaccgccacagcggctcgtgccgctccctgcgccccgcgccctcgccgcacacgatgtcgcagatctcgcgctccaggtaggcctccgccgccgcgtcgcccgcgccgccgctcgccgcgtccagggagtcgaacaccgccgagtagtagaagagcgcctccgtgaaccggtccaggaaccccggcttgttgtggtccgcctcctgctccaccaccgtgaacaccctggggcgcacggacgcgacgcactccagcacggcgtcgatgggcgcccgggcgtcgcccgacgagggagcgtcggcgaggaggcggtgcagctggagcacggagttcacggccacggcctcgccctgcgagacctgcagcatccagggccgcacctcgtcgaggcggttggcggccacgccgcggaaggagaagtggacgcgcacggagcgcgccaggtcggcgaggcggaccccgacgtcgcggaggtcgtcgcgccctggcggggacggcggcccaatgcccgtgaggcggagcgacggcggcccgccggggcggagcgcgagggcctggatcagcgctggccactggaggccctgcatgatgctgaagtcgatgatgtgcacgtgcttgcagccctggacggcctccaggatgggctggttgggcgtgaagtgcgcgaacttgaggtagggacccgcctcgtagaagcggtggtagaggaaagctcggtcggcgtcggcggcgtgccgggccgggggcgggagccaaagcgaaggcgaa

SEQ ID NO: 6529 - DNA, 640 bp, Zea mays
  Predicted polypeptide sequence is orthologous to G3111
caccagctagcccaacaagagaaagactgagagagagagagagagagagctccactgcaccctgcagcaccctgacctaaactggtccctctctgctgcctccgccccaccactcgtctcccaccgagcaatagcatgcggcacttgcaggccaccgtcgagcacctggccggggtggcggccacgcccccgccggcgtccgcggggggcggcgtgcacacggacacgttcctcatcctggccgccgtgctctgcttcctgctctgcgtcgtcggcctggccttcgtcgcgcggtgctcgcggctgtgcaacccctcgtcctactccgtggacgcgcggggccccgtcgacgacggcgacgacgaggcggcaatgccggcgccgcgcaagggggtcgacagggccgcgctggagaagctgccgaccgtgccgttcgcgttcgaggagggccaggacggggagcggccggagtgcgccatctgcctcgccgagttcgcgcccggggacgaggtccgcgtgctcccgccctgcgcccacgccttccacgcggcctgcgtcgacacctggctcctctgcacgtccacgtgcccctcctgccgcaccgccctcgtgctggcgcaggcgctggagccgccggcat

SEQ ID NO: 6530 - DNA, 818 bp, Zea mays
  Predicted polypeptide sequence is orthologous to G3111
cctcctcacacaggcacacacgcactttctgtcagcttcctcccctgcgccgataagcaagcccgtgagccaacagtggtgccagcggcccgagcggcgaggatgcacagcggagcgaggaagctcatgtgggggaccagcccggacaggcccgacgaccacgacgtggtcatcgtgctcgcctcgctgctgtgcgcgctcatcaccgtcctcggcatcggcctcgtggcgcggtgcgcgtgcgcgcgcgggcccagcgcgcaggcggcggctgccgccaacaggggcgtcaagaagtcggtgctgcgcaggatccccaccgtgccctacgccgcctgcagccaaggggaaggggacgacgcggacgagtgcgccatctgcctggcggagttcgaggagggcgagcccacgcgcgtgctgccccagtgcggccacgccttccacgccgcctgcgtcgacaggtggctgcgcgcccactcgtcctgcccctcctgccgccgcatcctctccctccagctgccgcccggcgagcggtgccgccgctgcggcgcgcggcccctggacgacggggacgctgggtggaagcccacctactacagcgccatgccgccgttcctggcgtaagcggcggaggaatcgcccgatccggaagcaaaggaaagcaaagcaaagcaaaccttcgggttaagttcctcggctgcagattttcgtactgcctgtatgtggttggtagtgcgtagcaatctgggaatgaggaaaattaaggggatcaattaggttgtttgttgcagctgaaaacactgcactggagcgtgcgt

SEQ ID NO: 6531 - DNA, 559 bp, Zea mays
  Predicted polypeptide sequence is orthologous to G326
ttttttttttttttttttttttttacaacaagcagtaccgtgcaatctctggagttgactgcccaacaattggccctgatcgctatagcttccacgcaaaacttgggccgcgtgcgtagcgattcctgccgcgccatacatacgtacgtagcaatccgtaccatctccaggtagcattgcctagctctccgttgctaacgcaggcgtgcagcagacacgcgggcttcacaggccatgcatatatatatggctgcctcatccgccgtacctggcggcgttgagtgcttcggtggacttgacgaaccgccctttcacccgcttcctcgtgtccgcccgcagcttcctcgactcgtaccggatgtgcttctcgtacctgcggttcttcttcttctccctgtaccgctgcatggcgctgtccctgttctgcgcaagcgtctcgctgtcgatcctcacggcggcaggcctctcggtctcggccgcgggggcggacaccgtctgatccccgaaggagatctccctggtgagcgctgctcctggacctggacctgaagcgggtacg

SEQ ID NO: 6532 - DNA, 1057 bp, Zea mays
  Predicted polypeptide sequence is orthologous to G326
gcacgagcttcaatttaggacggtcaaggcatcacgatgagaaatctgctcttgaagttggatacggttctaaccatggcggctttatgattaagagttacagtgacatgcttaaggacatttcttcggggacaacgaaagatctggaagatatttatgactcaagatactgctcaaccgccgaagatatcatgtcctctaatatctgtcagttgtcatcgaaaaatgtgagcaccgggagcaacaaacggaaggtgaggtcatgtgctgcgtcgacgatggatggaccaacgacctccgggaaccacaaccacgtacccgcttcagcttcaggtccaggagcagcgctcaccagggagatctccttcggggatcagacggtgtccgcccccgcggccgagaccgagaggcctgccgccgtgaggatcgacagcgagacgcttgcgcagaacagggacagcgccatgcagcggtacagggagaagaagaagaaccgcaggcacggatccatgagctgatcttgatgacccttacctacctagcttgcctgctgcgacttgtgcggtattaagaataggctgttacatgttgtgtcccatcatatcgttcgtgtccgcagtacgagaagcacatccggtacgagtcgaggaagctgcgggcggacacgaggaagcgggtgaaagggcggttcgtcaagtcgaccgaagcactcaacgccgccagatacaacggatgaggcagccatatatatatatatatatgcatggcctgcgggcggatgagtttgctgcgcgcctgcgttattacgtgcggtagttacctcacggagaggtaggtactgctacctggaggtgctacgtatgtatggcgcggccggaatcgctacgcacgcggcccaagtttaattttgcgttgaagctatagcgatcgtggccattgttgggcagtcaactccagagattgcacggtactgcttgtttgtaacagacgaccctccctttccccttttttctctgttgttgccgtcatccccaccagaacagaaagtatgtagctt

SEQ ID NO: 6533 - DNA, 655 bp, Zea mays
  misc_feature (567)..(567): n is a, c, g, or t
  Predicted polypeptide sequence is orthologous to G326
gctggtccggccccagcgattcggtttggtgcgcctcgtggtccacgtgcgcgggctttgtgctctctcttccctctgtgtgtgtgtcagttcgtcgggtaggttggtggcggcgtgagagatgaagagctgcggcgggggaggagcggacgggcagcagtgcccgtgcgactactgcggggaggcggcggcggctctgcactgccgcgcggacgccgcgcgcctctgcgtcgcgtgcgaccgccacgtgcacgccgccaacgcgctttcgcggaagcacgtgcgggcgccgctctgcgcagggtgcgccgcgcgcccggccgccgcgcgcgtctccctcggcgccgacccggcgttcctctgcgcggactgctgcgagggctgcgccgccgcttccgcggcgcgcgtgtcggttgagggcttctcggggtgcccctcggcggccgagctcgccgcgtcatgggggctcgacctccgccgcgcggccgtggccgtgggcgacgacggcgacggcggcgacgacgacgaccccttcctctcggtgctcgactactccgtgctgggggntgggggtggccgacacggacctgcgcgacctctacgtgccgtgcgacccaccgcgggtgcccgtccccgacgccggcgcgcgcccgct

SEQ ID NO: 6534 - DNA, 750 bp, Zea mays
  Predicted polypeptide sequence is orthologous to G326
accgggcaatctctggagttgactgcccaacaatggccacgatcgctatagcttcaacgcaaaattaaacttgggccgcgggcgtagcgattccggccgcgccatacatacgtagcacctccaggtagcagtacctacctctccgtgaggtaactaccgcacgtaataacgcaggcgcgcagcaaactcatccgcccgcaggccatgcatatatatatatatatatggctgcctcatccgttgtatctggcggcgttgagtgcttcggtcgacttgacaaaccgccctttcacccgcttcctcgtgtccgcccgcagcttcctcgactcgtaccggatgtgcttctcgtacctgcggttcttcttcttctccctgtaccgctgcatggcgctgtccctgttctgcgcaagcgtctcgctgtcgatcctcacggcggcaggcctctcggtctcggccgcgggggcggacaccgtctgatccccgaaggagatctccctggtgagcgctgctcctggacctgaagctgaagcgggtacgtggttgtggttcccggaggtcgttggtccatccatcgtcgacgcagcacatgacctcaccttccgtttgttgctcccggtgctcacatttttcgatgacaactgacagatattagaggacatgatatcttcggcggttgagcagtatcttgagtcaaaatatcttccagatctttcgttgtccccgaaaaaatgtccttaagcatgtcactgt

SEQ ID NO: 6535 - DNA, 891 bp, Zea mays
  misc_feature (1)..(1): n is a, c, g, or t
  misc_feature (6)..(6): n is a, c, g, or t
  misc_feature (687)..(690): n is a, c, g, or t
  misc_feature (694)..(694): n is a, c, g, or t
  misc_feature (710)..(710): n is a, c, g, or t
  misc_feature (712)..(717): n is a, c, g, or t
  misc_feature (722)..(723): n is a, c, g, or t
  misc_feature (741)..(741): n is a, c, g, or t
  misc_feature (745)..(748): n is a, c, g, or t
  misc_feature (771)..(771): n is a, c, g, or t
  misc_feature (775)..(775): n is a, c, g, or t
  Predicted polypeptide sequence is orthologous to G328
nccggnattaccgcgtcgaccccgcgtccgcaggttttaaaccggcttttggaattgtacacatggatcaatttgtgggagtggaaattagagcagatttctgtgctttttttttttccagcacatctgccagactagtatcatcagcaattgtccatcgcagcatagtaccagacaacatggcaacgacagacatgccaagctccggcatcctgctgacgcctgctggggccatcagcctgttctcgtcgggtcctccgctccagatgccgcttcacttggcctccatggacagggaggccagggtgctgaggtacagggagaagaagaagagcaggaagtttgagaagaccatacggtatgcaacgaggaagacgtacgcagaagcacggccgaggatcaagggacgcttcgcgaaaagatcgtctgatatggatgtcgaagtggatcagatgttctcagctgcggctctgtcgtctgatggtagctatggtaccgttccatggttctgaaggaactttagtgagacattatatgtatcatacagtataataattgtaacatgcgttgaccatatatagtggtaaggtcaagtacaagtagttctaggaaaccgatggtaatgagtgatattgtgtttgttttgaaagataaatgaacaaatatcttagcattaaaaaaaaaaannnnaaanaaaaaaaaaaaaaaanannnnnnggggnnaaaaaatataaaggcggnaaannnnaggggggggggccgtgcaaaggnatcntggtttgggcgggcgccttactaaaatacgactgccaaattcatccacctgggcgaatggaacaccctggggataacgaaataatgggggagacccccctttcccccttcgagagc

SEQ ID NO: 6536 - DNA, 887 bp, Zea mays
  Predicted polypeptide sequence is orthologous to G344
ctccgctagtccgctctcaagtaaaaagctcccgaaatcccctcacctactcctctccctctccctctggcagcgccgcctcgccggcggttgcctgcctgcaccttcgccccccgtctcgacctcgacgcggcctccgttcctccgcgagacgcagcatggatgtgcgccctgcgaatgcggccgacgactcgtctctcggagacctgttcccgcaccagcccgccggtttggagagtgacgagagcaacacagaatggctctctggttacgtagaggactgcttttcgagctccacgtcgtacacaaatcccgtctctgcaatggcaagcgagggtgtcggaaaaccaaagctacctccaccaccatcctccaacggcaggagaaagaaacggagcttggcctccgtcatgaccaacggcgactaccaacaattcgtcctcccgctgtacgtcgagccaccgctgatcctgatcgaccagaaacactggatggcagagagcgagctgatccaccccaagaaggacgacgacgaccgagaggtttgccagcaacaagggcaggagcaagagaagggcgtgccgcggctggtgaagatgtgcagcaactgtctgtcaagccaaacgccacggtggagggacgggccgtcggggcgccagatgatgtgcagcgcatgcggcatgaggctcaagccagagaccaggttgtcagccgagcagcagtgcggccaggaagaacccaccaggaaggagcaagagccagacaggaagaggaagaaggcggctcagaagacgtgctacgagagcagcgacgccccgtcgtcgtcggaccagcaagagaagcggtgcgcccactgcctgtccttccagaccccgcagtggagggcg

SEQ ID NO: 6537 - DNA, 420 bp, Zea mays
  Predicted polypeptide sequence is orthologous to G344
gaggcttagcccggaagcaaagagataatcaggccgaagataggaaaaaaaagatggcagctttacgcccggtttgcgcggtgaaaacgatgatcactcggctgcaggctgcgggatgcggcgccgtgtcaaaaaacgcctggggccgatgagcgcgcggttctgtgtagattactgtggtgtggtgtttgctgaggagttgatgtagccagcccgagttcaccaatgggggaccggggtttcttcgtgcagagtcaacatctgcctatggattacgataaggctggcactggcatggcatcatcgtgcgcacgctcgcagccaccacgctgtttttttttgaatatttcggtgccactgggcggttgaactgaatgcaccgttttgaagccaaaaaaaaaaaaaaaaaaaaaaaaaaaa

SEQ ID NO: 6538 - DNA, 610 bp, Zea mays
  misc_feature (15)..(39): n is a, c, g, or t
  Predicted polypeptide sequence is orthologous to G351
ttttttttttttttnnnnnnnnnnnnnnnnnnnnnnnnnttgatatcgatgaaacatcatacgcatcttcctttttacatgaatcgatggacatatgatctcagtcgcaggtagcgagagttaatgatggattcgaaatcctgcgcttcttgatcggcagcgggctctgcacctcctcctcctcttttacccatcgcctcatcccatcgctctccggcacaggcatcaggttgaggtcaaagttcctgacggtgacgcctgatgaccccgtccccgtacccgtagcggacgccgtcgccgacagggagacggacacggagctgccgtcccagtagtggcagcgcttgtgcccgccgagcgcctggcccgtggcgaaccccctccagcagatggtgcaccggtgcggcccacccgacgtcgtcgtcgtctcctcggagtggtctgccgcctgctgcgcggcggcgagagcagcagcgtactgctcccccgtgggcggcctgcggtggctggacttgtggccgccgagcgcctggtaggacgcgaaggccttcccgcacaccgcgcaccggaaccggagctcctcctcctcgcgcgccggcgccggcggcgg

SEQ ID NO: 6539 - DNA, 576 bp, Zea mays
  Predicted polypeptide sequence is orthologous to G351
tttttttttttttttaagcagtcacttcagtttactagaatcaattgataatcgatgaaacaatcatcacgcatcttcctttttacatgaactcgatggacatatgatctcagtcgcaggtagcgagagttaatgatggattcgaaatcctgcgcttcttgatcggcagcgggctctgcacctcctcctcctcttttacccatcgcctcatcccatcgctctccggcacaggcatcaggttgaggtcaaagttcctgacggtgacgcctgatgaccccgtccccgtacccgtagcggacgccgtcgccgacagggagacggacacggagctgccgtcccagtagtggcagcgcttgtgcccgccgagcgcctggcccgtggcgaaccccctccagcagatggtgcaccggtgcggcccacccgacgtcgtcgtcgtctcctcggagtggtctgccgcctgctgcgcggcggcgagagcagcagcgtactgctcccccgtgggcggcctgcggtggctggacttgtggccgccgagcgcctggtaggacgcgaaggccttcccgcacaccgcgcacc

SEQ ID NO: 6540 - DNA, 716 bp, Zea mays
  misc_feature (8)..(30): n is a, c, g, or t
  Predicted polypeptide sequence is orthologous to G351
tttttttnnnnnnnnnnnnnnnnnnnnnnnaatacggttaaaagaatgaagctacgaaaacactctacatgcctcagctcaccaaaaggaactctaaatcgttaaactaagttcggtggaaggaccggaggacagccgccgcttcttgaccggcaaggggctctgcacctcttcctcctctcgccaccttgcctttcttgcggccggcaccaaattcagatcgaagcccctcaagctggacgcggaccccgacgccgccgacgcggtgagcgacaccgagagcccgtcccagtaatggcacctcttgtgcccgccgagcgcctgccccgtggcgaagccccggtggcacaccgagcacctgtgcctcccctgcccggcgccgctgccgcccgccgacgaggtattcgtcgtcaccgacgacgacgacgacgccgcctgtacgagcgtcggcggcggcttccggtggctggccttgtgcccgcccagcgcctggtgcgacgcgaaggccttgccgcagacggagcaccggaagcggagctcgcactcttgcgtcgtcatcgtcgtcgtcctggcactggcagccgcagcgtgccctcctcctcctcccgcggctgcgagcgccatgaggcacagggagacgtagtcgtcgtgggtgatggccatctatcggtcacggcgcgcgagcgaggcttgttgaaaagctaatgctgctagct

SEQ ID NO: 6541 - DNA, 437 bp, Zea mays
  Predicted polypeptide sequence is orthologous to G351
ctttttttgataattcttattgtgtttatttacatgtattatttacacaccaatgaaagaattgatccttgcttctacctactcctatatcacatgtatgtagctaataaacaatgaatatgatgactgtatatacacacgatccgaactaatcaccactacgatctagatgaacaatccaagacacggagcacaagtgacgaacaaatgagctgctgatccacacgagcttaacactaactaggccgggatcatgaagcggggcttcttgaacgcgagcgggctgagcacctcgtcttcgtccacgcccgcgcaccgctccggcagcgcaggcaggttgaggtcgaaggcgacggcctgcggcggcggcggcgccgaggctggcacggaggtggcggcaccgaggctgctggtggccgccgaggctggcacggagg

SEQ ID NO: 6542 - DNA, 570 bp, Zea mays
  Predicted polypeptide sequence is orthologous to G363
acgcacccacgaaacaataagaataatccggtcaagcaagagaccgccgcgatctgaccagcgccagacatggaccgatcagtttaaaaaaagaaaagaaacagcctgacggattaaccagtctagtcgacggatcagttcgcagttcacagcctgagcgtcagatcgggctcctcccgggcgtgcacggcgacgccgccggccgagtccgccggcgcagcggcgtctggcctgaagctaccgggccagccgaagagcatctcctcgtcgtcggccacgaggaacggcatggggctcagcagcccccgcgcgggcctcctcagctcgtcggcgccggcgcgcgcgtcctcgtgctccgggagcgctgccgccgacgcgtgcgcctggatgccgatggggtacaggcaggagccgtacagcggcagcgacgccacgtcggcgtagtagccgtagccgtagccgtagtaggggcccgctgcgtcgagccgcagcgcgcgccgggccagcgtgcgctcccgccggtgcgcgttctggtgcccgcccagcgcctgcgagctgaagaacttgcgc

SEQ ID NO: 6543 - DNA, 696 bp, Zea mays
  Predicted polypeptide sequence is orthologous to G363
ttttttttttttttttcgaaaaagagagatatctcgagctcttgcacatccaactgctgtacaaaaattcttgcacgcacacgaaacaataggaagaatctggtcaagcaagagaccgccacggtctgatctgcatcagccatgggccgatcatcaatttaaagagaatgaaagcctgacggattaaccagtctagtcgacggatcagttcacacacacttcacagcctgagcgtcagatcgggctcctcccgggcatgcacggcgacgccgccagccgagttcaggacggcgctccccgccggcgcaggagcgacggcggtggctggtctgaagctcccgggccagccgaagctcatctccgcctcgtcggccacgaggaatggcatggggctcagcagcccccgcgcgggcctcagctcggcggcgtcctcgtgccgctgctgctgctccgggtgcgctgccatcgatgcgtgcgcctggatgccgatggggtacaggccggagccgtacagcggcagggacgccacgtcggcgtagtagccgtaggggcccgccgcgtcgagccgcagcgtgcgccgggccagcgtgcgctcccgccggtgcgcgttctggtgcccgcccagcgcctgcgagctgaagaacttgcgctggcagtagttgcacgtgaacacgcgcgacggctcgcgggcgaccg

SEQ ID NO: 6544 - DNA, 737 bp, Zea mays
  Predicted polypeptide sequence is orthologous to G363
ggagctcgcaatatgcttgtcatatcattttattacaatcatgtatttgtaagtagtacctgctttgaaggtctcaacgtataatcatgtatttgtaagtctgttcgcttgctttaatccataccgtcttctactacttctatagtgttttgtctctatgaattgcagtcgcagcagtctgaacagtccgaactgcatgagtaagactttacaacatgtgaatctttgttattggtaaagaagcaaatgtcttgaatatggtttgtcttgtgaaacaatctttaccaatgaaacaaaatgtatgatttcgaactggttatcacaaagatgcagagtaaactaataaacatttacttccatcctcctttcaacctgctacaagtaacataagagcagataaagtgcagccgttgcacatgcgcgcgcgcgggggagcatagtctatacttgttcaccgaacagaaattatgaaaaggattacacgactcagaacagaaaatgctaacatatgatgacctacttattacaatttaatttacaagcgcagggttaggtcaagatttttctccatttgcttcttggactcatctgaacttgctgtgaagctccctggccatactaaccctccaggttcttcaactgcaaaaggcatccatccactcatttggcctccgtcgaatcttgctacggcaaccgcagctctttcaccatgacccttcagaatcgtggagtgcgag

SEQ ID NO: 6545 - DNA, 831 bp, Zea mays
  misc_feature (621)..(621): n is a, c, g, or t
  Predicted polypeptide sequence is orthologous to G385
tggatactgaacaagtctgaacaggtgcagcagcagcagcagcacaaattacatgctaaataacggttttgtacaccacaagagaagaagcctaaattcagaggaagcagcatccgagaggccaacatgaagaggaagtcaatacccgaaccaactacccttgcgtcgtggtgactcgtttccttcggcgactgaagtgtttcttgaaataaccccagaaattttgggggaaactaggcgaaaaagtaaagggaactatgagcaccacatggcaagcaggagagtctgaggtgcgttcttgacttcccactgacgaaagctctaaaattttgctgctccttcaatgcaaaggataagaacactgttggattcaacgaagctactgctgctggggattgctctggccggagatcaccgccgccttgatgcgctccacggtgcaggcgatgaggctgttcaccgtggccaccgaccccagcgagatcttggcggtggggacagagtcgacgagtatctggaaggccaccgtcaggagcgacccacctgagccgacgccgccgtcgccttgcagcatgctgctgctccctgacgatgggccgtcgggcaggatcgcgaaccagnagggcaggagcgccacgtagtcaggggtcgccgccgttgaggaccacgttcatggcgaccacatccaccgggggcgtagatgacgtacgagcccgacatgtcggtgcagctctcctggaggatcagcatgctgctttgggttcgagttcgtgctattgacacgaagaagcgagacgcaktttccatggtcgcggccgttggcgatgtgag

SEQ ID NO: 6546 - DNA, 3092 bp, Zea mays
  Predicted polypeptide sequence is orthologous to G385
tccatatctcagtcacacactcacgcgcgcgcgggggccgggggccgctggacccgccgttctccttctcctccccccctcgttcctctcgtctcaccattactccctacacgcgccgcggctaggattccgccgaggagacgctgcgcgcgtggatctccggtgctgtcctgctagcgtgcgacgaggccaggcaggcgcgcggccggcgccatgagcttcgggagctattcgacggcgggtccggcggcggcggaggaggaggagggatgcagttcccgttcacgaccgggttctcgtcctcgccggccctctccctcggtctggacaacgccggcggcggcatggtcggccggatgctccccgtgggcggcgcccccgcggacggcgggatggcgagggacgccgccgacgccgagaacgacagccgctccgggagcgaccacctggacgccatgtccgccggcgccggcgccgaggacgaggacgacgccgagccgggcaacccgcgcaagcgcaagaagcgctaccaccgccacacgccgcagcagatccaggagctcgaagcgctgttcaaggagtgccctcacccggacgagaagcagcgcggcgagctcagcaagaggctcggcctcgacccgcgccaggtcaagttctggttccagaaccgccgcacgcggatgaagacgcaactggagcggcacgagaacgcgcttctcaagcaagagaacgacaagctgcgggccgagaacatggcgatccgggaggcgatgcgcagcccgatgtgcggcagctgcgggagccccgccatgctcggggaggtgtccctggaggagcagcacctgtgcatcgagaatgcgcggctcaaggacgagctcaaccgcgtctacgccctcgccaccaagttcctcggcaagcccatgcccgtcctctcggggcccatgctgcagccgaacctgtcgctgcccatgccgagctcgtcgctggagctggcagtaggcggcctccgtggcctagggtctatcccttccttggacgagtttgctggcggtgtgtctagcccgttgggcacggtgatcacgcctgcacgggcgaccggatctgctccgccgcctatggtgggcgtcgacaggtccatgctgctggagcttgcgatcagcgccatggatgaactagttaagctggcacaggttgacgagcccttgtggcttcccagcctcagtggctctcccgacaagaagctgctcaactttgaggagtatgcccactcgttctctccgtccgtcggcgccgtgaagcctgtgggctatgtatccgaggcctctagggagtctggcctcgtcatcattgacaacagccttgctcttgtagagacccttatggacgtgagacggtggtctgatatgttctcgtgcatgattgctaaggccacagtcctagaggaggtgacatctggcattgcaggaagtaggaatggtgcgctgctgctgatgaaggctgagctacaggtgctctcacctctagtgcccatcagggaggtcacatttctcaggttttgcaagcagctggctgagggtgcatgggcagtagtggatgtgtccattgacggattggtgagagatcacaactctggaacagcatccaacgccggaaatatacggtgcaggaggttgccttctggctgtgtgatgcaggacactcccaatggctactgcaaggtcacatgggtagagtatacggaatacgacgaggcgtcagtacaccagctctatagaccactcatccggtccgggctggcctttggggccaggcggtggcttgcaatgctgcagcgccagtgcgaatgcctggccatactcatgtcccctgatacagtttcagctaatgactcgtcagtcataacacaggagggcaagcgaagcatgctgaagctggcacggcggatgacggagaacttctgcgccggggtcagcgcgtcatctgcacgtgaatggagtaagctggacggcgctgcaggcagcatcggggaggatgtgcgggtcatggcacggaaaagcgtggacgagcctggggagccgccgggcgtggtcctaagcgcacgcacatcggtgtgggtgcccgtggctccggagaagctcttcaacttcctccgtgacgagcagctgcgtgcggagtgggacatcctcagcaacggaggcccgatgcaggagatggccaacatcgccaaggggcaggagcacgggaactcggtgtccctcctcagagccagtgccatgagtgccaaccagagcagcatgctgatcctccaggagacttgcactgatgcatcaggctcgatggtcgtgtatgctccagtggacatcccggcgatgcagctcgtcatgaacggcggggactccacctacgttgctctgctgccgtctgggttcgccatcctgcctgatggcccaagcagtgtcggcgccgagcacaagacaggcggctcgctgctcaccgtcgccttccagatcctcgtcaacagccagccgaccgccaaactcaccgtggagtcagtagagaccgtgaacaacctcatattctgcaccatcaagaagatcaagacagcgctgcagtgtgacgcttgactgtcgcgtgtcgccgcagggggggtggtcggtgatgacgagcctgagtcaagaacgaacctcgtgcgggaaagaaacctttgctaggtgataaggatccagcttggacgggtctttagcacggagcaatggtggtggttcgggtattgactcggtctctgtcatctgcttcttctccatggcaacctgttgtctgatacgggatcttgaatagtgcgtggacaatgatgtggttagatggttaaaatcttttgtttcagtcccatcgtttcatcagggaatcaaactttgagttttggccgcctcgttgttagttgtaatatacagttcattttatattgtgaggtaagctatatgccatgtgtaaacatgagagctcaggaatgttgggtagcatcatgagtgtagctaggcatcgaactatcggccaataaaatgtctgatcgataaaaaaaaaaaaaaaaaaaa

SEQ ID NO: 6547 - DNA, 3580 bp, Zea mays
  Predicted polypeptide sequence is orthologous to G385
ggcacgagctctcctctcttctttttagtagctcgctcgccaggccgccaagccacatgcagcatgtggcggagcgcaagtaggtagctgctgcgtcttcctggcctgagggtttcggattcatcagctgggcgccggggtcgccatcgccgccgttgggacggcggcggcggagtttggcgtcgagttcttcagagggttaggtgcacgcgtctctcgcgttcctccttcccaagtcgagttcctttctttccatacccgtccccatgacgttccttcttccatgattcccttccatatttgctccagccaggccatccgcgggctgcgtggctgcgctcctgctattttaatgcctgccttctctccctctcacgcctcataaaaaaaactaataattccttgggatctgaggggatccgcgtggggttggtaggatcgcgggcagagattttagccaggactggaggaaaaccagtccgctctctctccatgagcttcggcggcatgttcgatggcgccggctccggcgtcttctcctacgacgctaccggcggcggcacgggcatgcacaaccccggccgcctcgtcccggccccgcccctgccgaaacctggcggattcggcgccacgggcctctccctcgggctgcaaacgaacatggaaggggctcagctgggcgacttgggtcgtatgggcctgattggcggcggcgggagcgggagcggaggcgacggggactcgctgggccgcggccgtgaggacgagatcgacagccggtcaggcagcgacaacgtcgacggcgcctccggtgacgagatcgacccggacaacagtaaccctcgcaggaagaagaagcgataccaccgccacacaccgcagcaaatccaagaactcgaagctgtgttcaaggagtgcccccaccccgacgagaagcaaaggatggagctcagcaagcggctcaacctagagagccgccaggtcaagttctggttccagaaccgccgcacgcagatgaagacgcagatcgagcggcacgagaacgcgctgctgaggcaggagaacgacaagctgagggcggagaacatgacgatccgggaggcgatgcgcaaccccatctgcgccaactgtggcggcgccgccgtgctcggggaggtgtcgctggaggagcagcacctccgcatagagaacgcgcggctcaaggacgagctggaccgcgtctgcgccctcgccggcaagttcctcggccgcccaatctcctctggcagctccatgtcgtcgtccctgcaaggctgctccggcctcgagctcggcgtcggctccaacaacggctacgggctcggtcccctcggcgcgtcagcgctgcagcccctccccgacctactcggcgccggccttccgggccccgtgggctcggccgccatgcgcttgcccatgggcattggcgccctcgacgttgcgctgcacggggcggccgccgacggcatcgaccgcaccgtcctcctcgagctggcgctcgccgcgatggaggagctcatgaaagtggcgcagatggacgagccgctctggctccgcagccccgacggcagcggcttggaggcgctcaacctcgacgagtaccaccgagcgttcgccagggtgttcgggccgagccccgcgggctacgtcaccgaggctacccgcgaggccggcgtcgccataaccagcagcgtagacctcgtagacagcctcatggacgcggctcggtggtcggagatgttcccgtgcatcgtggcgagggcgagcacgacggacatcatctcgagcggcatgggcggcacgcgcagcgggtcaatccagctgatgcacgcggagctgcaggtgctgtcgccgctggtgccgatccgtgaggtggtgttccttcggttctgcaagcagcacgccaaggggctgtgggccgtggtcgacgtctcggtggacgccatcctccggcccgacggcggccaccaccacgcgcagaacggcggcggcgccgggtacatgggctgccgcctgctccccaccggctgcatcgtgcaagacatgaacaacggctactccaaggtcacgtgggttgtccacgcggagtacgacgaggcggtggtgcaccaactctaccgcccgctgctccagtccggccaggcccttggcgcgcgccgctggctcgcctcgctccagcgccagtgccagtacctcgccatcctctgctccaactctctccctgcccgcgaccacgccgcgatcacgccggtggggcggaggagcatgctgaagctggcgcagcggatgacggacaacttctgcgccggtgtgtgtgcgtcggcggcgcagaagtggcggcgcctggacgagtggcgcagcggcgagggaggagacgctgctgggaacggcggatcagcagccgcgggcgagggcgaggagaaggtgcggatgatggcgcggcacagcgtgggggcgcccggggatccccccggcgtggtgctcagcgccaccacgtcggtgcggctgcccgccacgtccccgcagcgcgtgttcgactacctccgcgacgagcagcgccgcggcgagtgggacatcctggccaacggtgaggcaatgcaggagatggaccacatcgccaagggccagcaccacggcaacgccgtctccctcctccgcccaaatgcaactagtggcaaccaaaacaacatgctcatcctgcaagagacctgcaccgacccatcaggctctctggtggtgtacgccccggtggacgtgcagtccatgcacgtcgtcatgaacggtggcgactccgcctacgtctctctcctcccctctgggttcgccatcctcccggacggccactgccagtcaccaaaccctgcccatcagggttcaccaagctgcggcggtagcggtagcagcagcagcacggggtctctagtgacggtggcattccagatcctggtgaacaacctgcccaccgcgaagctcaccgtggagtcggtggagaccgtcagcaacctgctctcctgcaccatccagaagatcaagtctgcgctccaggccagcatcgtcacgccctagctagcgggcatttgacatggattccggccgccggttctcagaaaaaaggacggagtagtcggatgccatgtcaaatgcttagctagaggacgacatgctgtaacggcgcagatgctaaacaaggctgtgctcgtacgtacgtcgatcgtttcatagcaggtcggggaactagtgcttgagaaggcagtgaaagaaaataagggtattaaaataaattatgtagtagtgtggagtatttattgcatagagcaatatatatatggggtgaggtacacagggattaagtcaagaacgaaccgttcgctaggctttgattgcttgagcaaacacgttttgctatcgctcaagcttgttatatgctcatgtggtggttcgggtattgacttaagtctctggcaaaagaaagtgaaacaccacctattagggcttctcctatatataaaatatatatgtagcagtttgttttcaaaaaaaaaaaaaaaaaaaaaaaaaaaaa

SEQ ID NO: 6548 - DNA, 3010 bp, Zea mays
  Predicted polypeptide sequence is orthologous to G385
gaattcggcacgagagctgatcgatggtagagagcaagagccagctagggtttgggagctgaggctaggaccgtacgtcgtacgtacgtgctgccattgttcatgacgccggcaaggcgcgtgccgccggcggcgatgatcggccggaatggcttcgcgtttgggtcctcgtccgcgctgtctttaagccaggctgacctcctagacagccatcagctgcagcaagcgttccagcagcagctcttcgatcagatcccgaccaccaccacagtggacgatagcagcgacaacctcatccatggccgctctgacacgctggtagatgagttcgagagcaagtcctgcagcgagaatcccgacggaacctctggtgacgatggcctggaggaagaccccaaccagcggccgaacaagaagaagcgataccaccgccacacccagcaccagatccaagagatggaggcgttcttcaaggagtgcccgcacccggacgacaagcagcggaaggagctgagccgggagctcggcctcgagccgctgcaggtcaagttttggttccagaacaagcgcacacagatgaagaaccagcacgagcggcacgagaacgcgcagctgcgcgcggagaacgacaagctgcgagccgagaacatgcggtacaaggaggcgctgggcacggcctcgtgccccagctgcggcggcccggctgccctcggcgagatgtccttcgacgagcaccacctccgcctcgagaacgctcgcctccgtgacgagatcgaccggatctcgggcatcgccgccaagcacgtgggaaagcccatggtctccttccccgtgctctccagcccgctcgccgccgccgccgccgctgccgcccggtccccactcgacctcgccggcgcctacggcgtccagtcagctgctgcgggcctcggcgccgaccacctgttcggcgccggtgccggcgatctgctgaggagcgtgtcagccgggcagctcgacgcggacaagcccatgatcgtggagctggccgtcgcggccatggacgagctcctccggatggcgcggcctgacgcgctgctgtggggtggcggcgcgtcggcaggggcgcagcagcagctggacgaggaggagtacgtccggacgttccccgctgggctcgggccgaggcagtacgggctccgtccggaggcttctcgggacagcgccgtcgtgatcatgacctgcgacagcctcatcgagatactcatggacgcgaaccgattcgcggcagtgttctcgagcatcgtgtcgagggcttccacgcacgaagtgctgtcaactggtgtggcagggagctacaatggtgcattacaagtgatgtcgatggagtttcaggtgccgtcgccgctggtgccgacgcgcgagagctacttcgtgaggtactgcaagaacaacccggacgggacatgggccgtcgtcgacgtctcgctcgacagcctccgccctagcccggtcatcaagtgccggcgcaggccgtcaggttgcctcatccaagagatgcccaatggctactcaaaggtgacctgggtggagcatgttgaggtcgacgacagatcagtgcacaacctctacaggcctttggtcaattcaggcctcgcgtttggcgcgaagaggtgggttggcacactggaccggcagtgcgagcggctcgccagcgccatggccagcaacatccccaacggcgaccttggcgtgatcacaagcatagaggggaggaagagcatgctgaagctggcggagaggatggtggcgagcttctgcggcggcgtgacggcgtctgcggcgcaccagtggacgacgctgtcgggaagcggcgcggaggacgtccgtgttatgaccaggaagagcgtggacgacccgggcaggccgccgggcatcgtcctcaatgctgccacctccttctggctgcccgtcccacccaagagggtcttcgacttcctccgcgatgagacctctcgcagcgagtgggacatcctctcgaacggtggtgctgtccaagaaatggctcacattgccaacggccgggaccatggcaactgtgtctccctcctccgtgtcaatagtgcaaactcgaaccagagcaacatgctgatcctccaggagagctgcaccgacgcctcgggctcgtacgtggtgtacgcgccggtggacgtggtggcgatgaacgtggtgctcaacggcggcgacccggactacgtggccctgctgccgtcgggcttcgccatcctccccgacggaccaccgccggccggtgcggctccgtcccacggagagggtttggacgctggcggcggcgggtcccttctgacggtggcgttccagatcttggtggactccgtccccaccggcaagctctccctcggctccgtagccaccgtgaacagcctcatcgcctgcaccgtcgagcgcatcaaggccgccgtctgcgcggaagccggcaacccgcagtagacatccatccatgcgatatcgaggagggagaaggggggcatgcagcaaggttttgtggaaatgttagtggggagtcaagaacgcacctcagactctccttgccgtgtggtgctcatactgaaaggaaaaagaaggcgtcaccactatgcaaggggggatggttcgggtattgacttcgccgtccaatcaaactactacagaaaggacgtacgggtgctgtggagaagatggatcgatgctgtttctagggtttacttcctcattgttcgtggtgctgccgtagttcaggctaaggtgcctgtgcctgctcgcagtcgtagctagagaacacagagatttgttgcctctgatctttcctttttggatttgcaaagatttgtagatcagtcatttcgtaaaccgatgcgccttggctaaaacgcgcccgttcgttgttgttcgatcgtagctgccttttgctattcataaaacgatgcaatttcaaccactgagtttcttctagaaaaaaaaaaaaaaaaaa

SEQ ID NO: 6549 - DNA, 639 bp, Zea mays
  Predicted polypeptide sequence is orthologous to G385
aacatataaacattattaaaccgacataaatccatgacaaacgcggggggaaaaacggtgaaaacgagaacgacgatggggtactgccccgctgataactgagtctaaacgtcattattttgtcgacaaatatcaaatggtagaagcattattgttcgacattgtgcccgactcttctgcctcgcccttctgcatcaagctggggtgacgatgtcggtcttgacggcagccttgatcttctccagtgcacgacagagcagcttgccaacgtcgtcgaaggcccctggggcagcgcggttgtcagacggggatgagccgggcaccagcgcctgacatgccacggtgagcagggacccagcagtggtgtcgtcgcagccgacgggtgtgctggaggaggagctcggggcgtggcgagccctgccgtggccgtccggaaggacggcgaaccccgacggcaacaggaagacggaggcgtggtcgccaccgttcatgaccgcgcgcatggaatcctcttcgaccggagcggagaccaccatggagcaggacgcgtccgtgcacgcctcctgcaggatcagcgtcttcttgcggtcggttccatcggtaacattggagtagaggacggaaacagcgttgccattg

SEQ ID NO: 6550 - DNA, 719 bp, Zea mays
  Predicted polypeptide sequence is orthologous to G385
gggtgaaattgcctcgttttatgaatagcaaaaggcagctaccatcgaacaacaacgaacgggcgcgttttaacccaggcgcatcggtttacgaaatgactgatctacaaatctttgcaaatcccaaaaggaaagatcagaggcaacaaatctctgtgttctctagctacgactgcgagcaggcacaggcaccttaacctgaactacggcagcaccacgaacaatgaggaagtaaaccctaaaaacagcatcgatccctcttctccacagcacccgtacgtcctttctgtagtagtttgattggacggcgaaatccataccccaaccctccccccttgcataggggggacgccttctttttcctttcagtatgagcaccccacggcaaggagagtctgaggggcgttcttgactccccactaacatttccacaaaaccttgctgcatgtcccccttctccctcctctatatcgcatggatggctactgcgggttgccggcttccccacagacggcggccttgatgcgctccacggtgcaggcgatgaggctgttcacggtggctaccgagccgaaggagagcttggcggtggggacggagtccaccaagatctggaacgccaccgtcaggagggacccgccgccgccagtgtccaagccctctccgtgggacggagccgcaccggccggcggtggtccgtcggggaggatggcgaaacc

SEQ ID NO: 6551 - DNA, 745 bp, Zea mays
  Predicted polypeptide sequence is orthologous to G385
cgtgtgctgcttgcagtagcgcaggaactggcactcacgtgtcggcaccagcggcgacggcatctggaactccgccgtcatcagctgcagcgcgccattgtagttgccggcgacgccggtggagagcacctcgagggtggcagcccgtgacacgatgcttgagaacagcgtcgaccactggttcacgtccatgagcatctcgatgaggctgacgtggttcatgatgaccacgacggcctcccgcgacgcttccgaccggagctccggcagcttgggaccaacgcccctggggaagaacccgcgggcgtactcttcctcgttgagagtctcggtggtagccccgtctacggcaagggcagggatccagagcggctcgccgagcagagccatccgcaccagctcctccatggcggcgacggcgagctcgacaaccaaccccttgtcaaagtcaaacccaccgccagcatgacggtggaggccaccgaacacgtctgttccgccgggcaggaggtggtggtgggaggaaagcgccgggccggagacgttgtttgacaggttgttggggggcagcagcagcaggctgccagcgggcttgccgacgtacttggcggcgatggtggagatgcggtcgacctcgtcgcggaggcgcgcgttctcgacgcggaggtggtgctcgtcgaaagacatctcgccgatgacggccgtgggccgcgggggcgccgcagctcgggcacgaggcgttggc

SEQ ID NO: 6552 - DNA, 765 bp, Zea mays
  Predicted polypeptide sequence is orthologous to G385
gctggataaatctgaacaactgcagcaacagcacaaattacatgctaaattacggtttttgtatcccacaagaaaagaaaaagaagcctaaattcagaggtagcagcatccgagaggccgacatgtagaggaagtcaatacccgaaccaacaacccttgcgtagtggtgactcattttcttgttgcgcgactgaaatatttctacccaaaaattttggggaaactaggcgaaaaaagaactcgaactatgagcaccacatggcaaggagagtctgaggtgcgttcttgacttcccactgatgaaagctctaaaacttgctgctccttcaatgatgcaaggataaaaagagtgtctgattcgactaagctagctactgctgggtaacactctcgccggaaaccgccgccttgatgcgctccacggtgcgggcgatgaggctgttcacggtcgccaccgaccccagcgagagcttggcggtggggacggagtcgaccaagatctggaacgccaccgtcaggagcgacccgcctgagccgacgccgccaccgccaccgccttgcatgttgctgctgcctgacgggccgtcgggcaggatggcgaaaccagagggcaggagcgccacgtagtcggggtcgccgccgttgaggaccacgttcatggccaccacgtccaccggcgcatagatgacgtacgagcccgaggcgtccgtgcagctctcttgcaggatcagcatgttgctttgggtcgagttggtgctctgattg

SEQ ID NO: 6553 - DNA, 837 bp, Zea mays
  Predicted polypeptide sequence is orthologous to G385
acgaacaacaacggtacacgttttagccaagcattggtgatgaaatgactggtcctagattctacaaatctttgcaatccaaaaaaaataaaataaaagaggtaaacaaatctctgttctctagctacgagcctacgagcaggcacaggcaccttttagcctgaacaacaacaacacgacgaacatgacgaagtaaaccctagaaaatatggaaagagatccagaagaaacagcatcttctctgcagcacgcatcctttctctagttgactcgacggagaagtcaatacccgaaccatccccccttgcatagtggtgacgccttctttttccctgcttgcatcagtatcagagcaccacatggcaaggagagtctgaggtgcgttcttgactccccactgataaatatctccgatccccaaaagctgcaccacccctcctctcgctctctctatcttatggatggctactactgtgggttgccttcagcgccgcagacggcagctttgatgcgctccacggtgcaggcgatgaggctgttcaccgtggctacagagcccagcgagagcttggcggtggggacggagtccaccaggatctggaacgccaccgtcaagagggacccgccggcggcctccaactcctccaagccgccgccggcagcaccctctcctccgtgatggggagccatgcccggcgccggcggtccgtcggggaggatggcgaagcctgacggcagcagggccacgtagtccgggtcgccgccgttgagcaccacgttcatggccaccacatccaccggcgcgtacaccacgtatgagcccgatgcgtccgtgca

SEQ ID NO: 6554 - DNA, 878 bp, Zea mays
  misc_feature (680)..(680): n is a, c, g, or t
  Predicted polypeptide sequence is orthologous to G385
taactccttcctccccatctccacattctcccatccgccgttcccctccgcttcctcctaccatggcgtcttcttcctccccgagatctcgccatgctagctctcccgccttctgctagccagctgcgagtacggagcgctcgttttcgggcttcctgcatgcgatatcaccgacgaaacgtgtctctggaagaaggcatcacaggccgggatcggagaatgaaagctgacgatatagagcaagatgagctagggttcgcgaggcactagctgggaccgtacgtaccgtgctgccattgttcatgactccggcaaggcgcatgccggcgatgatcggccggaataatggcgtcgcgttcgggtcctcgtcagcgctatctttaagccaggtgattattccggctgacttcctagacagccatcatctgcagcaagcgttcgagcagcaactctttgaacagatcccagccgccgcagtggatagcagcgacaacatcatccacggtcgctccgacgcgctggtggacgagtttgagagcaagtcgtgcagcgagaatcccgatggcaccgcctccggcgatgatggccagggggacgaggaccctaaccagcggccaaacaagaagaagcggtatcaccgccacacccagcaccagatcgaagagatggaggccttcttncaggagtgtccacacccggatgacaagcagcgaaaggagctgagccgggagctcggtctcgagccgctgcaggtcaagttctggttccagaacaagcgcacacagatgaagaaccagcacgagcggcaggagaacgcgcagctgcgcgcagagaacgaccagctgcgagctgagaaacatgcgtacaaggacgcgcta

SEQ ID NO: 6555 - DNA, 920 bp, Zea mays
  Predicted polypeptide sequence is orthologous to G385
cttagcttctgaaggtctccgccacctcctgctagctacccttctgagctttcaagctttgctgaacgcacgcgggcggacgcggtaaagcatcacatcttctttgagagctgcagggaagagatcgataagagttctattttttgcaaaggcacacagacatatatagttcttctgctagatctcaccgccagtcagctcgcagcgaaggttccctgggctaccttgtcgctggatctgttgctggtcgtgttgttacttgtcaggcaaggtataatatatctccgtacagctaggaataggattgggtagtaggggggtacgcatgtgccagtgaagaaatgggaaggagctagtgtggaggcagcaagaattagggttggagaggttccgcgagaggagaaatgatgatcccggcgaggcacatgccgccgacgatgatcgtccggaacggcggcgcggcgtacgggtcctcgtcggcactgtcgctcggccagccgaacttgatggacaaccagcagctccagttccagcaagcgttgcagcagcagcacctgctgctggaccagatcccggcgacgacggcggagagctgcgacaacacggggcgcggcggtggtggccgggggtccgacccactggccgacgagttcgagagcaagtccggcagcgagaacgtggacggcgtctccgtggacgaccaggacgaccccaaccagcggcccagcaagaagaagcgctaccaccgccacaccctgcatcagatccaggagatggaagctttcttcaaggaatgcccgcacccggacgactagcagcgtcaggagctgagtcgggagctgggtctggtacccctccaggtcaagttctggttccagaaacagcgcacgcaaatgaagaaacagcacgagcggcaggag

SEQ ID NO: 6556 - DNA, 1889 bp, Zea mays
  Predicted polypeptide sequence is orthologous to G4
gcacgagccgcctcccaactcccaagtcccacccccactccctcgctcaccagaggaactagcggccaggcaaagccgagccgcaaccgcgaagatcttgcgtggcctccttttcccagctcgtcactgtgccgctcgtgtccttcactcccggtccgcccaaccaataatccatcgatccatccaccaccaccaccccgctgcggcgatgtgcggcggcgccatcctctcgggtttcatcccgccgtccggggtggcggcggcggcggcggcggccaagaagcagcagcagcagcagcagcggtgccgtgtgactgcggacctgctatggccggggcccggcagtaagggagctccccaggacaaggaggaggacttcgaggccgacttccgcgagttcgagcgcggcctcggcgaggatgacgtggacagcgccggcgaaggcggcgaccccgaggtccaggagcttcctccgccggagccgacgaggtttgccttcgccaccgcggccaaggcagcagttgatggcgtgatgacgacgactccaaaggatgtgcaaggagatagagcagtaaaaaagcgcggccggaagaaccagtacaggggaatcaggcagcggccttggggcaaatgggcagctgagatcagggaccccaacaagggcgtccgcgtctggctcggaacctacaacaccgccgaggaggcagctagggcatacgacgccgaagctcgcaagatccgcggcaagaaagcgaaggtgaatttccccgatgacgacgcgacaggcactcgtcacaggccaacgaacgccgcgaacgcagcgaggctagtagctccacccccacccccgaaggcctgcgccgatgagatgtttaacaacctgaagaacgacgacggcgacaacaacaacaacgatgatctgtttgcgatgtttgcgttcggtgacaataagaagaaggttcctgcagcgaagccagccgccgacgaggttggcagtggcagtggcagcttcctcgtccctgcgcctgcggtggcggcggtgcccggtaacaagaggaggtcgtccgcgaccaacattatgctctccgtctccgacgaccagagcagcaactcctacggctccggctcctccgccgacttggtggggtcgtggtcgtgggacgacgacgacgccgccgccgccgccgccgccgccgccatgacctcggtcttcgctcccgataacgccgtgctgccggcggcgtcttactcttacatgcaaggcggagcgccgaagagaatgaggaggagctacggcggcgcgccgcccagcctcgcacatgacgcggccatgcctggctttggccttgataaagtgagctaccactaccaggcgttgcctccttattacgtcgggagcagcaacgcgtcggtgggcaacctcggtcttctgcagcaggctgatgatgctccagctccacaggatggggcgagcgccggggatatctggagcctcgacgagctgctcatgctggcagcagctggtgcttattgagaaccgcaagaaaaaaaaaatgtgttggcgctgctagctggagacgagacgagagggcgagaggcagttgcatccgccatccgctatcgttttgtctctcctatatctagtatatatatgcttctggcagtcgaactctatggcaatgcgtgtgtatagtgtgttgctgccgtctatgattggaagcgagctcgagactggttcaataattcacctttgcctaccgtcgtaccgccggcctgctggactgtagtgtgcgtactgcatatatatgccatagttatgtatgcactcctcctatatatactatatattattatgaaaaaaaaaaaaaaaaaaactcgagacctcgtgc

SEQ ID NO: 6557 - DNA, 2052 bp, Zea mays
  Predicted polypeptide sequence is orthologous to G4
gcacgaggccgcaattccgcatcacgcagaggcagagcgaccaacccagaaccccaccccaccgcccgcaaccgcaagctcagattccctccccaccccaccccaccccaccgtcccgctcactccagcccagcccgcgtccccacagcccagcgacagcgggcaccggcggcatccagccatgtgcggcggcgccatcctgtcggacatcatcccgccgccgccaccgcggcgggtcacggctggccacctctggcccgagagcaagaagccgaggagggctgcatccggcaggaggggagcccccgtggagcagcatgagcaggaggaggatttcgaggccgacttcgaggagttcgaggtggagtccggcgagtcggagctcgagtccgaggacgagcccaagcccttcgccgcccccaggagcgcgctcgccagaggtggactaaacactggtgcagctggtgtcgatggccctgctgcaaattcagttaaaaggaagaggaagaaccagttcaggggtatccgccggcgcccgtggggcaaatgggctgctgagatcagagatcctcgcaagggcgtgcgcgtctggctcggtactttcaactcccccgaagaagctgccagagcttacgacgccgaggcacgcaggatccgcggcaagaaggctaaagtcaacttcccggatgaggttcctacggcggtttctcagaagcgccgtgctgctgggcctgcctctctgaaagcgcctaagatggacgttgaggaggagaagccgatcatcaagctcgcagtgaacaatatgaccaactcaaacgcatatcactaccctgccgtcgtcggccacaacatcatacccgagccattcatgcagactcagaacatgccattcgctcctctggtgaattatgctgccctagtgaacctgtcttcagaccaaggcagcaactcgttcggttgctcggacttcagcctcgagaacgactccaggacccctgacataacttcggtgcctgcgcccgttgccaccttggccgccgttggcgagtctgtgttcgtccagaacaccgccggccatgctgtggcgtctcctgcgacggggaacactggtgttgatctcgccgagttggagccgtatatgaatttcctgatggacggtggttcagacgactcgatcagcactctcttgagctgtgatggatcccaggacgtggtcagcaacatggacctttggagcttcgaggacatgcccatgtctgctggtttctactgaggctgaggcccagcgactggtgcttgtgtacatagggggggacaaagggtaagagcctgcagtaacagagattggctctttctggtacttgcaatttctatcccttcaactctttcttccgcccccgtgtttcaggaataatgttctggagatgaagaaacgcttgcgtgggcgtgcctgcaggcacgcgtgtagtagctgcggtattagtatatatgcttagatgttcagtcacttcctttaagtacaatttggcgctggacatgtaccttattttactatgtatccgtgacaacagctatgtgtctgcgtccgcggggtctgggtactacgaccacacggcacttatgtatcacgcgatcccgctgtcccagcagctggagtacttcagggagtaccagacgaagctggcggcggtggccggcgccgggcaggcgcgctccatcctcagcggcgcgctgtacatcgtcagtgccggcgccagcgacttcgtgcagaactactacataaacccgctgctgttcaagacgcagacggccgaccagttctccgaccgcctcgtggccatcttcggccgcaccgtgcaggagctctacggcatgggggcgcgccgcgtcggcgtcacgtcgctgccgccgctgggctgcctgccggcgtccatcacgctgttcgggcacggcgccgccgggtgcgtgtccaggctcaacagcgacgcgcagagcttcaaccggaagatgaacggcaccgtggacgcgctggcgcggcggtacccggacctc

SEQ ID NO: 6558 - DNA, 828 bp, Zea mays
  Predicted polypeptide sequence is orthologous to G4
gcgggcacgccgtcaagcaccgatttgtttactgctctctccgacgcgcggcggcggagctccctacgacgactgaaccatgtgcggcggcgcgatccttgccaaccttcgcgagccggcgccgcgccggctcacagagcgggacatctggcagcagaagaagaagctcaagaggggcggcggcggcgggaggcgctcgttcgcggcggaggacgatgaggatttcgaggccgactttgagggcttcgaggccgactccagtgattcagatttggagctcagggagggtactgacgacgacgtcgtcgagatcaagcccttcgctgccaagagaactttctccagcgatggcttaagcgccatgactagtgctgtagcaaggtcagtcaagaggaagagaaagaatctatacaggggtatccgccagcggccttggggcaagtgggctgctgagatcagagatcctcagaagggtgttcgtgtttggcttggtactttcaatagtcccgaggaagctgcaagagcttatgatgctgaagcgcgcaggattcgtggcaagaaggccaaggttaactttcctgatgcaccagcagttggtcagaagcgccgttctggcttagcttctgctaaagcatccaagtcaagttttggacagaagcctatcgtcaaagtagctatgagcaaccttgccaacacaaatgaatccttcttccaatctgctagctacccctccaatttatttgttcagcatggcaatatgccatttgttccagcaatgaactctactgcttctgttgatgatcttatcatgaatctgcagtctgacca
